United States Patent 9,328,346 (POLYCOMB-ASSOCIATED NON-CODING RNAS) - sequence listing, part 83

SEQ ID NO: 15495 - RNA, 404027 nt, Homo sapiens
ugcccagcccagccugugauucuccacguuuauuaggaaaagcuugcacaauuaauaaucaaaaucacacugugaaacucauuaaaacacagauccaaaucaccacaaauuauugauuucuaugcgauguaaugcccagaaggaaccccuguccuguguaggaaccgucacuucucugcggcucagcagcuggcaaggggagguggcaguccccuucuguguguuuggcuggcugcugggacugggcgagggguuggaggcgggagccccacgcacagugggcucaggggcggagaggcagggcuccucuccagcuaggaagagcuggcagucuaacccagggaagugggcguuccccccacucaaccacgugcccuggggaaauggugagacugucccuccugcuggaagcugggggcucaggagcagucuccacagucuccugcccaugggucagcauuuccugagagugagggagccaggcccaggcccuccaaaugggcuccugggcuuuuauugccggcggcccuguagucagcgugggcugguccugcccugccugugccuggcaggguccuggauuugaggcugggguccagggguugcucugucuccccucaggaagcccccugggccaagcagggugggccugcacucagccugugcuacuuccuggccauacaugggccaggcccugugcccugccacugggucccaaccaccaugccagugaugucaacaucaccaugugggggccagggcgcuugggguaacaacucagaccugagacggggcccccacaccggccaggaagagguggccuugcugagcccccaagugcaggcugugccagacagcaugguccaugggguauuggggccucugagaguggggcucuucucucugggccuuuuaggagguggccuccuucagagagggccagguggggccacucuuggccuccccucucacucaggcccaucccccagccccauccccuccucaggaccccucaucggggccccuccugggcacggucagcugcucguaggugggcaggguguugcugggcaggaagagcucagggucgacggagccgccacugccgcagggcugggugaugugggccccgcccucucugggggggccgccgcugccgggggugcugccaccgugcaaggagagcagcuggugaagcaugucggugaugagugccagccucugguccagcugcgucaccugcggggacaaaggcagacgagagagucaguggugggaagcacccaggugugcagacagccucagggcccagguuuggggccagagaagggaaggugccaaccgucucugcaagugcaugcuguaugcaggcggcacgcacgugugcacccuaugucugcaaggcccucggucgcgccugugugugugcaaggaaugugcaugugugccgauuggaguccaucccgugcgugcugggagucccuauauguguccacaggcauucaggcucagggccaggagcucuccucuccuccuucucugcuccccaggcuggccggccuucugugccacauccccgcauggcagggucugcaccagggacccggaccugaaauauuuggguuugcggcagccuuuggcuucuugaggccaggcuuggggacauuuggguuaagggucaagaaaggcugggggcuaugucuacugugucuggaggagaacuggacagagggcagaguucagcaaggcuggcucaugggcagggccuggggugguugaggaggcagagggcuugggcuuugccugggugugcaggggaugccccugcugggccacuuccaggaggggcuugcagggcacagggcuugugccucugugaugcuuucugcaaggggguggggguggguuuuuuugucaucccccaggaaccauuaugccaugucuuuaaccuagcggggacaccacuauuuucccagacaccaucugcacccacauucuguggucagagcagugcccuagagcgugcccucuggcuagccauguggccuccaccuucucaggggcugguucugcagugagcuaugugccaggguggcugcccugcaaagcuggcagggaggucaaggcaggacagaacccgaaaugcacccagcacagagaguaggugaucagaggccucgcagugcugcggaggcagcagagaagccccaaacgaguggacagccaggugaucugagagcuccuuggaaggacagcaccgcuggggaaugaggcuggagcccgccccgggugggaaguggccauccagccuugauggggagacuggaaggcccuggccggcaggccggcacccuggcacccucagagcaggugcuggguggagcagggccaaccccaggggcagacuagggcaggugagggaguccagguuggggaccccucucccuaggagguuggaccugggggcccuagcaugagugaggguucggggagggcgcacagcucuguugguggccacaggagacagggcugguccuucagccugcgguguucuugcaggagagccccucagcgugcucuguggagaaugaaguagacccucccccaccguggguaccuggaggccuggaaagaccuagaaguggugggggaggggcaaacagaucagcacgcgauaagggcugaacagcagagcugcuucagggaaacguauggcuccagagagaggcacgaagaugacucagccacagcaacgucaaccacuggcccuaagcacaggcagcaggcgggagcuggcccgguccaccuggccgugcacuccaggggucugcacccuaggcugcgccgggcgggccuggucccucaugcgcccggccccacugcugauccagccggauaggcuuggggugaggugugggccagggcuggguucugugcgggugagacaaccccagggaagaugcugcugggugacgugggcacaagccccgggauggccagagagggagcaaccaguuugcuagggucuggguggacccgggccagcuucaaaggcugggugcuguggucgucacccacagcaccuaccacggaggcugagcaggcuaaggaagaggcggccaacagggugcugugagaggcugagaugagaggggggcgccugccugaguggggccgagcgucugucuagagggcuaggugggcagccuccaccugggagggugggacugugcccugcccagagcaggagcccaggggacccacuuccagcccuggguggugggggcugcaguguggaggcucccuggcuccccugugguucugccuugcagguauggggugagucugagacccaacuguccugaacacaagggcagguguacauccgaggucugacgguccaggccagagggagccccauguuuuauuuuucccagauaaaccugaugugaggcccagacuauggaggaaaggggugcaggacuucugugguuuggcaggggcaggggcccagggccauccaccggggucucucacacccaaggacccgccagcacuucagugcucugcaaagccacuuggggacgagccacagaggcccacacuccaucccacagaugcagacacugaggcccaggaaaagagggucagagucacuggcugaaagugccaugucucccauccuguccccacagcucccaccccaaggcuccaucucgagaccacggagcugccauauggggggacacagugugucagguagggagccggcgaaagcagagggcaggguggggcggggccucugggagggggaccggccugaggucucguucuuguucagccacacccugacccccguggcuccugcugccggcaggaccagcccucucagucccacgaccugcucaugccugguaggggucaugggaggucucucagccuucagggugcacaugaggaaacugaggcccagagaccuacgagagcguagcagaucaaaggugcagccagcgugggucuuugagggcaaagccugggcuuguguccuagggcucaccucagcucccugggccccgcauacugguaguguggaacgagguuugccccgcguggcuuacugucacuaacugugcaggccccagcuuggguaucaauugguuuggcauuaauuaaagcaccaaauacaucacagaugaacauuugugguuucauaaauuuucacauuauggcacucgaacaucuguccaagucccacaugugcuaauggguguggaggccuucacaggggauucuugggacagaaagagacagugggugucagggccgcaggcaggcagugcaggcugaggguguggcuggaaucagcgcucaguccugagccacuuuggugacagcuccucccggcagggagucccggcaccguguagagaggcacucagccaccuuuggggucgggaggcagccacagggccgagcuugccuccgacggacacugaagggcucccugaagcugccugggccagcgucagcccaugccuggcucuggcuggucccaggcucaccucaacugcugccugugccaacuggggcuuugagggacuggcuagggucucuggccccagagacaugcucucaucaucccagcugcuggugacagaggccccgggggugggccaggaugugggcuggaugcccagggcggguccacagucugaugcaucaugcugcugccccccuugugggaagggcccaggccugggcuacagguggcuccucggcagccccagagucuuagcucugacucaagcacuugucacagcacgugucccugaagagucccaccccaccacucugcgggcagggcgccuucaucucgcuggcacguuugguuuuuuuuggcgauggaggagccugagaagcaccucccauggccgaggccagaccccacccaugcggaggugcauccgggcaggugccaucggggagcugccgcccugggggaaggcagugcaugcucuaggcacuggggccgguuccccaagaacugcugggacagaucaauuuuggggaucucagccuccaccauuauuugcaauuugauagugauuaaaaggcaaggcagacaaaagcugcuuugugcccggccugcacucaccaaauuaauaaccauaagagaccuaugcagcccucggaagagaaaaaagcaauuagaauaacagcuaguuagagagccccgggcggccggcgaucaaacccaaggcaacggggauuccuguuugaugugguuaugaauuuguuuucaaaagaaaaucuugaaaaagagucuuucaagggaaauuuuugcagaaccugcccggccuugauccccgccuaggaccgccaaaggcccuggccucguggauggcagacuggccagggacaggcgggagaggccgggcacacccgcugcucccaggguggggguccuguucucugccugggcugcaguuccccaggaggcagaaaacucacugccccuucuagcauccuuguugggcagugucuaaagaccaggcagggccuccccagggcccucuguagggucgcagggcaaaggucaccuuggccuuccuccugucuguccugaggaaccagcaguuacuaagccacucucagggcgguaccuagaauguuucauaccaggcucugagcaaucggaugucagacccggcuccuguguggagcugggcacaaguggcaauaggucacagcacgugguaaggucgcgguucguggcagggcauggagcgauuguguuugacuuugcuuuagugcuucaguucuuggacaaaagucgaccguguuucucgcugcugagguuuuaccgccaggccuuggggcagcugcccugcuggagcuugcugugcuguggccagugggagauggccucagaaccccccacacugcugcagggccuugggcacaaagcaccuccucacgggagcgugcaggcaggcgugugugugccgcagcgggucuggggucagauccugccucugccgcuuccuggccgggugaccuugggcaagucacuuugcuucucugaaccucaguuucccugccuauaaaacagggcagcuguagcaccuuccccaggaggaugcugaggggaucaaguggacugaggcaugaagacaccagggacagagcauggugcucagugcacugcgagccacccgauggccaugaucauuagggauuccuagagugcacguacaguugcacauguaugccuguggccugaggccaaaggagcacugcugugcacacgggaggcaugcuaggugagcccacauauguguaccucguacgaaccuguggcuguaugagugugggagacugugcgugcaagaaggcaggaaccacccugcacccuuguacacacuuguacaauucccuucacuuuccauuagguuguucucugggcugcccaaggguuggagugcaccugccugcacccccaggccccugggccuuugugugugccacagaggugagcacccccugcaacccaucacaggaguugggggugcugcugggacaaagcugcguggagagcaagcagcaacucccauggcuugggugcuugggcagguaccaggcguccucuccuaauggggagacagauggcacugagucugggacccauggucacacacauaccagcugcucccccugucccccagagcccuucacccgggcaguguccaggcugugugugagucuuggcccagagagucgagcgucguggcagccccugugcucaggcucgggacuggcgccugugguggggcugaauuggcaggcacugagggugaguguguccgcucagaggcugcagaccaaauccucaaccuugucucugucccuggugucuguugucugccgagcagccagaggaagcucugccgcggcuggggacccacaccgcucauggucgguuauguccucagcggguccucggcacagcgcaaccaugcggcagaggccuggucagcuccaccccaacacccuuccuggggcugccgcugccuggcuggcccucacugaccaccccccaggagcgggguugccucccucugagagaggcccaagauggugaaagaaagacccuucccccugcugcugacauccacuuuuaccagccucugcccacugacggaugcuuggccccccaagggccucaggggcgccaugucccuggcugacgacugugggggaauaucucaagaucgucaccacacgacccucguucccuuccugggaccucggcuagcuaggauguccccgucagcuacuugcucucuccaggggcuccaaggccugcaggccaacagccccacagcucagcgugucccagcgggagcucagauuccucccaagccggcccgaauccuguauccacagggcacgaccaacuacccagggucccuggugugcaccuggugucuguggcucucuggucuggagcaugugcucugagccugccccccaugccccuugcccaggcuggcagcaucuucugccuggacugucacaaccaccucacugccuggcuaugcccccaaccuguuccccgcuuguuccaggcaacagccaggcugagccuucccucccagccugggccaaauccuucugcagaauucccacuggacugggaguaaaauccagucuccuuuugcagugcccccagaggcuccgcuggccccucuccggcacugagcaugcccguguugaucugagcgcccaucucaguugggcccuggggccuuugcacccgcuguccucugcugcuuuguaaccuuagcucaaaauccugggcggccuccucgucucaucucuccccauguuccuguaagccuucaccacucccugaaaugucccgguuuauugaucuccuugcuugguguuuugccaccagcuggaggcccagcucuaggccaggcagucaccaucuuaacccuagacagucucccagagccuggagccuggagccuagaaggugcccaguaaauacauggaggguagaguuggcgcugcacaaauguuuguugaauuaguaagugaggccccggccaauuucccggggccccaaggcuggagugaggggguagaagccccccaagcccacucccucccagggugggugcugagcagagaagcugaggcugggacugggccuuuucacguucauugauuuguaaggacucuauguuaagaaagaugucaaguacacaucacacauguuuuucccuagugugcuauuugucucguguauggguuuauggcauuuauuauuuuuuuguuuugccacacagaggucuuacuuauguuuucacuuuuucacguggucaaagccauccaucuuuuccuuuaugccuucucauccugugcgugcuuggaagggccuccuccauuccaacgccaaaaucuuuuuuccuaauacuuuuuugauuuguguuuuacccccuaaaucuuugaaucgccugggauugauuucugaccuacagacuuacuuuugcagguuauccugcugauaccccaccacuuauggaaugauggaccuuuuccccacuggauuagaauguccuuuuuguguaucaucgacccugaacaacccaaguuugagccgugugggugcacuucuacguggauuuucuuccuccucugucacccgagacaguaagagccaccccuccuccuccccagcugacucaacgugaagaugacgaggaugaagaccuuuacaaugaucugcuuaugcugaaugaauaucuuuucucuuccuuacuuuacuuuauuguaauacaugaagcauacaaaauguguuaauugauuguuuauguuauugguagggccuccagucaacaggaggcuauuagugaaguuucuggggagucaaaaguuauacauggguuuuugacugggcaguucgggggucggugccccaacccugcauuguucaagggucgacggcacaaaguuccugcacgucuuccuguacuuuggcgucuacgcagaacugcccuagagaccgcucuuguacaugcuuugauacugggagccagggcccugcugucuggaggugaaagacgacaggcucguucuggcauccagucggggaguggcgacgggagcuggaacccacaccucucccaggugaccucauaaccuccccucuugucugucucccuggucggagaggucgcgcucgucugcuaagaacccggagaaggccucuucuuuguacucugagcaaacaacaaaguccgcaccacggcugugggggcugagggaucccagccccugcugccuucccucccccagcuggcuccagccaccagagccucccuuccucuuccucucggcccgcacgccuuccuggauucucccucggcucagcccucaccucgucauagcccccagggggucuaugugugccgugucugcugacaugagccggugccacauggccccgugcuccuggacacgcagccaccucccucccugcaucuggguuggggcugacguuugugccagagccagagcugucacauccacagccucacagaccugcagaggcugcuccgugcggacauucaugucaacuucaggguggggacagaggucauggagggagucaguggcagagccaggggggcccacguggcacaacacucccuggguggcacuggagccccuuugcccucuucccuuggaaggggccugggcaggaggcccaggugcacccagaggccagggagcugccucacugccaggcaggugggaggggguggggaagccccaggcugggauggggucucgagccucccccaagggcuggccuaucccuagcccggccucaggagcuuccugccggcagacgccaggcaggggcggcucuguccaagagcccgaggcagcugcccaccugcccaccugcccaccugcccaccuagugcaaccccgggcagggcucgucccaucggccucuguuugggggccaggcgggcaggaacgucgggcaggcugggggcccaggagccguguuugugcuggcggugggcacaggccccaccugcauuugauucucugccgcugccuccugagcugcccccucuggcgagcccgcagaggcccggaggccaggggacaccaggcagaacacuuuguucgggcagccagcgagcgcucugcugccucagccaaaccccagcccggccacgggggcaggugggcaggggaagccagggcugccuggccguucucgugucauugcuccaggucugcccacaucggcccugcugcccccacauccuccccuacccugggcccucagccacuugcugggccaucuggaaccucugagcgcaccagccccuaggaccccagcaauaccccucgcuguccccggaaguccacaagcagaccuuagauacuuccucucgccucccuuccccagcccagcaggguggccccauaccacuggaagucagaccccugucagucauaggcucuaacccucaguggcuccggaucaaugccagaguccgcucacaacccuguggucuggcccagcccccaucccuggccucacucugcagccugcuucccggcgcgccggucccuggcccccagccccaagccugcuuccuucuuucugcaugccguuucacacuccuccaggugccugacgggcauguggauaguuuggcaccugucccccgacccugccaguggcugugagccacgugaggucagucuggcuuccuuccauccccaccucugucugccuggucccuacuggugguguuugcuucucagaaguagguccccuuccugaaacugcccuuggcgugcagcagguauacccuaaauauuccugaauuugggacgggacguuucugggcuggcuuccucagucugucccacguugccaccauuuuucucuaagacagaggccucuggggcccaugacccccucuccuuccugcagacagagaaagcaccggcaccugcugaucucccacaccacaauguccacuugcugggcgagaaccuuugaggcaucccugcuguucucgagauaccagccucggcugagggucccucgccgccggccccuguggcccccugggcgccgcccuucucgccccagagccgguuuccucugguuccuaccucaggacccucacaugggcuggcccugccuccuggagcauccaccccucuccuuagccuccagacccuucucauucuccaggccccaggugagggucuccuuggugaggcccccucccuucccccuccugguuuggcuguggccacuuccccugcuuuccaucccccaccucugucugcccgguuccugcugguggugugugcuucuuagaggccgccuccccgagggcagggcacugcacagccaacaacaguucaauggccucuugcucgcugggagacccugggccuuggucaccucucgagcagggaggggccggggagucuguucuguggcacagugcagccugggggcucaggcccgggcgugucugggaacggaggcugugagcgcggagcgggcucuccugggccccaggccacucccugggccugaagggaggggcucaggggaaggaugaggccccucguccccagcucccugggcaccacugagaggccucuggccaccuccgucccucaacauuggccacgcccacagccugcuguguucugucuccacccaggccucuccccgggcgcucuuggcugucccugcuggcucaagacgguguccucucucuggacacucgagaggcugcccagggugcucccaaacacgcacaccaugugagccucuuccuccgcccuacgugccccauccugcccauccccaggagagggcugccaugccccgugcccccagcccacgggcucucugcggcuggggugcuugucuuccugaacccuuucugugaacgccucacauguuugcuucaaaauuagucuguguacaggguuuuucaugguauaaguacccuaugaagacguucucccgccaaauaaagacauuucaaagacacaucuccauuucaccugccccauuucccucuagggccccugccugccagguaaccagcuuagggaucugauguuucuccuuccagcaacuuugauacgcagcucgugccugguucugccuggucagcgagguuuagcacgagugaggcgaggcgugaugugacacacauguggcucuccacugcuuguuuccaugcgacacacuuguggaggcugcacguagaaucacggggacagugcuggcuccugggacggcugugcagcccuccuuucuguggggauugcugacaucaccacccagucccugcuggugggcguggaggcugagggcuccacaggccaagucuuucugccuacaugugcugguguucggggggagggguccccucuucuggggagcuugguggcagcagccaggcugugcucucccaccuccuccccuuggagugcaguccggccucacccucuaccuccugggugaaaacuucuaccuccggccugaaacgucaccaugccuccccacagacagacggauggacagaugggccucccugcaccugcucugugggugugggggcuccugcucagcagcaguuuccagacccuucucccugcuuuccccaagccacccgccuugaaucuggggugcucuaccagacccauccccucauuucuaaagauuugagccacuagucgugucccucucccucagaaaugccuuggugacacuuggcugcuuucaacucuuccacccaucugccucuuggucucaucuuuaccuucugcuaaagguccugacccccacccccgccacgccacggggcaccccaugguggugcguccuugggagcagcucugucccuuuccccguggccuuugccccgccuccuaugacuucgauucccaccuguccccgaccccugggaccacugaccgggcccgaucacccugucacugcccugucaucugcuuaccccacacggugcucugcugacccaggucuugcugucucccaacagccccacgaggcuucccgucgcuccuggacacugcaggcugagcccgcugccccgccgccuccaugaggaaggcuuuuccucugugagccccaggccacccuuucccuccuuuaaguaauuacuuaagucccuugccagggcccucccaguacccuuucuaaagacaccccugccccagcaugcugcaggcuccugcuccacuuuccucucaggcccucgucgcuguggugcugccuuuguuuucugucucugccacggcagggggucagcuccuuggagguggggcuucugcccuugcuguaccacugccuggcacacaguaggugcucaauaaagacuugcagggugagcugccugaagaauagucaccagaggccagaaaugucuagagcucugccgguagggugacuggccgaggagccuggccugcaugugugcgugugugugugugugugugugugugugugugagucaggguuuauaugcaggugucuacaggagacaugcuggguucugugcugggugugaggaauaugggagcagaaccccagggagguggcagagacuugggggccaaagggcuggggugcaggggggcaacagccaggugccacuggccaccccagccgcagggagcccugcccacccuccaggugccuggauguccaaccucacugcuauucccaccucaagccaggccuggagauggaggccccaugacucagccagggccgguuugcagcugcggcugacccagacgggcgggcagcccccagcccccgggccugcacccaggacagggccgcccucccucccucccccgcuucuggcuccuaggacaggauucucugaauucagcuccccugaggcuggggccagguuggaggccaggccugggggcccugggcuggggucccagauaggggcugggcggccaggcuuggaaucuggaauccagccccauuccuggcaucugcaggagccucguggggagggagacuugggauggacuucaaccagccagggcuggauucuugccccggaaccugcauuccuggggcagccaagggauccuucccacuucugggcccagcuuggcccugccuggcauucgaggcccaucuggggcuugggggugucuccccaacucucagacauaaggacacccuuccaagcuuguuccuucaccuggcggggcccugagccccacaccccuccccuguccuuucuccauccgacaucaagcgccucccugccucugcucgcacagucucugagauggggaacucagcaccucacaggugggcccagcucuggugcugucuguguugggggagcuggggcagcccccaaaagaccuuggagacagacccucagaggcaggagcagaggcuggcaguggaugcugugccuggaggccuugagggcgaggugugaugaugaggcccaggcugcagggcucuuucuggcucuccagcuccggagaacaagggauuuccuccugcucugcccacccuccccagccagugcaugcucagccucagcaccgcaccugggcgcccuccaugaucugccccaccuggacacauggcucgaggggcacacuaccaugccauacaccaugucacgcaccuugccacuccacaugcuacacaacccagccccagccccagccaugccaugugccacaccaugugccacaccacucccaccaugccaccaccaugccaugcacacagccacgccaggcacagcaggcgcugagcccauccugcacgaaugcagcaguguguguguguaaggggaccuaagccucugcccauguccucccgggagccagccccuggcugcacuccuuguggcuaagugggguucugcugccccccagccccugcugacagccugggaagggggugaggaggugggggagcaggcugggagggcaggaaguugcuggggcuccagccccaucuggacauauuuggcaagccccgcuccccgccgcuccucagccugucggaacggccccuggcgcuggugcuggacacucuggccuucccccagcugccugucccaccuuccccacuguugucucggucccgucucggggcacuugccccaguuccugcugcugggcccaguggacugcacggucacagccaggugcaaacaugggaccugguguuugcucaccucucugaaccuccauuuugccucugcaagacaggggcugcaaauggagugaagcggggaagccugcccaccccaggaacccagccucuugccucccagugacacgguugcuggcggggcagcaguggggaugcucggggaccccugcccuugaggcuggcucccagguccacgugccuggggcugacuuggggccugacagcugcgcccaggugcccacccuaaggcugagacucccucacaucuaugcagucuucacagaggucccaaggggcucugggauccuaugaggggagaagcuuggagagggguggggcaugugggcagguggggggaggacucggcuccagggcacuggcccggcuuggcugcccugacucugccauuguguccagaaguccacaggccucccgucccucagggaagcaagaaggggcuauguccucugcccuggcgcgugggccccuugcgugcaggggcuuccacagggccucuaauugccucgacuccagaggcacacaggcaccccuacccagcauguucucccacacccacagccuccuagcugugggauaaccauggacgaugcugccaaccucuuauccccuggucuggugggcaguccuugggcaccagccugcccugagcagggaacagcagcugcauugcccacaucugucucccacugggaggaggcuaguguccaggucacucugggggagaggggagggaccaggucaaagugggagaguggagugaagcccccugagcugggcauggcuucugccccauggagcccuggccaggcccuguggaccacggcgguggcagccaccuuccccacacccuacaguugucaccuggggcagccccagccagaccauggucuccuccugccuuggggagcaucagccccagccuugccuuucaccccacagcugggccgcucagugaugccaucagcaaccuucuccacacaggcccuaccgggagcuacagagggaacaugcuccggggaggcgggcagaccugaggagggcuuccugcugcaacuguggucucccaggcagcagggugcuuggcgcuuugccugcacuggcucuccugacccugccaaggcccugggcaugggcggggacugcgucccaucucccugaucuugcaguaggggaaggugaguuguggagucgcagagcccgucugagcgagcagcuuguggguauccugguuccucuugcuccccaugacccugugcggucggagcucugacggccccacucccaggaggggacacaggcacccuguccuagucucccagcccggaagcccccacccugccaggucccgcacaggcaucugagccuucaagucccucaucuaguucagcccucugguaccuccauuugcagggccagguccaaggcuucucuaacgcugcccaucugccaagaugccgggcaacccccacugugccugaggggccaggccuucccucaggggugcugggaaaggguaggguggggaccgggcugguguguguccuggggacaaugaagcuaucaccugucaggaaggcuggggguagucuaggcaguugucccagguccuaagccugaggcccagcuguccaccugcagggcugccuggagguggaggucugccugggccucaggccaccccccuggagcagaggcuccugguacacgggcagggccuccuuuccagcuuccuaccaggggcauguccagcucaggccacugcaagaccaugugccaggggcugagucaggcauaucccauggacccuggacaggugagacucuugaggcucagagaagugaaaucacugggggucauggaguggccacuuccucgcuguaccuagccuuccagggcucuggugggggagggaggagggggcaacggagagaggcagaggagggcagcggggaggggaggggagggcagcggggagaagggugcuggaggaaggaggggagcagugguggggaaggggaaaggggaggaggggcaauguggaaggaagcgggggagagaggagcggaggggacacuaugguuguggccauccaggacaucaagaggaaacugacugaagucuagagaaggaucaggaauagaucugggccuaaggguggugguucagggcacagaguaccagagggacccagagaccuggagagcuucuugugucuccacagucagggagggcuuccuggaggcagaagcaccuucgacagccccacaguguuccaggccuacaaggcauucaccccuucucuccccuguucauggguuauuuccagccgccacugguccaagcacccccugaugguguagggcaggccgggccacauacuucuucucauggcccaacugugggcacaggcacccaucacgucugcugaggugccuccucagggacauccugcccugcacccgauggccaucccuguagcagcugcugcugaucacagagcaccugucauucugagaacaucccauugaucgccgccuuuggcuucacagccauacugggaagcaggcagggcugcccucugcaugccagaggccagaaaauggggcgcagagagcaugggcagcuucccucagggggcccauugggcgggugcugggguggggcugagcacccagaccagcugccucucaucaucaccacuucccuguccugccuugacaagaccugcacggggucucccaaggguacccuugcgguuucaaagacucccuggucagcuccuaacccugcauuuuccugacaggaaagcugaggccuagagagggguugggccagccugugcuggguuaccugaugauggggagaggggaaggcccagguguguggcucuguggccagggugcuggagggcacacacguggggugcccuugggaggucagaggucugagggccacggagauguggggguuccugggaaggcccacaaugcucggaaggugaguggaagggugggaaggucuccacccaggaaggagguccugggcuggcccccagccugccuggcccaggcugacccugugaguugaugagagauucaggccccauccugcagcucccagcccgcccuuccugcucccggggcuggaggaagagguucuugggacacugggacugggguguggggauacaugcugacuagacugggugugguuugcaggccauugggaggaccuagguccuuuaacaggggacuuaacagggacuuagaucccggggccuuggagaucaucuaagauaucauucaggucauagcucugggaugccugcccagggaagagcccagaucccucugucaacccuugcuaaagguggggaggaggcacccaccagugaguccucuucucucacuggccuuauccugcacagccccagccccagcuagucagagggcuccugcguagcacccagccaguccugagccugugcccacgguguaaagggccugcuggucuuuccccuucaccacacaccugcuguucccagccaggguggcaugcacccaccuuccccucucagagcuccuuggccaaucucuuccuucucucucuuccucccuccucccuccuccuuccuccucccuccuccuuccuccuccuuccuccuccuuccuccucccucuuccuuccuccucccuccuccuuccuucucauccuccucccccucccccucccccuccccaccaggguauuggcagaauucccuauucucuggcaccaucacuuccuucuuaaauuuucuuacccuuagugagaaaacccgugaagcucucccaucuuuaaacagccuucccugggcgcuagaucuucuaucucuaauuucuguucccagaggcagcccuucaacccuaccgacuaucucuuggcuuuaccuuggcauuuccaaacuacacauuuacauugcuguuccuugaaauuuugucacuuuagacauuaucuagugacugccuaacauggaagagaagugaucaagauuuuguucucaugccccugcccuccccacucccuuaucuuuccaacacaguuaaauuagaauucuaggcuaaauaaguacuuacuguuugcauuuuacacaaacaguauauaacucuuuaugucacuauguaaucacuguuuuuagcuguguccuguggucuguuaugauuacaucuucuuguuuucccuuggguuacaaauggccuuagguuuugcuuguuuuuuacugcaucugucacuaauucauucuugaacuuucuguaagaauuguaaaacuucuuucauccuauugagaauacuggcagucuaucaccuucauuuuuuuuuucuucugggauuucuuccuggagucuuagcaggacuguuugcacuguaggcaugcugagcagcuguaaugcuagaacuucuuucacucauguugaaaauucucuuggccuuuuguuuuugguguuggagucucccugguucuugaauuguguuucucuuucuuuguuuuuuccucucauuuugcuagagcacguccucaaguaacuuucugagaaaaggcaugugguagauacaauuuuugacugugcauguuuggaaaugucuuuauucuauucucauaccugagaguuugacuagguauagaauucuggaugggaaaucauuuuuucccucagauguuugaaggcauuucucuacuaugugcuagcuuucugaauugcuguuaagaaauuggauaccguuuugauuuucuauucucuugugugugacuuacuuuuucucucuggaaauguggagugucugcuuuauugcugguguucugaaaacaauggugugccccaccgggcauucugggaguugaugagggaagugggggaggaggucuuccuuuuuagcuugaaugcauuuacugaaucccuguuguuuucaucacgagagcuccugccccacccacaacugcuccugguggcuccaaguucagaaccucucaggcucagcuuuucuggagacucaaccugucucuagcugagcuugagaaucaguagcaucuggcuucaugggcuggggugagaccugccugucaggguccuggguugggaacugccucauucuugguggcucuucuuccugcagggcuuggugucuacccucuccagucuccuaggccagucuccaucuguccuccugcuucccagcuuccaaaccuuugucaacauauuuuuggucuccucuuuucuccugaccacuuuacccuaguugauuuacauguuuccauguuuuucaugccuuuacugucaccuuagugggauucaaagaagcugaaauagacauguguuuacccaucacguuuaaccagugcuuucagcucuggcaccugcugcuccggucaccaaaccuuccagcagcccccugacgacaccaucuccuguccugacuucucagaguuuucuucuugggugcuagucccugccugcugagguccuccagcucccaggagccauguucccaugggugccuuucugcacguggcugccuccucugagucccggcuguggccccuucccugcuggcuccuguguggugcugccagccuuuguccugcccucgccccuuugcagguaguguucccucuguugcuggccuccccacauucgagcuuucaagaccucuaugugcccgguggugccuggcuuggacucagggccaacaccaccauaggguucccggccccugaccucaccacuuccaugucucagaggcaucuugaauucgacacaccccaaacaaagcucucgcugccuucugcccgccccuuccucuucauuccggaaaacaguaccaccacauaccugcuacuuacacccuggccugagccgcugaaguguacccccauuuccucccucaagcgcccaacuccuaucugaguccuucuggucuggccuccaagccacauguggaauuuucccucuggcaaaacagccacuugucuccauagccgcucucccccgcccccccgaccccacuuuuuuuuuuuaaucaacagaacccugaauuaagcugaguguuugccugccuggaauagagacuccguccccaggggcccuugcagcgacucaggcgugcgucacauuccggcggguggacagaaagggggaugacgugggccgcuucuguguaggguuuuacaggaguggggccuguccuucaugucuuuuaccucccuccugcugcuggaaugcagaugugauggugaaugcaggagcagccgcuggggaccauaggacagaagcacuggauuguggacaggaaagcaagcagagagaggaggucuggggccaggcugauucaccaggcacacaucagcccugaagcuucugcuacucugggacccugcggguggcaaaguucucucuuauuugggcuguccccagggucacugucucagcagcagcugaaccaagaaccuccccuucucccaccugcccugacucuggucccuuaucuccuaccugggggacagcaacacgaggugacugugccuggccuccucucugcagcccagccuguuccccucccggcucugugacaucuaagcacaucaccucugagcuucaggcugaagcccuccuguggcuugugagugacugaaaaugacuccaaacuccuuagaggacugcuccgaugucaccuccuuggagauguccccuuccccaccuacuccacggcucaugggccaccugccuggcuuucuuccucccuguccuugucacuccaggaccagacaccccacacccagugguuuacaggcugcuggccugugugucucucuggcugugagcauauggggaagugguuagugugucuccccagcacccagcauggcuccaagcacauagugggauucugaguggaggcagggcaggggccccaagacgaggggugcccaggggagccccgugccucucuggcccucugcaccccucucuguucucccucugggagcacaguggugggcugggugugcugggccagcccucuugugccacagccaauccagggcauuucuacccugugggugcccagcugcaggucugcuggggaggccuucggggaagcagcagcaggagggggcgggggaaagugcucccacaccggccuggcgcacccaacgccgggucugccugaguuuccgugacugucugcgcggaaccgcacggcgguuuccaucagcgcugccaagaggcggcugcugggccuggccgcggguucugacccccagcuggccugguuacugccaggagacccugggaagcuggggaauacuggagcccgaaggguuaaccugcccuccccgcccccaaccccggcucaauuucuucauuuuucaaaggccgggcccucuuuccuuccaagucacagcugacgugaaauguagccuuaaaaugcagcugacaugaaaaacaauagcacucccucggagagguucugcugcgggcuggacagcccccgccccccaauaauuacucaagacauuggcaugagccaggccugguuagguaacaggcugcuugcuguggaggcuuauaacucacaggcaguuacacauaaucucugcagacaacaaaaucguuuccaggauggcggggaggacgaggccucggggagaggguacuggggcaggaggggcugagaccaugccaauggggacaggaucugaggaaggggcuccggguggcccuggggagccagcuugucaauguggggaggugguaaagugucuguggaaagggguugcccugccucucucuuuacuccaaacuccacccuugccccagucccuggcguggaggccgcgcugguccaguccguuacugagcaaaguacccggagacucauucauacugaagugugaaugacugacugcuuugggagagcugcccccgcgcagcuccgcgaaggauaauuaauugucuguuuauuguucauggccccacuguacugacuuccucaugggcagguccacauacuuuccccuguguucccagagucuaguacauagcagacauucagaaaauauuuguugaagacgacgacaucuaacccaaagaaggaagcguccagggugugauuccaggcacaugggcggggccccuggcagcaagggcuggacgacuggagggacacuggccaguagagggcuggggcgccccuacccccccgcguggugcuugcucuuccagcacccggggccccuggcaccuucccacaggaaacgcccauuucccuggaaggacacugagcugagcaggcugagggcucggaaggucugggcugcgggccucccuuggccucccauuggucugggucugcacccuggcggccuggcugcagagcccacccugccaggaacuggcuuccugggcuaugaaggcacacgcccgacagcagggucggggaagccgggccccagccccagucccgccgcagggaaacggcaccucccauguucucuggacucucuuuccaccgugacccugucucugcgcaugggacagccguguccaggcugaggcccagcacacugcgccuccugcaccagccacaugugcagaccaaugucugagcucggagcuggcccacaaucccuggcccaggccccaucguacagcuuccauccacacccggccuccccuguccaaacgccccuguccuugcccagucacugaggccccagaacucacugggaaccugcucugugcccggcaggggaacucgugucccugaucaguguacccuccggugccaggggcaggauggaugcggcacggcacugagacaggccaaguacagaauucuauggcucugugguguggaacccaggggacguuccuuccucaaagcugucccgggggccucuaggaugcccaagcuccugacugucuucuucccgccacccccagcugcuuccuguacugcaaggcccuguucaccccuugaguggccccauucucacucucuccucucccugcaaucucuugccaggcaaccucauccacaccccuucuucagguaccaccuccauguugcagccucuguuuucagcuccaaucucccugcugagccuugcagccuaaacugccgggcaaacaccuccacguggacaccucagaaccuuucaggcccugcguguccuccucccugcuccugucuggaugaaucguuucagccuccaacauauggccaagccagaaccugggggucuuuccugaagacuccccuccuucaccaccauauccagcucguccccaagucuggggauugugucuccaaauccccucucguaucugucuucuuuccaccccugggccuagccucccuccucccagggccucugcguagccuccucacccaccuccccucuacucuggccccuccauggacagccucacacuucagccaggggguggcucuugcuggaagaguuaguuauccaugugcaugcaugugucuggguguguuugugugaaugugugugucgaauaugggugugugugacggugugugucaagguguuugugcuguggaaagggcaggccugcuauaugauggauaagcacaagccuccaggccuuagugugcaugcccagcuccacucccgggaagcccaucacugguccucuuaucagcuuuuggugacaugcuggccacaugguuucucgacuugucaaucuuagcuacuagaaucuuccuuguaugaaggugaggcuuaagcucucaccccacccucggcuuuguccacccucuaacuguccagcacagcuuccccauuguuuugaugaaaucuaugcccacugccugggucccccacagagccaggggguauacugugcucacauuuccuuucuggguucuccugcuucucugcucucuucucuaacaacaccucccucagggagauccuccgcuguuuuggaagcuccguugcagauuuucuucccagucccaccuauuuucucuuccuggguggccucuucaggaguauccuguccucugcuccugccugggcugccugggcuggaggccuguagcccugagccagcugcugggcuuggaccucccuguucugucuguguagggucuucugccuccuuguuguuggugccuuccuuuucccugguuuccucccacguuuugcuggagugcauucuccagaaccuucuaagaaaagggauagaaagcaaauucuauacuuuuuuccugcagugacuuggaaaaauuuuauaaguucuugaguaucugaaaaugucuuuacuguauccucacccuugauagauacuuuggcuagguauagaauuuuauuuuccuucacaauuuugaaggcaucucucuucauaaauuuucucuaccaaagacugaucuguucagaggcccauguuuggaaaaucaccuguuacuucuuugagaagauucuagaauguugucuuuaucucugcuguuccugaagggcaugaugacacaguggcugcucuuuucugcuagagguucucagugggcccuuucuuuagucucuauuuccucucaucucccuuucuggaacuuccaauagcaggauauuggauguccuuggauugagucugcauguuucuuggguguucugauuuucugucuuucagucuucauuccacuuucagggagauuuacuuccaucuuuuacugauuuuuuuuuuuuuaauucagcagcauaauugacauuuccaagcacucuuucugcuucucuaauuguuucuuuuucacaauguccuacucuggccuaugccaccguucugaauuucagaucuuacaauggugagauuuguucauugcucccuugccucacauccuuuggggcucccccuguucugagcugagccccugccaaggacuccaccuucccucccuaacuuucuccuuuggcccguguucagcccucuccauccucucagacccacagaccaggccuauuccuuccugccuuggggccuuggcccaugacuaucccaccucuccacuuaguuaagcuaauuuccacccauccuuugggguucggcucacagggagcuuccuugggacaccucugcuaauacccuagguaggcucacaacuuauuauguagccuuuagcucucuuuacgcacuuagcacaguucuaacuaaacacuugcauucugccauaauggccuaauaucuguccccauuuccccaccuccaccuccuagagggacaucccuaggaggguaggguccaguccaucuuauccacacuauaccccagggccuggcgcugugcuggugcuugugucagcauccugcacuguggugccauguuaccacaagcauagcgcaacacgugugugacaucuugcagcacuggaggucaggagucucaccgggcuaacaaggugucagcagggcugauaccugcuggaggcucuagggcugauucauuccucaccuucuccgguuuucuagaagcugccugcguuccugggcuguggccccuccuccgucuucaaagccagcagcacagcaccuucagccucucugagcucugcuuccaucccccugucuucuccgcugacugacccuccugccucccucuuagaaggacccuugugaucacauucggggccccuggauaacccaggaucaucuccccaucucuggauccuucacuuagucacccugcaaaguccacucugccaugaagggacagggauagaaugaggacaucacuggggccaugacacgacuacagagcucacacacacuugcuggggugggggugugcagagcagggauguggcugcagaggagggcaacaggaguggcuuggaagaugcacccuuuaaggaaccccuauaggaccaguacauagcagccaggaaaagguggggagaugucaugggcacagggaacaaggugagcagagggcaggaccucaaauggcugggaggguuuccagcagaagggcagcacgcaaggcccaucccaaaggccuuggaagccacugugaacaguccagaauuaccacguggggaaggggacaccauggguaacuguguggggucaguggggcucugcccucaugaggcuuuuuaccagccacuucccaauggccucccacuccaucugagcccauccaucuggcccucauggguccccagacucccucagccagagcaaugauucaggacacacaauggcccuguggcuccacuugaaacuucucgagaaaguguguguggcuggcgugaccccaugggcaccauucucaccauauuccccaacccuugccaggcccacggccaccuucccauccucucgcuugcagugcuccugccccacgcggggccucugcaccuggagucacacagcugagaggcgaggaaacgggacucgcacagagcaccaggcuucgguguccgcccucugacacccguguugcuacagcaccagccaggggccaccgaacacuugacagacccaccccacccugcagggacgaaagcuucccaccaaggcagcagagcaggccggaccuggccuccgaagagugcugauguccuuagagggagguucaggcagcugcaaaagcaaggcagguuaaggaaccccucgcuuagaugggccuagaaacagccccagagauggccgaggcccagcacgggccaggggagggugagcagcaauggaggugggguguaggcacuccccuugacagcucugucagggagaagaaaguaugggaugaaggaagagccaggggauguggaggacauggcuuccagcagcuuccagaggggcucuagcaggagggaagggaggcggaagccacgcagacucaaacccucaauggagaccauuuccccagacguaaggagaggacacaugugcccaggcuuuaagggcccagaggauggggcaggaaaaacaaaugaacaaaaccaacacaucaagaaauccacaauauuauuggccauccuagugccugucucucagaaacugacaaaccacagugggugaaacuaacaaacaaacaaacaaacaaacaaacagcaagguaagucaggagguggaggagucgcagaacuccacuaacaaguuuaacacaauuaacagaaaagacuccaccgccuccacacauauacaaaaaggucacagaaaugauccuauuaggcaccaaaggaaaacuccauaaauuucuaaaaaucuguaccuugauguaaaauagaaaauuauuaauaaaaauagcaacagauggauacaucuugaaguuuaaaaaguacccuucuaaauaacucuuugauuaaagagaaaauaaggcagagagaaaaucuuaggauggauuuacaaggagcugauuacaugccaagagugugggaugcuuccuauaggguauuuggagaaguaucgauggcaauuuuagaaaauaaaaaagauugaaaauaaaugugcuaagcuuucaacucaagaagcuagaaaaagaacaccaaaacaaauacaaagaaaagaaugaacaaagucaaaggaagauauuagcaaaauagaaaaauauuuuaugaaaaagaauugaccaauaaaaccaaaugcagguuguuugaagagccaguaaaguagauaaaccuuaagcaaauaaaguaacaaauaagaauuaggaaugaauacuacugcuaccgagggaauugaauaauuguaagugauuaugauauauacuuucauaucaauaaaauugaaaacacaauaugauggauaaguuucaaggcaaaaaauaccaaaaguggcuuaugugguagaaaauccuaagaaacauaaacccauuggggagacacaaaugccaguuaccuacccuccucuaaaagguuuccagucuaguuuuugggggugauuucuauaauuaccuaaaaaagcagacgacauccaucccauccaucccagagcacuagccaaaaggggagguugcucaacuuaucugacaagguaaaaccccaggcaccauaacugcucaagcaaacacaagaaaauucuaggcccaaaucagguaugaacacagaugcuaaaaccuaaaaaugcaucagcagcuggacuugagucaagaucacauaagguuuaccucaggaauucaaggaagguucaaugucaggaaggcucucggcaccugguguuuggacccugcuguuucagguguguuuucaacuggacuucuacccucauguaugggcugacacguguuggaugucucccauucccaaauccccagcuugcccaggggagggugggcugggccucauaaaagccuugcccacuccucacuuaaacucugguuugucuuccucuccugcuccuuccucagcacaugggcaggcauagagcacacaaugcucugucauugucuguccuccuagugggccacagcccuugggaggagggacuuuggcugucuggccuaccacugaugccuggagcauagggaugcuuggcaaauacuuguugaaugaaugaaugaaugaaugaaccaaugaacaaaggccaggugaggguacucccuaauccuguagggcagaaucucccuggagaauguccagcuggucuuuucaaaggggcuggagaggacuagcuccuuucaggcuggagcugggagcaggauguggguccuguggggcuggguaaugcuggagggugggaugaaccucuugugccaccugccuuccaagaggcauguggcccacucuccuagaugugauucugcugggccuggggguugggggaagagcagcuaagcugagcugucuccuggcaguuguggagacaccuguuggggaguguguggugggggcugugcuggcagcugagcacaaggcuagccugggcagggggaaaggccugggucaucagacuaggguaggggcugggggcucugggcagcuggugcuaaggacccaacaggugggcccgguuagggaccagcagcugggcugguagggaacaacuggagacagggugggccgcauuccgggggcuuccagccuccaagcugugugcguguggggaugggggguguaaggcaucugguggagagggguuucuaggccccucaccccggguggcaaaguccugugacagcucccaucaucuggcucaugccagaggcaccuacccuugcucuuccucugaggaaggccucuuggcacuuucugaggaccucugaaccaccuuaggaugcacacucugugggggccuuagccacaccugggacgguggcuccaggaacacgggcugcagccuguguacaugcucaagccagggcuuggggugugacuuugcagaaagggaagcuguguacccacaggagugggugacaagggcacaaggacgccauuccugacccccacacucuugggucaccugacacugaggggaagagcagacaagacccuuuccuagggcucggaaguuggggcacgcgcucccacucugagggccagcagacacuggguuuagauguuguggaacucagggugcaggguggcuggccauguguuuuucagacaauccugccacuuuuuugccaggauaguggguuuuagguguuaaugcauauucuuuaaugauaaaagagaaaaauauuuuguagauagaguuugggaauaguuggguuauacgaaguuaguuuuuuucacugcaggccuucucagggcuuuuaaaaugcaaauguggagcauuugcgcaaagcugguaggugcuggcuggggaggggagagugccagagguuucuaacauacaugugacucuggauucaggaucucuccuuggaauuuaaguugcagcccaaggggauaucaugucucuuugagucuaauguaucaccuuugccauggaggagaggaggugggucguaaguggguaggccccugugagaagggggccucggcucaggucugugcuaacaguccccagacccgggguagcucucaccaccucugugauggcccugaguuaaugcccagggcucugcccagcguccuccaccucccuggccagggacaucaucugaagccgucaucucagguaccaugaaccaaaauuggggaaccuguucuuucacaggguacaugcugcucaggaucugaaaugccccagcagguccuucccugacugcugggguggcugccacgacuggggucagcuucauccuaaggguaucagugucugcacaaggcugggggucagggggcacuggugugauucuccuccuggggugcaacagggguucaagguagcgcucagaaacuggcugaagccacggaaagggccgccguggguucuguccaacguaguuaaaaacaucugacugcaaccacaaaaaugcuggcauccgagccugcugcaaaaacauuuucaugucaaaggcaagcgcacuggugccgugaggagcuugcaccguuaacccuugaaaggagcgugcgcagaguuggccuguggagcagagccgggugcaggcuggcgccacaggccugggucaugggucgggcauguggacuagggugaggguggguucccucugucuccuggggucaggagugccacugggcucuguugcccugagaccucccuguugaccucaagcccugacacccucugcggacagggaccaagguuuuggaggggaccuccagaggcagaggggcagccacugcccagggguugggcuguggucacagacauguauuugugcauuugaggagcccugaacagacaccugugucuguucagggcucagacaucagauggagaugucugaaauggagggggcaggggcucagggaaggccuccugagcaggggacuuuggaaagcaugagcugggaggagcguucagugcagggaguccagccagggcagugggccugaggcgggagugagccagaauguuccaggagcagcaagugcauuucucccuuaaugaaacaucaugguuagcccuugagucaaaggguccuauagcccccuuucugcugccuccagccccucaucauaugugguguggcuucaccacaggguggcuguuugcucccucuggaugacaggcagucagaguccagcuuuucaccacuccuggacagcgaugacgcacaacccagaagccauucucagucccaaggguguuacugcuccagggcggauucucagaaggagaucacuggaccacagggugaguguggucucacuuucagcagccugaccauuuucacaaaaggcucuugaaauucucccccacggcgcuggaggccccucuccccaacaucgucaccagcacugagcuugacuccacuuuuuagucuuggccaacuugcccuucaagucucccucccacaaccugaaucuuuauccacuucacucgccuguuugucuuuuccacacugcagcaggaacucucugguggccacugacccuucaaccacaaugccauggugaguuucccaggaugggcagaggcgugugaggucuugccccuggcuacuguccucuuccucagggacuucuugaucucccaagccccggccgccagccguccacauucaucuaacggagcccucacccaggacugugcgcacacuuggacuccccagagcccugcccgccugcaagggaacauauccagcuggcuggucccccaaguccccuccacccugacaggugugcggcgacucagcggugcuuaauuuuucggcacaggcagcuguuagauacagccuggagacccccugagcaacuugccuugggugaggguguggccucagagccuggagcucuggggaggccagcaggaagggcugggggcagcuccacccaguaccuccagggcccccauccuacucccgugucugcucccacccucuccugaauagucuccagccucuuccaauugccccucugccugcauagggagggacuggggucagccuggggcugggggcgauggugccugccccccugcaacucuacugucaggcauccugggugccucaucuuucuugggcuuggcaacuacaacaggacacccuguccccacucucaaaggcucugggauggggcacuggaguggcgauccugagcugagaucagguguuuggaucuacaggaggugggcucccaggaccuccuccgaccccacagggccaggagagggucccccgaacucagaacuacccugugggccucagcauagcuucuuagaacccagaggugcccaugagcucccugacaagccccccaccagaaagcacagagguccaguggggucccugcuguggcacccauaagaccuaugugggcucuaguggggaguguggaugcugugguggcagccuagacacccccaaggccccuagagaauaaaggcugcccagguucaagcugugaccuggccaccccagacuugggacccucagugacacccugagcauggggguaauuuggggagggauugguacugaccacauaaggcuguugagagcacaggaagcacccagcauggugcucagcacgcagcaggugccuggaugaugguugcuaggacaacuccugcccacagugcaugaggccgggaugaggaaagcugugugugcagagcaggccucagaagggcauagcgcuggggccgucugcacaggugcuuucucuccagaucccaggccaggcuccagaggcagcugggucagccugaccaggaagcuccaacaguacccucugaugagcauggaagaguccagagucaagaccuaggccuugguaggacagcagacuggucugcccagcaggcagaggcagauggagcaggaggggaugccagccucgaggacuuggaggcacauguauuucuaagggagacacccuugcuugaggugcuuuagcuacucauccaagccugcuugcucccucucccucccucccuuaccuccacccuuccuuccuuccuuccuuccuuccuuccuuccuugucuccuuccauccaucuacccauccaccuauccaucauuucucaaucuacccauccaccuauccaucauuucuccaucagcucacccacccagccgucucuuuauccagccuucccuucccuccaucuccccauccauccauucauucaccacucauccauccauccacccacccaucucuucauuuccccauccauccauccacccacccaccauccuuuuauucagcucuccuucccuccauuuaucuauccaccucuuuauccauucauccaucucuccacccacccacacacccaucgauccauccauccaucuauccauccauccauccauccaucccaccauccauccauccuuuauucagcccuccuucccucuaucucugcauuuauccauccaccucuauccauucaugcaucucuccaucuacccccccacucaaccaucuauccauccauucacccaccuacccauucauccauccauuauccacccaucccuuuauucaucccuccuucccuccaucucuccauucauccauccaccucuuuaaccauucauccaucucuccauccacauacccacacacccauccauccaucauccauccauccauccauuucuuuauucagcccuccuucccuccaucucucuauucauccuuucaccucuuuauccauucaucuaucucuucauccaucuaaccauccauccaucaaccauccuuccacgcaucccuuucugcaacccucccucccugcagcuccccguccaucuaccuacucauccgccacucacucacacucauuaaugcuccccacaccccaggccuaugugcccgcccucauucuuuccacaagcagugagcagcugccuccuguguaucuugcggcaacaagaucaaaaggcacugaugacgcagucacuggccuccggagugacagcccaccaccgacuaaaaauagaccaggaucagccgagauguugguccuccccucuguuccuucucucauccuuugagucccugcccccucgacagaggacauacuccauguggcugaauggcuccagaucaaggaggggaccauagagacaggggcuggagguguugucaggacuuggugaccaggcgcaggguugaggaagggggagagucaugaaaagauggcgggggaggggcauuugcucuaagcacugacgggcaggcggguuugggggugaaaaagaggugcaggucuccaccccugugagaguggggagcccagguucccugaauggaggugcaugaggacacagggcagaugcccuugaaugagcccugggcaucagagggccugcuggcauccugaggccaucagugaccuccauaagcuacuccaggcaccuuggggcugggauggaacucccuccagcucugccagccccucaguuugacaggugacucauggugccaagaggaagacagggcucacagucugucggguucuuccucuguaccaggcuccguucuaggcacaggguucucacaggagagauggugcuggccagcucugucuucucagagcuucuguuccagcuggagagccaggccacagccuccaggcacaggcacaggcuggggcaguaaugagggauuggaggcuggggcagagaccugaggccaugagggggcagcuuugcagccaggagagggcaggugccaacagcagacuucagaugguuugagggcuggccauggcacaaccccagggugccacucacacaggcacagaggccuugaggcggaagcccccaggaggcuggguggagucaggaaggggauguugcaagggcaggcauggggccccgggggcguggggccucgggggcguggggcccacggccauggaagggugccuggauugcuuccuagggaagagggaggccauggggggcuugagcaggcagugcuguggucugguuuauguuuuaaagucccucuggcugcugcauggagacaggaauguagggggagagagaaagccgggagccccuggggacggggcuggcccuccucuccgggaaggagcucugccuucauacaugcuguucccgccucccggaaaugcccuuccggccccggcagaggcugcaguaggaagaucaggggccacagagccggccgggcaggcugugaugcaaaugugucccccaucauuuucaacuggagcccccgagcacugccagggugggggagggaacggaacccuccucggcgucccaggucucagggaggaaggagagaaggaagcagagagggagggaaggagggaagggggaaagaaggaaggagagagaaggagggaggggaggacuuugaggagggacucaggcuuuucauguaugugaguugacacauuuccuucuuagacaaguuucagggguguuucuguuccuugaaacagaaaguuuguguggggaccagccgucugggagugcauggccaaagcuggggucugggggucagugcagggagcaugggugccugggaggcuuccugaggaggcggcggcuuagagaaccaugagggcugggcugagggguggccggcggugccaggaggacaggaacgagaggcggcacagccgguggggcugcgugccagggcguggggucugccuggggcagggccugagcaugccccugugaggacugucccacugucauccugcggcgggcacucgggagcucaggaaacuguagaacgggaauguguugcucacugagcaccguuuuccaggcuugagccugcaggaagccuggcuuucgccggccccuccucuuugguggucuccacccaucccagccaccguugcucagcucccaggcccacugcugcaccgucucccacgcagccccccacacugaccuccuccagccaggggucugcugacccuugugcugcgcgcccacugggacauccccauccugaaugugcagcccuagaccgcagcccagaaggaggacgaucacagaagguggcugccagccacccugacgcucggcaagggccccgccugggcuugucagaccaagcagggcccuguguucaccuucuguccccucaugcggccuuuagggcagugaaccucaagaaggucuccagcggcacagacacaggcacagccucaugcgugcaggcccauggacuuggcagccauugcucaagugacccagacacuggcucaggagaacguucugcugccuucacaaagcacugauaaggguggaggagcuguguuugcagagaugauuccccaccccaggaggucacaggcuaggaccaguugcgauaagggaaaucuggguuguaacagggacaaugagccagggaagccggacaggggucguggggacggauucccaccaggggcuuccugggggaggcuccauuuggauugggguagcuguacaggggugugacaggcuccagacaggacacggcacugcggaggugcacagccugagggugaagggacgcuaggguccacgcccacccgggucucgccggggcuguaagggugccaagacugggcgggggugagucuaagccaucugcugcucugaaugccaugcugggaaggcgggaguccuuguggaggcacacaucaggcccacagcaccaagacgaugggaaggggcugagcaugagguccauguccugucccucugccacagcagagcguccuacaggugggacucccggcugccagcccuguaccucgagcccaagcucucagaugcagcagccucagagcucuaacauaugggguuccucaguguaaugacaggcaccucccccagucauugucaacacauccuaaaugccagcaggcccauccaugcacagaucccgagcaaacauugaaaaacauucagaacaugagagagaggggccuggcuggccaaacauaaacagaagaucaaggaauuaagcagaacuuaagauauaagauguaucuggagucuccagaaagauccuaggagcugucgugcccaucaaaugagggcggaaugccaugaccacggucagagagcaagcgugugcucugggauauuaaaaacaggacugcuaaaaacauuuccuagaacucugaagagauaaaguuaagaauauaaugccauaaaaaaggggaagaaaguugagacaucaaagugucauuaaaaaugucuucagucugacuuaaaaggaauuucagaaagagagaacagagaugguggccuccaugaugagaaaucauacagagaccuuuccagagcucaaggacuaaaguuuccaaagagcccaccaagugcccagaacagucaaugaacaaagccauccacagggaacuucucugggaaauugaaaccccugaguccagaugguagauacuaaacauuuccaggaagaaaagaaaggccacuuacaaaaguaugagacuaaagcaaguauaagacuucugaauaguaagucuggaugcuagaaaaccauaggacgaggucuucaaaauucugaaggaaaauuacauucagcuccaaauucuauacccacuuaaacuaucaauagggcaccaugguugaaugaagauauuuucaccauguaagaacuuugaaugcuuaccuuccacacaguucuuaucaguaaggccccugaggcuuccccagaaaacugaagaaaugagcauuaagcaggucugaguaccagggaacaguaaacccaaucuaggauggccagaaaaaaggucaguugcagaauuaugcaaggaaggaggguuugggaggaaaacacaucaauuagagacagagagggaagagcucagggaaacauggcuagaaccaaaggggauuugagagaagggcucuggccuggaguguugagcacgugguggagaugauaaaggccaacagugcacaggaggauagcagggaagcaggcaugagccguggggcccucuggagucagcgaccgaggcagaaacccaaccagucaggagaugaguccaacuggaaacgaagaacugagaagaggugucuguggugagaggacuauggggagucuguugccaccuucauacacagcaccaagacgaacaaacagagggaagcagagcccccaagcugugcacaaguaucacaaaccuggaccaaugccacgguaacaacaacccauaaaugaacacgugcugcaccaggaggcugcgggggcgggguugcagcgucgcuggcuaccacacaaagcugagagaagaccgcaaaaacccacgaugaguccagcgucccacauuuuauuuuccuuaaccugaaagugacauuuagaaaugaauuucucuuuuggugaagaaacauuuaucugaauucagcaauuccuucuguuuuacuuugguuucuucuuaaaaaaagaaaaaaaucaacaauucaaaagcugcaggcaucccuugauuccauauuuauauuugcuucugauggugugucugucugucugcccacucauucaucuacucacucacacauccauugucuggccacccaccuacccacccaccuacccaccccuccauccauccauuccuccauuccuccauuuauccaucccuccuucccucccucccuccaucucugcaucuauuucucugucucuccaugcauccauauauccauccauccuuccaucuguccacccaucuauucacccaucuacccacccauuguccauguguucauccauccauccauuuaucccuccccuaauccuccauacaacaaucuguccauccauuaaucugcccauguaucuaaccauccuuuuucuaugcaacauacagagaagcgucuggaaugcugcucuccucacacuaaggauggguauuucuaggauaacaagggguauccuagggaaagggggcauggucaugaagguauuuaccuuucauuucagaccuuucuguacuguuggaauuuucuagaaauucaaauagaaccaagauuaucaaucaaucaaucacucaaucaaccaaccuaccugaggacucccauuuaaaaaauuaaugauaguucucuguggagauauuaugguccucuuuuguuuucuucucugcucaguucugcaucagagccuauuaauagcaacucugaaugcuauuuucaaaugccccucccucggaggucuucccugaccaccccuguuccucuccggcacagugcccugcuuugcuccugcacaguaauuuuccuggucuguaauuacaugguauauuuuugaccgggguagcucugugaugccaggaccgaguucuagcccauccccguaacaccuccauuaucuuccacugggauaucgcaggggcuuggugggugcugggggagggcuggaaggcgggccagccuggauggguucacccucaaugcccugggcagauggcaucagaucuuggucuggugcuuggcagugggcagggaaaauaagcccacagggugcccaaguggugcccacagugguguccaugagaggggcgggaagcagccgccuucacuugccacgugccgggcacugggccaggugcucaguggggagggcuccagguaccaccggcccugcccccagagagaccguuccugucucauccuuacagauguggaaaccgaggcuccaggaggcugugcaaggugcccaaacuuggccuucucuaccgcugcuucccucaugcugcagccagggcuugucaggggcagccucaaguuggugaccggauugggggccaggaggcauggugggcagggaagguggccacuggaguaucgugaugggggaaagaggcagagagaggucggaagaggccgguaggugggaggaagucagggaggagagugcgggaaaggcaggcagcucggguggguggggaggaggcugagggaaggggggcccuggagggggugggggugccccucgcccgccugugcccaccgccggcuguccuggcgcggguugcggaggcacugggcgggaaggccugguaggcugggcccgaggagggcccggcccgggaguguuccgaggagggauuuauuagugaaacaaaagcauauuuuucagcaggacuguuuguucaguuaccucaugacaucgcgcuggccccgggcccggagugggggggcgaggaggcccagugcagcgaccgcgggcggcacagucccgcucuccauggaggguccccucccggccuuaucuggucccggacaucaaagcgggggcuuuucauaagcgaauuaaaauagcacacaaacagcacagggcugggaagaccccgggccaauuagcuuccagcagaauaggaggccuuucagagccggccacguucgaggcgucgcugcggcuugucaggcucgaugaaauauuuugcccaaagcucauuauaauaaugaaccugcauuucuuuccucaagagaauaauuagcagacuuccaaacgggcuaaagcagccauuuaaacacugccccuucaucgucccauuuacuucauucugugacaaggaaacacuggcgccuuccgaaagagccgagacucccagcacccucccugcacggucacagacuguggggccugcagagaggggcuacgccccagccccagggaccccgcccaaccugucaccccuccccaugcccccgcuggugcugucccgguggugccgucccucucgggcuggccugagaguggagaagcagaggccuuugugugucaccggagccagcacgcaagccaggcuuuuacugucucugggggcacgcuauucucucagggcacaagagaggggcggggaggggucaggugggggccacccucaagggaaaccugagcccgaacguacucccgggcaguggucugguacagcugagccucugaugaugcccacggagagaaugaauggggaucccccaggacagguggaagauggagcugggggcugagcagguuagagaaggguuaccugcagccuccucggaaagcagacacggcccagcugcucgguggggagcacagacagguuaccuggugccuagccacuggcacaaccgggguaaggaagaggcaagccugcguuacacagcccaaggcgggucgccuacccucccacauggcuggcaccacagacaaggaagccaggcuucacugggcacaguggcccauguggccccaggcaggcugggaaggacagacaaauuacggaggggcuagcguccucagcagggaaguccccuugcugccucccugcguaccucccucccuuccucucucccuccccucucuucuuccucacuccacauugauuguuuacucuuuuucuguuauggagguaagaaccacuuacgggagaaauuuugaaaaauaugaaaaaaucuguuucaaaaacauaucucuaaguccacccuccagagacacguuuccgggcauuuucuguaaggugauguuuugggcaccaccucccaccccagaaacugggaccauguuugucuccaguaaccuuguacauggggcauuuuccugggucacugagggaugacugaaagcugcauaauugucccuaaugugcauaacaagaaccaacaucccgcaaaugcugcacaugcggucuguuuccaauuucucacuauuauaaauaaggcugugauuagcuuguuugugcauaacucugauuuguucuuuagggagagaauccuggaaggaggauuaugaggucaaggggggaggaauguuuuuuaauccccgugauacgugucaucagagcgauuucuggagcagggaaccggcucauacuuccauuucuccucggcuuccccagcacggaagaccacacaauuagguucauuucugcaucuugcgucucuucacugaaacucuuagagcaagggcuagcacgcuuuucucuaaagggccagagaguaaaucguucuggcuucguuggucacacgaucucuguuacaacgacucaacucugccaaggugguguaagguuagccagggacgauguguccaccggugggcguggcuaugugcuauuaaaacuuuauuuacaaaaacaggcagcggggccagaugaggccccaaguccaccuuacaggaugagugcagugaggaccuucagauccuuuuguaaauugucuuucuaguucuuugccugcuuuccuacugcggggcgagugcuuuucucauagauuugaguuuucacuugcaaaaugucgucccucuccgucgucggcugcaguuuucuccccagcuugcugucugguagcagcuuugggcaggcagggaggggcccugugcagcugcagccuuugcucuccccagccaggcuggagcugggggaaaggcucugugaccuggguccccagcggccugugaaccaccccugcgucuucuagagacaaagcccuugcuuccggcucucagccucaucuccacgucuggcucagccugacccgcugacacaccagagggcuuguccggcagcugcccaugggcagaaacucaggcccgggauggccagacacucuuccugguuuuguuuucaaacugcuucauuuuuaccccgggggccucauugccuguggaacucugccgucccugucagcauuguaucugacuguggugcugccucucccugaccacauguguugucacauguuccggugaccugagccagguggccugggacaaaucccagcuggcaacugugggcccgugccucagucuccucauacacaaaaugggaugaacagcagcaucaguuucaugguggggacacauauuuccagcagcuccagacgcugggugugggcgcaggggaaggccuuggugucgccuccgucugcaaggcucauccugugccaagggccaggagaguguggagaaugguggcugcagcuucacgcugggcagugcaaccccacucguuagcuuuugccuuuagaaauaucagcuauuuucaccucuuuaugcuucuauaugagcccuggaaccacucugucaaguuagaaauuucagugaugcucuccacaaacccacagacaaaacuggggugacacccagcccucugaggggagcagccggcucuguuccggccuccaucccucccuccccucaucucucccagcaccgucaauacagccuuguuucugcccagggcggcgggguucuaguucacagaugggcuugaccaggcggccugcauucagaucucagcucuaccacugaguugggugacuugguggcaguggaguauuuugugccucaguuucccuucugcaaaaugacguugcaggaggccugugcuugcugaugugccgaggcauuugcagggcucgguggagagcaggcacguggcauggguggugugggagcuggugcacagcaugggugaacugcaguuguuucuggcccugugaauauugcugccucuguaucuucuaaugggcuacugggcgcuguagagaauccagugggucccugcagcacuuccuaagaaaaugcagaaggagcuccaggcuccuccccgugugguucacccgccaucccguccuuuccccucugccuucgacuccccgauaccuuccgcugcaguuggggcugcggccacaugcuggccaaggcucugugugagccgagugggaucugccagguggcuggagcagguggcagaggcggccccauccaauggcuggugugggguguccugaguaccugagugugcauaaaagcugacccugggguccaugggcauagcagggugggagcuggugggcccgagguggggaugagaggggaggagggaaguggggagaggaucagggagugcuucugagaggccaggagaaagaagggcacaggagcucccuggcaagucugggcaggccacagcccugggcauuugggggacaggcugggggugggcaggcuggggcaggccgggaccuggagauggggcugcagacgguacaggccuaggcuuguguccccaguccuggcgggcuccacugaagccccaucacccccagcucugccagugccugcagggagaaagggcgagguuugggaacaacuggcuccugcuccccaucacaccaccuggguaccccuaaagcuccugggaacacaggugcauucuccagagcccagaaggcaccguggucuggagggaauaucauucuacacacaccaugggaacucugccacauccuccaagccccauccccaccucgccgaguccugccaccguccaggcugaccugggcccccaggaagcccuugcugacuccggggcccuauuuuuuccugacuaggggcgaguccuugggaggaugcuccagacagucccagggucuucuggcaaagccauggcagguccuccagcaaagccagggcgguuccugggugcccgugggggggggggcccggcuggguuuucugggcuacccugagccccuugcucacucugccccucaccauugacucccguggccuuccggcugaugggcacucccauccugccaccuucccuucaugucaccuccugcucugagagaguggccagggccagcuccucuggguggcgaaguggagcugagggguugcccugugguggccagggcacugucuagcccaccucccuggcuggccggucuggccuuugcagguagcgcuguagggucugcuggggcugggggcuucuggacucugaguggggaaaugcucagggaacguccaaggguggguggccacucagcuuccccauuccgggacugugaggugaagggcugggagcaugcaguggcuucuccccucuagcucgcagucuucaggagacaaccccgcccugcaaacgccuccuuccuggacccagccccucuguuccccagugagugucaucuagggguuugaccgggagaaugagcaucugcugggccucuugccacuaagccuuggggucuggcccuauacccuggggacccaggaggcacuaggcuggcuccugagaggcaggguggcugccagagccacgguccccagagagcagaacuuuaugagagggcacugagccaaggcccccagcuccuggagucuccagggggcuuaauuaauagacauugggcaggcccaugaagggcugccugcgcccgaggauggcacauuccagggcaggcuccccgcugccucaguggcccccuugggaugacaguuaauacuggugagggcugggaggcugugcugguggccccagugcugccggcuggcgacagggccggagccagggcuaaaccccuguccugcugcccucaaagccagcucugucacugugaggacagaggcgacagcucacagaccaggugggcuucgcauugucagaaggcggguguggcugaagcugggcacccuguggccucccccugccugaccccuggaaaagcggaguggaggguggaugggccccaacacccucagcacguccugggccggugugagucugggugaaugugcccaccgcgccccgcuccgcagcuggcgaaaucgccuccagccacagagaauacaaagcucccccaacacccuacuggaggcaaagaccccagacccugcucuggcuuuuucugugcuugggccugcccggggcuccagccuucugaggucugugcugccaagaagagcaagggaggaggcaguguuaacccaggggcugcggggacaccaucccugucacugcuggucuucccuggcgcaggcagugggcguggcccugagaggcaaggacacccccgcaacaagcucuccccucccucacuuccugcccuucagcaugcagugggggcaucuccccaggcuccaguggcccgacggaggacuuguguuaugaacugaacugugcccuccuaaauucacauguugaagcccuaauccccaaugugacuguguuuggagacgaggccuuuaggaggugauaaauauuaaaggagacugugaaggcagggccuuggucccauaggacucacgucuuugcaagagaaggcggcagcaccagggauguguaagcacagaggaagggcccagccuaugagccaggaagagggcccucaccaggagccgacccuuccacaaccuugcucucggacuuccagccuccagaacugugaggaauaaauuucucucaccuaaguccccuggucugaagccuuugcugcugagccagcugauacgacuggccagcaggaagcuggagagcuagaggggacugcaagggcaggugagugcccgccccuacaggcacagggcaggguccggcaccccgagugggucagaagccaguccaccuacagacagcuccacgugacagccauggagcccaguauccuguuggaacuggggagccucuagggggcuggucugugcaaagaguggacccacuccaaaccugacugcacucuacccuuccaccaucucuagucugucugggccaccagcaccccaggagccacugccuggcccugccccagcccugcacccaccuccauugcuucugucaccagcucuggcaccucccauuaccaguguccccacccugggcacaccuggucuccugccuccccaugccuucuggaacauucucuagaaugggcucugagacccuguccucaugagugccugccagccacaccuucuccuccugccccagcgccauccuguucucugcucuuaccauagcugaauucucccauaacuuggggaauggugacggcagauggucacugaguggacagcaccugcucuucuccgugcucaauggggaucuccugaacccccgcaagcauguccccauuuuaggguugaagaaacugagucacagagaggcuauguguggugcccagauuuacacaaugauaagcugggcguuggaccuuggcaucaaaacccuuuccacuucaagcuuggaaccuucacggccacagcugcucuggcccccgguucuguaaacgccaccucaauccugugcgggacccaggccccuucccccacucccugggcccuacacagccucagagcaggcaaaguggggagggcugcagcugggaguacccagguuugggccgaggugaggcaagugggguggggaagaaagaggcuacaaagcuggcaggggcugggagugguuccaaggacagcccaggggucugggcucagcugccugcacugaggcgcuggaaaccuccucuauagccucugcccaguaggaagcaggaacggcugucagcccccucuuugcaggguuacccugcugggggaggccucugucccucccacacccucaggccacugggauggagcaggaaguggcuuuauucccuucuugaagguggcgggaaaggaucccagaucugugaccuccuggccuuuuggguggggcugugggcucuggagacagggcagggucagagcccugggaacuguggacgucugcaucugcucacagcccccaggucccagcagccuuaucggagcccuuggcugggagccuggagaccugaggguggcugagccggcaccaugcuucuaccccacccuuaggcagcuacccaggccucuccggaccucaguucugcaucuucaaaauggggucgcccagguagacaugaggacugacgggcaggcgugggacacuuggagcucaggagggcaggcaccgaaaacacacacccucugugcugugacuggaaccccccaugcagccugccgacucauuuccacucuguacaacucuacugagaagcuccucuaaauguucccgauuccaacccagaaauucugcuccuggcaaaucaaacacaagggaaaaaugcagaggaggguauuugcuguaacaggauggagaacggugacuaccugcagacagcacagaugcugcucccuggacaccgagugcacgagccccuuggaacuucccuuuggcugucuuggauacaacauauacacaccacacucacacacacaaacaccacacacacgauacaugcagacacaacacacaccacacucacacguagaagacacaccacauacaacaaaacacacacacugcccucacauacaaacacaccacaccacacaugccaacacacacuguguccaggcaugcaagcaugcuacacaccacaccacacacacacacacacacacacacacucgaacuuacagcuacagaaguuaaacaucacauuccacuucaguccauuccaaagagcgcugguugucaccacaacagugaccuccuggcccaccauggauggacagccacauggaaucugagcaccaccgcccccgugguccggccccugccugccucugagaguuucucuccugcgcugcucucucacucacuuugaugcagacacacuggcucccuuucuguuccaggcacgugccugucccagguccuuugcuuugccccucgccagcugguguccucuuccuaguuacccaagggagcugcuuuguccuccuuugaaggugccuguuuagauuucaccugccagguaagugccgccugaccaccugcauucuugucuaauguccccuuccucguggguacccuucacgcggguacccucugcucuccuuccucuucuuccucuccuucccccguccuguuccugcuccuccagccccuuccccugucccaaauuaggcaaauguacaugcauagaucaacccagcccugagccacagaggcgagaguucaaacaacgcgaccaauuuauaaacaauuuucucugcuacgauuaaguuacauuuuccccaauagcugcuucauuuucuugucaaaaauacacaguuuucacauuugucucgcugcaaggguaauuaauuuccagaccauaaguaagaacuuaauuugauaccugcaaggauuauaaacuauuucaagcuguuguuuacacgaaaucaagaaaauucguucuguuugcaauuauguuaaugaggaaauagaguggguauuuuuuuuuuuuuucagggaacucggcauaauuuugccaucaccaaugaauuaguuuaaaaacgucugcugcugcugccgcaaaccccucuacagcuguuuuugaggugaccccaguaaggaggccccccagacggcugaggaucccaaggaaggcuuuugugggaacggcucagaugaccaugggcaggugaguucugaggacugggcacaaccccaggugguuggcaacuagcuaggucugcagguggggcugaggagucuucuucaagcccuccugaugccaagccgaaaggugaccaggaggggaagggugguugggaacccagggcguggacgguccagccccuuccucuuggacagccauuccugggcccugggcugccauguggguuugcaccaugcaggcuugcuugggccugggccacaagugggggcacugagggugggaaaaggggcugcucucaggguugaggagagacaccccuaacucaagacucaguauugucccaaggccgcuguggauggcugugcaauuggguccccugugagggugagagggcugaacuuggccuggaaaggggcugcaucugcccaccgcggugcccuggguuggccaugacccugagcagccugggcugccugggccaaccuggaggcuggcacaguacgcagggcaggugcccaaagggaagagguauccccugugccugggggaaccggcuggcuucacaggaugggacacucaagcugggugccgaaggccauguggucagggugaggcaggcucccaggggagggagugcaggcacaagcagggggcuguaaaaaggucccgcacaccugagaaggggcagaauggaggaaguacggggcccgggggaggaggaggggccagacuacacuguaaagggcccugcugcacagagaaggcaaagaaccuucaagacauacaagaaggcggucagaugcuaguggggaaagggcccucgagcuccggagcaagggugguggguacgcaggggcagguggccaggaggugcagggcugguacagccacgggagucugcgggguuuuggaaggucugcuaggaagaggccagcccagcccgaccuugaugacacagcagcuggagcuggcaucgcugagagcccaaggaaagguugucuucagccuccuggccccgucaggcacaccucuggcugcccagugggggacgcacagcaugaggacucauucgcgaugugaccgcuuggucugcaggcagguuggggcccguuccuggcuggcugucucuggggagcugggagcugggggcuggggccagcgcugcccggccucuccguggcccagcccccagcacuguccuccucuucacagggccucccccccgccacccccccaggucugcccggagcggccggcaucgaggcucugggccgaguccucguaaauccuggggugcuggagacagcccaggugaggccgugaacaaugccccguuguggccccguggggacgguuugccgccacuugccaccagcccauacguuguaaaaucucuccccacggaucuaauuucgccucucuggcccuugggggguuaggcccgggacaggcacagucucacuccacacagaaaccauuuacggucgggauaaaggcggccuuuauuggcaccgaauggcgaacguuucccugccccaucguuuucucaccgccacaucugucagguggcgcaggagggacggcgcagcagugggggcuuguguggggacaaggacaggccgagagccgcugccgccgggaagaauggcucccagucucugucuuccugggaaacccacgaggucuuccugggucuguccaccgccugcaccucagugggcccauuaucuucaggcccagcucugacgcagggagacacggccccgaggggcugagugggcaggaaccuggacacaggccccuucggggcacguuuuccuuccccauggagagggugugucggggugugagagugaggaaaugaggacuacuucucaggccccaugauaggccugggucggcagugggaggccucgccuggucucgggguauaaaggcugaagguggaagggugcugggaagauccgggagaggaaagcgaugggugcuuccugccacccugccaucaaugcccaggguccuccaugcuccucaguuugggaggagccgugagaacugacguggccgccuuggccuuagccaggcggugaucucaaacagagcuucaucagcacuguggcugccauggggcagcgucaccuggcagggggccaggggccgugcuggcuucuggugggacauggaaugauuucaggugguguccgaauagucccuguguauuuugguauuuacauuuauguuuucaugcaugccgggaggaagugcauugcgccauaagccaaugguuucacacgugucgguucuaggcugcugcaguagaaguacuuaacgggcaccaagcacgguggguucaagaaaacgucaucuaagaaaugucgguggcucucagauguggaaaaacacaaagggugucccugugugaguggggcagggggccaaaggccggucucaccuggggaggggccuccaucuccaagcccugugcaagggguuggccacacuuacccccuguucccccggcccccgccccaugggaccccugcuuguggaggcacucaggggaugagagcuggagagacuccagggcaaggaacccgugggguuccucauggacccggggaaaggcagggucccgccaaguuuguggagcagaaaaauauuguuucuugcaaaauggcagggaagaguuggcgggaucuguagcugggggcugggugucaccauggcaacggaaagccagaagcuggcagaauuaggggcgggcuucugauuucuagggaugcuggccaaaccccaggugagccccagugggugugggguagggugguuuagaucaggggccugcucaagccaggcuggguugggggaagcuccguggggcccacucugggcccaagcaugacugugucuuuagcaauugcucugugacugggugucaguuuggaggaggaggagccccucggcucacagcucaggcucuuuuugcuccagaacuucaccuuuagggaaagagagaaacgaagugggauacacaagacaggucaccugagacccuggggcccuguccguggccuccccagacaugggugcagugccccaacugcaggucuggcagcagcagggacugcucugagcuccagcccgaggcgaaggccuccaguucauagccaccacuccuaccucaucccuacagcacccgagaggucggggguaggggaggcgagaugcggagacugacgcagcggaaggucaagugaugcccuggcuucuuggcugcugugggguggagcugagugggacgugggaggagguggcgaguuagaugggaagaccccuuggacccccgccaaccacaggcagaggacccucugagucaucaaacucaggucuugacugugcugccugcuugccuuccuccccgcacagcuucugggggugugaugagcuauacccacucuaggcugggccuggucucuguacauugguccccacugguggcaucuugcuuucaagagacaagguaaucuguggaccucccgucuuucccuccgcuagggagagcaaacuugggaagaacagguaugugguucugggugguggcuucagagcugaagcugaaagugggagaugggggccagagggguccuccaggcucaggcucucuugcuggguccaguccagcccagcagaacuugugccuccuccaggacacccucaccugggaaggcgguguacucccugacgccccuccaugcggcaucugcuccccgcuaaucugugaacacacaugcaucacaucuuugugucuuuaagguccagcaucuuugggggcccggcugggcucagggcugagucacaugagccugcuucuccccugugccgccccugaccacggccuccccaaggcuucccucacugccuucccaucucucucacucccccaucuucuuccucuuuucuuuuccacuugaucucuaagcacugggguuuugguugccugccaaguccaaauacagcuccagacccuccugacccuccuaccucagcaccccuccgagcaaagcauccccacgugggggcucacagcagaagcucgggguccuucuccaaccuuucuccccucagucugcuuguucucaucgguggggcuggcagacugggggcuggccccaaggccuccacccuaguccaaagugcugaugcucucccucaucccacagcagccccucaccacuccuggaacugcauccucaccugccuguaacccuccucccacgaagccggagccaccccuggauccuuggcccggccgggccaucccucgcucaccagcucugccucaccugcucucauggccucaggaggaugugcccucgugcccuagggccuuugcaaggcugcacacacuggacacucuuccacccugugucacccuccuccuccucacucacuccugguuggcucugggcuccugacuccacugacugggaaaaccgaguacuuucuccuucacacagacagauauguaauuacgggucacuaugugcgucccccugcccagccauggggcuguacauucuaaggagcaggggccagcccacccuacucacacugcagccccaggcaguggcacaaggugaaugaauaaaugcccacagugcuucagaaggauuccuuugcuuuuuuccuuucugcuccuugugacuucuggucccuccaucccuccagaagggccucaguuaaaaaaaaaauacuucuuacuuuuauuuuuagagauaggaucucacuguguugcccaggcuagagugcaguggugugaucauggcucacugcagccuugaacuccugggcucaagcgauucuucuaacucagccugcugagcagccgggaccacaggcacacaccaucacgcuuggcuaauuuuuuauuuuuauuuucauagagacagggucucgcuauguugcccaggguggucgugaacuccuggccucaagccauccccccgucuuggccuccuaaagagcugggauuacaggugugagccacugugcccagccucaguuuugaggauauuccuggguucuggagaaagcucggagcccucacaugacccugcuagugcaauuuccacccguuauuggauauggucccucucaguaagaggggcuaucacagagccuuagaacaagagcccuuguguuugucgggugcacccaggcgggcccugccugaugcccaugaggcugaacccauuuguagcccagcgaggauggguggccagguagcaugagucacccaggcaucagcaucuccucagcagcuccugcccugacgggguguucacccugcuggacaagcaucccuuugcgggcagcagacaggcagccaccuugccgcccacacagauggcucuugugugccugaccugcggcucccggggggcggggaagagagggggugcugugcacuuugacaccuaugugggggacugggggcagggagggggcgaggggcagggggcugcgugcuggccccgcugucaggcucaccuuacucggcuaauccugaacgugcaagaacaaugcugccaaagccaugagcuggaucucagcccuccggggccccaagcccccaucuccucuaauugaggccucacaggguggucugcgcccccaggcucccccuuguccguggcucuggccagugccuccugcuguugccaaggugguccaggcacugccucagcccgcaccccacaaccgcugugcccuccgcccagaacgcucuuccucuagauauccauaggaugcgcucccucacccgcacagaccuuuuccuggcagcccgcacacccugcaaccucuucuugaaaggccugggucugaccugagggagagaguuucucuugggcagagggaggggucacggccccgucccuccuauccaccuggcgcuuuccaccuuccugagagcagaggccacuguaaaagggaccgugugcuggggguuuucugggugcuggacuugugggcacacaccccauccacuccugccugguccacacacuggcugcuguuucacagacaaagaucuggcggccagaggggcuccagguuugagaagggcccucaaaggagcagccccuuccuauugcugcagcgucuuccacacguggagagggguucaggcccacgcugcucugggccugcagggccacccccuggaggccgcgggagugcgggaggggacgccgggccugcagggguggcggagggacccgggaaggcaugaauggaagcgccggaccagggcgggaagcagcggacgcggaacgggguggggagggcucagguugccaacccaaacagcccagcgcgccucggccccguguuuaauccacaaaaauuuccaucugccucuggagcacucggaacccgggcaacgaaaggcuguucgcgcggcaaaguaaacaccggcuccgugcagggacggccgugcgccgcgucagccauuuuguggacgccaccguccaaagugaggcggaagcccccaccugcgggcucggagccagggcaggaagccggucccaccgcccggagcggcgcggcgaggaccugggcauccaccugccgccagcgccaccucugaccuggggccagaacccgagcccgggaggcccgggccccccacccccacccgcagcugccgccaagcccccgcacaaccucgggguccacaccugacggggagggcccgggacgugcugggccugugccgccgguucgccccguccuuccuuccccgcccgcgguuucccagcccagccggcacggccagguccccuccccgggagggaggggaggcucgggucgggacaucuauuuuugauggugaccaagccacugcuuaauaugcagaaccggcugggggcaggcugugcccugacccacggggugacaaguuugaaaaggggcccauuuugaccaaaauacauguuuuucugagguuggccagggcagccaggcaggguuugccgcacagacaaggcuccgcaccgcccucacgcccuggccccugcaggcggccagcccagccggacucccgcaauugaugcugucgauuauagauccgcacacggugcccagugagggcucggccgcugcgggcuccggccaccguccugcucgggcaccugacacgccccugccgccugcuguccuaucccagccucucucugaagcaguugcacucacagaaguugacacacacuugagcugaauuuuuaaaaagacuuaaauuuccucucuggccaauauuggaggccuauaaauagagucauucaggagaggcuugaggguggcaacugucccccacaggcaggcuaagagagaaacaccccaagaaagagagacgcuaguguggggaaaagaacaguucuugggggauugcugaggguaagagaagcaggaagccgcuggauagcuggggaaagcaagaccuggauucaggaggccuggccagggccacguaguaggguugaggcggaacuugaacuugcagagagaccccugaugccauccucaugcucacacccucugagcucugccaucagccaagcaggccuccugggccaggagcuugugacacugcccacgccacagggccuuugcacgcgagcgaucggcauaauggugccuguccccuccacugggggccaggaggcugaggcgcugagagcccacgugacucgccgagucucacagccaucgcguguagggggcagagcuugcaccccagccacuggcuccaaaggcgugagaggaggucaggcuuuugcccugugugggaugggaaggggggaugggaaaggggucuguguguggcccugugugcacagcuggaugcuggguguggaugggccacaccuggaugaggacccugagugaugagccccuccuaugggguucagggucccauggguaaccaagagugacaaagugagacugcaccugcaggauggggcuuggcccggcugucucaguaggugcugggccaggcuagggcacugcugccagggcuguccagagcaguagaaccagaggcaaugccagcuccuggugucaccgaguggggacaguguagacaaccccagcagaggaggacgggagccacaucagacaggcuucuccucugagcugggcacucuccacggucccaucacccaguggcaguuagugggggcugucucuguggcagguugagggucauuugggcucaugguauggcagagggucauugggauaugaucugggggucaugaccugguggucaaagggauaugauccccuccaagucccagggcagggcuggaaucugcagcugacaagugcccuuugccagccucuggcaaccucauggcaaccuauccgaggauggguggcacagagaggagccucugaguggggaggaccucacaggauguuaggauugggggugguccucccaggggagaccagaggaccaaggugggaccuuguuucugagguucccuuucccaucacacucaccuccacgugacaucacuuuacuggggggaaaaagaaacaccucgaaaugagcacaccaacuaccuggcgcaucucaaucuuggacaaagcgagaacucaugguggaucucagagccaagcccacgguggucccagugcccaggagcugggccugggaagggggaggccgacggccccagcaucccggagcgcagcuguccccuggccucccuucccagcugcguccugggugcuguggcugcacagagaugcgaucacguuccuuggcaacuuugguuucuuacugagcaacacaucaauaauaucccucccgagcaaugacugccggcaaaagcucgucuguggcgggcacuggggcugcggcgucgaggugucucaguauauaccacgcuucucuauggacaaacagauggcuuugagcuugucacaugacaaagcuugcaugcaaagcccgacccuggugcuuuucuuuccuaggagugaugacggguuucuaguuuucacaggcagugcuagagucccuuccaggaguuguuacuuucauuaauucccaccuccuaguaagacagaagagcgucugcucuuccgcacccaugccagcacaggguaucaucauuuccuuacauuuugacuuuaggggugugcauuccccuggccacugguggguccacugucuuuccaaagaaggugcugggcagagcugggcugcgguucagaggugccugcugagccugguuccagggguggccuuuggggguagccugaaguugggggaggguacggggccucggucccuggccaggcaagccaugauggcugugagaaugccaggucugaagaccucccaccucaggcucccugggagcagacucaaccuggccccaggggccuccugcaagccuccccggagcuugcugggcacagggacucccuggcagacacacccaccccugugcaggaacaggguggcggugcucagcgucaaacgcugcuuucauuauagguuuaucuuuggaaccccagacaaaacagggcuugugugguuugacugaagggcagccccuccggacuccgccauccacuaagacggcuccucaggaaagaaaaaauacacuaaccuuaaaauaaccaguucccagaauagcaaacuaaugacggcuucuaaagggagcccuuugaucagucagagcccccgccuuugccuauuuacggcccugucacucaagagcagcccagcagcagagagaggaguguuggguuggguguggggggcgggggguggugcagaggggagggggagcugccgaggagaggcaggucuggggcugccagggcaguccaggcugccuaacuuucugaugcaaccagcccuucaguggcaaggugcucccuggccucugggacagccuggaaguguguccugccugcaccgacacacacuucucacagucugcugagcagcaccuuccaguugcgaagcuacgccagggaacagaccuggcugcagagaaccggaaaagaaccagaaucccaagcggacauuccuuagggaccucggggaggcgugggucaugagcucuggggacucgaggcaggggaacuuggggaggaugcuguggagaaggagcccaggaggggucugcagggaugcaucucuguugggggcaugggguggagaggggcgcuggggccaugagauggcaacuacuggagugugcucucccguauggucccugccauccacauucaccacauucuaugggcacucacugagcauuuccuuggggcuggccuggguaaacguugggggagccacacucaccuccccacacgcgcgcacggccaugcccguccaaagcagcgcugucccauagcugaaucuguguggcacagcacuuaaaaaaguggugacugagauccaggaauggaauuuucauuuuaauaaauuaaaauuaaaauuuaaagauagauccuucauucgguuauuagaaaacccuucaguauguuugaaaugacuuaggcaugggaaucuccuuuuucaaugguaaauuuuaugaaaucuaaauacagaccaagucguucucaugaaaacucggugucuaaauugaaauguguaaaauaugcaguggcuuuugaagacccaguaugaaaaagaagaaugucaacaauuuuaagaguuuuaaaaauauuaauuauauauugaaaugauauuuuggaucuauuggguuaaauaaaauauauuauuguaaucaauuuuacuuauuucuuuuaaauuaaaaaaguggcuauuagaaaauuuaaaaugauaucuguggcuagcauggaugagcugaccaggaaguaagggagguuagaggcugaaaacucagugaaaguggaaccccagagguaauaggggcccugaagguauuugaugagugagaugaacuugagcuuugguuucaccaggaauagaugauuaugugucaaagcccaggccugccccaggaagucucauagcagagacuuacacaaagcugggacccucaaagggcucugcuuucauugugagggccaaugaaaaaucuccuacucccugagaagauuguaaagaaaacugcauuacugcuaagagaaggagaacaaguucuguccuggaaagucauguucacaaguuaguccaugcucagcuuggaggcuugaauucauacuaccuaaguggccuagaaaacuuugagccuagaauuaaaaguccaggcuggcaguacacccacauauguggcaauggaagggguaaacaugauuccucccugaggaccccaacuucacaccagacuucaaaaauucccacagauaaauuuuaagauauauaaguuuacaaugaaaaaaaaaaaaaaaacagaaacgaaaugaaacaccaugaaugagagucagcagaagaaaaaaucaaacagggaggugaacucagaaauacuuuagauacuggaauuaagagaagcucaauauagaauagccauauuuaauacacuucaagaaaauuuuaaaguuugaacaggcaaguaaagaggaagauacgauuaaaaugacuuaucagauaugaauaagaacccaacagaacuuuuauaaauaaaauaauaauaauugaaguuuaaaauucacugaacaguuuuaacagcagauuaaacacagucaaagaaacaacuagugaacuggaagauggauuccagaauacaguacagagagacaaagugauuuaaaaaaaaaaaagguuaagagauaugaaggggagugagguggucuacuacuggccaauaaaaauuucagaaggagauaaugagacugaagugaaaucuuacgaaguauuaacugagaauaaucuagaacugaugaaagacaccaaaccacugaguaagguagcucaggcagaaaaaaagaaaccuauuaacauauccuagugaaaaugcagacuagagucaaaggaaagaucuuaaaggcagccagagaaaaaagacagauugucuuccaaggagcaacaauucaucaucuucauucucaacgguaacaguggaagccaaaggauaguucaauaacauuuuuaaugugcuaagaaaaaagaauuuugauaaccuaaggccuauaauuuuauaauugguggaaauauuuuuuaacaugacaguaaaauggucauuugcggacaaaaucugagaguuuuucacugaagaaaauuuaaaugaaucccucagucacauaaaaagguaaucccagauguaagaucugagauaaaaaagaaauaacaaaugacaaagaggcaaaugggugaguaaauuuaaacaaauauugauuguauaaaacacuaccaauuagugaguuaaaaauuaaacacaguucaacuaaaauauacaacagcaaaguacuaagucagggggagaauaauugaaguuaaaguguucuaggaucccuauuuuauuacagauauggguagauauagcaauuacuucugauauauauucauuuaaaauguucuagguuaaccuuuccaaggaugguaguagaauacauaacuucaaaaccaguagagagaaaaguagaaugagaaguaauaaucuaaugagaggcaagaaagaggagaaaaauaaauauuacagauuuaguacaaguggaaagcacaaaauacacugcuagaauucaauccaaaucuauuagaaauuauauuaaauauaaauguauuaaauauaaauguauuaaaugauuuuuuaaaaacucaguaauacaguguuuacaaaagacaaaccugaaauccuacgguuguaggauuaaaaagaaaaggauuuaaaaaucugacaucaaagucagaaaagaaaaccacaccaguauccuuuaugaauauaaaguacauucuuuuuuuuuucuuucaaucagcuuuccuagguugaagacacaaacauucuuaacaaaauauuagcaaaccaaauccagcaucauauaaaaaggauuauauaucaugcccagguaggauauauuccagaaaugugagauugguuuaacaccugaaaauuaauguauuauaccaaaucaguagaauaaggaauaaaaaccacaggaccaucucacuagacacagaaagagcauuugacaaaauccaauauccauucauaaugagagcucucaacacacuaaaaauagaaggaaauauucucaacaugauaaaaggcaucuauggaaaacucagagcuaauggaaauugauugaaugauuuuccccagaagaucugcucuagcacuucuagucaauauuuuuuuugaaguucaagccagugcaauuaggcaaaacaaagaaauuaaaggcaucugacuggaaagaaguaaaaauugucuuuauugccacaagacaugauccuauauguagaaaaucuuaagaaaucaauagcaacaacaaaaauggcuaaagccaagaauagaaaagucaguuuacaagauugauauaaaaauuuaauguuacuucuauauacuaguaaugaacaauuaauucaaaaugaaauuaagaaaacaauuccauuaacacuagcaugacaaauaaaauauuuaggaguaaauguaacaaaagaaguaccaaauuuauaugccccaaacugcaaaauaucacugaaagaaauuaaaguagaucaaauaaauggagggauauaccauguucauugauuacaauacucaauuuuguuaaguugucaauuuuccccaaauggaucuauagauucaacacaaugccuaucaaaaucccagcaggcccuucuuuuuuaauugacagguugaaccuaaaauuuauauggaaauucauaggacuuagaauagacagaaacaauuuguaaaaagaugaacaaaauuagaaaacuuacauaauuuaauuuuaaaacuuacuguaaaccuacaauaaucaagacaguauaguauggguuuacagaaaggcauauagacuuacagaaaggcauauagaccaacauaauagaauugaaaauccagaaauaaaccuauaaauuuauggucaauugauuuuugaccaagaagccaugauaauucaaaggaggaaaugggguauuuucaacaaauguucuggggcaauuggauauccauaaguaagaauaaaacaaaacaaaucuagacuuuacuucauaucauaccccaaaauuaccucaaaguaaauauagaccgaaauguaagagcuaauucuauacaacuucuagaaggaaaaaaacccaaaacaaaacaggagaaaauguuuauggcuuuggauuaggcagaguucuuagauaaaacaucaaaagccugagccauauaagaaaagacaaauuggacuucauuaaaauuaaaaacuuuugugauuuaaaagaugugauuaaggaaaugaaaagacagccacagaaugggagaaaauauuugcaagucauagaucugauaaaggacuuguauccagaacauauaaaaaacccuugcaacucaauaauagaacagacuacuuaauuagaaaaugggcaagagaguugaauaaacauuucaccaaagaagacuaugaauggcuaauaagcacaugaaaaguggcucaacaucauuagucauuagggaaaugcaaaucaaaaccacaaugagauaccauuacauacucacuaaaagggcuaaaauagaaaagaccauguauuugcaaggcuguggagaaaguggaaccuuuauacuuuacuggugagaaagcaaaaugguauaaauccuuuggaaacaguuuagaaguuucuuagaaaguuaaacagaaauuugcccuaugccuucucaguaauaauagaucaagcagauaaaaacauuccaaugagaauauagaagauuugaacagaccaacuaacaagcuuguuccaguggauaugaacauaacacugcacccaacaaugucagaauauaccuuguuuucaaguacagaaggcacauuuacaaaaauugaccacauuuuugccguaaaucauauuucaaaacauucuaaaggauuaauaucauauggauugcuuucucugacaagagggcaacauuaugagaaagcugugcuacaauuauaacaaugacaaaaaccacauugcuacagaacuccuaggauaaacaagagaucauaauggagauuagaaaaauacuaaagugaaugaagauuaaaauuaaaugccauauaucaaaaugugggagauguaguuuggaugauauuuaaaggaaaaauuuauaaccuuaaaugcauaccuuaaaaauuuagaaagccaugagauugacagugguuagaaaaauuaaaacgaaaaggaaauuuaggaagccugaaaauuaagaauuauccucuucuuaauuuagagagguuagagaaagaacaguauauuaaggccaaguaaauagaaggaauaaaauaaacagaagugaaugaaacaaaacaaaaucacaauagagaggaucagcaaagccagaaguccacgaaacauuuaauaagacaggggaauagugucaaguuugaccacuaagggggaaaacagugaaggcacaaauaaauaauauugagaauaaaaaaugggacuaaaugcuaauggacggacauuaaaauuauaauaaaugccaaugaacauggaaacuaaaaugaaauguauaaauuccuagaauauauaacuuaucaaaacugauacaagaagaaauagaaaaccugaacaguccauaauuauuagagcgauugaaucaggaaugaugaaucuucccacaaagaaaacaccaggccuagaugucuuuaccuuuaaauuccaccaaacauuugaggaaaauaaaauucuaaucuuauacaaaauaucccaauauaggaaaagagggaacacuucuuaaguuagucugugaggcucacauacauuugacaccaaagccugaugaagaccauacaagacaggaaaauuaugucauguauguaucucacacauaaauacuggcacaaaaauucugauauauuaaauauuaguaagugagauuucagcaguguuuaagaaauaauauacaaugugaaggauuggugggugugaggagaggccggagaccgcauauauggcuggaaaaauaauccaaguaagagaugauaaaggccugaacucagcagggguugggcuaaagggagaggaugaacagcagcacggcggcucugggggugcagcucggggaacugcccaagacaaaaaagccuugggguccagcuuguggccugguugauggaggagucacacuggaaugagggaaaggguagcagugucugggggcaaacacccaauucugggaggcugggccugccugcauccuggagguuggggucaugcacgaagcuugguaaaggcaugggcagggugugguuuugggaguccuggguuggggggcauucucauccuggaggccuggauucugcgaccggaggcagugaaaggagugucagguggugggggccccuucccgcccaacgcuuucugaacugcggcauggaaacccaggacuccccuguguccggcucucagccaugaacauuuccggcaaaaacagagaagaaagaaacucucccagcccacugugcuccucauaucagcaaaagcaguaugagcuuagcuugcaaaauaaacagggcccaacguaaacaguguggcagguccuggagaccaagcuaagaauacuugcugggggaggagggcuggagcggccucugccaucgauuccucagaaugucugggguaugcagcccccacacagacugccagcccugugugggacuucaggaagcccaguggggccagagggggagugggcagggccagcucucuccggaccucucccgaccgccugcauuggucccuggcccacacugaaggcccugggcccugcugcuggugcccccagccugccccuggccucaacccuccucagccucuccauacggacuuugggugauaugaaaccccuccuugcucucucuaccucaucucccaccccugucuguguccuccuugggaccagcucuucaccuaacuagcugugugaccucaggcgaccacucagccucucugagccucgguuuccccaucuguaaaagaggauuuaugugggcauuugagcaaauaagaguccucuccaggauaaagaagacaauaaucuaagaugaaaacagaaagggcaugaggcagcuuuugugacuuuugacccuaaggacacaagcaggagucaaacccucucauuugacaggggagggaggcccgcaggaaguagacucgcugugaggaggccccuggaucugcggguguggguggguuucugcucuccacacccuggagugaggcagaaccuaagccaccaggacaggcacagggguggaagggaucccuggaauggggacguccugcaagguaguugggaggucuguguuggagcagacacugcacugucaagcaagaguuuugacgagcccgcaggacugugacgagaagggagacccccagaccccucucuccaaugugggucccuggccaggacaccaaggaagaagagggcucccugccagggaaacugaggcagcccugaacaagcucagcuggccugcacuggugaacucccugcagggggacacucuaggccucccuggaggggugccagccagcugugcaucccggagaccucucauccuauggcuaggcaagcuggccuggggugggacucacugcacagcccagcugaggggcugagcugagcugagaaaacaguuggaggcuggggccuugacucccuuccggcaggcagccagaccagcgggaugaggugggggagggugcugguagggaaggccaggggcucuggcugggguuggcagggccggcgggcauuggcaccgcugcacgccugcugggccuccgagggccgggcggcugcuggauuuccugccccuacuucccgaagucagcaggauugcgcuugggguauuuacggucccgauggcugcacugauaacggagaaaacucgagccaggcugugccaccaagcccuccaggcccagccaggcccuuuccuagggucugucccugaggggugcaccagucaguggcagggcaaggaccggguaggcuaccaccuacccaccuaggucagcacagcucugucaacuccuugaugggcagccagguuccagguagaccccucagcggggcugagauuuagugucgacugugggugccacucaccaccucagagaccccaggcagaggacucgaauguaauggcagggagccagggcccaccagggcugugcaugcagaaucuaccagaauccucguggccccggcucagagccugacagggcaccaggauguggccccagccuuguucuuaaaccuugcccuagggaucagggacuccggaaaaugcuucccuuuguugcucagaugugaagaaauugggugcauaauuuugugccuucaaggccagcgcuggccccucugcaggcccccacaccgaccuuggcugacugaggacuguguccuuguucccaggccccagcaggcugcuggacggcugcugugcacgucaggaaggggccauugcacuucaggaggcccugucugccacccaccaucacccccgcaggaugccagacuccaggucugggcuuagaggguggccugucccauggagcaggggcagagccguaagaaaggucugggacaguaguguaggcaauggaaccagagcuuggcagggaguggcggggaaaggcgggggcuguccccagccugugcuguccagaaagggccaccgacacuccugcacgucagggauguucacgccccgccugccuggcugcagccgagauggaagcaggaguggaggcuggggaacugggugccacucccugucucuaccacggcuuuccuugaugucuagaaacuccuggccaugccaacaacacaggguacccggcccugcuguacugggugugccagccaggagucacccagcccuugcgcaaagagaaagccagggaaacaccguguuccccgggcagcagagaggccaaggcuucugggccucugagcuugccaauccugugagcugaccucucccgggucuugcuuccuguccugccagaugggcgcuaucucccacugggccaucugccuggcaaaggucugcaccagcccugcucaggucugugcugacagaggguggccaggcccaugggacucaggguacuguggucacacagccccauggggccaggcaccugaacaccagccuucgcucuuucugcaugacccaauuugcuggucucagggccccacggccgccccaggccaugggcagauggugccagguggggagagggugacgcugcagguccugggggccaggacggguggggcaggagcaggagccugggccgggcugugccugccccgccugcccggcugcagccgagauggaagcaggccagagccaggcguugccagggaaaccgggcggcagacgcacucccugcccaacugaaacuccucuauuuuuagccucucagcuacuuucagauaaaguccauguagacggacuugcuguucggcaagauaacagcccgcuucaaaccacagagacuucaaagggcaguggugggcucagccaugggcccgagaaaggcccucccaccgcccagaucccccggcagcucccagggugccugggggagaggcuccggccugagggaccgagugaugggcacagagccugguggggagugggggccugguggguucggggugaacagaagaugccucucuucccaugaacccaucccagcugggcccugcaccucccugagcccucggccggccccaaguggaggccccagacagcugggcccaggagaaggcugggaugugaggccagcuucugccacccuccacucaggacacagccaggaggcucgcagagcacaaagcagacuacgagaggcagcgggaaagagcuggggggagggggcacuuggugccaccugccaguaaagacgccacuugucagaggaugagaaaccagccuggccuggcuccuuccaugggggaccaaugccccgccaggugggcagugggccugggccccucuugggaguugcugggcaggcugcaguaggcacuggcgggaagguggggaggccugcaggagcuucacguucacacgcagaccacagggaggugccugcuggccccaggacgcuaaccagaaccaccgcaggccggcgcgugagccuaccuugucuucuacucgguucaggcgggcgccgaucguguugcugccgcgauccuugcucuuuucuaugggggauaaaacacccaaaucagggccaagugcuggggugggccggggaccccagcugggcuugggaaguggggugguagggcugggggagguagcugagagucaaaaugccuaaaccuacuaggacauuuuuaaaaagcaugcuaugacaaaaauaccaggggugguacgguggccgggcauggcugcagcuggggaccugggcuccauccugcuccacgcucuccaccucugaccucugagagcccuagggggcugccuaagcuggccacacugccagcugugcaagcccaugccauuccacucccagggcgacacaggccugacuccaggcugggggcacagccauuccgcugcuccguuacaccagcccacacuaugagccguggcugcuguuugcaucugggcuagggaaaccccagggaaugugccuuuucccugucauuccccggaaugacucacagccccguguccaggggacccaaggaauuuggucaaggagccagaaaaccagcccccaggcugcagccaggugcuucugucccucucaacuugagcccugcaaggcccccacccauagucucuugaauucugggcuggcagcucaccccacccaaaccccaccccaggaucacccccuucugcaaaguugcccuggguucauguuuccacaccuagagccuaaccucaacgcccuggaauuuaaagggacccagguagguucuuaugaaaccugaauauuccuuuguaaaauguacuuuggagccacuuugcuaaggguggggucuaccuccccuuacucccuggcuuucauuucaugucaugcacuuuggaggugcaauggcccauucugacaucauggggagagccaggagggcagaggugcgggagaguccauugcaggcugcugggcccagaguaacugacacagaaacccaccugagacggagaugaacagugagggcuucccaauggacugguccagccuggagagaaggacacagacaccaguucacaccuggcccuggcacugcgcagaugcacugucgucugugggacagacagcuugacgugcccggcaagacaguggacuguccacccacucuggggacacccccgacccuaaggccugccaggucacucccaaccccccagagggccaugcucccgagggggcugagcagggaucucggaaagggggagucggugggcugccucucagacuuccucccuggggguaggagugggaggcaguggaucagccaugggcaaggcagccugaccccucgccuguggccaggauggacacgggcucccagccaugcccuguaacacacggagcuaguucccaggcgagcccaucucggaggcacagcugcucugagucugugcaggcccgggaggauggugcuagcuccaugggaacacauuagcuccccacagucagggucuccagcuccaggccagucugggggagacccgugcgguggggccuggcaccaggcagugucuucccagggcugggccuggccccuugcucagaggugacagggaaggcgggugggcuggcugccgaguguccugaaguuguggggagugugaagcugguguugcuaccugagcagggacggaggcggguguuugccuccccuacgcgccuccccuaccccaauucccccaucaucucagauccgggcggggaacaagguagagcugccuggugggcuggcugugaaccguggccguggccagcugcccucccucugcagggcuggggguggugaggagaagggggugguugagaggcaagaacucagggucucagccccucccuccuccggcaccgcugaucaugcagcuggggccgggcugggcaggaccugggcacccuccccgcugccguuuggccgugcccaccuccucugcagcuccuugaugcgcaccaugagguugagguggcccugcgaguacugcucaaugacgucccgcacaucguaaggcuuccgcgcuugcugcgggacaaaaagacacgcaucacuucuccucccugugccccagccauguggcucaaagugcaggcagugacagugucugcccucgggaggcuugugaagaccugggagcucgccuauguggugauggcauaagccugguuccaagcgugcacaguagcgaagcuuguccccaucagcuuggccaugggucucuggguaguccugggccaucagcucggccucucugggucccagcuuccugucuacucaccggcaggggccugcugucuccucccuuccaccccccaccaccccaggcuaccaguucugguucucaauggcuucaggaagagcuggcccccccaaggggucaaggagcagcacagugccaggcacugaccaggaggcacagcucugcaugcccacuaccuaccugggccccagacugacccuugacaugcucacuggcugcagccgccacuguccucaggguagggagcgggucuccucugcaucguuccuggcaguuugugccaggcagcagggguggccccagaugacggccuuagccugcagcacuugcugugggugacgagcaucugcuugggcucccacaguggggcuggggccaugugaggcagggcaggggaccccagggcucccaggcuuguugccagcucuaagccuauaagugggacucaggugacaucuugaaaccacaacagagaaaacaaagcaucucaugauaucaggaaaccccaagccacauuuguggccuugcucccaagggccucacucagguggagcagccaggcugagcagggguuugauggccuaggaaggccuuggcccugcaggcaagccagcacauaggacaacagacugccucuaucccgagaggccacugggugaccgggugaggcccaggguagucaucauuagugcucaaauagccaccuuagcacugagcuaguggcuuuccugccuuuugcuggggaauuugcaaggcccaagagacgagccaagcggcuugguggggagggguggggcagggccagcccaagucagagggaggcaauugaggcccaggaugagaaaggaggaagcucagguaccguugagggcccgggcugggucugggaacaugcccucccugcccaccugcuaccucucuuugggguccuacuccugagaccagggugaccuuaaucugaggaugcagccacuucuacccugggaagcagcaaguucccagauggggagacccugaggucaggucuccauguacccacuuucagcucuagacacacuucugacaugcccagggguucugccaccaaugccggaggcuugguggaguucuuacagcccgcccaacauuguuuuggaccccaggaaucccaagacagggcagagaccuccucccuaccaaaggcugggccucagaaguucaggggguuccucuuccaccugacacaagcagguagggcccucacuggcaacacuagccacucucugggcccugaacgggagauccugagaucaggagggcugggauggggcccguguccucacaacacagcugugccccauggaaggaagggccugcugcuccuggggccacacugggcaccaggaucgccggcauugcccagaaaugacacaccaagaacugugauagaggcaggcaugggguuggacucuaggcagacccucuggcccguaaaaaccguacuuauguacaggcuaguaauaacauccucaggucucaguuucuccuguaauaugggaaugcuaaguccuucuucucucuucuguaagauaaaaugcugagcccugucucucucuuccguaaaaggggaugcugagcccuguuucuccuuccuauaagauggagauacugaguucucuucuaugaaaugggauguugagucuuaauucucuuuucuguaagaugggaugcugaacccugucucugucuucuauaagaugggaugcugagccuugauucccccuucuguaauaugggaugcugaacccugucucucucuucuuuaagaugggaugcugagccucaauccuccccuucuguaagguggguugcugagcccuguuagcaucugguagcaucucuuguaccugguagcaucuccuguaagauggagaugcuaagcucccuucuguaagauggaaugcugagccuugauucuccuuucuguaagaugggauauugagcccugauccucccuuuuggaagaugggacacugagcccuguuucucccuccuguaagauggagauacugagcuccuuucuguaagauggaauacugagccuugaucuuccuuucuguaagaugggaugcugagcccugauccccccuuuuggaagaugggauguuucuccuuccuauaggaugaaaaugcugagcucccuucuguaagaugggaugcugagcccugauccuccuuucuguaagaugggaugcugagcccugauccuccuuucuguaagaugggaugcugagcccuguugguaucuucuauaagaugggaugccgagccuugauccuccuuucuguaagauuggacgcugagcccugucucucucuucuauaagaugggaugcuaagccuugauccuccuuucuguaagaugaguugcugagcucuguuucuccuuucuguauaauggagauucuaagcuccuuucugcaagaugggaugcugagcccugccucucucuucuauaagaugggauacugagccuugaucuuccuuucuguaggacggguuguugaacucuguuucucccuuccguaugucccuucuguaugauggagauucuacgcucucuucucuaagaugggaugcugagcacugccuugcucugccuuaagggagggagugaggaugacauaggaugggaguugagaaaggucagggaauccuaagccagcaccaugccagagccagagucacagccagcuguggccgaagccucucuucagaacacauugaacauggcaugagucaugguggugagccuccugcagaccacagagcucugugaagcugaagcauggggcaccuccagccaucugggugcggugugggcaggugaagggaggcagggcaggggaaaaccaagcccuaggagucucugggccacugugaccagguggguguagguguguguguuagcagccucugcagaugcgagugcuuccaaacaggccuguugugggcaaggaaguauuauguaccugagugugugcacgucugcaggagcagggcugggugggccuaucagcagagagcucccugcaccuucagccacagccuuaccugguguagggcauagcccaagaaggcucagcaaugcccgcagaccaugaggacccacggcccgguggcaucccagcccacagagacuuauccuggagccacugagaugccugcuaggauacgguuagggcucacgggggccuuuguccagugguccucugggguugggcuggaaagaucauccugacuucaggagccugagaugagccgagauaaugcaggccuguccagacugacugaugguggacagggaguucaaggcacacuugaaggguggagaggcuccggcuccuugggccagacacaggggugguuggccaaggacuuaucagccagcaagguaggcagaggggucaccugccaugucagcagccccugaggccagcgggggugggguggggugcaagcaagcagacaggcaggcgucgaggaagggaagcauccugagaggugggcuaggggagccccuggagccacacacagcuccucacugccacgggcuacugcuccccucacccuggccccaccccuccaugcugcucccagcaauaagagccagcuggugaggucggagggagccccagcggcuuugugcaggagccucugugcccugcgaggauccugcuguugccagguuucugcaaggcucccagggccagggagcaguggagaagcagacagugggguggggguuucccagucugcuucaggaagccuccugggccauucucagggucccggccuguguccuaagacaggaaaggggacccacucccuccugucuggaagggagugcagggcucacuguguuccuccccagggaccagcuuuuucaccuguggcucagcgacagggccugcuggggcuggcgcagaugaucucucucucucucucugucccucucccucucucucuuuuuguauuuguuaauugcuuauuuaccaagagaaaccauuucuuggcccauauauucauguuucacaguucaggaacacaggucacugacaagcuucuagguaauucaacccaaagaaauucuuuauauuccaaaaucacuuugcacucugaaagaugccagccuuccucaucaccucaaaaucuuugacggcaucauaauaucuguagaaaucgugugcuuuuuuucuugguucagccacaucaaacuuacagagagcugcaacucccagguauucaacgaaugcuccaacaacaugaaauugcagacgcuuggccaggaggcuacgcaucugagguuucaccacaagacuggaagccaugguaguuauuaucacgaugggauauccuugauaucaaccucaaugccaguguccuuccuggcugauggagaaagggauggcuggaugaucucuugaccugagcuggaagcugcccacaccaccccuggagcuaggccugcccaggagccaucagggucugcaugcucugcuggguucccccagaccuuggaagcagcccccaggaugcccaaguggcgcaguucugcaagccuuggugggcucuggcucugcccugcugggaccugcucugcacccucaggccagacaccagccccacccugggaggcucccugugucccucugcucuacugcuggggugacgucagcugcuucggcugucacgaccaugcuguucuccagcgaacugacacacccuggcccuucccauggucuccucugcccucgggggacugcccugcccagaucugagucccaaagggguucacgcagccccuucccugucugggagagcacuggugcugccaggaggcuggccucucucuuccauugcccccgagugagcucccugcuccagcaaggcccuccaugccagcaccagagagaggagacggucccagaauggagacacccugguccacaggggcugucagaucuccccuagaacaugccaggcagaucuccgggcacuggccagcaguggcauuugccauggcuuuuauuuugacugcaagaggucccaggcacugcugggagcuuugacacaacuugguucaguugagucaugaaccacccccuucccuggggggaugcaggugggagggccagcugagaaacaccacugugggagggcugugcaugcgaaaccccccuggagaugguggcccgguggccagaacgagggcccgcauacugcucuuggcaagggccuggccgagggcugcucuuggggcucagagugacgacgagccuagcgggugcuggccugggguugcugggggcaaggcccgggugaggcacgugcauaugaucuuaugccaaacccuuaggcucucauuccccucacagcuggggaagaacuugcccagggcugccugugccagggucugcacccagaccgcccugugaagucuggaggcugagguggcuccagggcccagaugggugggggcuccaccaaggagacugugggcgggccugugucaauccuggggccuggaguggaagguguggccuggugugaaagacauggcugcagggggaccagacuugaaugccacugucaguccgucuggaugggcugugcauuaucuuggcucaucucaggcuccugaagucaagaugaucuucccagcccgacccaacgaccucuugacaaaggcccccauaagcccugaccagacccuagcagggagcucaguggcuccaggauaagucuuggugggcugggaugccaccgacuguggguccugguggucggcggacauugcugagccuuccugggcugugccuuaugacuggugaggcuguggcugaggugccaggggcccccagcucagaagccccacccugcccugcuccugcagacacgcacucacucaagcacgucacacgccccccgcuccaagggacucaggcaagucaccccccagccuucccugcuuugugauuuuugccuucuggaucacccaccacagaggauacgggguucccacaccuacacauguauuuccaagccaggacucaguaccccccaccaccgccuucauccgaggaauguccccaaggcaggaggggagacaugccugccaucaauggcauucucugcggggcauggacucugggggcucuaaggggcuucuguaggggggacaugccccuggagaaguuagggcagcuuauggaagcccuggagcuccagccucaccuggccaaggggaccccaccucuuacagagcagggcccagccucccuccauccucccaacucacagaggguggaggagcagggaaugagagcacugagccaguggaggacagggcuggggggucugggggaccugccuucccagcuuggugacucagggcaggcuccgcaccaucucugagucauucugaugucacccucacaucucucacuaaugcugccuugcacgacccaccccacgggaggacugagugagcuacacggcugcugccuucuacuuggugaagaagacacugcaugugucccugguuccaggccgggccuccaaggauagguccucugaggggccugcugucugggguucggugggguaggcacugucaggucucagauaggccugccuguguggcuugggggcggaggccuugacacccuccacuaugggcaggagagaacccaggagaggugugggcagcugcaucaggcugcgaggggcaggcugagggcaggaaggcucagcacagggcuuaccuggaauuucuucuuggccacaaaguacugcaugcgucgaaugaccuuaaugguggcccgaugguguucccgcagccugcaguggagagaggagaggagauugugaguggccacccugugcuggucauccccucacugccccugcacugccugaggagcacgcagacuggauccuuccagaaacaaggagaguguucaacuccaugggauggagauacuuaggccaugucccagugugggcucgaggggaggcugggggcaagaggcuuuucaaggugaaauguuucaccucaucugugagugggaaggggacccuuaccuugagugucauucagaagggggucagguaggagucagggcccugaguuggccauggcuaugcugcugacacauggcagccauagcaacuucuuucuaugcuugggccuucaggauccuugucagcaaaugggauaagaggguacaugcuggcgaugcccacagccccuuucagcugcuguguccuguagccccacaaacagcaagcgcuugggaaaguaggggcuacaggacaaauuaacaagggaaaguugccaccagagccacucuguuaagggggcugcgcuguuuuugccuccuaaaguuucuucuagaaauaaagauccuuuuagaaacagcaucacaaaaggaaacaaaggggaugaugugucugugcauagaaaaaagacuggaagaaaacacagcgccauggaggccacaggagauucccuccuggcagugaagcuaacgccugccugacuuuccugauggaaacaccagggacugcgagacuaagugaugccaacagcaaggaacagcugugugaggcuuuggagaccaagaaagacauagaaggugaggaucccacauagaaaggaaaugaacugagcugcgccugcauccgagcguuuccuccucagggcacuugucaguuuggggagcacugacacccaacagggugggggcccagugggcuagugauaaaaauguggaguccagggccacaggacagccaggacacgagggaaaaagauucugguccucuagccaccuuucacacaacuuccucuggaaacacuugugaauuccuaagccacacgggugggugagaaucacagaaacugagcaaaaagcaguugcugaagggguaaaagcuaagcagaguacucaguagacgcauggcacuguggagagaagcuuugggguuuagaagcuaucuagaaggcagccccagaaacuaagcaaugccaacuuuccaucacauuaaccccaccucucucaauccccuacuggaguaaggugcuuugcgcguggcagaagaaaauaaaauuaucuguagggagauaauacccucgagcaucuacaauuuuauacacgaaagacuaaaaggcaagggaaaagagagaucauacagaucuaaaggugugguacuuccaacagccuuaaauacuugcagcuccuuccauuaagagauggagucuguuuuccuauuacuugaauuuggggucaccuugugacuucacugaugaaagaguacuggggaauguacacgguauauaauucauguccuuuuggaauguggcccugcaaacaagcuugcugauuagagaggccacauggagaagagagaggccucagcuaacagccagcaccaacagaacaaccuccuagcugaaccaaguccaaccuccuagcuaagcaaagaaaaaaaaaaauacacacacacacacacauauagauggagucucgcucuauugccaggcuggagugcaguggcacaaccucggcucacugcagccuccgccucccggguucaagugauuuuucugccucagccuccugaguagcaggugcacaccaccaugcccagcuaauuuuuguauuuuuaguagagacaggguuugaucauguuggcuaggaugguguugaucucuugaccucaugaucuguccgccuuggccuccaaaagugcugggauuacaggcaugagccaccaugcccggcccaaagaaaauauuugaagccacuaaauuuaggucuaguuugcuacgcaacaauagguaacugauacagaaauaaggacuaagaaauagguaaugucauaucaauauccuaaaacuuacagcauuaauuuugggacaaggaauuggacagaggcuggaaggggcagaucacaagaugucggacuuugagcaugaugccacauguaauugggugagaauuuuagguaucgucgggaggggggugagugaauuuugcauaggggagaaugcgaaaaguuauggccagagggcagacugugauuaauuaaagaugggcacaauccauugugguuccucccauugcaggcuagagucuaucuccaccaugguggaaaugaucaugucuucugaagcucagccucaaggaccuuguggcaucuacucuuacccucuuagaauucuguuggcucauggacaagucugagcuagccugcuggaacagccgcgugaaggagagcugagagacccuggcugacaacccaguggcuccagacacgugaggacaacagagaccacucagccaccaccacaucaccaugcaaguacugccaugucaucgaauccaagugagaccacccaacugggcagcccagauugcugacccauagauuugugagcuaacagaugauugugcuuugcuucagaauauuuagaugaagacuucaaaauaaccaugauaaauagguucaagaaaauagaugaaaagauagacaauuuuaccagagaaauaaaauuuauagauacauaaaaaggaaguuccagaaaaguaaggaccauaauggaaaugaagaaugcaauaggugaguuggauagcagggacgacagaguagaaaagaauagcugugaacccaaagaaaauagccagcuuggagcaugaaaagaaaauagacuuaaaggaagagaugaaacaaaugaaaaagaagcauaagaugguagauugcauacauuauaaguggauuaauagucuaauuaaaagaucaagauugucaugauuaaaaacaacuauauaaauccacuuuaaaauauaacgauacaaaaacauguugggaaaggauagaaaaagauaggucaugguguagccaaaugaaaacuaguaaaggaaaaccaauagcagacuuuaaguauuacuaaagaagaauauguccuauuuauaaaagugucaauucagcaggacgagaucaauucuaaauuuguaugcaccuaaaaacauaaccuuaaaauacauaaagcaaacuggcagaacuaaaagcuaaaagagaaaauggugggagauuugaacacaccucgucaguaacugauagaaaagcagucaaagcuuugucaagucagagacaaauuugaacagccugauuagcaacuugacauauacagaacacugcucccuacaacuggagacuacauaagcuucccuagugcacacagaacauguaccaaaagagaccauaugcaagacuucagaagcaaguuccaacaaauuucaaagcaggcaaaucauauuuauuaugcucucugacuacaguacaauuaaauuagaaauccauaaaaagagauaacuagggaaucuccauguauuuuggauauuaaacaaucuaaauaacccaggggucaaagaaaaauauauaaugagaaucaaacaacaguuuaaauuaaauaguaauaaaaauguaagguauuaaaauucauagccaaauagguacugaaaguacagugaaauaagcacagacagugaaccucguggcuuuaaaugcauaucucagagcagaggaaaggcugaaauccaucucaagcgguuaaaaaaauggcaaauuaccauuugccuccuaccaaagauaguaggagggaagagauaaaguuaagagcacagucuaugagauaaaaaaugaacauuauuuaaggaaaaucaacaaagccaaaauuugguucucagaagagacuaauaaaacagacacacuuuugggaagacugaucagaugggggaggggacacaaaugaccgccaucaggaguuaaagauggaaugucacuauagaccuagaggugcagaaacauuuauucagaggacauuacaaacaaaaauacuuuugaugauuuagauaaaauauacaaauuauuuaaaaacacaguauguaaaaguagacacaaaaacaaaaauaauccaaauugcccaauauuaauuaaauaaguuaaauuuggaauuuuaaugaucuucuggcaaagaaaacucuguaucuagacgacaucaccaguaaauucuuccaaauguuuaaggaaaaaauaaugucaauuuuauacaaguauuuucauaaggcagcauaaccuugauaucaaaaucugacaaggauauuucaagaaagaaaaaaaaaaucacagguuaaucucucucgugaacauacgugcaaauauccuaaccaccaccagcaagcugcauguagcacugugcccaaacacaugcucgaaugugguuuaauccacuugugcaugcugaguuuacccucuaaggaccaagcagcgucacucuucacaucaacagaauaagucagaaaaaauacaaucaacacaacagauuguaagaaagcauuugauaaagcgagaccuguucauaauuaaaaacacaacucucagcaaacuaggaauagaaacuccauuaccuaaaaaaaaaaaagacaaaaacuaaaacaaaaaaacccaaacccuaagcagacaucauacuuaauagugaaaugugauacgcuuuccuccugagacaggaagcaaggcaaggauguuaucguuucuauuucacauuguccagaaacucccagcugguauguuaaaaagguaggaaaagggagauaaaagguacaaggauuggacaggaaaaaauaaaacauuuguuauuugcaaaugacauaaccauacauguaaaaaaaaucccuaagaauccucagauaaacuguuggaauacaugaauuuaacaagaacgccgguuuuaaggaugauauauaauaauuauauuucuaggccugacagaguggcucacaucugcaaucccaguguuuugggaggguggggugggaggaucacuugagcccaggaguuugagaucagccugggcaacauagugagaccccaucuguagaaaaaauaaauuuaaaaaauagccaggcuuggugguguguaccugugcuucuugcuacucaggaggcugagaugggcggacugcuugagcccaggagcucaaggcugcuguaagcucugagccuggaaugcagagacccugccuuuaaaauauguauauguauauuucuauaugcuaguaacaauuagaaaauaaaacauaucaauuacaauagcaucaauaaccauaaacuugaccagaaacuuaagaauaaaucuuucaaaaaaguuuuuuguuucuucuuuacugucuugcuuucacaaucuuucuuucuuucuuucuuucuuauuuuuuuuuuuuucuucuaagauggggucuuguuauuuugcccaggcugguuucaaacuccugggcucaagugauccucucacuucagccucccaaguaguugguauuacaggugugagccaucguacccagcucuaaaauaaaucuguuuaaagauguguaagacugcuacacagaaaagcacugagcauuggagagacagauaaagaagcccuaacuugacuuggggauauaguauguucauguauaagaagacucaauauuuauaagauguuaauuuucugcaaauugagguguggauuaaauaugauuccaaucaauaucacagugcuuuuuguuuguuuguuuauuuauuggaaaccgacaaggugauucuaaaauauuccuaacaacgugaagggccaagaauagccaagacgaucuugaagaacaacaaagucagaggucugacacuccuaggguuucaugaggccacagggcuugauuaagagcgugugggcagacagaugaacagugggggucugacggaauagggcagugguuccccaaccuuuuuggcaccagggaccaguuucguggaagacacuuuuuccguggacggggugggguggggggagaugguuucaggaugaaacuguuccaguucagaccagcaggcauuagauucucauaaggaguacacagccuagaccccucacaugugcauucacaacaggguucgcgcuccugcgagaaucuaaugccaccacugaucugacaggaggcggagcucaggugaucacguucacuugccaaccgcucaccuccugcugcacgguccuguuccuaacagucuauggauggguaccggucuguggccuggggacccguggaauaggacauuagacacacaaacccuccuguggccacugguucauagaaaagacgccuuugccgucgagcuggcggaaggauacgcuuuucaauaaagggugcuggaacaauguggaugcaccugugaaaguaugucaaccaugauccuuaccacacaccggucacaaaguuaacccagggagagucacaggccuaacuaugaggcaaucgggccugucgaagaaaguuggauaauauuuucacgaccugggaugggcaaagacgucuuuaaaggaacgcaaacaguaugaacuguaacagaaaacuauuugacaaauuggaggccccaagaucuccgugauggucucaugaaggccccccucccaggccugacacacgagaggaacuauuacccuggccucacguccuggccucuuuccaucaccccaaacagccugggagcaggcagggaacggggagucauaggugccugaccgugaagggucuaccacuggcugucacuuagggccuugggagccuguggccaugaccgccaaggucuggaugcggccccacauccagugagaacacucggggcuccucagauccuguucugcacagagggccaugccccguggcugcuucacaggccgcuagaagcugcugcgggccuccccuccugccaacucccuagaacacagccggagccuucacaggcaaacagccggccgggacugcaagcagccagggcugagggugccagcccaggcccccagcucuguccaggccaugcugugggucagccacugcucuggugacagcgcuggcuaccuggcuuuucugcugaacacaguccacccuguggucucagagagaagggcccggcuugcuccuuugcaggggguggugucucucucucugucuugggcgaggccugggauggggccaaguggccuuuccugguagugauacggaagaggggcagggaagugcugggaggagaagggcgggucccuggcuaggguuccacccuacggccuaugugcacggacccaggugaggacagacauuucgguguuucugcccaaauguugcauuucccgagaacacccuggccugccaugcucccaucccgugccuauaaagaucucgagaccuuagugggcagacacacaagcggcuggacaucaagaggaacacaucggcagaagaagacacaagcggcuggacguugaggguaggucgagaggaacacaccagcguaggagcacaccgacaggcaccaacaggcaccgacaggccggcagaccauugaccggaggaacgaugaaggguuuggcugggguggacgcaggagagcccaggcugcugagccgccugaugccaggggaaaaccacccucccacuccaucucccuucuugcucccccaucugcugagagcuaccuccacucaauaaaaccuugcacucauucuccaagcccacgugugaucugauucuuccaguacgccaaggcaagaaccucgggauacagaaagaccucugcccuugccguaaggcagggggucuaacugagcugacuaacgcaagcugucuauggacggcuaaacuaaagagcacccuguaacacacacccauggggcuucagcuguaaacauucaccccuagacgcugcuguggggucggagccccacaaccuguccgacuguaugcuccccuagaacuuugaguaguggggcacugaagaagcgagccacaccccugucacauguccugcaagggggacaaggaaaccuuucccauuucaguagcacugaugcaggagcgagcugguaagagacagggggcaggacggaggccuugggcucacugggccgugaaggaagugaccccuggacccugguugcaggaaggcacugagggcccggggcuggugcccuccugccugggcugggccacccuccaggcccguggcuuccucaccuacugaagggcggauggacccucucccugcccgcaccacccagcuugggagaggaggaagggacgugcugcccagcgggggcuuggccgugggucagcugcugagaaaagacccgcuucauucaucuccucacucauucaugcacccacugaccuguaucucaccuguucauucauuaaugaacaaguuauuguuaauaauuuguagaugaaugagaugagcuccccacccccauccgcugguucauuuguuaaugugcugccuaacuuacccauuagcuccuccacgcccgccugcccgccugccccguccacguacaugaagugccgcugggcacacagcccaggcugaguggucucaggggcugagcccacugaaggagccguuguuucuggauaggucaaauucaaagccaggagcccccagugcugcccaggcugggcuggcuggggugggggcugcugggcugcccaaggggccagcgccacauucaacacacgucacugggggccaucgaaggacacugugggaaagcagaggcaggaaguuucccggacugggcugcccauggcgggccgaccuucccaccuguggaacagauucccagcagcucagcggccuggccuccauccaggcagauccugaggcccaggguaggggcuggcaugugggagggcuggaggugacuccaggggguccuggggcuuggguccaguacagcucaggguggggcugggccuggagaugcccaggguggaggaggggcuggccucaccugugucccugagccuucagccccucccaggaccucuguccccucucccccagccagacaauuaagucagaugcaagccccuuguauccacccugccuggacaagcucucggccccuucuggaggauccucuaacucuggaauaaggaagaauuuaucagcuuugccugggaguggagauggaaagaaaauaaggaaauaagagcucgcucccuuccuucccacaugcuggggugucgcucuuugcaacucccucccgcgcagugaggucccacaccugugcguccuaggagacacagagcugucuucaaaggcccgagcuugggggacccucuaaguggccacagcgccuuggggaaggaacauccccuggggaccccugcccucugcacacaugcaggcuugugagaugaagagaggcagaugggugggggucuuggcagaggaaacccagagugcuggaggacccaggagacaugaagagggaaacugaagucacucuacgucacaucccccuagcagccaccucguaggcaugagggccuugcaggccuuccagacucuuccuugagcacuuaugucagcagacacaagcacaucacgugugugguuuccugcaccucccaguguguuguuuugcuucuuuuuauuuugaaacaauuauagacuccuaggaaguugggaaaaaaaaaaaaaguaccaagagguccuguaugcccucuacgugaguucgcgacggucacaccuugcauggguggaguaacagaucaacgccaggagauugacauugguacagugugcguggcucugccuuguguucacacgugcagauucacacagcaacgaggaauggaaguccuccccaccagaaagacccccucugcgucuccugugcaagucacucccacccucaccauucccaaccccaggaaccaccaucugaucuccaucccuacagccuggacuuugagaauguuaucuauacggaaucacacagcaugcgaccuuucgggggaggcuuuuucuccucagcacaauucccguaagauccgcuuagguuguaccgauaguggguuccuuucuacugcuggguaguguuucaggguagggaugcaccacuguuugccuguuccccuguugaaugauacauagauuguucucagcuuucagcuaguuaggaauaaagcuucuauaaauuuucauuuaguuuuguguaugaauaugagucuucguuucuuugggauaaaugcccaggaggaguucaguugccgggaugugugguagucgcaugcugacuuuuauaagaaacgaccacauuauuuuccccgagugcugcaucaguuuacauucccagcagcaacagaugggcaaucccguuucuccacauccucgccaacauuuggugucaucauuacuuuucauuuuagccauucugauaggugcguagugaccgcucacugugguuuuaaucugcauuuccaucuuugcuaacgaaguugaucaucuuuugguguacuucuucccuauuuauuuucuuuggugaaaugucucuucgugucuuuugcccaucuucuaguuggacaggcuguuuuuuacuguugaguuuugagaguacuucauguucuagaugccaggugucaaauauguggcuugcacauauuuucuccaagucuauaguuugcauuuuuauccccuucacuggggcuuucacaaaacaaguguuuuaaguuuuaaugggguccauuucaucaauuuuccuuaaacagaucaugcuuuuagcauccaaugugagaacuguuugcccuuccuaaauccuaaauacuaucuccucuauguuuuuucuaaagguuucagaguuguacacuucauauuuaaguccaagguggcucuugaguuaauuuuuauauaaagugugagacuuaggucaggguuuuaauuuauuuauuuggccuaugaaugaccaacugcuccuguaccguguguugaaagaggagucuuccuccgcugaauuuugcaucuuugucuuaaaauuagucaggcauguuugcgugugucuauuucuggauuccucguucuguucuguugagcuacaugcuuauuccuccaauaucaaaucauauugauuccuuacuguauaguaggccuuaaaauugguagagugauuucucccacugaauucuuuuucaaaauuguuuuaaucuacagcaugugccuuuccauauagauuuuagaacaaguuuguccauguccauaagaaaucuugcuaggauucuuguuaggaauuaugcuauauuuauagguaauucuaaggagaacugaaauguuuacuauuuugaguuuuccaguucaugaacauggaauaucucuccauugauuuaggucuugauuucuuucauuggcauauuguaguuuuuaguauauacaucuuuacauguuuuguuaaauuuauaccuaaguauuuuaauuucuuuagcgcaauuguaaaugguauuguuucuaauuuugguuuucacagguucauuguuaguguauagaaaugcaagugauuuuugugugcugaacuccuaaguuccagauauuuuuauuguagauuccuugggauuuucuauauagacaauucuaucuuugcaaauagaaacaguuuuagauccuccuuucuaaucuacaugucccauuucuuugucuugucuuauugcaguggcuggaacuuccaguacuauauugaauagaaguggugagaacagauacccuugccuucuuuuuuauuuuagggggaaaguauucuguucuucacuauuaagugugaugugauguuagcuguggguuuuuuuuuuuuuuuuuuuuuuuuuuuuuuaagaugcucuugaucaaguugggaaaguuccauaauagaucacauuaauuaaguuuugaauguuaacuagccuugcauuaccuagaauaaaucucucccgguugugcuaauauaauuuucuuauaaaaugucauauaauuaguuuuuaaaaacaauguagaaagcucccaaggacucguuauucaaaauaaacgcuagacggccaggugugguggcucacaccuguaauuccagcacuuugggaggccaaggugggcggauugcuuugagcucaggaguucaagaccagccugggcaacacggccaaaccacaucucuacaaaaacaaacaaacaaaacacaaaauaaaugcuggacccugacagcuccaccccaacuguauccuugucuccccuauccuggguaaccaucaaccugaauccuguguuccucucucccuugcuuucuuuuuuaauauaauauuauugaaacuauaugugucccaaaagucauguuuuuuuuuuuuuuuuuaauuuuaguaauuuaaacuugauaagaaugcagugggcuuuuccuugguauuauauugccaagccuucccacaugguugucugucacucuggcuuguuugcuuuaauuaguuuaaaauucucuuuuguaugggcauuccauguuuacucacucucccuccugcugggaggcaaguggcugguugcacguggagcuugugaacagcguugcaacacacacuccuguucauucucacucguccacacaccagaguucccuuuugguguaugcccagauaugggacugcugggucaacagguaugugaauucaccaccuuggaggugaugccacccuuuuaaagugguagucccacuguacacucccaucagcaauguaggagagacccugggcccuacaucccugccaccgcucccaauggucagacugugguuuaugccaauggagugguguaaaugguuucuguaaauggugccuucacguacucacuggccacauguguuccucgaccaugaagggcagaacaagucuuugucuuuggccauuuuucugucugauaauuuguauauuuauugauucguuauuuuaguuucuauuagugauuuuauugguuauacacacacauauauaaauacauuauacauguuauguauuaguuauacauacaccaauucuuuaucaauucauuguauugugaauauccauuucuuugguaggcagaauaagggcucccccaaagauguccuagaaccuaugaauauguuacguuauauggaaaagggacuuuguaucuguaauuaaggucaugaacacugagauggggaaaucauauugaauuguccaggugggcccaauuaaccacaagucuuuaaaagugaaggcccuggccaggcacaguggcucaugccuauaaucccagugcuuuggaaggccaagggugaggugggaggcucacuuaaggccaggaguucaagaccaguuuaggcaacauagagagacuccaccucuacacaaaauuaaacaaaauuagccaggcgcgguggcacgugcguguagucccagcuacucaggaaguugagguggaagaaucguuugagccagggaguucaagguuacaguaaacuaugauugcgccagugcacuccaacccgggucacagagcaaaaccauacaacaacaacaacaacaacaaaaacaacaacaacaaacaguggaggcucuuuccuggcuguggucagagagagcugugauuacgaaaaaaaaugucagagaggaggaacaugauggcucugaagauagaggaaggggcuaaaggccaaggaaugcagacaaccccuagaagcugaaaaaggcaaggacacagauccuccccuaggaccucuagcccuaaugacgcccuccagccccaucagaccugggguuggaccucugaccgacagaagugaaagagaguaaacgucuguuauucugauguguguugggggucaccuguuaaaccagugccagaaaacuagugcaaucgccagucugcaacuugucacguucuuuaagguaucuuuggaugaugagggauucuuauuuuguaaaaucgaauugaccaauguuuuucuuucacagucaaugcuuuugugucuuguaaaauaaauauuucccuaugccgaguuauaaaagauacuaauaaacguauauuauccaguaagaguuuuaagguuugcuuuuaacauuuaauuccuagauccaccuggagucaguuuuuauagauugcaugaggugggggcccaacucuagcuuuuuccuucuggaggaugauugauuccagcaaccugcaacaccuccuuggucacaugccaaugucccacauuuguauggaucucuucagggcucucugucuuguccacugggauaaugggcuaauugucuacccuugugccuacacugcaacaucuuaguuaguauagccucuuccacauccugauaucuggaaggcagggcccuuccuugaucuucuugguuauuuuuauucaguucuuuauucagccauagaaauuuuagacucaucauguuaaguucccugaaaaacccacuggaggaugccugggcugcaggugagaggcugggguggugagaaagcccagcagaggcucuuucuggcaccacugccugugcccacugcaugggaacacacagacaugcaaugggcacaccccuccagggcccuccuccagauacauggcauggcuagccucgcucuggcaguccacauccuugccaacacuuguuauugucuuuuuuguuuuagucauccuacuggguguaaaccucacugugguuuugaucugcaucucuuuaaugacugcugaggcugagcguguguucaugugcauguguuccugugaucauuugccauuuguaucugcucuuuggagaaaugucugcucaaguccuuugcccauuuuuuaauugggucaaugcauuauugaguuguaagaccucuuuguauauucuggauacacaucccuuaucagauauacaauuuggaaaaacaacaacaacaaaaaaaaccagccacagaugucucaguuccuuguguuguaauggagugagccucagauagagggaagcugggaaguuucucaaauguguguguccccggccaaaggaauacaccaguggaugaaagaagaacuagaguaagguccaggggcaggaugugcagcagucacaagccauccccauggggccugguauggcuuuguaccugggaugcaagggacauuuugagggugaugaaaaugcucuaaaguuagagagucgugaaguugcaugacucugaauauaccaaaagccacugagguguauacuucaaaaggugcaucugacugucccagaucacucccagguggcagguacuuugcucgggagagaggcaggcuccagagggaggggacacagagcagguagggaggcuuugagacauccccagcuuuccuggcucugcccagggcacaugccuuuucugggagggagcccuuucucagggggaucagggacccaggcaggaacccucaggacagcagcugaagcuggccucccuccuucccugggcagacacggaggccucugaacucccuauuugggcuccagccucaccccuuccaacccaucccccugaguggcggcaggaggggcuuuccgagggacagacugaagaucucgugacucccccgccucagauacuguauggcuuccuacugcucauguaaugacauccacacuggccggguggccugccaggcuccucgcaaccuggcccaaaugcaacagaaacagagcuuguggcugagagaguucugcgugaaugcacguucucuccucccccuggguugaugcaucacacaugacacuaagcaugugugguucuuacgucuuugugagauuguuuucauaucagcgacccacagaggagaacgaucccgugcugguccucaagcccagaccagccagggcagaccuuccuggcuggcagugaaauugugcgaggauccucgggagagguggcugaaacagauucagcaaagggaacucauuuugacauaacccagaaccgaaagaaaggaaccaguuuccucuguuuccccaggagcaaggugcuguagucugaaugugugugucuucccaaagucccuaugucgaaagcuaacccgcagcccugaugguguuaggagauggcgcauuugagaggugauucggccgugagggcagagccuucaggaagaggaugcgugcccuuggaaaggaggccugagggagcuuguuugcaccuuauuuuugccucuucugccacgugaggacacagcccgcugacuuccaugaaucagacagaccccuuaccagacaccagaucugcuggcgcccugacccugugcuucccagucuccagaacaaugaauuccuaaguaugaaucaccaggucuaagguauuugguuauagcagacugaacagauuaagacacuagguaucccaucggaccccccgagagaccaccuggcacacaccagcuaaacaagcugcucaaugaaacucaguuuagcuuaguccggaucagcuucauggaagccacucaacuggguucagaucagcuccauggaagccacucagcuggguucagaucagcuccauggaagccacucagcuggguucagaucaccugugaagcuaaaaucaacccagucaccucaacucaguaacacucagcacaguucagcucaagucaacacaacacgaugcaacucaagucaacacuacacaacacaacucccaagcucggcuacaaacagucuugugguggaaacagggaugaccagggugagugcugccuaggacggccccucagggcguggggaggacagggcaguacaagguaccccagagaggugccaagguggcagcggcaaccgagaaagugcagcuuugcagaagagcaucuuugaggaaacgucuugccgugugugggcauccacgaggggcucagaggaaggucagccaugcuauggggggaauagggcaaagcuggccgggccucauguucugcaagugccauuuugcccucacccugagccagugggagaggcacucuguguaggggacagggcggcugaacaccuuggcuauggggaccagucccuggggucccgaucugccugcccuugcagggacacagcgcaucugcagaugcuuuaauuuaaaaaccaugguaacgcuacgcucaccgagggcuucccugggacagccaccgcucucagaacagccgccugucagacgagggucgccgccccguuugaaagagggagaacacacuaguggccuguuggccgggauggugcccaccagcagugaacucagaugcucauuucggagcugcacugucccuccacugcccucugcacugagacgcaaguccccgcgucaggagagaggguuuccuggggguggaacgugggacagaugcucacuuugggcagcugcucagccuugccuccccuuucccauagagcccccuuccgggagcccacccgcuccuaaacgcuggcguccguuucugcugagagcguggggcuuucucugcaaguggggggugggagaugaggguuuggaugagggugugggaggacccuaaacugauucccaugcuaguuggagaaagaaagguguggaugaggauaaaguuuucauggugaccagggugacccuccgcucagagggacgagcggagcccggcaaaaccagucacugccuuguaguuccaagcuuuggggaugaucagcucccaagaaauugcuguggggugcgggggcugugggugacccaaauugggcagagggccuacaggucugaggcugccugcacagagccaccaggaaggagcuagcgaagaaauacaucuuuguccuggcuuuuucccaggaggggcugggugggugcacagacagagguaaagagccucgagguugggguguaggcaggcagcuggggaggaccccguuuaaauccuggggagauuaugaggacguuugucgcaggcugucagcccucauuaaguuaauggaacuggcgaguuggccggcuuccagcaugccggagaaagaaaacaagaaaaguguuuucagugaaagagccaggggaucccauuucgcccagcagcccaggagauuaugagccauugguaauggccugacugaaaugacuuauugggaacugguugauuaaaacaagggagagaaaaccccuaaugucucagaagaaugacaugggcuucuuacuggucuucgucuagaaaagugauuugugagcacugccuuccaaagccuugugaauugcaaagcaacugguccagccagggccucugcagagaggguuaccaggcaggagaggaaaagacguggggugaaaccgguggauuccacacagacccugggagccagagaacuuggagcuugggccagcaggagccuggacauucugcugggaaggcuccccagggccccuaaggaaggcccagcaguucacagagcagggcuaaagccucccauggauucccccaacugguuaggccaggccagccacaagcccaacagcuauacccccgucucccauguccuccgcccugggcugagggcucugucguccuguuucagccuccggcccaauucuucccuggaauacaugucauuccucaacuuccccagagauccagccccugcugccccuggcgcugaccuggacucugggcccacagugccucacucaggugggguugcgcaggucucuccccagcuucaccagcaagaugccccugcacccaggcuccgcuuccuggccucuuggcuguucccacucccucccucucaccccauuuucacucauuuacacacaauucucagggcgccguguagagccccuguacuuuuuauuuuuuuuuuuuuggagacagagucucacucuguugcccaggcuggagugcaguggcaugaucucaacucacggguucaaguguuuccccgccucagccuccugaguagcugggauuacaggcguccaccaccacauccagcuaauauauauauauuuuuugagauggagucucgcucuguugcccaggcuggagugcaguggcgcaaucuuggcucacugcaagcucugccuccuggguucacgccauucuccugccucagccuccugaguagcugggaccacaggcgcccgccaccgcgcccggacaauuuuuuuuuuuuuuuuuuuuuuguauuuuuaguagagacaggguuucgccguggucucgaucuccugaccucgugauccgcccgccucggccucccaaagugcugagauuacaggcgugaggcagcacgcccggccaagccucggugcuuuuaaacacauguuaacuccucgaucauucccguuguacgaauaagggaacuggggcccagagaggcucagcagcgugcccagggucacacaguuggcaccaggcagagcccuggccuugggaucccccauucccagugcagacugagugacacugagcugcuuccauccucaucugugcuugccccccagccgaggcccccgacaccccucgauuucuaggucucccaaucucaaccccaaaccccucccugcagagcccuggcagacagguucugacaccacccuggaaaucauggcauccucucauccucccuacuggggugcuggcggaacagccccccauuugguaaaggagacagaccugaggucucugauguuuggccuggccugagccuccuuccuccugcggccccaugugugucaacuguagggccaccagguuucagaguuacuuuuuaugcuaucaguggcaacagggacuugcuggacacagccaccacucucuuuccuugcuccagaggccucgccccucccgccauuuugaauagcucacgucaaaggcagcacagccccaguuagacucaaggacagggugacaaccgcaaagaggggaagagggcacucuggaggucuggggcugccccugcacacccagcugccagaccagagguggggaucuuggcccccaggggcaccauucaccuggccagaacacagucucuguagcucacagugaguucaagaaaggccuagccugccccugucacgugacagauggucuugaggcccagagggaggggcagcagcagcuggcuggacccgaagcucugugauccagccgggccuggcguggggagucccugcugugggcucuggguggccucugagcccccacauuccaggcuggcuggggcuccugcaccugcaguuucaugcuggguccugguugccaggcuugucccacccgggccccacaccuccacguggacgcccagcugggcccucgggcucaccuggaggaagaguggagccugguuuggcaucaggugcugagggcccugccuggggagguacccaggggcaucugauagggacccuccccaccagcacaccucaccacaucuacccaacacacacaaccacccuuacugggacagguggggcaggcacaccucugggauucacucugggagcaggcccugcguggacccagggugagcuagggggugggggcaugccagcuucaccagcauuccugaggggaacuugcuucucccucgcccgaggucuggggacacaaggagacagggcugacugcagagcugggggucuguguaggggucuuuccuggccaguucugggugucccaggccacugaggauagugcugcacuggccacaagcccagcccugggaaccugcccuuuccuaggguagagugugggugagccaugguuuucugaaaaucagauauugcuugcagagcccuaggcccgaguggucuucuugaaguauucugcuggugguggaagcagccgguucuggucuguuuucaagacggcuugcuucacgccagagggauuguuuugaaacacagcccuuaucgcuccccaucugguaaagcccggggaagcugguuccuggcuccugaggcugggcugccucaccugccuccagccagccucacccugcgugccucuucccaccaccuccuucugaucucuggaaccugcccccaugacccccacucccugugggcaaccaguccucccuuucccggcauucucuugccuucccaccauccuagccuguggccuuucugcaagaagccugcccagacguguccacccccaaagccaucuuccuuuccucugggcaccugugacaacagugaacuuauggccuucagggaacagguuguuucuugaggguccugucuuucucauggccguauuccagugacuggcacacgguggaugccuagugaacaagaauagaucagugggcacuggggcagccccagcccaggccagcagggaccaagcaccggcugccccagggugcaaggcugcaccgcugggcagaggagcagaaggcuggacgagccccucccggggccacccccaggccccagucuuucccucccucccucccuaaagggaaggagagguuaauaaaccaauuacuuugggcaacgaagcaaaauaagucccauuaaaguaauuaauguccuuugcacaguccccauuggagaagacuaauaaauuggggcuuugucaccauccgguaauuucuuucuaaggcguuucuucauccccguccaacagcacaguuuaaggcucuguuaauacuuuuaagacgggcucaaugccagacuaauuagauuugcauuuccaccaugggccaggcugggcucggaugugcccaaugagagaggcuccaggaccccgccagagccccagggacagcacccgucuuugagaagggccauguguggauucccacgccugccuggggcgguggcccauuacccaggcugccugcacagcuucccuauccccggggaaugggggccauggcuuugauccaggcagaggccagaccucauucccaggaggucccuuccuggaucuguccccaguggggcucacaggggucaccagugugauccacaucccagggucucucuagggccccagagccaaaugcuggcggguccaaggacagucugcaaagggggaaaagaacaaaucacaguugaagagauugacagccacggccucagagccaggagacagagacagcaucgcccaugacgagccacaccgacaggaugggcccucggaacagggcgaugagaagggcauuucccucugugcucucccuccucacacccacagcccagucgaaucgugaggacagcagcagacggauccuaguaagggacacccuacaaacaccugaccuguccuccucugaaccguccaggucaccaccaacaaggagagccugggaaacagucaccgcccagaggagcccagggagacggaugaggaaugucacaugggacccuggguggggcccggggagagaaaaaagacaguagggaaacugaggaaaucugcaucaagcauggacucaguuaacagucauguagcacuguuguuuccuugugacaaaugcauacuaaugugagaugcugauaauagggcugcugggggaagggcaccuggggacucuuggugccaccuguguaagaauuuuguaauuccaaaacuauucuaaaaucaaaguuuauuuaaaauaaaaaaaaugacggcaagaggcugggcauggugccucaugccuauaaucccagcacuuugggaggccgaggcggauggaucacuugaggccaggaguucgagaucagccuggccagcauggugaaaccccaccucuaccaaaaauacaaaaauuagcuaggugugguggcgcacaccuguagucccagcuacucaggaggcugaggugagacaaucgcuugaacccgggagguggaguuugcagugagccgagaucgcaccacugcacuccagccugggugacagaaugagacuccaucucaaaaaacaaaacaaaacaaaacaaaaaccaaauaguagugagggagaagaggcagccgaggaugagcugccuugcugcugccgccugcuccugguccuggccccgggcucaggccugaaggcggcccucgcugagcggccuucuccaaggcacgcuuagugagcagacaaggaaccgucagcaaaucccuguaucgugucagaggaagccccugccuccgccgggugcugaggcccagcagaaggaugacaagugucagguaaccccagccucugccagccccgcaccugaagacaugaggcaagaacauuaggggcuggggaaugggggccuguggucacgcugacuccuccugauaggaccgauccacuuagacaaucagcaggaucaaaagaucaaucaauagagcugauagaaaguaugacaugguugucaggugugagaucaacccccccaaaucaauggcauuucuuuauaccagcaauaaacuccugggagaaaaaauuccaaaauagcaggggaaagaaggucucauccaggaauaauggaagcaagaccccaccagcccuuucaggaaaagauggcaacagagguccaagagggccugacucaaugcagagagacuccuuguucuuggaggagaaaacgcaacaugagagagacuccaguuuuucccaaauuuaaccugcaaauucgaggcaaucccaagcaaacuuccaguugaaauuuuuaagaaaugcaauaaacuuaacuuuaaaguuggcauggaggaauaaaggucccaaacagauaagucaaacuuaaaaagagauuauuauaaauagggguuuaggagcucuucugggcauuagaacccguuucuaaaccagagcaucaggucuuggggugccgccauuguccuuccgaccagcagacuaucagugcaaagagggagccccgaucacacacccuuguauacucgggaacacacuagaccacaaagaugacaccaucgaccaccauagacaggauggaauggcugcagggcagguggggaaggggagucacuccacggaggaaaaggaaucuggauucuuccgaaugcaaaggugcaccuggacacgacgacaggccugaaugacaaaggcugaauuauaaauuucacagaagaaaauguaggaaaauacugcccaacagcacaugugacgaggccaaggguggaugcauucgguacaccguaauuuagaaauuuccauuuaaagaaggacgcaguucacauccuaagcucuaggaugaaggucucaucucuuuuguccucuuuuuuauccccagggccuaguaagguaccuggcauggcauggggcccaggaaacacuggcgaauaaaugaaugaaugagagagugagggaacgccaccucaugugccggcucugcgucaggagcaaccgcaaacaagucuuggcuaugccugcucucaggcaccucuugcaccccugcagguaucacaugcucugcaguacuggagcaagaaacacauucuucccucccagaaggcucugcaggagcucagcugcuacacaagcuggugcagccagugagcccaucaggggccagcuggcuaagagccuucucugagugccgcauugguguucccgaugccacaucgucuccuguuugagcagagacacuagaguggacacacgguggccuuuuauccuaaacaggcagggugcaagccugaguccccagcucccuguaauaaucucuuuuuaaguuugacuuuuuaaguucaaggagggacuaaacauugauuuucagaaugcggccaagaggguggugaagguaccauggguaccggcaaugggcugaugaugucccaagcuacgugggugagggcaggcaccuggggcugagagcccacgagagaccugcagucaagaggccccggaucaggccagaacgggcaggagcaggucugcaggccagcacccucaaggcccaccaggggaggccccagucugccguucugugacaacaccuguuuaccucccgcugaaauaucccacccuaccagaagaacccgcugccugugagauuccuuucugaggcaguccgcugacuaaacaggcauccgaugucauugcugggggcaacuccuuuuaggcucaaaggccugucacgaagcacaguugggccuuagauggcggcuaaucaagaaggcugguuaaagcugggaggucgugaaucugacccuauguagcugugcagacuccaggaaucaguaagagagggcugcgcagggcugcucuccuccggggagacgcaaguccccauagggccaugcagggacuggcguagggauucgagccccuucccuucccugcucaaguucucccucugggagcugcaugccggggagcugggagggaggccacagucagagcaacagccggcaggcaaacugacaucuugggcccugagcucuggguaaaagcugggauaauuucuaccccuaagugaaccagugaguuggguggugggccugcucugaggccugugccagggccugaagggguggggucuuaccucaugaaugcuucugaagaggugaagagagacacccagcagcaccucagaccccaccuucuggaggagcacagggccuugaagacccucggagucaaugaggggccccgcaugguacgggagucuaggugggcggugggcucacaccagucaucccugugauuucugggaaugccccuucccucucaaacaugacaacugggucuccaggcccagaucugcccaauuguggccaccugcucuaauguucaucaaagccugcucaggccggcuguccucacaaggagcucuccaaaaauaugaaaaauucacgaguggguucaggcaaaaaagcugcucuccuggaucugaggcaagaacaaaccaccugcacucccugugcccaccuggcaaggguggcugcccacguggccucucgguccagucuugcuggguggcugccacaccacaggugugggggcucggagcacuggauuuccugugggucugccugcuuacucgggggucccuaagccgcuggccuacuuuguuugaccugcauucccucagcagccgugcagaggaggccacagcgggcccccgcgcauggcugucaggaccgccccgaauucagcacauggggaggggaaggccuccuucucuccgaggcucuuguuugcaaagcuuuagaggagccagcaggacagagccuggacaaacaccgagcauccucagccccagaaaaccaaaucgguaaacauuccccugccaggcauuucugccccugauugauucagcugcaaaguguaaacugccccgagaaagggccggggggagcccagggcccccaggaccagcauugggaugaauccaccacaugagugggcacagcugggcaggcagacaccccacaggcaugaaggccccacugcuguaucagggugcaguggccagguggccgugaguaugagacagacugcaaaugggcacauggggaccggcuugagggccugaggccgccugaugccucucauuguagcugauguaucugaucuuggggcacagggcuuccccugcccuggacugcccugcccaucucauagaggcugauucuggccagcaccacccagggucucaaaucauggugguaccccccaagccacccgcugcagggauggucguucugugcaaaaccucuguucaccucaaggucagggcagaggcagggcaagucuguuucuuucagaacuuauuuuucuuccuucuaccuucuaauguggagaaaaccuaaccaugucgcagcacccagcagagugucuugcaacagguuaaacagucaacgcugacucauauacaugagagccaagaguucuggggguuacaaggcggcagcccgcccuggggcagggggauaggaggggcgcugcugggggccccugagggcuucugcagauggugacccacccuggcccugccugggguggcagagaguggggccuuggccaggagaaggaacuggacccuccuaagaaggucaaggaggaaaaccacaggcggaggaucccuggaagaggcucccagccccagcugucugcgcgcccgcagcugccccugcaaggaggccggcugugcuccggcccgagcacagcuuccucagccugcccccacucacagcgauggggugauaauugcaggccaguggugguggaaugcucuggaauguucuaucaguaagagaggaggcuaaagggcaggaggauagagacccgaacagagcucaggccuggguuggaagagggugagcugggagggcugggccuggguaggggauaggcuguagguagaagggauaaacaggggcacaggggacaggcaccagguguggacaggggucacacugggcaugcguuugugcguacacgugugcagccccgagggggcacacagggccuugcaagucuggauaauaaaacaaaaagaaagagcaaauaucuccagggccccaaugccugcugcacacagccaccccggcaagcgccagucagaccucucuggggugacugccugggccacacagucacucagcggcagaguaaaagucaaaccugcccucucacaggaggcccuguccucacacucccuccagcucauaggggccuccccugucucugaggccacccugagacacucugaggccugucugagacucaccagagacucuugacuucccccggaggcagcacugccugagcuggucauguguccaagcaggggcugcagggagacacaggaacaccccccaccccagggcgcccccaaaggagucuaugcccuaauccuuggaacucacgcaugcgucacucaauuccccuuugccacuugauuuccuuugaaggggaaucaaggcugcauggaauucaggcagccaagcagcugaucgugcaauggggagaaaauccuggguucucuggguggcccaaugugaugacaaggguccugauacgggaaagaggcaggggaucagagucagaggaggagacguggccgcaggggacgcacagagucugugaugugaggaugccaugagccgcagccgccuuugagggugaaggaggggccaugauccaagggaugugggcgccccuaggagcaggaaacugcaggacagggacucucccuagagccuccagaagggaccagcccugaggacaccuugauuuuaggccaccaaaauuuuggcgacuuguuccagcagccacaggaaacuaacccaggccccuccagagacccuggcuccagcugagcugaggcccccaggaggccuggguccacccgcucacauucggggccugccaggaaggacuucaaagcccgcgugcgcuguccucuggguggggcugcaucggggucccucgccccaucugucacucauuccauaucuuugaacaccuguacuauuguuugcuuaacauuguuccuuaaauagacucuguuuccuuaucuaaguauauuuggagagccagaaaaaagugacuuuaagugaaggcaguugucgaacauacacaauaaaaagaagaauuugcugaauuuguuaguugcccagcagcgucgaugggcagcagcacccacuccccaucccccacccucccuccugccauuccuggaggcuccucagaggccaggcccagcccaucucacagagggguaaagaaguucuaacguuucucaugguuugagagcaaccagagucacuggcacccugggcgccaugcagggcuugccucugucuguucagggccuaggcagcagcacgcucagggugaagccacggggaccaggccggccagcuccgcacagcuccacaaggagccugcucuaguccccaggggcuacugccgcauggcucaccaccccaccugcacacccaggccucagccccagugacuggaucccacuggugaggccucugucccgacccauaggggcuggccucccuuaggacacugcuccaagcuacaucugcagaaaggcuuccaacaaccugccccuccccucucucuguccccuggacacggucaacuuggccaauaccagcugggcaaggacaccauacugacagggccggcaguccucggagcagccgaccugccuuaagacggagcaugucagcuccuggagcucugcgggcccagugccguggauaggagccauggcugggcugacaaacgcuggggcagagugagaacaaguucuuguuaaaaaaccaggacaccaccagccccuggucugagauggaguccucagccuuucuagaaugaaauggugguauuucauuagaguaauguuguucuacgaaauguccuuuuuugcguaauaaaaauguugcccaccuauguccauccaccuuugggggugggggaauauguagcggaccuuugauggggcugugacauccaaauggcugggaaccacagauagggcagaaacaacugccgggugcacauguguuaccaugugaccucaggcaaucucgggccugccaccugucaucuguggcuuugguugguccaucugugugaugggcucucaguaccucacacaggggcuggguuggugucaccuguggccaguggccaaguaugagccagccaggaugggugggggcccugcugcgacccuggcccucccagacaugcugggcacacaugugggguaccugccugugccagacgcacugcacacacucaaggccaccccaggacaggggaugucagucccacuucacagggaggcggaggcagcagagaagucaguccuuuuucaaagcagcauggugguagcagggcucgagccauccucugcagaccccuggacuccaccuguaccaggguccccccaagccccaacccugcuggugagugacagccugcaccucgcucacccaccuggccgcaggcaccucacugcacccgcaacaacagggcaggccuggggccagcgucugaugauagcccacucuuuggccugcugagugucugcggaaggccagugugccaaugcccagguggcagaaggacaauccccccagggucugucuguguggccagugcugcagcccacguucugcugggaggacagccuggcccagcuguggggcccccaggaaaagcagacauccaccccaccccugaacacccaggaaccgcacaggccccucuccaggcuaagcccugcaucuccuggugacucgggggcccaggagggaugggacaggcugacuuggccuccuccagccuccaagggcacucugcucuaggccuggcugggaguggggggagguuggccauggcucuggccagggucucugcccccagcagaggugagcagaagccugagauucccuugucacacacgcuagugccaguggccccgaccugcugcauucucacauggcgcuuagccuggaagaaggaucuucugccucuuuccuugcuugguacaaaugucaccucccucagagagccuuccuugaucucccggcuucaugauaacacgucugcccacccccauggccaaggaacccgcugugcccccacacuccagacccugccucccccugggcucaguaaggaacccgcugugcccccacacuccacagcccacccccaccgagccaggggcucacuucugcccucgucucuccucccuccccaccauuuggagcaguuucuccuuuccucguucaucuucuccauuuccugcccugaccacaggcccaggcuccuggggccagcaguccaggccaggcucggccccucccagcaguggaggagggugugguucucccuugaaucccugcagcccaggcccagggcccugccuggagcaggaaauggaugaagcugagaggacccagugucauucugugcccccaggugugccuccccugggcagggggcaccaaccccuuucccugccuccagcccacuccuguauuaugaccgccucacauccucauguccaugaucacaacagcaggcauccaucacagaguuagggcugugacggucgcacccugcugcagccccacucucccuggcagcgagguggacauggcauuaauagggacuuugcugugaccccauaucccugccgggcucggacccaccagccguguuuuauggucugcgagggccgagucagcacgaaggcuucccggcauuuuacacaaagcuucuucgccgugaacggagucaaauucacucacguugggaucauaaauauaauuaggagacuuuuauuuucaaguagcacuucugaaaucuauaaaauuaagcuaauauacugauuuuuaaaacacaagaauuuuauugcucugugagucagaguuugccagcccacaaggccaggaauuaacuccuugcagcucgcgggcauccagcaggccuccaggggcccccgugggucugggccugcugcacccacuugaggugcacaugccccaggagagcagcuuccugggacagagagguggcugggcaguggccggacauccacccacacggcagcagcugcccggggcucucccucuccaccggcaccccuucacuucugugcugggugcccugggaacaaguccagaugcucucgggauccagccucugcuuacccuguggaauacacuccccccagaauuucccugccugccuccuccucuccugggggaguccucccuaauccgcugcccuacccugaaggcugccccuucccgcugggaucucuucuggacccacuaauggaaagugguaccccuggcuccuccuccuggaauaaugggauccccgagcagggagugcuggcgaggggcacucaggaugucuugggaaggcaggcggugggggucgggacugggcuuccucagccacccucggcuggcacuucaggguagcccgaggcaggcccaggcucugcgccacuccccaccugugacuguggggucccugagccgugggcaucuuaucuugaccgaguuuucacccuuaggccccaccaggcccagcagaggcgcagggcgcaugccagccagccaggaacccaccagggcagccgcauaccagcugcagaugcgcaggugaaaugggaagccgcccuuugcucugggccacaccuaugucaguggcggaagaucacaagggacaccuggaaggggcuagguugggguuugcaggcuguguaacuggggggugggagggacggcccuaagcaagccgcuauggcgaugagcuggcauugacucccucaaggguccagcuccaaagcccccuccuagggccauuggcaccuagcgccucccauccccaaagugcaccuucucuccaggcacgggggccaccgucuaaccccagaggccccucaggcucucccaagcccacuggucacaagucucaggaagacuccaaaaaauccagacuccccagaggccugggaccugggcccucggcacuccagggcuccaacuauucacagcccccggugggccccagaucccagauacggcccaagcucggucgccuuuaaucccauuagguccccaagacuuagaauggaguuucaacuggucccaguccucuaauccccuggacugcugguuaggaaaggcuuccuucagauuugggagcacaggguaaacugaagggcaggcaggaagccugggccccuucccagguagguucugcccaaugagcccccucuggcaucuaaaguauguauaaggaccaccccccaaccccaggcagcucaugggccuucugcacacacauacuggagggccaaggagcccccucgcuucucugucccuuuguacacagggaaggggcuccagacacacuggaggaagggcgugggguccucucacccaccuccuccugccucugacugugacugugugucuggagauggggucuuauaagaaguaauuaaagcagaauggggguauaagggugagcccuaaucccaccugacugggguccuuaugagaggagaaggugacucgggcacacacagagggauggccccaugagaacaccggggaaggugaugucuacaagccacggagagaggcugcaggaggacccagcccugcagcaccuugaccuuggacuccagccuccagggcugugaggggaugaaugccugcuguuuaaacugccccacuguggucuugguggugacagcggaguggacucaugucaucccccagcuccuccaagugcuccucaagugugcucaacagaaaauggugaggagggagaggguggugggccaggcccuaggaugccugcgggguguggaugggugggugaggggcacuucaggacgguggcugaaugcaguggaguguggcuucaggcaucccuggccuaggaggggugggaaggagcaagcagugguugggcucugaaggaaggggagaagcuugcgggaggggaggugggggcggccauggcccacccuccaccgggcagggccucaauugccauuagccuguccccaccucccaccccagggccccaggcaucucuggccauccaggggccaggcugucccccagggccucagggcaaguggcgucucauagggggucaccaucaaggagagcccccugagcagcccuucccuggcucucacacacagucccucccuguccugcugcggcgcugcugucagguuucacacguuuuaugggggaguucaauguaagccagaugcgcgcugacagccacggcacaggugaugacaaggcagggcuucccuggcacaugugccucuuguuagugugcccuccgaggcgcuuaccccaccagccuggggcagcgugcacagccggcugggcacgcggccacuccggggcacaugugucgcacuggaacaugcugcuggcccagaagccuccuggagacaucaccucugcgguggucccagccggggccugggaagccacagccaggccccagcacaggaggucaucccuauuucacagugggggaaacugaggcuggaggaggcaggaggcccauccaacacgguuuauggcggaggagcgguggucuugcccucgcuucugucuacauagcagcuuccaggauuaccucucaccucccuggcuggcacugaaugugccugggaccugacucaucucuucaggaagcuacccccgagaccugcuccuacucuccaguccuucagggccucggaaaaccccuguuaucccccacccagcagccgcagcaagcauccugagaucagccucgacagccccgcuccccacaucuggcucucagccaaggggcccguccuacccugcuccccacauucugcccaucaccaaggaucccguccugccuugcccagcacagcuggcugcggggccccggggacagugcucccccgaccugcgguggccggggggcugugaagcuuccucauucaacccauccauugcuccccugccucuacccuuggugcuccccgccaccucacggaaaguccagccuucuaggcgccuuuuggccaccccugcccugcucugcagcugggcuccggccugaggccucuuaggaccugacccucccaaucugccucuggccugugcuuuggaugguucauucguuuauucuuuggacguccaccaugcaccucucacacacaccugcgggcccuggggccggagcaggaccaccccugccagugcuagacaagcuugaaacugugccugugaucagaggccagaaccacuagaaaggcaaggcuggggcugggagaaccgcaaggugguccugauuuagagcgcgcaacugcucugaggaggauguucaggggaagcguggguugaggccugaagacucaagaggauuaagcagggaagaggagagcgugugcauguuucggggguggugcgccuggcagggcaggggaacagcgggcgcgaaggcccugaaguggggggggagagagagagagagagagagagagagagagagagugagagaguguguguguguguguguguguguguguguguguguguguggaaggccugaagucccccuccugcccgcuagaccccucuccacugccucugcccuccaggaggcucuauagcuucagaucugaggccaagagggcagcacacuuggccuggcuccucccccagggcugcccaggccuggcuguucuuccucucaaggugcccaccgugcccgacugucucccuaggagcugccagcagcaaccucggggguccccugcuacucuuuggggucccuaugcucuaccuguaucuuugcaacuagaaugagucccccucacuagggguaccaccuauggcugcugucccugccugacaccgcccagggaagccaagccguggggagggccugggccagccugucuggaaggaagcugagcaaaggagacugaggguuugugggaaagugagggucggggucgcagugaaggagggcgaguguggggagccccuguguugagugcagcugagaggccugaguggggucagugcugauggaggaugccccuucccucuggacacacaaaggagcacuagggaaggcagagagaggccugggggugggggugggggugggaguggaucucagagcucagggcucugcucuucagaccccagcugcggggccagagccguucugagggacacuggagacgugcaaggcugggugaugccuccuauuuuacagagggggaaacugaggcuccagaagguaaggggcuggcuccagguggaggaugggcucagguguggcugugucccagacccccucuucccaggacccuggcuggcuugcugccuguggguggucaccagcccccagcaggagccucgaguuucugggccuccagagggugggugggaccagagccaccccugccucaggcaagauggggcuggggcccauggggcaggggagaccgccagggcagggguccccucccugggccccagugggugggacagaggcccccaggcuccggcugcaaggcgaggccucgguggcggccacaauaaauauguuuguucaagggaagccaggcugggagcugugugcgccggcccggugaggaagaaaaggccgcuugugccuugcacacuggggcgauuguuccugcucacgcaacugcugccccguggccggaaaggucagacggcccucgggccccgucggaagcaccggugccucgggccccuucgcucgcgccugcuguaacauucgccugcgcuccucacugcccggcugcauccacaucaccuccaggccuuggcacggggagagaagguaccaggcaaggucugaaagauggcccagcaaaggcgagggaagaaacgaagccaggaguccccugcccagcccaggcgucaggaauaguguggaaagaggaggccccagcugguggccucagcacccugagggaguggcucuggccccgagggucuucgcagugcccacggggcagcuuguuuuguggacuauuguuuggauauugggggaugccaaggugaggguuggggagaggcccaggagcacaugagaggugccagcaaugcuccugaggcaagaccaagcaucguccucacccaccaaacagaaggcugagaggcacugccuggccgcagccccgcuucagagcaaauggagucgacagaggccaccacgcaggcacuccuggcucucccacaauuuaaaaacccuaaagggcaaaaaucaggaacucaagccugguuuccucccauuccucugaagggggaggaaggaacacaggagcccacggcuugcaggccacaccucgcugguccccugcuggcaaggcggccucccucuccucuccucucugcaggagacagcucugugagauggcuucauccaaagggcccucagaauugugguccugauggugaaggcugugagcagccgcugcaguggugugaucagacgcucuagcugagugaguuacccaccacugucuuccacccggaagagcugggagauggggccauaggagccuccuggguggcuggcagaggggacagggacucuggaccagcccuccccucccuugcuucaggcgccuuucucugggccucaggcccuccugugugcgcugcugggggugauucuaggaaccugaucuccaugaccacagggucccccaaaagaugggucuguuccggagggcuugccucaagcagcgaaggggacucugacaugggaggaaagcccucuccugggugagaaccuggagccgcaccuccugucccgagagauggccgcccuggguguccgccuucccuguguccggugcccgagugggcguguggugggcggccugcagugcuggcucccuuucccaggccucucccgcugacacacagccggaaugugccagacucaccaaggccugaauucccgaggggucuggcaugccgacugugggacgagggcauuugggcauuguucucuccaugcaacaguggggugcaugggcggugaggccccuuggauuccgccugccacccuuggcuuuaugaagcugcaccaggucugacucaggccuugaggaauucagcacccccucgagugggcacaggggacuguaccuaggggcugccucccucugccaggcugggcaacgcagccccugccgugaacagaggugccuggcugcccucucuuucccccaggucccugaggaccuuuggguccaagguugagcugugaggccaaaggaaguguuugcucccaaugcagggcaacaagggccuuccuuuucuaugagcaaagcugggcucccagagagcggcggcugggaggaggcugggccggggcucucauuucuguaguugguucagcugggggcagccucugguccaucuggccuggugcccagcccugcuucuggccacagccacagaggccugccaccaaaacggcuccagcgucugucccccaucccuccauucuucccuccucugcccuucgaaaccaccauuacugaagaacccugcgucucccaggggcagccccucuuggaccaccugcagcaguucauaccauaauccgccucccccaggguaauggggccuggauagggagacucuguggccauacaggucucaccucugcacuggaugccuagggacaaaguccaccugccuccuggggccucccaggcccccugcagucugucucugccagaccccaccacgcugcuauugaccggcuccuccagaucaccccugcacuccccauaagagaaagagggaggaagggagguugugaagagcgcaggacagaagcagagacaagggggccguggggaaaggccacaagccaagggagguggggccucccuuugagcuuccagugggaaccagcucugcuggcuccuugaauguagcccaugucggacaucugaccuccagagcuguuagauaauaaacgugucacuuaaagccacuaaguuugugggaauucauuacagcagccguaagaagcuaaaauggucccucucaaaacaguccugaaucuacuacuuccuccucgcccuccugguccagcugccauccuccgccuggacuagugcaguggccucccuccuggucugccaggucugucccagccccucagugguccauucuuggcucugcagccagagugacccuguugccaucugcgccaaccacaccgcacucggggccagccagggcuucacguguccuagcucucggggucccagcacaugggucuccuugcuguccugccagccugugggcccauccccacuucagggccuuugcuguggcuguacccucucuccacaaugcucuuagcccugacaccaugagauucaccucgcuuuggggacacuguaagguccuccacgaccccauccacaacaggccccuuccccaaaccagcccugccugucuuuguuuucccuuccaagcacucuguagauaaauacuaaagugcagcugucccucagcacccauggggaccucccgcagguacccaaauccacagguacucaagcccccgauacgaaauggugugauacugacauggaggccacauacauccucccaucuccagaccacuuacgauaccuaacaacacaaaugcugcgugacccacucuauuguuuagggaauaacgacaagacaaaaagccuguacaaguucagauguucagcacagaugcaacuuucuuuccaaacauuuuccauccacaguugguugaauccauggaugcagagcccuuauacgucucccauugguggacaucccuuuggaauuucguaucaguuuuguauugucacugcugucccuggcaccuggagcaggcauucaguauuuguggaguaaaugccaacacaucucacuuuaaggacuucacuaucuucuuucauuuaauccaccuggcagugcuacaauguggggacuuuauuacccccauuguauaggugugggcaccgaggcacagagauuugucacguccagggcagucacucgagcccgcagcauggccuuagcccuguggcagggggcucaagggagaaagagcuaggccagaccagcccuugccccuaggccuugcuaagcagcuucucggcaacaggucuggacccucggccccgggagagcccagcucauggguuccuggcccgagcgcccuuugugcccgccuggggcaggcggggggugggagugugcuacauaaacgggcuauuguucugugacuacaguugccagcccugcaugcacaacagccccugugucugcaguggcucccagaaccaaucaacaccuuaucacgagcauuaaucaccccgcuaucugccccaaaucaggcaaacacuucuggggacuucaaaccccugacugcacagaaguuucuguguaauaauagauuaaguuucuggugguucagcagcauccacugcggccggcccucuggggugcugaggggccaagggcugccaggaccaggaggacgcucugcuccggccucagcuccuccugagaugcuccuccugcagcuggagcccucagggacuuccugucccccuggcacucugggccagcagaaccccaugcccaacuggccacccugagccuccguccuguaggccagcuucugggaggaugcaguaggcucaggccccgugcccucacgcucccaaggcccggcucugcuggugggcugugccagaguguuuuagaaucuccuagaggaagugaccuggacccuagugggcgggaggcuagcaagccagaggcugcagaauuaguaggaagccagccuagcucuugucaccaagcaccaacccccgguucuagagucaaacgcucgguagguccuauagaaaaagcagcuaaccaguuggcguucagccggcugugguccccugagggcuggcgccgggucaggcauagcacugugaacaagaguccuggcccuggccucagagcacagccaccuggggucggacuuacccuacgaggugccaggaagagccuugggaagccacagagaagucagggcagaagggugggcgaguggccgcuccagagguggagggggcaaaagaggugaggccugugugaggggaggacagaaccaucggaaguccuggaagggauuugugcaaaggcccugggcaagaacacucuggaaggagcugaaggacgaggagaaggccagaguggcuggggagggaggaggggaacagggaggcaaugaggcugggaggugagcgggagcggucacaugaaccucacgcaggguaagaggguuagauuuugcaccacauaugauggaaaugaagcgcuuugacuagcgcggccccgggggccaucagaugcucccucugccuccacagcaaagccccacagugcccacagaggaacgaaugccuggccacgucccugccccuucauagugcaagacgagcccacaccaggccaggugcuugguguuguacaucgacaccguuguggaauccugggcucugucugcucgcccuucugcauacagcccuucuccauucagcucacucugcccuaggaggcugaucucugcagguuauguccacaagcuccuggcccagggcuucagauugggucuagccaacuggaccccuggcaggaggcaaggagggaggagagcggauccggggugucugcuccugcucccugccguggagcugcuggggccaguugugagccucaugucagacagccaucauucuguuaagcucaggcaaccuccuccuccucuuuauuccucgagucugggguaggauuucccccagggacacuaccccauguuccugcacaaggccugguggucccugacaccugacucacacaggaaugauccuugggugccguccugcgccccacacguagcuaccgugauugucccuguuuuacagaugaagaaacagaaccucagagagggcuugagcugcccugggccccugagcugggauucagacccugaugugucugccuccagggccugagcacaucccccaagcugccuccuugucccuaacaucuguagacgcugagcuuuugaggccucuguugcuccagagccccacugccccauggcugcuccuuccugaaaucuggcuuaugucugucucgcuccuacaggggcagauauaucacaggaccuaagagguagaagcaaaccuaacagggcagaggaaagggcauagcacaaacccccaaccaaguggcuuaaguguccccucccugcugccgaccuccaugcccagggccaacccuucaccugggggcagggacagggcuuggagagucaggauuggaggcaaauguguucccuuucucacugcuuuugggcuucaaguguucugcugggagcuacuugggaggggccucuggaagggcagaccuggcgcccaugccaguggggcacgggggauaccucucugccaagcagugaggagaugggcacagucacaggagaagcacauuccaugggaaagccggcuuuaaaaucacuauuucccccguauuaaagucagcuccuauucaggccaaugcagaaaaauaaaauuuugggggaaaauauaaacuacuauuccucccugcuaggaaugggucauccccuuuuucucuggccucaguccaccagaucuucaccggggucccacccagugucccucuggacuucuggccaccucccucacaucagccaugguggggcagggguggggugggggacggcuggaaccugcaguggguggugucuccgccuggggccucaguuuccccacucugacagggcagcauccaucuccugagcugugucugugcccuuuuggaaaccuacugcuggcccaggaagagcaccacccucacucgacacaccgucugugaucugaggaugcugcaguucccccaaacccauccaggggcccuaggauccucaggucagggggccaggcagccacuccuucaugaagacucccgcccaucuugccacgucagcacacaucucgugagcgagcucagcuucucugggccacugcccgggacccacccuuggccugcuccucugcccuggccagcuggaagcaaucugccuggagcaggcaggugguccuccuuagugggcucccaagaggccguccccagcccuucacccacgcagagguggcucuguaugcauggcugccuggggccccuucucugccggagugaaccaagugcucuggaauucaugaagaaaucaggggucuuuagccugcuguuuuucuuggcgaggccuuaucacaaauuaguggggaagcccgaagguuaggguuucaguuaguucagcagaaucugaggagcggggaguuggccuccugccucuccaagucagaaaacgcuuggccuguggggccccagggagcucucagagcccaggaugauuaaccaggcaggugaccugugcuuugggugggggcggggguggggccugggggagauagcuuucacacaagcugacagguuucacaaagcccagugaucucucguaccuuccccaggcugcccucggcuggagugcacagccugugggccuggggcuuuggcacugaaggcagggcagggcgcccagccucauggaaaggguacguucgggaagggggcgagggcaagucugacuuggguuccaggggcagcccuuugaacuuggcgacuucacgugaaugcacuuccuaaaccacagcuaaacgcagagguucuauaucaguagcucgaagacgauuggggacccccaaccggacaaauggcaggucaccuccacgcaaaaagugggcucuucugaggaaaaagcaggccaaguugccucuccuguuuuggaaggcaggaacccgaaagccaaaccacuaaguauccaccagccacucacgaacucaaaaaagcugggaacauuucuggcaagcgcuggucccguggcugagcccccgacccuggaguguuucacaaguccagccgucugucccggauggauucugggaacuugucuuaggcucaccacugggucugagcacagauggccgucggcuuccuccugucuccacgucaggaauccgugccugccccacccugcccuggcucuccccuggagcugaaacggguccagcacugcuucaagacgugagcuuguuuaggagucauugucugaugcuucucagacccugugcuucucuauugggcccacaggcuuuucuuaaacggacagggacccugguggcacaccaaguuccaauccaguggcuccugauagccacaccagacccugcccucggcacccuguccagguuacuggaucagucaucucuacccugugacagagaccaccguguucccauuucacaguugagaacgcugaggccugguaccuuccagugccuuguuccagcuccauacgauggccagaagcuucagcccagugacuccacccucugugggugaacuggccccuucccccaacucugagcccugguucuguugccugugucuccuugggcagguccccacguccuccucugugagcccaggacaaucacagugucgccuccuggggagcgaagugagagggaagggcaaggcuugggugcagcugcaauggcacccaaggggagaagcuguguuuccgcgggaagggguuccuagugggguccuuccuaggugacaaggccccuucugcccucagugcagccacggccuugcaggacagccugcucgcugccacccaccacuucucucucuuugcccucccacccuccuuccuccaagggcaguguuagcuugccagggaggguucgaggccuagggcuggcgggacagggacccuggcugccagcuccauuccacugugcagaaacccaauccgggcgggaggacgcugucacuccugaggauuuagggccgucaccugguggagcgggagggcucuccucccugacagaauaagugguuacaugccgaaaggugacaccgcaaagggguccugagccgggaggaggacuguauaucaucugagccuggaucugugcguguuuuucuuucugucuuuccuuccuggucuccuugucgcggcccccuggcgaucuuaccagaacguccugguccagaugugauucucuaucaaaagccugggcccccaggcaccaccggaggggcugugugcagagguggugggggcugcauagauggaguacagggcucugugucagacacagagagccauguucugauuucugcucccccggugaaaagaguaaaugccuccacgcccacggcagauacaaaggcugagaugccccaucccugcggcacaucccccaacgugugacuuccucgucccgaggucccccuggaauccgugacuugcuuugaccaccaugucaugagcaaaugggacacagagaggcuggaguacaugugcaccgaguggcugggaacccugcggccaccagcgguuagugaggccccacuagcuaguagaggagaggcugucugccaagggucuucuccgggagcaaggccauccuagaccacucagcucggaccaguccaccugcccagccaaccgcuaggugugagggauucgaggcuguugcuacuucgagcugcugaguuugaggcuggcauccccucuuuggacuucaggguccucucuaaaugccacugccuccaggcccacugcuacaguaaggacagaacagcggaccagguguggggcugccuguguagggcuuccacgugccacagcugccaaguaccaccuggucucaccuaacagcuccucucucccugcccauucagcaagaaggguauugucacaucccacuuuacagauggggacaccaaggcucugagacggaggggcuugcuaggagucuugaggguugcagugucccgggggaggcugcggagccuccucgucccucacuugccccaacgguaaaugggacagggccgugggcaccuuguccagggcggcagggagugggguaagcagcuguggcagguguguggagcaccacggacaagcagcaccacaccccucucaggccaccacggaggaaggcggagccaagaggaaggcagagccacagaggaaggcggagccuguuuucaggauccgucugggauccccccuguccucuccgcucagaccacccuggcacgggaauggaggccaggaggcuuuugggccgcagcuggcccacaagggugugaggugagccugccccgaggcaccccagguggcagcugcagugcccaaagaccuucaucugccaguugguccugggagugacacaugcccccacccccacuccgcuaaggcagcacuugccauagcucccacucagaaggguggcucagauacugccucacagggcccuggugucaguuggcugagccuggugggguagagggaaggagggaggaagggucuuggucacagggcacagcuaucuaggggcagcuuagccaccucacuaaguuccaagaggcugccauagccuauuuacuaaacaggucaugacucccaaccacgugagaagggaagcacucucgguccgccacugccgacccuggcuacggcaucgcucucaucagcuccccuaggaccuccauguggccaaaccccacugccaguucuauucucagcuucagugggacccaccagccguggcugacaugcuggccucuccuuccuuagaaaaagcuccuccugggggugaccaagccuccaccuucccgaucuccuuugugagguccuccuugaucccugaccucugaaugcugcagucucugggcucaguuccaggcugcagcccccaugguccagcacucagcucccaggaugggcuggccuugccucguucuguacaaaugucacugccacagagaggcaugcacccgaggcccgcccuggccucccauaguccuuuccuaucuucacccagccuaccucucuccaccugucaacaccugguaagaugacacaucaccugggacccccaaaaggcaggagcaugcuggcuuuguggcuccccagcccugacucaccaagcucaggaccucaggauccaagcuugaucccaggggcacagggcuucccauacccugugccugccaggaccauaguaggcugucugugugggcccugcgaccccauggaggugaggcggccaccaaauggaggacaggaaagcucggcaugugccucccaggggcagggggugugcguagggacaggcuccuugggcuuggggugaggguauccccaggcaguggaguugggucucacuggaagucccaaugagaaguccacgguggggucucccugcacuggcaaaggggacaaggccucuuaaaggggccaagggacagauggauggauggacagacagcuccaggugaaccuccucggaggcucggucagccuccagccagggcugcugcaggccaggcaggccgaggggaccaucaccaccgcugcugucggaagagacaaacggccggaggccugccuggcgugaucugcagcaucagaaguggcccagagugaguggguccuccugaaacacccaggcucugcugcccccaccaacucuacgcgaggccucccaccccugcaggcggaguaaagccucccaaaggcugcugaccgccggaauguaaaucccuagaaauauuucuugauacaauuugcugauuccacucacaccuugggggugaaacacaucccuggaccugccccucuugcgagcuggagacagcaauuugcugaucugccagcccucugaggcagggaggcugagcuaggacugggaacagcggccucgcuacaaagcgcccagcgggagucggcuuauuagcugccucugaacaaaggcugcagaggcccgggggucccucacgagcagaccccugcggguagcuuuucaacccccgaagugcugccuuuuaacucgaccuccacgguaggacaaacagggggaagaaauuagucguggaugcugcuggauguuucguaacuugucgaguugucucccuggaguuggucuggccccagcaacauguccccccggcguccagaauggaaaacaugagacaggcccccaccaauccccuccccaccuuuuagaaacucuuuacaagcuuuaagaaacaaauacccuuucuugcaucuggggccuggcugcugcagguguccagggaccguccauggcucuggccuggaaagcugugccugcccgagucccuggaaaucugagagccccugggaugaggaaacccugggaacaaccucaucucccucagguagccaaguccccaguggccucgagguccaggccaggccccaacucccagcaaggccguuccccaacucaacaccauauaaugaagaaaacgaggaccauuugccccaaaugauccaagggcacgacuucccauuggcugagagggacacacuaugaaccccacagguagcauggacuccuagguucugggagccgcccugcaaaagggggaaggggcuggugguggcuaaugcuguuuccguuucaguggccaaggaggcuccccucuucagccuugacacccaggcugacacccccaacauaggacacucagagaaggacccacaggagcucagaguucuggacagguagggguuaauggcacacugcuugcucuggucagcccugggucccucuccccuuacagagagaggccaggugagcuucgagggggcugccucugcuucgagaggccuucuugaggccagcagcuuccuccuggccuucagcuguccccaggcagggccagcacaugcucagcacgaaggaggccugacuguagccgggccccggaaggcggcugagccagggaguacgugccugaguguacacauaggauggaugaggagagcugccaggacacucaagcccccaugagcccaccgauacuuuuuaaagauaacaaauggcaagggcacuuggcuucucgauucuuuacacauccaucaugcccacaguccauuuggaagacugugcugucuaacauacuagaagcgucuccuugcaacccuccaguggguuugggaacugaaccccaccucuuucagcaggagccccuccagugagcuggcauggagggacacggacaguaagggacuuguuuugggacauuuugcaguuugcuacauuugcauguauggugaagcggcuccaccuccgcccaggcgugcaaggggucagacccuggggucuuuugagugguucgcugaccuagcuauacaucugugaugcagguuugaucuguguccauuuccgucuuucugucacugaaaaugauggacuauucggacaccuccaagggccacagcuacaucagggcuguuuguuucucugaaaccagcacgguguuuggcuccgaagcucugcacccaggcccauucuccaacccaacacuguguggugagaaacacaggugccaauuuccccaaaugauccgagggcaggacuuccuacacuguccugcccugguuuccuuugcuacugcugggccuuccaccaccagcaaggcucgccagccagcaggcagcauuugggugauaacaaaugaggguuuucagcuggagaggauucucugacuucuuauuuugaucuguguucucugaacucugggauuugugugcagggggugauaaugguuuuuuuuuuuguuuguuuguuuguuuguuuuugagugccuggucaacacgucaaucacagucaucauggcucacugcacucuugaccucccaggcucaggcgauccucccaucucagcccccaaacagcugggaccacaggcacgcaccaccuuguauggcucuuuuuuuuuuuuuuuugguagagacagagucucguuauacugcccaggcuggucucuaacgccuggccucccaaagugcugggacuauaggcaccagccugugauaauggcuuuagccagcaccaccuucuguguguucuccuaaucuuauguacauagccauuguuacccccaaugagagacaagaagccugagacuugggaggucagcucugcacccgagagcacacggcuggagauggugcucugcgguuggggcuccacuugccacagggccuccugccccagcacacacucaggggcgggaggggggucacaagcguagaugaguaucuguggucuauggucccuggcagacgccaagccuucaccccaggguggggauucaguaacucuuggaauagcccaggaaucugcauuugaauggacuuccugaccuuaaggugcauggcagggagggugcagacaugaaggcccuuacaggcccaguaaugacccgggaugccugccuagccagcucucagaucccuguaguaaaaugggcaccuggaugcugaugggagugccuggcacagcaggguccagggcuuggucaacaccagcguggacauuaaccuuuuagugugguccuaacugcaacugcccuuccccugacagauauaaguggcccuagcccaggucaucuaguacggagccagcuggggagucaugcgucuacacaaagcacguagacgacuucuggacaguccaggccaugcaugugcuccaaggagccucagcuagcucagaugcccgaacuauccuccaugacauguacgagucagccuugcauccacuggaagccaauuccugggguucaucaucccuguccuccccucugcucauccacauccucagagcugugccccaugaggcuacggggaggggcuggugcugcggggaucaaguuccggcuucaggaggggcccugagguggaaacaggcaggugaggagggggucagccagaugcagggaagccagucuggggcuagggauggaguguggugaggcacccuaagugugggggucuaccuggggcucaggccccugaagcccagagcaagcacaaggugugugagggggauguggggaaggacggagcagaggaaggcagcugucaggggagggccucugggcugcaguggggcucucagcucccccgagggcagggagggccucaaaguguuuaagccaggacggggcacgcgggugucaacccggcucuuccagaagaggcagcuccacagacauugaacaugcccugagacuacacccaucaacaaaacaaaacaagguucacuucugcgacagacgcagcuuucgcagccuucagaaaccaaggaagccaugccagguguggucuuuacuccaugaccacggcagccccuaaaaugcugggcuaauaccccggggggcucaaaccuggaggcccuggggcgagugggccaucgggggagaggggguuccucuggcccaaggucuuggacaggcgugugcucccugcucuccagccgcugugagcugcuuuccugucuacccgcucucuaucucaggcuccccagugcugcccugcggcaccuccugccaucugucuuuccguuucugcucuucugaaagcuuguguuuaaaacaaaauuaagaagccaguucauacgggccuggggaacuuuccugaauauggggaugggaggauugggacaggaacguuccuggguggggccgugaccucccggagcuccucucccucacccauccuaagccaggcccugguggggcagaggcacuuucauuaaaagguucuggaagaaagccagggaaaaggguggaaaacugggaaacaggaagggaagaauuccaccugggcuacccagaagucucccuguggcuuugcugucuaccuucucaguauguagauuuuggggaacauuggcauacugugcgcagaggugugggcugcgaucacagaagccugggagggccuggcugucgaggcucucacucugggguaacccucaagcugacauccagcuugugauuccugcuccccaacagccuuugaaauggcccaggugacccgaccaagccguggggucugagggacaccaugccaggcccagucugugucgcacugcagccaucaguggaauugccugcccugccaggaguaggaaggaagacuuggguugucugcaagagcaccugggucccugagcagagccccggccacuucaugguggacaagcagcaccagagggcaggacaucuggggggcuguuugucacucagcaggaccauggcugugcuggcgaauacagggcccacugaacagcuccacaggcaccacugagguuccuguacucacauaggggauaugcacagagcuccuacugcaggccuggccuugggccagagugaugucugccagucacccaguauucaggaugcacuggguccuggcuccugccugcccucggcucccuccaaaugugggaagagaugguugcuuuggauccagaacaccagugcuccuggccuguucaaugcgggccacccaguuccaccuccugaaggagaagcaccgcgcugcccgugccuuucacggcugccuuccguaguggggaaucuggagucucuggggcuuggggccuacuguagcugagcggcccucaagauaagauuucugggaggcagggaauggaauuccaccaggcccugcagaacugaagcugcguguccuaacaccgcuuggcaagccaacccacaagagccugggugggaagcacacgccugggaagcuggagccuggcccuggaggcuggggacaaggcuuuucugcugagaaaggacacccagccauuccucgagagccuagcugaggaggcuuggggacuguguucuggccaaugggccaccuuuucccacuguggcuuggccagcugaccacgcagcuccacuccccaaagcugugcccuagaggguuccuugagagccgcagcacaucugaugcagaggguaggugugggcgcuucagcuuggagcuuuuuucugacuucuuucccuagugagaggaccgcuugagccuggcccggagaggguacauguugcuuugggguuauucacgaccccuccaaaagugaaaaauuguuaagugauacaaacagccauuaaugaggauccggcaaccaaaacgcucaagggaggcuaggaauaggggcuccgaccccggcgguggggucagugcucugcagacagcgcuugcccauuacucucagugcaugagaggucaaaggcagggcagccucucccagggccauuccucaccaagaggccagcccaaaggguuuggaggugacgugggggacagguuuaugguuugcaucaccaugguucccacucuggccacccccucuacccacucaaucacccaagcucuggcugguguggccacccucaaccucaggaggcugggaggcauuuagaccagcgcaaggcugcggggaugugggaugcggggcugcuccagcuggucaacccucacaggcagggccagcuggaauguggccagagggacagggugugauaugagggugccccagagggcuccccauacccccuuugcugguuccccuucccccaagagguccuucuguguuugaccaccuggggagucacagguuccaaggcuggcaggggcuuggaaggaugggucccaggggaccccagcaggggugguggaagaggaaggcuugggcacaggcauccccagguacacuccggcuggaaacgaagucuaccuggcugcucucuucccccugggccuucacacaugccccugccugagccaggcugcaggggguccucccuggccuccccccauucccacacuggccaacaaagggucuggguaaucugcaaagcccccuccugccccacuccugccugcucuguccaccuuccuggcuccuccgggguaagggcccuccaugacacagcccgcaggucuuuacagguucccuugagcucuccagagagcagagagucagacagaggcucagcaccaaaccccagcuggccacuuucuagcugugucucuacugaggcuccuuggcuguaaauggagcggguggcauggggugcccaugcugagguucaugggaggaugggugaggggcaucucauguuugggucaagacacuugcggucauccucgccaaguaucaucaguggcauuaccgccggaccccacccugcuacuccucaccagcaccaaccaccggcaaucugcccagcugcacccuggagcucugcuugugugacaccuggcccuggcuaggccccuccugcaggcuccccccuggcuuugugcccccauuagaguauccagguaacacugacgagcuggagagcauguguccugagggacccagaagucagguccccaggaccuccauucuuucugaaaggcaccucugucugcaucauucccuugcuuggggaagggaugccaccauuggaaagaugacgacgaugcugcagccacccucaagaugcucuccuaccccuaccaccccggccccaagggcuucgugucccuuucugggaugcuggcuacagcuggugccuucaccucccaggcguuugcaggugcuauguccgccaccuggcaugccgcuuccuccuuugagauuccaccucugugaagccuggccucgccccccacaccccauauguccacccaacacucccugcagcugugagcuccuccaucuaucuagagcaccuauggcgucacagcccugugcccagcccuggggauucagaagugcacaggggaagcagagagaagacaguucucacugauggcagaggggcuguccagcugcccugacuccacugccaccacacuuagcccuaccccgggagccccaacccaggagaguaccagagccuguggcccagcaggcagcucgcccauagugccugcugccucucacgggccugggagggggcugaccuugcggcucaggccaugugaggugagugggcugccagggaggugaggcccaacccccccaugagaugcggaaugcuggaaugcucccauuugacuuauccuguggaugagauggagacgcaggaccucuccagccugggcacugcgccugcccaggacugugcccuucagggagcaggccccagcaacaggagaggcucggaaagaguccuggcccgcauccuuggcgcucuaucucuguggagacugccugugugggggagggcugcaggccugggugccccaaggcgccccccacacaccccugaguggcagccaccuggagcucccugaguuagcaggaaccgagcaggaagcagagaacaaaggcgcggcagugagcggcgugcugggccaucgugucugcagggccaggcuccgagcgcgcguuugcccaucuggaagcaauauugcaguaauguaagacggccagaauacgguauauccucugaauccaugaacucuacagugaggaauauggauuuaauggauaaucuuaccagcagccaagagaacccagauuccuccccaggccuucacccggcacuuggcuucuccugcaacccagcucggccagaggcccgcagagccuguggcuguggccuccagaacaggggccgacccauaaugucagcucacuuuuuucucuugcugggugggucgagggagaacagaaaccuauccacggccaacaagggugccuguccuccagacccccuucccacagugggaaaaauucagcuggagaaagugaagaaauaauggggauggcgauuaaucaaaaucuacaauggcugugacuuguucuggaaucugggggagaagaaaccauuucuguagcucuucccaacguaauauagcuggaauaauaaaauaaaacaauaaaaaccacagcggaaaagaugacuggagaguuuuuauggcgagcagcagaggaagagcccagaaggccugagaagcgcagugaacaaugugauucagggaacguuuccagggagcggaggaggagcgggaugcagguccggcuggcucgggacaccaagcaaguaggggcuccaggcugcucaguccacggaagccacaucccaggcaugguccuggccccucuccgggaucucauuucagaggcucauuaacccuaauguaaaaucccccaaauaccaaaugcuucacaaaguuguuaauuucauggggagucguuagccugcugccuucugggugccccaugccaaggggugguuccucauacuuaccaggucucugguuccucauacuuaccaggaccccugccccacccuguuuacaacccgggugucuuccagggagcugaucuugcucugacaacugccuuggagggaggcgggggcugcaguccuuccauuucccaugcugccuccucccuguguccagcccccaaacucucuaggagaugccaugugugcucccaacccagaggcugugagggagucccgugcagaaaaagugcaggagccaggggacucuggcuuuccagccacuggugugguugcggauggcaaggaaggcugaggcuggaguguccacagggcucuccuguaggccugagcagggaugggggccuuagccagccccuucuucauguuccaaggggaauauggaagccccuaagucuccucaaaccaccuaagagagaagagugucuaacauuugggccgccagcaugcauucagcuggggcggugucuggccugguggcuucgggaauaugugggcgagaucuccacucuaucccuaaauaccucacuaugauuacugggggcucugcucugagucuccccacagcuuuccaggggauggcuggugagucuaacaucccccaggccggacuccuguuccugccccauuugcaccccagccccagcgaggguugugaugaucuccugaggccaggcugcccagcuagagucugcuucccccaggcaggggucaccagugucaguccaucccacacgguaacucccacaucuaguagagggccgggcacccagaaggcacucaauaaaugcaggggguguggaugaauagagagccggcaaguguucauggcuuaaaugagaugcaagcacaaaaccccacucagguuuccaaagggcuagaaagccguuaccuccuuggauccuggccucucccuggcucucugggaggcagggagcacagaaacgauuucuccuuuuuacagauggguagagauucagcaaggcugggcauaccauuuggcagugauccaauuugguccaaaaggacuuggcugugugcugcccaaggggauggacacaggugagcaggugagcagccccagccaccugccaccugccaugccucagggccagccuuucccgugagccaacucugccuccccucaaaggcacccuccucagaagcagugccaggacccucccuccuaagucugcugaguggauuugagacccucgaguugaaaggaaauuugaaaaauaaaacuccuuuguaagcugccaaaguucuauuucccuggugguaaagccuuaagauaccucacuuaguuuaagcacaguuuaccgauugugaggucugacugggaaauagcuccauuguacccacagacccucugugggacccugugccuugugcauggccgugggguacagagguuggugggauaguggagucacccuggccuccgagagccccguucugggcaggcgacacccaagguugagaagauuccacaagcugccacagagcacuuggauaagaugguggcucaguaagcccacaggagguguuucaugacggcucacagaaaagggaggagagagaacacuccaggcaggaugcaggaugugcaaagacuugggcaacaauuagugcgcaagacaggagaccacaaagaagcauuaccagaagccaagggccugaaaggggccaugagcccuggagucggggagagacuccaagggagaugggcuggaggaugggcagaacccaguacauggggaggaaguauggcugccagucacugucacacaaaacccuguaggauuuacaaaguagugcaaaaacuauacugaaaacuaugagauauucuugaaccaaauuuuuaaaaauccaaauacaaugaaauacaugcucuuggauuggaagacuuaacacauuguuaagauggcaauacuccccaaguugaccuacagauucaaugcaaucccuauugguaucccagaugguuucuuugcagaaauugacaagcugauuguaaaauucauauggaaauucaagggacccagaauagccaaaauaaucuugaaaaagaaaaacaaaguuggaaaacccacuuuccaauuuuaaaacucacuacaaagcuauaacaaucaagacgauauaguacuggcauaaggauagacaaacaaaucaauagaauaaaauugagaauccagaaauaaaccuucauauuuacugucaacugauuuuugacaaggguaucaacauccuucacugaggaaagaagagucuuuucaacaaaugguguugggauaacugucuauccacaugacaaagaauaaaguuagaccccuaccucacaccauauguuaaacuaacugaaagcggaugaaagaccuaaguguaagagccaaaacuauaaaauucuuggaagaaaauauagggguaaaucuuuuugaccucagauuacauguuguuauuuaguuaugacaccaaaaacauaagcauccaaagaaagaaacagauaaauugaacuucaucaaaauuaaaaaccuuugugagucaaaggacaugaucaagaaagugaaaagacaacccacaaaaaggaagaaaauauaucugauaaggaacuugaaucuagaauauaaaaaacuuauaucuagacuauaaagaacucuacuaaauaauaaaaacacaacccaauuaaaauuugggcaaagaauuugaauacauacuucuucaaagaagagauacaaauggcuaauaagaugcucaacaucauuagucaucggggaaaugcaaaucaaaaccacuaggagauaucacuucacacccacuaagauggcuaaaaugaaaacggcagacaguaacaaguguuggugagaauguggagagauaggaacucacauacacuacuggugggaaugcaaaauggugcugccacauuggaaaacagucuggcagauccucaaaagguuaaauauggagucaccauaugacccagcguuucuacuccucugugaauacucaagaaaaaugaaaaucuauguccacaauaaaaacucguacccaaauguuccuggcaguauuauucacuaauagcuaaaaaguaaaaauggcccaaguguucaaugaaugaauggauaaauaaaaugugauaauauccauaaaauggcauauuauuuggcccuaaaaaggaaugaaacacugauacaugcuacagcaugaaugaaccucgaaaaccuuaggcuaagugaaagaagucagccacaaaagucugcuuagugugugauuccagcuaugugaaauguucagaacaggcaaacccguggagauagaaagcagagccguggcugacuggggcuggggaaugagagaagggaaguggggagugacggcuaaagaaugcaggguugcuuuuaggggcacugaaaauguucuggaacuagauagugugaugguugcgcaacucugaacguacuaaaaaccguugaaucguacacuuuaaaugggugaauuguaugguaugugaauuuuaucuuaauaaagcuguuacaaaaacaaaaaugaacaccaaaaaauacaaaauaaaaaaaaaacagcccugcaggaccguagcaccagagcagacaccgagaguggcucccaauuccaggaagcccccgcagguccuggcgucugagccucugcccgcuucuugcugcacgguucccagguuugauauuucucaugcugaaagcccaggaacagggagccagaaguccucugcagcuggggcugggggguggggguggggggggccuggaagccgugcaggagagauggaggcucccacgcuccagggccaagcugacgugacuaaagcuaaacagaccccgugccacaacaggguuacagcgaauucugugcagcacacucagccgcucgccagugauggcagccucagggaggggcgguggagcaggcagccccaaagguaauuugcacacggaguuuauaaggccccucagcucuuuuaaacauaugcuucucugauuauaaacagcugauggcucacaagauucagauuuuccagcagggcuuccaaaaaaagauugcacuccaagcagagaaaggugaccgggugcuuugccgcagacguaaauccagccauguucucgcacagcuggagcugccccuguugccaggcuucgaacaugucacaucuuuaaaauguuugcugcuauugacaugucccaaggagggcuuuagcccuggccauuggccuggggagagaacagggagauggaaauggaccgccccccgcaacccgcguauaaacuguaucuucugccuccuaagagcugaggcugccugaaacccucaccucuugcucagaggugcuuagacccagaucaagggucaaaauuagaggcccuggggugagucuucuggucacugcccacccugugcaccccaggggucuccgcaccgacccucuugggguuggucccuuugcugccugccuggcccaccagggggauaagccugggcuccaccuccagccuccucagccccacccuccucgggggcugugggugcccugaagagaaguuacaaagaaaagaaaggagcagggagcaaaacagaaacgccagcaaggagccucaggaccacgugccuaagugagcucccaauucacugcuuugccaaguuccgcucagccaugccagcggcccgggccgcagacaccagugaggaaagggauccuguugagaagagugucaaagucaagucuccaaagcggcugcugaagaagugugcacgguggguucaggagcucucucccuacugaggaaagagucacagaggacuccccagcccaguuccauaaaaaacaauguuguguucaaguggaacaauucaugagcguggucuccugggugcccccgaucuuggccaucuguuugggaaaucuugggaaacaggggaacagcccugaggggccuggugcuuugggagguuggcugcccacaccaccuccucgaccugugcacauucacccggccacacacaggaacucugggggguggcacaugcagguucggcgcucaagaagccaaaugugggccaaggcacaccugcccugucccccaugcuccaugaaaggagcugccucugcaaacaggggcugugucccucacaccaaggccguguggcagagggggagggauagacccuggcuccaggauacccaggugcagcccagcucuaguagcuucuacauccuaaggccugcccaaucccuugaccuugcuaugccucaguuuucccaucucuacagugggugguaguguggaugaagcccucagaaccaugccugacauacuaagugcuacaggacuaauugggagauaaacaaagccucccugcuuggagugugccagugcacauccauuuaucgcucuccuggguccaggcugcucugagagccuggcaggucucagagcuggaccuaugaacugacggcccagaacaccagcuaggaguaagguuggaggcaggggcugccuggggguggggugggggcacaguccccaaaagggagggcucuuggaagagugguggcagcucugugcccaggcagggccugacuagggcaguucuguccuguucuguaacuugccuccugagggcuaaaggaauuucucaacacugcaaugucugcuuuuuauuccaguggacguuacagcagaagcaaucccugcuucuggcacaggccuguccccaagacccagggauaagagaaaaacaguagugagcuuuggugcuacuucucauccaccuacagcaucccaucaccaccccaucacaccugcucccccuucucuguggcugaccccaagagggcccuuugacauuccugggcauagaaaacaaauuugggacagaaguggcuguugagaaccccgcuccugguccuugugggugcugcccuuagccuuauccaugucccaaggaaauggauuugguguucucuuggggagaaaaggucacccguuacauuuccuaaaucacauuccaacugucaguuucucccacccaucacgcacccucuccacccacuccacccaaaaugccacagcucucugcugccuuagagacugcaggagucaaaaccgcucuccuuucugggagugggaccugcaccggggagugguucucacgaggagccuagguuaagagccacuggucuggugggcagaguucaaacucugcaagagcaaagacaugcuauguaugccuggggugggcaugcuaccugggcacaguacucuuucuccugggagccaccaaccaucaguaaaagccaacagguaggcugagcccacuuugcugccccugacaagggucagacuaagccuggugagaguggguggcucugucagcuggccuuugcugugugacaagucacccuacagcuucauuccuaaagcagcccacauuuaucaucccacaugguuucugugggcgagggaucuggggguggcuuggcugggugguucugaucuccugugaggcugcagucaagguguagaccagggcugcugucucaucagagguuugacuggggcuggaggauccacucccaagcucauacaggaggccauuuauaggaggccucaguuccucaccacaggaccucuccagagggcugcuaguguccucacaccaugguggcuggcuucccccaaaaucagugaucccagugagagggcagggaggcugcaaggccuagucuuggaagucaugcucugucacuucuuccauauuuuauuugaaagaagcaaaucacaguccagccaaaacuuaauuagaggggaauuaagugccacuuccggaagaacggauugucaaaggccuuguagacacauacuaaaaccaccacagccacacgguaccccagguagguuucccuuucuuucccauucuugucuuuuuccuccaaauuacauccaucuucugagccugccuagcuugauuagaauauucucuucagguucucuaaggaccuuuacugccaaugacucugcacccacugcucaccagaggccugguggguuucauuucagcagccucacccucuacaaguacagagcugggaauggaguaggcucucugcaaauaucuguucucacuacaaauaccgauccagggccuuuuaaugcguaaaacaaacuauaaccaccagagcgacagggauggggcuuuuuguuaacaccucucccaggacucaagagauaaucagaaacaacuucccagguuggcccuggcuguggcaauguccucaaaggccugggcccacuuuucccuggcaggcugaggggauuguucuuggcuggggggcagcuguggaaguggcaggccugcacaggaaggggggcacacaccccgagcuugggaugcuuugugggaggaagcugccucuggaagguggugguagaaaaggcccugcaggcaaugggucuggcaggcccaguucacuucauuuucccacccccccgugccuggcacccaaccaggccccaagcaggugcucaggagacagcugcugaguuaacccgcgucgaagugggggcucugggagaguuggguucggcuaaucaaggcuuggcugagcaaugcccaaacauauacacacacagcacagcugcccucccaaugggaacuggcccacaccccgugcugccacucauggagaccgccugaacuccagaccccccacccgucuggccucacguuaucacugaccccaaaugcaggaacgcaaaucugccugugaggacaggcugggagugacccuaacacagcacuguugucugagggcauuccccgagcagcccaugcugaggcugcucuugcaugggggcugagacuguccuggaaugggggauucccugagggagcaggaccugcaucugucacacucugucagccugagccgugugccucucccugggccuuggguagcuaagacggcaauggacaccacaaacaggccaugccacagggugacagugccccagagccacagaguugucacugcagcuggguggagggauagggucugaccccacuauauccaagccagaucuucagaaacccuccaaacccguccuucccuugggcucgcucguggucauacaugcacuaggcugcuaccccuguuggaugcugagggcuaccuuaagcuccucccuguccucagccagaagucuagacaaaguugccgccugagggagcccagccuggcacuucucacaccuccacagaugcucgcuuucuccaacccucccaucucucucacugggugacggcaagucccccguagucuucccccucacccugcugccucucuucaguucucucucuguucagcagccagagugaccuuucuagaagggagaucugauccuuggcacugccuugcccaaaaccuccuagagacuccccacugugccuccccucugacgacagccuacaaggcccaaaaggacccagagccugcccauccugguggggaugugauuuggguggggacaugaguccaugccaccuguggguacagcagagaccuggggcaggaagucaaguaaacaugucucaaaggaauagccgucucaugggcucagugggaacagaguugacaacaggcccauguaccugaaaccaucaaguuggaagggaagccccaguggaaugcaggugcaggcgacacacaggccacaggaggcggaagauucuggaacaaggacaugggcugcagggucagcagaaaccuaugaccagugaaggaagaaggugggcguugcaggaucacagagcccuuacccaggacagcugcagugguggguguguggaccaaugcaugcaaaaagccucacugaaggggaccgaggaggggccacagacugccaacugcaagggcugaccuuaagagcaggcuuccuggcaaugcaucagccacucagggauaacccugagguccuaaccacccccacucccccacguuccuguccacuccugagagcagcgugggguggggccuuucuucagauggacugcggaggcugccacguggcccugggccucucagcuuccgagggaagcagcaacuugggaaccuggcugggucugaagaugguuccacccuuagacuccgagggugggggcaggguagggagagaauugaggcccacagaacuccuuggccagggccugccacacauccugcugcuugggugaggggcucccacagcaguucuuucuccugccuugcacugcagaagaggacugguguuuccccugggacaccgccggggcucugggccccaucugcacuucugugcuggcaaaugcaaaagaauuagcucagcaacuuccuccccuaaucccccacccccacucuaaauaccuuggaaucaagagaaaagccgaguggacguuuugagccuaauucucuucagcugugagugcgugugugcgugcgugcucucgggugcacaggcuugcaagggaaccuuuugaaccccaaagaguaaagcuggagggagugcaaggaacgcuagcucagccccuaccauguacagaugaggcaaaccagacacaaaaggagaaugggaccugcccucugucacguggggagcucagggaguggccaccaggugcccaggcucucugucucacacccaccccugcagccuugagucccaagaaggugacaaggugcaggcgccaaauuucaaagccuuccacaacccacagaacaauucagaaagggagcuggccgugacugcagcccccucccagaauucugccauggugcccaaggccagcccugggcucaccucccagccugccuggcagcccccaucugccucuggggcuggccuggaguccgcccagccucacaugcuucucuagccaauucccacgugucucuugucgcccgacgagacaacaaaccccucucagucucggccuguuuuccucuccacucuucccccaaaggacuagaggaggcgggagugggggcacacaacaggugcgcugggcuggcaggcggcgcuggcugauugacggcaccccguguguggcgagggggugaggagcagaggacauaggacacagaacuguccuuccugaccacgucuggugagcuggucacaaacaauagugacaggcuccuuggccuggcaaccccacugcuaagaguacucaaggagaccucacacaagcacacaaggugaggugcccauggaauaucacaggcggggaauuugucagggaaaaauccaagugcccaggagcuuggggucugagguuccaggguuagguagaggguggaggcaagcccagaacaugaaaaucuauauaaaugaaucaacuacuuguaagauauguccccauccaggcccacaauuagaacccacaguuuuguuaaguguaagaccaaauaagcucaauuuucaugacuuuacaaaucaguuuucaagauaaaaauccuaaccaacacccuuugucacucuuuaguaggaggguggacaccauuuuaagugaaauugauuuagggagcuuuucagccuguguucgacauccuuggagaacacaacaacaaaggcugggagacagcucuguguccaagagcgaggacugaaggaguccaccaggcuaccuccuccaucugaugcagcuaacaaaggcccaaagaaaaauggccacguuucgaaaaucugucuuucccaccagaauguaaaccccacaugagugggacuuuuauucuggugaaaucugugaaaugacucugaagaccugggauccugcuccccugaccuccuggggagguagaaauggacaugcagggagggugaucaggggaggauucuggccuccugaggaaggcugaggaaggccagaggaggccugggggccacagugaggcuggaauugagcugcaccccaagcagcaaaaaggagcaggacaggggccugaggccacccucaacucaacauuccugacccugucuucucacauaaucucucucguuuccuaucucaauggcuccaagaggcugucagcaucaccuccauccuacaggcggggaaaugagacuugcagguaucucugcauugcagaguccaggccagggucaggacuccagcccugcccugcucuuuuuggucaggggcagagaauaauaguggucacugagugggaguugugauccuuuggaugucaagagagaggcugggcacagaggaagcaggcagacaggcagcugauaaucuguccugaggaggcaggaaggugggaaagccacuugggagcugaaguuccaagcuccauuuuccccucagacuucacuucuaaaacacaaguucaaagauaguaacuaucaagaauuucaagacagugacauuauagcgugaaacccugagucuggggugcaccugagcacuggcucugagugauggcacugguugcacagcugccucucggacaggcagaugacaaaaacuucccagcuagauagugaggguggacugcgcccucugaucagacacaugaacucccugggccagugcgaagggacaggcgcccaggggaugugucacuugugcccagauugccugugggcugagcaggaggcagggaguggacucaucugggcgucguugcugaaggccugaaaggaaucacuugcugccugaaaaaaugacaccauuuucucuuucucuucugggcugaagaacaacaaaacccccaacccggucacccuuggagagagauuccuggcucucccguagacguauauuuucggcagaggcagugaagaugaauggccuccuugcgugccuugguggggggacggcuggcucgcuuggcuggcuccagccucccccuuccuccuguguuugaggucaacccuggguugggguuguaacaacuuucgagaacauacccagaguccugcauuccaacacuguuuuugcaguccacauggaagggccaaacggcccccagccuugccagggaagccucagggugugaacuucuagagggggcuuuugugacccaggcuuuuguccccggaguuuauggcaaugcuuggcauucagaaggcgcgcgccagcggcgcggaggggacggacaaggggaggggccggcagacgcggucaagugucacgcccggaugggggaugggaggugggcagggcgggcccggccgggcgcuggcaggcgcggggcgcccucggcgcugcccuuugccagguggguggccuggcaugucccggccaccccugccacucacccccugaggucccaaguccucaggggugagcggcagacacggguguuccaggcacagcagugggggcuucagaacaucccgauccccugcauggacccgcugggaggggggaaaacgccucccgcacccggugccacggcgguggagaccuugcccggguucgagggucgcugcagcggcgccggcggaggggcuggucucgggcguggccuggacgcccacaggccuccacaccgagggcccacagcagugucggggugcggccgcuguccucacgcggucaccccgggguggugaacacaucacgcagagaacuggcccgugucuccagcucaccccggcgaugccaacgcugaggcuggcgcuggccccggcccccgguggugcucagggacgacgggugggggcagggagggcggcggcucgcgccaccucacacccagccagugccucaugcggcgcuggacccgcugggccaaucugagcccggguggcaucaaaacgagacucuuucggccaaugacaggacacggcacaucacuuuccgcacccagccaauccgugcagcagcccgccgcaagccuuccccugcugccgcccaaucagcagguggggggcggucgccacgucggcagcggcgggggcagucggagcgcugccgcagucuccaggcagaacggucgccgcgucgccucagcacggaccuccagggagcuccucagcaagauccugccagggcgccccucagcgcgauucugccggggugccucucagcgugguccuccccggggcuccucagcacgauucucccggugcgccccucagcgcgguccuccucggugcgucagucaucgugguucuccccggcgcgccccucggcgcgguucuccucggggcuccucagcgcggcgcucuucugggggcuccucggcgcaguucuccccggggacuccucggcgccguucuccucggggcacccggggcuuuucggcgcgguucuccccggggguucuucggcgcgguuguccccggggguucuucggcgcgguucucuccgggggccucucgccgcgguucuguucuccccgggggcuccucagcaugguucuccuccgcgcgguccucccugggccuccucagcgcggcacucuccugggggcuccucagcgcggcacucuccccgggggcuccucagcgcggcacucucccggcggcuccucagugcgguucucccagacucuccucagcgcggcccuccccaucucucugggaggguuugaacacggucagcacggaccugggcggacggcgcgggacgggugaucacuggcguugcugaggugagcugugugccccgcggccgucccagaucacaggcgucagcagugcagccuggccugggcagugcgcucccaucugcaccuuauggacagcguggccagggucgagguccgaguuccuggccgcgucccaaggaucggauuccgggucuauaguucucauggugguucagagugggcugaauugggauuggagucuggaauccgcaucgugguucugaguccgcgcuauugggauggaaguugggaauccauguugugguuuugagucaaagcccgaauugggaccggagucggaaauccacuuagugguucugagucagggcccgaauuaggaucggaggugggaauccccguugugguucugaguuagguauccuaguugggaucagaauucgggucuaggguccacauccuggcugggaguuugccugaguugggaucugaguaguuggggucccagucaguccgggucuggaguccgcauggugguuuuagguagggccucauuagggacagaggaucgggagucugaguuggggaccugaaucccggucuggagucugcaucauggcucugaguugagauccaagggagguccgaguuggcgacuggagucagggucuggagucugucuuuggguagagguucugaauggggggcucugaguuaagagauugggauugggguuagaggucucagugggguaugggagucaggaauugaagucgaaguucugccucuagguggggauucugagucaggaauuagggggcgaaguaaagguugcagucugaguuggggguggugaucaccugccaggugagagguagugguagaagucucuuggucauauuggagaugagaguugaucagaugcaggucucagucuggguaguaggcuugaagggccaccacuauguucagaucccaguaccccacuguggucccugagcaggucaaauagccuuuuauauaaaauugagaguaagagugccuucccacagcacuguucugguuaugaaagagaauaauucauccagguagaauaguucugucuuagauuaucacaaaguauaaaaacuuuccugauaauauccacauuugaugugcauuuaccaguucuuucuuuacuguggugccccuuuugcuagaccaaaagcucccaacgaggaacucuguuuuguuuucugcugccugcucuguacccagccaagagccugauacacagccuuacucagucaguacuugaaggaaagcaggcaggcaggauuaaccagauuucuauggugucucaaaugauccauuucugcaccuguuuuccagauacucaguaggagaaaaauuuaaggauugaguugcuugauuauggguguauuuuaauguguuuccuaacaugcugaggagaaaagugggucuguuucaggauuuaugcuccagcuagagggauuuuuuaaaauugcgaaucagagcauguccaaauucagauagaaagcacaagaaaacuauaaagaauuucccuuaugaauguagaugcagaaguuccuuguacaaugcuagcuaacugaauccaauaauauguauuaaacaacaauucuuaaacaagugggauugcucuuaggaaugcaaagaugauccaauaucagaaacuuuauccauguaauucacauuaagaggcuacaggagaaaaaccauaugguucccucaauagaggcagaaaaaaaugaugugauaaaguuuaacgccuaugugugauuuugggguaguggaguacaccacuuagcaagccaggacuagagaggaacuucuucaacuugauacaaguuauaaaccaaaacuuaacuuuucaguaaacuugauagagaaauuaaaaguguaucauucucuuuaagauaaggaguaggccaaggaugucauccuggccauacccuaauacaagaaaaagaaauggggaugugaggaucagguaggaagugauaaaacuuaguguagcucauaggguugauggucuccauaaagauucucaaacauuuugguguuacgacuuguuguauucuuaaaaguuauugaaacccccaaagggcuuuucuugauagagauucuaucuguugauaguuaccaucuuagaaguuaaaacuaagaaauguuuaaagcagaacuauacaagcacauauuccacuggggucauggugugcugccucuggaaaacucuuuaucuuugugagaaugaaagaaaaggcaaauaaugucgaguauuauuaugaaaauguuuuugaccuuuccugaaagggucuggggggcucucuggaauccccagacuacacuuugaaaauuacugggcuacauggaaaaaaaaaauuaaggaacuuaacaacuaaagagagauuucagauuucagagagguuuuggauauaagaucaguguacucaaaacaaaaaacaaaaacaaaccacauuucuuuaugccaauagcaacugacuaaaaaaaagcauaauagagauuaggacagcaaucagaauagcagcaaaauuuauaccagucuaggaauuaacaaagacgacgacuuuuauggaaaaaauuuuaaaacucuauuggaggauauagagggagaucuuuccauaugcagagacauuuuauuuucuugaacagggcaacuuggcauuagaaugacgucaggauuuuccaaaucuguuaaguucaacaggacuccacucaaacuuccaguuggagggcuugaguaauuuaacaaacauauucuaaaauguauguggaagaaaaauauuuguaaaugccaacugaacuuuugaaaaggagagcagaggacuucugcuggcagauaccagggcacacgccaacuucagcaaucagagcgguguggugacagaggcccagaagagagcucagagguaacuccaagucuagaggaaggggacaugugauaaagguggcaccacauaucaguggggacuguucagaagaugauguuggaaagccagcccuaaaauggaggaauaggaauauggauuccuaacugagccccuaggaaaaguagacuccaaauggacuaaauauuugaaagcaaaagguaguugccauuuguuuaauaggagaaaaaaugaauaaucuccagggccaggguggccgugggguucuuaaacaggauccagaaagcacaaaccucaagacuaaaauguaugaacuugaaugcauuaaugauuauggauuaaggauuucuguuaaauaaauccaucauggcaagggucaagacuguuuucauaauaauacuaaggaaacaauuugcguuuuucacuuuuacacucaugaauguaacuuugccaugacucauuacaagauauuugaaacaauuaaagcugaggagggaacaacagcuaaaauauaccagaaagcaccacaaaucauuaagaaaaagguaggaagauugccaguuugcaggaggguuaacaaacagaugaaaauuugcccaagcuaaucaguuaucagagaaauguaaaugaaagcaacagcuauucuucauaggagaagcauuagaaaguaggauaaggccaaguguuggcagaaggcaaggaacaagccucccugugugcugcagguggggacggagacaggcacagacguucugaagagcuggccaacacuucuuccucaaauaaaauauuuuauaccuguggcccagcaguuucccuccuaaguaaacaugcuggagcaguucucacccagaacaacgagaggcugugugugugcaugcucagggcagcauggcccauaggggugggcaguuggagcuggucacugugguuaggagcaggggacuagauguacacuucacaagauagagacgcguggaaacacagugcugagugacacaaaugccaaacagaaagagggccucaguacaugacuguguauuuaaauuaaaauuacacaccacccagacacgcaguacuagggagugcucgugagugcacacacacacacacaaugauauaaauaaauuacccuggagaagcuguuuguguagggaggagagcaaggauagaggcuagagaugaaguggaaaagcauggagaggaagagagcggugacuuuaugcagacccuuacagggugacaguguuucauaggcugagggcugugaucaacucugugcagagucccaaaagccaagaaccaacgaaugaaugugccuccaugacucuccugccagauacccucuaguggcuucuauuucuaggaaauaaaauucaaauuccaucagguuuuuacaagaucugcccugcuuaccucucugaccacuguccucccucacugagcuuuggcucugccagccuucuucuucuuuguuaaaucugccaaguaucccuccugccccaaggccuucaccaccucugccuggcuugucuuuucuggugaucuucccuugacaauuccuucuucuuauuuaaaucucacaggaaauuuugcucugaccugccauaucugucauccccuucagucacucacuagcugacgacuaccuuucgagucucugcaaagcacaggcuacgcuuuucuaguuccuuagacaucuacuuauuuguuggcugccuaucucuuccaccggaagagaggccccaagagagcauaucugucuuccguauaggguccgcacauggugggugugucacagauuucuguugaaugguuucauucauuuauugaacgaaggaagaggccaggccaggaaagugugccuccauuuucacaacucagugagaaagcaaauagcaugucaaaaucugaccccuugcaaccaggguuucuuagccagccacacugguaaugcuugggacaggauguaucuuuguugugaggggcugucauuuauauuguaagauguuuagcacccugccuggucucuaccuaguugauauuaguaauucucccauagucaugauagccaaaaauaucuccagacauugccauauguccccuggggggcaccgcagaugacaaccacuuccuuagaacagcucuugggacugggauggugucucugcuguggcucuuuaaaggcagcaggcccuggcuugcauccugccacaucuaacaccuauagccucaccaccucggugagaaagacccuggcccaggccuggccaaucagaguacccucuucccuggucagcaguauaauuuguuuggcaagcacuuccagucccacaaccuaugggcugccacccagagguuuaguuggaacuacgugucagcugccgucccucagccaucuauggcaugggcaccuguggcuugaccaaguuggagguggccuagagaggccgggcugggccugcucaccuucuccaguuagugcagacugaugaaugagugguucucagcggauaccggauccagguuugcaguacacuccaggaggaggacgaguaggguuucccucagagcaggccuggaugggagggcaagggguggccucuaauacugccuuuccuuccggugccuuuaucagccugugccaugcuccucugaacuggccggccccagcauguccagguuacuggcaggagccuguauaacccaggguuccagucacaccagccaggaaggcccaugaggcuggagcgcacccagucucuggcugcucugucugcggaacuaaaagccuuucucccagagccuuuccuacggcugggcgaagcucuuguuugcaauuuaaauguggccucauuuauggaagaaucccugcuccuccgaaaagccuugggcucaaccucccuagcagcccgggccucagccaggagaagaaauggaucuaaaaggccuuucuccugcuaauuguagcaauuagcauuagagaauggggacucgauggggggccagcgccuggcaaaacaagcuuauucccagcuuaggcccaggcccagcuccacacacugcugcuuggccagacucggcccccacccagggucugguuggcuucagggcagggagagagggcccaggccugugggugcuaagagcaguuguggagggugugcaucugaguuguuaagccugguagcuguacagguagcccugggcuaugacuugugguccucucagaaaagggucugacuggaacgcagagccagaccagauauucaugaguggaucacagaguguagacugagggcuaucuggugauugacagaaaguagucuuggggcaaaugacucuuaaagaguaaggagccauuccccucuauggcuaacuggaugccuuucucucccccugcuccagaaaggacuuccuguuccuucacugagcgugcuugcuuaugaggcuucuggaaaccaggagaguucagugggccucauuauugagcguaugggcaggacaaccugcuugggacauaggccaugcuacaguugauuuuagccagcuugcugcaucuacacagcacagugccuucccaggcagugaauuaugucuaacaggcaggggaaugaucauugccucauguuagggaugcagucauucaagaaauauuugucaaacacucagcagguacuagacccuggcccagagggagggauuugauaggagcagggaccugccuacccucccaggguuaguggacaaaggggagaaagacuaacuaauguugaaggaccguuugcacccugaggggagugcugaggccugggagcacagcagguguauagcaggaacccacuggaacuagccuggggucugaaaaacucccuuggggaaaguggcaggggcaggccaagggcccucuggugguagggagccugugagcaccugggauggaaagaagccaagcaucugaacuaccagaaaggcagcugcaggauuaagcaagacccacaggucucuaaacuuugaaaggaugucuguccacugaguagauaauugauuggaauggggcaggggaugugagaaugccaguuaggagaugccugcaguacagagaaaugguggccuaucaggacaguggcaauagggauggagggaagcagggaaccucuagaacuauggaugggugaaguaagccuggcuuggugaugggcuugaggugaugggcagguggugaggaagcggguguaucggaaaugaccccagaacuucugacuugugccacugaaaggaugggugacacugaaaggacaggggccuucaguagagugggcuauaaaaugauggaggcuguggagaggaggugggggcaggugacuggaaugugggucuggcuggguuggagagacauuuggggggucagggccucacagguggucuggaagcccuuggugcugagggaacagcuuagggaaaugguuugcauagagaaaggcacuggcauuuaguggccaugccagaagggaaaaccugccaaggagacugaggauagagccagaaagauggcaagaaagccaggagaacuggagggauggaaaagaggaccuaggggucaugguccuggcagaggucacauuggauccagugcuugugauucucugauugcuggcaguggauggccacuggccugcaaauggcccuaguggaauguccccugccuguguggcucccugugggcugccucuccccuggacagauggggagagaccccuuccccaccugguucucuguuucacccuuggaacuguggcgguaaagaggaccuccccacaguacgugcagggaacaagcuagguugacucccucagggaggccucguccuugcugagguauuucauaaccucaggauagagaaauccccccaacuuuaaugcaaagccaagcaagcugaaaaauggccuugaauaggcugagaugaaaaaacaaagaggcugucaacaucagagacucagugggggcagggagcuucaguggacuccccacagacagcaguuccugggcuucuaugcccagacccagaggccugagcccaagaugucaggauggguggucacuguaagugcaguggauuguagcucaggggugagacaucgccuuuuucuugucagcucuccuuccugauuaguggcucaaacagccuuccgagacucaagggguuaacugcagauccucuaacuccuccacuugcuaauuuuuaaacacagcugagcucugagcaccccucccaaggcugugagaggccagaggccagcacagacucugcaccaggucugcacagccuccaccccuacuguugucaggaaucugcaggcaucuagaacaaaggugccuccauuauuucccucacccagcauauccugauaccugagccaagaguucacccagagcuuuugcccacuucauugauggucuggugggcuuuuguugacacauacccgugacucccaaaugaaccuuucagguuggcuuaaagccgcugggaccuacacaugacaaaacccagacggaaacaguggcuuacacuccugugucccuaaagguaccuguuccuaacagugggagugccagagccuggaagcuggaagccaaggagacagggaccucccuccugcugacccccugccaggccacauccaccuaagggauuugggaucauacuccaucuucaaccacugggaucaaauggaaagcccucaggaauucugagagacagccccuauaccuaugugcacugacacacauacacugacaaauacgcauucugacacauauaugaacaugcacauaugugugccccacucccugccaggagguggguucugucccaucuuugacauguuacuucuuguccuucccuaggcccaguggcacuuucuuugugauaggugcugagacccccccgacugggcccaguggcuguucccaggacccagucucugcucuuaucuuaacccagcucuagcucccaggaccccagccuuucgcagggagagagauagcucuuuuggucuggcacauguuccaugccaaguaguggaaacagcagcugcagggcagccucagacuugacaucauuuaauccuugugacaauccuacagggaggaagacacuacacauaugugcagaugcagcaaggagcagcucagccacauggaaugacuugcuugaggucaccaggcacuugacacagcagaguuuagcccagucucuggagagaccagccuuccacauccugucaugcuggggagggcugcccgcuuuuugucccugcucccccaguucuaaccccggaagagcgauugucccugcugugccuucagcccagacagaagcaggcuaggagaggggaggagaggcagggcuggcccucggaaggcucaccuuccucaacaguucucugcuugggcaaaggucuuccaagcagccaggcucugaggcuagucacugucaucguugggugaggcagccugggaguaccagaaguuggagcaggugggaaccuuccccagggauggggcuggauaggcaggggugggugcuaaguggcaggccacaaccaggcaccugggagggccaagcaccacacugagaacgcagugcuuccccuccccuccuaggcugcucaggaacccaucagucuccuguaaacaaaugagacuaagucucuggcacucuaggcccaggugcaaaggacagcugccccugcagcuacucacucugcccuggcccucucaggaggcuugugaccucugcaccugcuggcuuguuuuguuccuaaaauacccggauccuugagaaucuagaagacaccacugcuaacagauuuccacaucauucauucuguucuuccugugcaagcuucaugcugggacagggaccauaaaacaaggugacccaaaaccuucagcagaaugcagguaggcagagcagaggucucugggagugucauuccaaggcagugucuuccuccuccccuaugcuccccauuucccaagagugggcuucuuccaccccacucaagcaccucuucccaaggcugaccuaaaggccucaagcucugcggauaggggcaguccugagguggcauugagucuuaggguuggagugggagauaucugugcaaaggcugauaggaacguccuccaagggcugacuucaaagcuuggccuaaaccacugcaucaaagucagcaagcugagcuguuugcacagaaaaggaggaggagcaggcccuugagccaccuguagcucuccuuagggucucaggcuuucacaccagggcaggccuugggccagacuacccaacuuccaggccggaugugccaccggggaggaggagguaacugccccucaaaacccugcagcccagggcuccaggauuccaacccagggaccugcaggcuccccugcucuccagaucagaccccuacucucagagcccuaggcccagugggugacagccugugagacaggccugugugggguggcccuagccccaccucagcuuccaaccugaccuugcugcaugaccucuggcccagcccucuccaccuggagugccaucucucuuugugggaugggccaggugggcugugugugggggagggcaaguauauaggugugguauagguggaaacugccacaguaaccagcagcagcucagagccgggccacccaauuuguaugccagccccagcugggccuaggcacgugguguguggaaaugaacgaagcaggcagcccuauguuuaggaggcagguccagagcucacccaggcacagcacaagaugagugccuggccucagugagcgagcacuggcugcuaugaggcugugguguggaaccuugacacuagggccacuggccuggcugugugaccucuaccucaucacccagagcagggcaaccagaggcagagccucagugugguguucuccugugaaauagugauggcacaggcaggggcuggggcccagugccuacacagaggaucagcaaaggauggcaguuauugaaaccucuacggggaaguuccccagacacgagaggaagacccccauggaagcugugugugugacgugcuuagauuuuccagagucuucauuuuccuugucuaaacagaggucauggcgccucccucucagaucaaacagcccuguaugaguggcuacaaccuuuggugggcucagugcagccccuccugcccccuugcuugggagcugucugcagaggccuagggagcugcguggggucucuccaccucagccuguauccccacccccaccagguccccugccugacuccagcauacccaggcccuagaagcaccaacuccauggcugcagcugaguggagugugugccugcccaagccuagaggggugcugaccccucccucgcacgaggagacaucaaagggaagcaggaagcagcggccuggcugacccacagcgggugggagaagugcagccucacaacugcuggggauuuuccaucccaccaggauuuccgcgggacaccccaaguccagccuuugaggcuccucaggaaccagaguuuggccuggagccaguuggggcagaggaggggggccaggcuggguggcuuaggggugugguuaggccugcuaaggggcuccucuucucagucuccccaugauuugcugguuacuggcuugaaaucugggcccagacccauuccaacacugaacccugagcucccugagaccuggcuggcaaggacaggucccaauuuuuacaggggccugagaggaauggagaagggaucucugccccuuccuuucucagucacaccuccuugacagggggucaucagagugggcugugguaggugcaccagggaagggaccauacagaggaggcuggucucaaguccuagggugccugggauggcccuauugaaaugcugcagcagcucuugugcaggcagggaucuguauggacagcuggguggacacaggugccuacugaccucccagauccuucagcagagcucagcccugagugacagcccaaggcagaccuggcuaccucagccucuggcucacagcccucagccagagcccugagaggccugggaucucaaagcugcaaggugggaggccagaggagagaagcccggagcugguagugaugcuggcugagugaaaauugcacauuucccaacagugugaugcucccuauccagccugggcuuuuggcagacuucugugcuuuguggaggaagcuggcucagauuccuccccucccugugcaguuugugugucaagguguacuugucacacccaacucaggauaucuugcaucacuuuguggguccuugucccccagagcugggacugcugaguuuuagcccuaagcucuugcucccaucuuagcaagucagggcccaguguuguccuugccucugcaucaggaugguaagcugggcaugcuccgcaucacggagaccugcauggaccuggauuggguugccucuaucuucaggcuggucacugggcagacacaaaccagggccucuggccagaggggacaguggcucugaguuacuugugcugcucuuuaggggugagcaggggcugcuugugcaucauaguguaucacaggggaugcacauuuacaauugaaagcuacugguccuggguagaaguggggccgaguaggacuucccagccuugaacauggguuugucauccaacugggacccacacuugauccagcggccaugcucugugcagccugggccugagggcagccacgcucaugugaaaagugcuaguagccaagcugccauucuagucaccacagcuguccuugcaggagcacauugcccagggcugggagcugucauuuccgugacgggagugagacucaacacugggugaggguggggguaucuguugggaauuauuucaaaacaauuguggaaacuuggcaguggaggggcucugggcauagguauccacaauauccuagucagggguugggguacccuggcucugcugauaagcccaagugagcauacuccucccccagcuuggaacaggugggacgggccaggugacacuaguguggucuguggucuggccucccaagccaguggcaguacugggguggcagacauuugcugugugcuaucccaaggccuaaaggucacacagcuagguuggagcaggguuuugggcaggaugaguaggcauugcugugcucucagaaaggcgaagcaaaccccagaagcaagggggcgagacagggcaaaggccuacacuuugccaucaacucaggccuacucaaugcuggcccuguccuuccccugccccugccccaucagauggugcgagcuggcggggcuuagagugagccccccugacucuucuugguguggagucugaggcccagaguguacaggccucauccgugugacccagcaggaggaugggagagugggcccagaacuuggucaggcucauccguggagaacaaguucuucccuagucuaguuguggucugaguccugggugaagcaggaggcagccugggaaacagccucguucuaguaggaaucgcauucucaggaacgcugacugugcagggcccuuucucacugccaccugggaggaugccugccugcuggccauuucggcggacugucagagcacccucccuggggucccagaccgaaggccugaaguccacaugggaccccugaacuucugguaccugugugggcuuguccccucaacccugaguggaauggcaacagccagcugcaacccuccuagcuuccugucaugugcuguauggaagggccaagagcuguagucaucugcagauccucccacugcaccuguaggacuagcgucuccugucuggaugugagcaacuugcugguggccugugagaugggaguugcacugggcuucuggauaagggcuucucguucaggugacaauucuaugugaaggagacccauggaaacacaucuauccccugcccauguaccaggcagagaugguaccugcccauguacccuccaugacauggcugggucccugaaacaucagacagaucgauacucugugugcauguuugugggcaagacacaguggcacgugugcccuggaguuugguaaugggaggacugaaguagugccuccgugugugagcugugccagccauccccacgaagggggcauuccaugcagauggggauccucuccaggcagcuucuuccacaccugauuagcucugaccaucagaccccccgugccaaaagggccccuucccuggaaucuguaauucucacaggcugucccauacauuuuaaauccaggaaaugugcucacccaugagacagggauggcaagaagauaugaaugaaaagcaaccaguccguaaaauuggaagccauuucacuccuuaccagguacaaagauaacaugcugcauggaucagggacacaaacuuaccuaccuuaugauguagugaaagaaucuaaaacuuuugucucagcagacucccuggaggaagccaauaacaggaggccuugacuaggagaccucaagccuuggaaugugcccagaccaguggggagggaaggcugggaggcaguccucccuuaccccuuuucucccaggcagaccuacccuggguucucuccaggccccuccgccugagcaagugcucaguuggccacuagcucccugcacauccaacaagccuuucuuuccuguuccuucuucaaggaaggcuuagccucaaauccagggccacagacaaaggacagucacucuccucugccagaaagucauuuaugggacauggagaaagcaucaaauauauugcuuuuccaacaccuaacaguggaauaggaggaauagaaggagaacucagccagaaaguucuggagcauagucuuuuugccaaaagaacacguuuucaaaugaaagagguggugcuggggcacugaggaaucagggggauggaccccacuggagcuugucucaugcuggcagcaagucccaggccucaaacacauaccugggccaccucaggagagagacugcagggaagaaaugaguugcaaugcuccagccuaaccaacuccccuuuuguuaauccaaucccagaagguacuggguagggucaguuaacagacagcugccugucuccuggcagagucugaccaagccccagugggcgcuucucuuccuaaguccucugguguaccccauucuucaagggaaacgguccccuuaagaaucuaugugaaaggguucugaaauugcuguaccaguuaaugaauuauuuacucuaaacaaugucuugauaaagggggaggaugaaguuagcugauguugacuaaggagagacggaguugccaaggaaauucuucuaaaugaaaaaaaaaaaaaaguaaaagcagucagcugguuuugucugacuaugaaacgugucacagagcaugcaccuuuggccaucuuuugcauuuaugauuuggaagagagauguagcagugaguguggggccagggaggggaauccaacaaagccauucugcaagcuaguggcugggauuuugggguauagaguaagagcagccagccuuagaggcccaugucaucugggcugccucagagcuaaagcuagguaaccagagggaguaaggaaaggccugagucccaggcuaggcuuuucacaguuguauugagaugggaaaguaagggauguuccuugcagcagaugcagggcccaguugucuagagcaguauuugaaaugaguuggcauuucagggcaguguuugugaugccagucaguagguaggggcuucuaccucuuuuuuagaaauguuuacucugaacuaagcucuaugcuuuaacaaguuauguuuuaauaggaaaacugucauugauggaaucauauguaauuccuacauuuuuccaguuacccauuccuggggaaagcuuagccauuggacaaaccacccagagccccaggaaccugcauuugcagacagcaguggcaggcacaguggccuaguguugagcgggggaaaccuggccucuaugugucugguuuugcaaacuaaaacgccauugcccauacucaggcugacagguucuggaggugccauggacuccugcucuguaucucaccucuaguuccaucacaaugcaugagcugucagugggagccuuuuaaugcagaugcuaauacccauuccuaaugcuagcccauccccacacccuccugaguuggugcgauauauccugggaacaagaaaaucugaaggcuccugguccucaggcuagcaagagccuugccuguaagaagugggagaaggucaccucucucaggaggcagaacuaaggcugcacagcacaagggagaugucugaaugcacagucuggguggcagaaggacuccuguccuuucuuccacacagaccugagcaccucuccaggugccaccauuuucugucugggaacaucugcuauccccaagccucaguuuccuggucuacaaaacugagauggucucuucuauacaaggccccaggaggaucacugcaagucacugcauuucauggugcccagauuucccugcauuucuagaaugucaacagagaugagugggcucaaggggaagagauucuuuaugacuagagauauucuggucaacuuuggaccccagcuucuauggacaauagcauguggacaugagcccuggggaagcagggaugacugagccugaagaagagcucucaagccuuacacucuccagaccagccuuggguugccugaaccccagcauagccuuauggaaccccugccaggguccuagcaccugguuugaccugggcacaaguacucacucacucacucacucacucacucacucgucaaacauucacugaggguccgugacaggcuccauauggauuaagcacugaagauaaaacacugaauagaaacagccagccuauacccucaugcuccuugaaugugauagaaggagccagccaguaaacccuuuaccacaaauaaacacacaguuacacauuaagaaugggaggggagguaugugauuuuuuacagcccagucuuaagcuuuagaaauuggcuccucugaggaagggacauuucagcuaagaaccacaggauaagacaguccuggccuggggaaggggagagaaggucaggagagagcuugauauguuuaauacugaaagaauauuugaugagcugggacaucuccugcagauccacggcucccuagcuuugugacccugggcccuagacucaaucccucaacccuuaggagauuaucuauaaaacaggagugauaauauucuuguguuaaaagcugcugugaggauuagugaaaugaugucuauauuugccuggcaaacaggaaguguaaguaguaguaucauuugaagauuauucuucagccuaaacguguguucauuauggccgguguguuuucuccccaccuagaugguagugcugggccuccuuuggaguaccuugauguuuggggagcauggaugauaugaccauaaccugagaaggcagggacuguacccauucugguccucccaggucccagggcccccacagugcccuggugugugaucagugcccacaauacugaauagaggaacagacacaugggaagcaacggcagccuggucuuuaagggugagggagcaccuucuccugagagagggagagauagguugggggagguuggguggggguggggagagcgagugagcaagcaagcuagaaacuuccugaaaagggaaguuacucuagaaaaggguaaguuccuuccaggcaucaugggcuggcuuaaccuggaccaguuugacuuuacuaagucccauuucucaucuagggagccugaggccauuaagguuaucuggucccaaaauccccuagagcugucacagggauccccauucuuugccuuuagucaccccagccccaagagccauccuccacauggagugagcagggagcuacaaggaaaagacggucacaguuggagagagacagagaaccaggugggcugguaggacaggaagguauagggagaaagugaagcucucuccuggggaggcaggaauacucuccugcuuccuucuacccacucuucauagaacacaaacacugcaaaaaugacuuuuuccaaacccucuuagcauucagaaguagaauugcuauguaagaauuuuuucauaggugcuuuuuuggggggcaucuauuuaaaaaauaaccacaucauuagugaaaucuuccaaagucucuuuuuggagcccacauuucacuaauguccacaucugaggaggcuuucauaauaaaagaacacauaccuauuucaccuaugauggucagugcaaucuugaaaacacuaguaaauaguguccaucagcuuuaaaaauacaaacccaaauugggucauaccaaaaugcaaggauacacacaauaaccugggugaaucuucagggaauugugcugagugaaaagagccgaucccaaaaaggugauuugcuaugugguuccauuuauauaauuuucuuggaaugauaaagaaaugaagaauagguuaguaguugucaggggcuaaggacaggguagggugggagggaauuggggguagcuauaaaagggggacaugagggauucuugaagaguuagaaauguccuguagugagacuaucaaugcaauauccuggucagaauauuguacuacaguuuugcaagauguuacuaucgggggagacuagguaaaggaguauguaagauuucucuguguuguuucuuagaacugcaugagaaauguacaauuaucucaaaauaaaaauuuauuuuaaaaaaugcccaaauuaaaaaaaaaucaguaguccuccuaaaaauacccagaaaugaauuuuagaauguccaaaauccauacaaagaucuaaaaaaauauggaaggauguugcaauggauuugaacauguggguaaacugcuucuauuuguggcuggaaagacuuuuuuuuugagguggggaaggcaauucuucaucaguuaaucuaaauugaaugaaguuucaauaacaaaugccaaugggauaugaauauacacacagauagacaacuuuuuuuuuuuuuuuuuuuuuaauuaggcaagcugaggccaggugcauuggcucacgcccguaaucccagcacuuuaggaggcugaggcgggcagaucacuugaggucaggaguuugagaccagccuggccaacauggugaaacccugucucuaauaaaaaaaaaaauuagccagucaugguggcagaugucuguagucccagcuacuagggaggcuaaggcaggagaauugcuugaacccaggagguagagguugcaguaagccgagacugugccacugcauucccgccuaggugacaaagugagacucugccucaaaaaaaauaaaaauaaaaaaaaaauuaggcgugcuaguucuaaguuuauaugaaaaaaaugcauguccuauaaaauucagaaguagcagcagucuggccccuugugcuccucuagcccucaacuggccuaacaggcccuagugugcagcagggacuauuuucccaucaucacuguccacagcaucuggacaagaauacagagaacggcugauuuaaaaaaaaucuaaucugggauccuaugcauccuaaauaaucuuaugaggaugcacuuguauuuuuucugaugcugauacuauucauuccaacucgccuccccaucagcuuugucaggcacugugaauugcaugguacacaugauuacaauggauggaauggccaucaugagguauagcaauacauuuaaguaacacugugucacuacuauaggacaggcacuuuucugcauacuuuauauuauuaauuuguguaauccuccuaacaacccucugaggaagguacucuuaugauucccauuuuacaaauaaagaaacugagacuaagugacucacucaagguguagcagguagaaaguaguggaauuaggauaugaguucagacuccagacccuguuauuagccccugucuuuggcuauggauuaguaaaggagagcacagccaagggugggacaggcagcuguaguccucuggaccagcuucacauggauggggcugcauuguuacagguggccuaacucagacauggaaacugagucgcugcugcccaacucaugccaugaaaccauuuuggccugcacagcuuauaacagcacucuagcucuagcuaugacacuuuaugguguuaguggguuuuuuuggugguugguauggaggaggggcugggcuacaaguuuuagauuauguuucuuauugcggguuuuuaaaaauucuugaauuaggccuauuugcucuuuuguucucuauugaguuagcaaauucaguuuuuccaagaugcccugaaaguaugaucauacauguauacgaaaugguccuuggguccagcuggcaacuccugugcacccccgaccuggauucugccuuccuugaagugagccuuggaagaaacaagugcucaugcucccugacauuauuagcugccacgaugaagccucagucccaaacaccccagcuuccugucuaacucaagagcuaauccuguguuuaaaucuuaagaguguuuagaucuuaggccaugccaugaauuccccugguugacugcauuugugaaaaugagcuucccauuauuggcucuuaaguaauggagaugagggggaguccugcuacacagauaagugcaucauaaaguuacauaauuaaaauaacugagcucuggccuaucaacaggcccaucagcaguccagaauagagucuagaaauggacacaaauuaaaugagaguuugaaauaugauaaagguagcaguugaaauuaguagagagaugaugauguacucaaauaaauaguguuggacaacuggacaaauauaugggaaaccaaauuggauuuaauuacucugucaaaaucccgauaaagcaaggauuuaaauguaaaaaaugaaauaaaaaaugauagaagaaaacauggaagaauuuauuaaaacaauuucaggaugagagguuauuucagaauuuaagauaaggaccucaaaccauaaaagacugacacagcugacuaugugaaauuaaaaaaauucugccaccagaaaaauauuauagaaaaagccaaaacaccuaaggaaaaugaggauaaaauauuuucaaugaauaugacaaagcaaguuucuacaaaucaguaagacaagguauuuuacaaaguccaaaggguaugaagaaauaguucacaagaaagaaaaacaaaugauuuuaagcauuuggaaagauaaaaaccucauuuccaacaaaagaaauguaaauuaaagcuccaguguaccauuucucaucuaugaaaugaaugaagauaaaaaccugaguauacacuugguaagggugggggaagaaagugcauuugugcagucaaagugauguaaaugguacagcccuuauuuggcaguaucuaucacaacauaaaugaacauuuuaauccugcuggaaauggggggaaagggaggaucucuuaaaguaaauccacugaaaacggagaccaaaauuuuacaauagagauauuugauugggaaguuaauuugaaaaauaacaguaguuaaaauauuauuuuaucucauaugcaauaacaguuguuagaguuacaauuauguacacguuuuagaaaaaaacaaauccagaggggauuuugguuugucuuuuguaaagcauuauaugguaacaucugagggcaucuuuuauacuuggcagaggauguuggcagcacuuccacagagaggaucauuuuuuguagaaguauggcaugguuucacugcuugaccaagaggccaccugcaucaauuaucaucuccccugcuguccucugaaaugcuuaucuaggcaucgaucuugguuuccucuucaacugauuaacuaacuggucuacucugcccagucucuauuugagaaaucauuugacaucauuuucuuuaacuugaugaaaucuccuauuuugacaagauuuacaguuccucuuuauaaguuccucuuuacuuugugugugcuuuauauugucuuugguugacaagagacagccaaagaggucagucagcagagauacaaguagggauaagauggauagggagaaacaacaguguucaauagggagggauguuucagggaaacuaauuucauaaguggucauuucaguagugaauauauuugaaugguuaauggcugcuguuuuuuagcugcccuacauauccaucaacagaggaucuguuccauaaaucauggcacaaugaaacucugcagcuguuaaugaaaaggagauuugcuagaugucuuaauacagauccaucuccagaacauaccagugucuuccuuuuaaguggugcacacuggggcugaacacuuacuaagaaaugaaagggcuccccagucaaagcugacaggugucauuacaacaugaccccugugguagaucccagcacaauacacuggccaucacuccauucucuucaaauguccuaggguugcuucauacagcagaccaucguacccaaagccacuaugcauaugacuugguuaucuccugccaggcuguaguccaguuagugcucccuuggaaauacucaagaccuuaaugaacuaucuaucugugaaucugugaagcuacccauuucuuagaggccucuuuggagagcuggcuguugaauacccaguaugaugguccuuagccuucuuagaccuuuccuguaccacuaccucuaugccuuuugccaaguccaaguguucaccagaaauggaacugaugccagaaagacuacagcuaacaaucugagcagaacagugagcauguccuaucugggaaaagcccagcccauugggcuaaaucucuagcugaacacagagacuaugcuccuuccaauuauacuggaagcccaaccaugagaaaacagcacuucaacuacacuguucagagccaucaccuguucacacgugugucuguauacauguaaacacacauuuugcaauaaaaaugcuucucagauguacugcaccauaauaaaucagcauuguauguacagcucaaaaagaaguauggcauaccuauggaagaagucaaaggcaaaguguagaaaaauacauacaguaugcuaccauuuguauaaaaaggagccguaucuacuaaguacaugcacacacagacacacguauauuuguuuauauaaaauacgucuggaaagaugcaauaggaaaguguugagugguaaccuuuagggaaggaaacuugggaauuaggguuggguggggagaguguuauuuuucaccccuuuuguacucugaauugguuuuaccauguguguaaagacuguuguaugauuuuuguagcacaacccuugaauacauaaagcacgauuggcuccccagaaggcagguguuggccaggcaguggaugcacgguagggcagugugcagcccugcaugcacguggcugguaugcccugcgggcagcagcuccccgcacacagugcugugagucucugguucaugucacucuguggagcaggggcugcuccagcacaaagagguuuuugacagggaaaggcagagccagagucagggcaggcccugggcgggcuccuagagagcccaaccacccucuaauaaggggugcucuccacccuaucugaggagcaauugggaucuccuaggaagugaaacuguuacguaugucuuauuacagaauuuccaguggagugauucuggaagaaauguguauggcauguugugacugcuaugucucaugaaauauuuacguuuuuauguaacuuuuuuccauuuucagaucaucuuuuauuuuaacgcaaaaugacaauauauuuuucaauuaauuugcccaauaucuguguuuaaauguuuucuaaugcacacacguguuuuaaacucauuaaaaaaauaugacuuagaucccaucccacuuucauguuuuauauugccaaaacucugcuuuugggagaggugaguuaucuucacuucugaaacaguacugcuugggagcugguuuggcccuggcuauucuggggaaaugacacaauauugaccuagaggggcccuaaucuuuccccgcuagagcacuaccucuaauagggugaaggaugggagaaagaggcuagugaacccaccuucaggucuguccacucaggacaugcccacacuagccucuccaggggcucugcccuuggcauccccgucccccaccugggcucuggcagagaagucaggcgggaagaagccggcugagugcccgccacuguaagaggaaacgaagagaaacagcuccagucagccccagaagcgaggccuggaaaaacucugcagcuggagcuaacacaaaggacuuuucagacccugcagccaaggugcccagugagcuuuuuuuuuuuuuuuuuuuuuuuuuuuuaaaaaacagcuauuagggugacaagccuuuccaaaggccagcaguuggcgagaguuuccaggaagcuggucuggcacugggcugggauuggagcaacuuuaacgaguuaaguucagaaggaaggagucaucaggaaagguuuaagguucaacaaacuuuucaaauuauuuugcaaaaaguucuggcuuuccaauucaaaggcauguuucgcugugacuguuuuaagccagagccuauuuaaaaggcaacacaacuagcaugcuucagauucacucacucgagguauuugucuaaauccuccgaaugggcuuugcaagugccaucuagugccuaguaacacuggggccaucuuacacaucucgacaggcagcccuccuccccacgugccuccccccagccucuguggucgugugcgcgcgggcgcgcacacacacacgcacgcaugcaccuucccuaagcaggaagcugcucuuugccaagagcgaauggaauucagauuuccagaggguguccuuggccuccagcucuacggcugcaugaugaagaaagguccuagugugugugccgggggcugggagagaggggccuccagcucugcucacaucuaucugggccccaagaaaaacccacaacuggcugugcucuccccagccacacccagccuuggucacauuccuucccuuccugagcccacacuggguggccccggcaaaccagcuuccacaccucccuccccaccggcagggagaccuagcccaagcccccauggggcagccagcaaguacaaaugaggggcugcaccccaggcccaaagagccagaaagcacggagggcccuccccccaccccacccccaaugcugggcauccccuuguggcugcugucacucauggggaaagagacacacucccuugucuagcacccggugagcugagcucccaucccuuccugugccugcuuucaggaagucccucuucauauccaaccuugacucuccuggcuguggugcuugugggccugggauugaagggccaucacugcccuuugcaccagagcuucccaacauaccagcaagaagggacuguaccccuuccccuguccagucugggccuuccaagcccugagauucagcaaccucaggaauuaaacauuuauaggaaaacaccuaugcagacaagggacaugagucaggguggucaucagcaguagcaagguggguaggcuggucacguuuagcuucucuuuagcccaaguaauagggucuuccaccugcauggccagggaggggauaggcugagagcaaucuuucuacaggcugucagcaucaacaagugguugugaugagcaggagucuguauggcuuuucagguguuccggcucaaggaggcccaacaccaaguuggaaccuccaggccuggugccuaggcagaaggugggcuaaacaaaggccaaggggagcucugcucugucacuucccuuuguuugcuaaugagacuguuuccaaaagcuggccugguagccugugggauuguuucucucaagauuucuucuaggggagaagguggcugaggcuuugcagucugcaucacccaguccccagaaucuacaggggacucagcuugccuagucacaguucggcuuuuggccuuggcuccagggcccauucugauccucgugcuugggucagggauggucagcaccccugcccugaugcugccugcuggggucuccugcugaguaccgugaaggccuacuguggccugagaagccaacuucacugucccuuuuggccagcccuagacccuauauuuguucaaguaacacauugauucacuggcuucuccuuuaggcaaggccugcaggggacucagcugggguucaugauuccuugccaccuguggugggccugcauggccagcccaaggccucaagugccacauacugcuccccugacagucagguggcuaggguaugacacucaagaaaaugcccaggcagaacccagaguuggggucacuugguccagcccuucugaaggggacugguuggaucuguugcggggaggagacaggccaugcuggaccagcaaaaaagcauagaacuuggagucuggaaccugacaucuggccuuggcucugccaucagcuggcuguguccacugggcaagguccuaucauaucuggucucagugcuuccauuuacccagaguccuuccaucaccugacaccuacagggaugcuuucccaaucaaaauucaggccaugugguuugauaaggccaccuuccaauguggaagacaggcugguaauggagaggccugggagcacagagcuccuaggcacugccauggaauguggggaccuuagggaaggauaucucaauugaagcucuucagagccccugggguggacuguucuguacucucauccccuaacccauaccagccugagcucaaucauaucagccugugaaggcugccccaccacacugcuucugcacccaccacaccaggcccccuugagcucccaccuggagcccacacacccagcuggugggguucguggggcaguucaaaaagaaaagcagaaaaaagcauuugaguauuuuggacuggaaggaauucaauuuaacuuaacaaaucaggacaugaaccuaaagaaaacacugaaaaacaagcccaacuuugaaaggcccaaagagggaggauuaggugggagaagaaagguccccugugggcagaagacagcugcucaguccagaccagggaccaggggaggauacugggcuugagugcagaccgggccaggguagggagacaagcccaacauacacucgaggacuugaagucaggggugcuagcugacuuuuuagcccacucuuucuaccccagauacagagacuagcugccugaggaagcauagcggggcccacaggcuggcugccuggugcugcccaccuccucuccagggcuuggcucccuggggcagaaggcucagaccuauaaccacagugggguugcagggauuuauuugggggaagaacccugacugggucagaaugauuaugugcaugcauguauguguauguagcuccuuguucucugaaaagccuugccuaccacccuacuucccaaguacccucuauugccuugcaaagucaccccugcucucugccucaguuuccccagcagggcaccacaggacacugcuguggcaagguuuauacuuagggugcagugcagucugaucuuguauaaaugcucagugccaaagacuuaggagauaagucaggcagagucaaaauuaaccuuugaaaaaucccuugaauuggcccuaaaaauaaucccuuucucagaucuuuguguauauccccugcuggguugcucuucugccugcuaaagugggagaaucucugggugcacauccagaguacccugggagaggcaugccagguguuccuguaccuuuuucaggauauucccagugucaucuucagagggagccucugaggcugcagccacacaugggaaaagauuacuuauggagaagaucagaggcuaaggggcuggggaugguggggacaucggauuuugaggucagaccuggacuccugucuaccucugucucucuaccuuuuauuuuucuuuccuuuucuccuaacaaggcccuauuucuaagauggcaccucaggccucccaugggaccaaccaggccugacagacuaacugcucagacuaacugccagacuuccuccugcuagccagucacuaccaaggaugugugccucagauacagccccugcccaggacaccuacguugucccuaacagggcccacauaucuaaagcaugaaugccuagccaggggcucuggggcaccauaagaaggcaugaagcugggccugccaauuugcauccugggagggcaggucagccuuguccaggcaauccaggaggcuucccaguggcccacuggccagugaggaccuuugaccuccuuggcugguggcaccagguuuaugaugcacauagaggcugaacuugaagaauucuuauugcagagggcagccacaagagccacuggccagugcccagauaauaucugcagacuguucccuccugcuccaugggccacagaaucccuuugucuuguuacugcuacacugccuuccuaccaaucuucaggguucauccuggccucugccaugcauauccaggcucccccagagauugugugucugggaaugagcccuggcuucugcuccuaucucccagugauacuggcaagucccuauccuucuugaggcuucaauuuccccuucugugagcugggaggacaggcccacuagaugcucucugagggaccuaccaaggaugugggcugugugucucagccaacagcaguaucuccuaaccccaacacaagaaauacacauaguaggugucugguuaaugcucuuggaauuucagccuauacuaaccaucugaaagccacugagucugaacucugcuaccauauuugagauuaucucuccauugggcaccuauggguugccuagagacaagcuaccaugguccucuucccucgcccgucaugugcagggucaaaggcaggugagcuacacagcucgcccugcucuucacucugcuuuaaugugggugcuugccuuggcagaugggcccgacagugauaagaacaaaugacagaugcauacuggggcaccugugacugccaugagacacaguccacugauucugccuccaacccccuccccagagcagaauagugagugcuagguuuccgccuguaccuccacgggaccccaacagcuccugaaccccauuccgagauuugagguugugacuuggggaccucuagacuucccuucccuccaccugacuccagacuguccuggagcuugggacucucaggccucuaggcacaucuuauuaaggacagcagcugacagccauauguugugaccccauuuguaucccaugguaacucaugaccuggcagucucaaaagcucucaggccaaauaaggaauguccccacaggaucucccaucacaaagagacauucuaugcuggcuaauauuuucaggcauuuccccgagucagguauguggcuggaugccuaacaccaucuccucaaggccuuacacuaauacugugagauauacucccaauguauacaagaggaaacugaggcugauagagauuaggugacugccccaguguccugugggcaggaugaaaugacccaagcuggccagggcucccugacagaccuugucccuggauucagcgaacauacaucaaaccauuagcugacaaggaaugaaucugacaagcuguucaugaccaccacacugaaaacuacagggcaagguaaaagauaugaaagucaaccuaaauaaacaagggacacaugaugccauguuucaggagccccaaaacuauaaggauacccauucucccaugcccaucuagaggcugcugcgccuagaggaggcuuuccauggcaacuggcauauguauggugaggagaaacccugcaaagacagcaaagccagugauggggaaggagaagcagccagagccagcaggaccagcugucaaaaccuguuagcaaacuacagugagaaggaagcaagguccuggccacaaagaacaacuugaaucugaccaguggcacccaauaggguccagaaacagagccacacguagccagugagcugauuguaaagacacugauacggcaggguaguugggagaggacgggccuucccaugccgggugcugagcuagacuggauauccaaguaggggaagaguggaccuugaccucggccucacauuggacacaaaaaucaaucccagauggagugcagaucuacaugggaaaggugagcuaauaaagcuuuagaauaaaccagaauaucuuuaugaccuuggaguagucaaaguuucuuaaauaggacacaaacagcccuauccagagaggaaauguuugauuaacuggaccacaugaaaauuaagaccuucuguucaucaaaagacaccaucaagagaggaagaaggcagccugcagagggggaggcgauauuugcaaugugugugucugugagagagugugaguguguguaucucucucucugacaaaugacuccagaauaucuaaagauauauaggaccauaaauaaacauaaaacaggcagaagauguaggcaauuuauacagaaugauguaucugacuaaaugauaacauggaaagggacucaacuucauuagucaacagguuacugcaaauuaaaaucaccauuugaugcugcuagacauucaccaucauggcugaaaaggaaacgacggaaaaugccaaguguuaggauguggagcagccagaaugcugccugugggaaugaaaauuggaaugacuccuuugguagacugcuggguaguauucacuaagaguaaacauaugcccacccaggacccugcagcuccacacauaggcauauauuccccagaaacgcaaccugaugcucaccaaaagcauguacagaauauucuuaaacagcaaccuacaccagaaacugccugcuggccacaggugguagaauggaugaaugauguaggccaugcacacaauggagcaccagucagcaaggagcaugagggagcacucucccuucagccccauagagaggcugccagacaucaaauugagugagggacauuggacacaaagguguaugaguugcaucauucccaccgcauaaaguucaaaugugggcaaagcugguccuugcugcuagcaguuaggccugugguuaaucucaaggucagugacaggaaaugggagccugagaggcuuucuggggguucuguugcuuccuccgggugcugcacacaugggucccagggacugaagaugccucaagcugcgcacuugagaccuguguacuaaucugugugcaugcacauuacccuuuaacuaaaaguuuaacaccaccacccuauaccaggguagcccaggugagccuaauuagguggauagcccuggccuucagggccgcuaggcccagccccaucccacucccucacuuaaggggacacggcuuccagacuuccugacuaggucaccuccgugcuucagccuccagaggcucugcaguucaaucuccccuuucagguaucagcagagcacacaagagaucuauaugggaugugccccccgcccaaccccgccccgacccccugccccaacugccagaagugucuccaugacaauaucagugcaguugugaaguccuuugcccuccagccaccucuguggcgugaauguucucucugucacauccuccaacaccaucugcuuggcugaggaccugagcagcaucauggcugggaguucacaaguggagagggcugagccuggccagagugcacuggggcagggugauuuggauggccuuucccuugcagaggaaaugagaagccucacugcuuucuucugggccauccaccuagacagugcggcccucuccccauagcagcagcccuaggccagccgcuucuuccucacgugcucagacggaggaagugaaguuuggaaagguuagggggccacggggggccgccacagcugggcugauggcaggcuggaagccagauugagggcaucugauucccaaucccaucucuuucccacugagccauuacgccucgguuuuaauuuaauuagaagaacauuuaauccccccgugcauuucagagacggguuugagccuggcuggggcuauguggggcucugacggggauccuaugacucaugcagcccuguacagcccucccgggcgggcccccagagggcuuccuuggcaucucgugcagacagagguggucuggagcuuugcagaagacaggacacuggucuagaaagacaaaauggucucaucuguucuugacaagccccucacucauccuucuggacacugguucccagaauguccuuucuguccuuucccaccaaaguuuacagggagagaaauauggugaggagcuuagacacucacagagcugcagugccugguacccuggggucugugggaguaggucacaguggaccuggaugucuccaaaaugucccaggccaagcuggucccaucaaaagagcuagccccuugguccaugaagccaaauuuggggccacccuugugacguuugcccuuauuuccagacagcacagacuggcccuguccuugcugacaaaugcagaauucaggagacauuaguagugauguggaugaaagccaggccacagcggccuugcuggaaaagagcaacucgaaugucuuggcgugagauucugcaggguccaggagaaaguugaagacauggaaauucuaauuaacgcacacggggcuguuuuugcucaaggauuugcgaagcugucaugucacaagaggccaggcaagcacaugcuugccagggaggugcucacagucaccuggugggggucucugcagcuuucccucugccuucuuuccacccccucugcccagccucggggguccugguccucccccaugcccaucucaaugggccgggugcucccugagugucccucuggagagugggacugagggcgguaucuguuaaccucgagcuggggcuugcccaucuaagaugccaaaacagaagagacaggggcccuucagagaaaccacaugacugggcugggcagagccauaggcugcagggcuuaugggccuguccucuugggccgucuaucucagguauccaugugcaaccaauggggcagacgugugaauuccaggccaguccuggcuggcuuggcaguuggggaugcagugugagggaggauuucacaaaaaugauuucagccucccaggguugcuuggagaagcucacccaggccacaccugcacacagcccccaaguucagagccgcagauccucaggccccuagcccugugccucagcacuggcacaaugugucugcaguccuugcuucaucuuaggcaggguugagugagcagcaauccuagggcuucuccaugccuggggcuuuggggguucuggggaggaagagaccaagagggcuauacaugcccuucucccuccuggcaccauucgaaaggcuuagggaacugguacugagggcuuugagagccaaaggaggacacagccguacagccuaaguguguccugggggguuuacugagcagacguuggaaagaugaauggaaaucugguggcugcagaugggugacaagggcauucuagauggcagguuaccacacgcaaggcacagggaugcacacaggcauggcaccguccccacccacugucgugccagugacccuuggugagcagaggauagugagugggucagaaucccaggaacucauccuggcucuugggguacagggcuccucuugucaugggggugcuccccaacugcccaugcaggccuacagucucuacuucccaccuuucucucagaagcccugucauaugguucugggugggagacacaggcucagggaguuugaggcuggcagggacucucuugugccccauucaaccuaggaagacagcuucugccugaaagguguguucgaggcugaguccuggccgcccagagcugguugaggguccugaggcugagcaguagggcccaccuauaggcuggggugcagcgacgccacucuuuaucuccuggguaccccgugccucagcuugucaugacucccuagcuugcaucaggccugcucaccccccaccccaccucuggcuaacaggccccggaaagaggagcuucgcccagccccagggaccuucccguaaucaaggcuauagugaccucaccucucuggggcccugcgggcggggagagcucgagauggaaacaaaaugugucuuuauuuauguuuuuaauuugaauucuggaacuggcccagcaugguaauacauuuaacaucaguagaaugcugaagaaaaauggaaauguuuuuugguaacugccucccacccacucugcccccugugagaccccagcacacaucccugucccucacacacaccagggcgugugccucucuucccaguucaggguccauggggccaggcugcccacaggagcuucgcugcaucccugagcagcuggagccgaauuuaauuaugggcaucacugggcgggcugugcaggagguggaggaaugcagccccaaugcgggcagaagaccugcacggcccccacaccccugccgccaggcgguuugggcccugaggaaacagggugcccacugcugccagccuucucccccagauggaguggggccucuacccagccuguaucccagaggagccuggguuccuaggcccugacacuguacgugcccacucuccccuucaggccucucuggagggaccguacccugacuucugaggaugcaggaacccagcuccccugaagccucagcccugagucuucccugaccagaacacaaugccucaagguggccccuuugcagcaaccuccuuguuuuucccucucccaguccccucuucagaucccucaccccaagccccaugccugggcuccuuccugccuucccaggcuggcucauaucuagcagccacuuuuggaacagccugcucugagagaggccuugguaaguuacagggcagggaccugguuggguaaugacuggagucucugaccugccugggcccacuuaucacuggaggccaugggagugccaaccugaaaaggcugcaggaucuugcagaaugguaaugugccagacccaaagugggcagagagcuuggggauggauguucaggucucucaggcccugucauccuggaguggaacaagaaacagcccaguguccuagaugacacagccacacuggcuuggggucacccuugggcagguggguaaccucuggcuccagggagcuuggcaugugcugauaccagcacuggcagcccucacccccauaguggugauuuacugggcagcugcaaguuuggcugugauccacauaagugccuggucucucaccaccuucaccugcaggggccuugcaagacccaagaguugguaaggccuggcugcccagcuagauggacugugggugauggcccucuccucccaguaggacuuuuugcaugucuggaugcugguccgugaccaagagaaccaaggugagcgagagcuccaacaggagaagcaagcagccagaaggaugagaagggacaguccccucucugaggggacagccaagaggcaauacaggcacugccaccuguauugcacacaacaugagccacuaaacuaacacugaucacuuuggagguccaucauauccaggacuugguacaggccuuggccacaguguaagccaucauucugccuucuggugcugaccuguaccugggcagcccaucuggcuaccagccugcucacaccucugcuccugccuuuuuacccagccaggaggggcccagaagcucagagcccuauucucaggguguccaugacuagucaccccugcuuuccagugaucugcuggcucccuuggagccucuucacacccuacccaccaugagguacugccaaccucucugugaacugggggggccuggaaagacagugggcagguccugucugaucauaauuaccccuuaagauagccacuccuucccuggagguggccucauucuggcuacccaacccugccaguucucugguuacaccugcagcccccagcaccaugggucccgauuuccucagugauuugcaaggccaggccuugcaccuggcuggcugcaaaggcaggaggcccagggccucacuacgacaaagacacacauggcucaggacaaccuccugacccccagagaguccaaagaacaaaacacccuuuagaaaaauguugguagagagaaggagaguuuccacaagugacccucagaagggccgcgagugucacucacagaucuugacacaaagacauuuaucaaggggaauccccaacggguuagcagccagaaugggacuguggccagaauggacuugggugccccacugaccccgcugcacggcugucaccgcugggcaccccagcggggagucacaugucgcaggggaaucacaccguggccgggcaccggggauuggccuggccaugccgugacggcgggggaggacgggcaugcaucccaggccagcugugccucaggggaaggccaacuggaaggcguggaaaaucagccauuuccuccaccugaaggagccccugaggacagcagcagcaacuggcagacugcacccggcaucugccccauggcuuuggccaggguuccauggggaaaugcuaaaaaacaaagucgucucuuuuuuggggggcaggggagggggcugggggagagaaaaacaaucucagacucucaaagcaugaaaacaaguggaaaaugaucagucugguuuuccauaagucaaaacaagaggaucauguucccaggcucagugggaagugcccuugcucuccucucuugccuggugccuccguguuggggccaggcagacggcaaguggugggcacuaggcgaguagauagcacucuggccagagagcaaggcuuccccagcaccaagucugacuccuugagcuccaguccccuccagcccagcccuucacgcacauguaggcacucacugugagaugugggugaugggugucagcagagucuccccuuccagguccagguccucggcgaagcuguugguucucaugaaauggggcaugcucacuuccagcaguguugggcucuuccuuacugaggagaaaguguggggacagcacguuaggccucccacccaaccugccagugcuguggagccaggccugugagcucccagggccaggugaggaguggagcuugugccuggaagcuccagcccugacaaucaguuuuauaguuggguguugggguggguggguguuuaagauggccccaaagugccugacaccucagugucugaggagaauaaaggccagugaaucaucuucggagugguaacugugccuggggcugugcucagguguccaagacucuccccaccucagguucugggccucuucccauguucacaacugacacuugggucaagaauaaaacagaggugacaggcacaggccugguaagggacaacagcucccaccaccauacauugucacacucauacauugacagaguagugggucaggaaagauggggugauaggaccucugacccaugaggaauggcaagccugggaggugggggcagccacagaacuccuuccucaaaacacgaugcuacaucaaccaguuguacccccaaugaggcacaggagucccuccaacagcuggcuucacauuaugauuccugggcccaccucugcaacuuugacacaggagcucaggauacugauccuuaucacuccccacucucuguugacacuaucaguauuugcucuuggcuuauauuugucuucauuuaaauauuuuauugcaaaaggauuaaguacucaucugugagaaguggaauaauucaaagauucacaauggcuuuccucccccaaggucaucaguguuaacugccaacuagaucccuagcccacccucucugcucauccgagcagcagaugccaggugggaguugcuuuuaugcacaugggaugucacugugacucuguuccugucacucuguaacauaagcucauuucauuuuucucuagguauauaggcauggauuuaauuauuuuagucauuacauaauaguccacaguuuagauuggccacagcuaaccauucuguauaucauggacauucaggcucuuauaguuuuaagcugcuuaauuauucagacuaugaugccauauucaucuuuauucuuaaaagcugacauacuggagcagggugagaggguguguccuuaguaauuuuaauaaauguugcuagauugcuuucccaagaaguuguagcaauucaggcucccccagcuuucccacauccaugccugaaugaaguguugaaugaagcccgaaugaagguugucagcaccuuuugcagggacuaucaagcauggaugaaaacugaggcauugcuguuauuuccaucuguguugaauaccuuuuaugggcuuggcaucuguuuggguuuccucuugcagaauugccuguucauguccuuugcucacuuuugcuuaucacuuuguaggaauuuucuauacauuacagacauuaacuccuuguuauaugaggcauagauagcuuccccagucuguuuuuucaccugaauuauguugcuuuuauccuagaaaauguuuuauguuuuuaaagugauacaucuuuugcuuuauaaaaaaggaagguuuucccacaucagcguaauacaauucucucuuaaauuuauuccuaauuucacuauuugaauguguuguauguauacauauguauguguguaaaaguuuuaaugcauuuaguaucuaugccugauaggacagaugaucaacaauuagaaaaugaaaauuuaaaggguacuacauacaaacuuacugaaaaaaaaucuaaaauaaaacauaaaaccauaaaauaucuugaagaaaacauaagagaaaaucuccaggaccuuggauuuggcagugaauucugaaauacgaaaccaaaaguuuaacucguaagagaaaaagaaucaacaaauuggacuuuaucaaaauuaaaagcuuuugcugugcaacagacacugcuaauggaaugaaaagacaaagcacagacuuggaaagaauauuugcauaucaccuaucaggucaaggacuugcacucagaauauauaaagaaugcuuacaacuugacaauaaagugaacaauccaauuuuaaaaauggauuauaaauaagcacaugaaaagauacauaauuaacauaaauauggaaaugcaaauuagaaucacaaugaaauuccauaaauuaaaaaaaaaauucaaaaccugacaauaccaaccacucuugaggauguggaacauguagaacucucauauguuacuggugggaaugcaaaauggcacagugacuuuaggaaauaguuuagcaauuucuuauuaaguuaaacauacacauaccacaugaccuaucgguuccuuucccacccaagugaauugaauuuuuauguucgcaaaaaccuguacauaaauguguauaguaacucugcucauaauuaccaaauacuggaaacaaugaagauguccuucaacaggugaaugcauaaacaaaauguauauauucaugcaauggaauaccacccagcaauaaaaagaaauuaacuaaugauuuaugcaacaacauggaugaaucucaaaugcauuuugcuaagcagugaaagaagccagaugcaaaagaauacauauuauaggaucccauuuauaggacauucuagaaaaacaaaacuacagggacauaaaacagaucaauagcugccagugguuaggggagaaguacuugacuucaaaagacucaccccaggguauuuuuagggguauggaacuucugugaaugauacuggauuguggacacaugacuccagacaucugucaaaacccacagaacugaaucucaaagaguggauuuuacuguaugcaaauuuaaaaaauuaacccggauguuggaggacccuacgaugaaaagcagacuaugaugagcguguuacaaacaaaugacauagcagugaaaggaaaggaggaggaggagcuggcauauguugcuuucaaaaacacuguuuugacuggacacucuaugguuaaagcaaaagucuguccuaaacacucuaaucuaguagguaaauuugcuucacauaggguacuacguguacaauaggguuacacaaauaaguaaaugaacuguagguaaugggagccagguuucuagcugucagagaaaaagcuauaaauaaguugugggggagggggcaaggaugaacucuggucagaaaugucaguaugaacucaugguuagcuuuauauagauacagauauguaaagauguauguguacucagguuacauacauacauauauuuccuagcucuguccacugagaggagacugaagcaaugauacccuaguagccacgagcauaccccgugccuagauccagguuuucuauucauucuccagggagccagggcucucuggaugaauggaugauucuagggcuaggguagggaaaauaaaagaugagccugaaguauugucaagugcuagaaaagaaaugcuuaaaaauaaaugaaaaggauggcggggggcacaucaaaaggacacaugaacccaccaguggccacagcuugaacaauuugagcaacaaaauaaauaauauuggacuauaacucaaaaaauaaauacucccaaauccacacugauaaaauuaaauaaacaauuggaggagagggacaaaucuuccuuauaaaggaauuccaaauaaaaaauguagaaggaaugaggaaaauagaaguacaucacgguaauauuugcugcaggaaaacgauccaugaaugaaugcugaaauuaguuagugaaacucagaaacuucacaguuucuuccuugaaauguauuuuaauugcugugguaguuuuaacauauuugcagauuuuuuuugauacucuccugcaggagguagaguugaaccccucccuuccccaccuugagugugggcuauacuuagugacucgcuucuaaagacuaagcuauggaaagggaaaaacagcuauucacuuacaguggaggagccuggccgacaccacuuuaaacgaguggcucaagguuaauauuaccagugauaaaccauguugaugucauguuccacaaugaggaaagcaucucaccucacuggccuccuuccccuaaaccuauaacccuggucuaguccugagaaaacaccagacaaauccaaacugagggacaaugacaccugacugguauucuucaaaagugucaaguuaaugaagaacaagacugagaagcccgucaccgaucagagaugacaauaaauguaaugaucgauccuagaugggaucuuggaacagaaaaaggacauuaguaguuaaacuggggaaauccaaauaaauuuauaacucuagcuuaauaguguaccaauguuaauuuuuuaguuuuggucaauguaccaugguuauauaagaugcuaacauuaggggaagcuggugaaagggauguggguacucgguacuauuuuuguuucucuucuguaaauaaaaaaugugagguaacaagagaaaacagaaccuguauacaauagcacaaaagaauauuaauuaucuaacuaaguauaugcaagaacucuggagaaaauuguaaaacuuuaguaagagacaaugaagaagauauaaauggagaaauaugccuucauuccaaugacuagaagacucaauacugaaaagauuaucucaaaaucugaauaaaucucuccaaaucuuaauaaaaaucucaaggcuucugugugagaacuuuggcaagcugauucuaacugcgacuuggaagugcaaaaagccaagaauuggcaauauucuugaagaagaacaaggugggagaacuugcuguaccaaacaucaguacuucuuccaaggcaguggucauuagggcaaugugguauugacacagggagagacaaauaggccaaugggacaggauugagcauugggaaacagcccacacaaauauggaagcuugcuguguaucagagguggccugcacauccugggaagagcauggacuuuucaaucaaauguucaggagcaguuggauacccacacuggaaaaacauuaaguuggacccuuaauuaccucacaucauauaccaaaaauucauucuugucauucuaggggauugaagaccuaacuaugaaaagcauaacuauaaaggucacaugacugaauauagaagaauaucuuaaugacaucagcauuaggaugguuuuuuuuaaaagaagcaauaaccaugagagagaagacugaguaauuugacauuagaguuaagacccaaucaucaaaauacaccuuaaagagugaaaagacagugcccacaaaaugcaaaggacuccuacaaaucaauaggaaaaauauaaaugacuuaauagaaaaugggcaauagacaaaguagcacaucacaaaagaggaauccaaaaggcugaugagcauguggaaagguguugcgccugacuagcaaucagggaaauguaaauaaacucaggagcucauggcccgugggggcgaguggcagacuuccagcaggaaaccacacagacauuacuuagucacagccaggagaagggcucagagugaaagggcucugugcccaugacauccuuagagagaccagggaaggaccuguaaggcuugaagaaugugcagauuuggagacccacaggucugggaccuggcagaagcauguuacugcccccauuuuagagauuuggggcugagauucaaguacccuagguuauauaaugcaguugucaagugacagagcuaaaacuucauccaggauucaauuuuuuuuaaaggaaggaagaaagaaaaaacauauuuugauguuugcaucacuuguauguagaaggaacgauggagcacaggcuagaacguagaguugcuuuccaaacacccaugaugacaagugcccaucuccaaagccugagggccaagggugagccaccugaccccugaggaagguucuguccugguguuuuaggaaauuaaaaugugcacaucaguuggcugcccagagugggugggaccugcaccugccagagaggaaugugugcuuuuugguuuaauccugggaacggcauauggggccccuauaacaaggggcagagaaggccuccacagauuuguuuuuccaauucaagaggagagguuauugucugcuggcuuguguguuggagacuguggggcgugcuuucuccaccacagggaggcagugaccagagcugccaccucuucccuguuuucaccuguggucguagccaggucaggcaucuaggagagcauggaggggagcuggggguggguggguggggauucagcucuuuccagacacacuggugcugccucuuucaggccagggcuugagggcaagugcugugcccuaacaggucuugcuugucacccccaccucugaaguggguauuucacagccugaacucacagcugcagagaagguugagcccaugguguacuugaaagggcaguucaucuggauauccaggcucugcaggagguaccggagcaaugccaggugcccuuugcugaacugccuagaguggcuggcccuggggacaaagagcacagcauccuggugacaaugaagucacacuuuccuaagacaguccugguuuuugaugcuuuaauucuuuggcugccuuugcuuugucaaggccaggaucugggccuaaauuuucagggcagaacaaaacaauuuuguuuucuaggaaagugggaggucugggauggcaaaggcagccucgggcguggcgacuaccccagcuggggacgcuggcugccaagucucacccucucaagagaacaggaaucaaacucagcacagcauccuccuuucuagucagugguccugcucgauagggggauuugaauuuuauuuuuuuaaaaauacaggcacagaaaaaagacuagaaggaaacagauccaaauguuaacuuugucuuugggugauuuucauuuccuuccuuauugugucuguguuuucuauuuugcaugauacuuuuccaagucaagaaacaauaauuuguggaagucuccuguaucugugccuugcucucuggcccacgaccuugcacaucuuauccuagaguugccagaauaugucccuccaccuggccuggagcugcccaugaggcuacauagagcucuccuaucaugaaagucuuugaggcuuucuguucccaagaaauucuggucucacuuccucugccuucucaucgagccccagaccccucccugcccagauuaggucagcauucaagccccaaguccagccuaugacaaagcucaaagcuccagcccaucucugcugcccucugcccucaagagacucucgccagugucugggcccuuccuaguaacuucacccaaccacucacccccugcccuuccccuccugauugauuaaaauccggccuaaucucccagguguaacccaagcccucuuccacaagcuuuccagggcuccggagauugcccccuccccuguacggcugcagggcuuaugugugccuggcgcucagcacgggaaccuugccuucugccucacccaugucuccccaggguuuggcacaggcgaguucccugagccagccuacuucacaaggaugaacagaagcucucccuauccuuugcaaguagaagcccccucccuggcccccucaagaaaucucccccucucaguggauucaccaaagcccugcggauccugcacugugaaggagaagcccuccccaggggcauccggacagcugcagccaggcccugcgugacauugcugagccgcagccccacagccugugccagcugcccaugcccggcucauagacccugagccagaguggccccgccaccaccugugucuccacucagaggcgagaaguaagggacauggauggaaaguguaaaagccauucccacaacagcugccaggaacaaggcgaggaauggagugaaaauguauauucacagcuggcacccaguuccgcuuaggaaaauaccuugcuugaguggacaccuguuguuuuugccugccagcagccaggccuggcuucugggaacagcuucucaaaucuuccuuagggggcucuuccuuucccacuccuagugugcaguguuuagguacccucuggccauccccaaaggggucccuguggaccuugccucagccaucggagguacagcugcagguccaaggauggcuuguaccccagcugaggccaauaagaaccuggccuuagauucuggcaggaauccuggaagagaugaccucguucugcugggcuuccugagcuguugaaugcaagcugguggccauuuugccccuuuuagaaaguagcugccuaaggauacagccaucccauggggccaauggauagagagcaagggaaagggagaacaaaagagggaacgggaagggagaaggggagugcaagaggggagagugagagcaagugagcaagaucaucucagcucugggguccagcugugucugaaacagcuggguccagcugugugagccaaaaaaugucccuuuugugcuuaagcuuguuugaguugggguuccaucauuuguuaccaagagagucuucaggaaugugcaugacaaaguugggggugaggugugagccuacggacaugggccugggggcagucaagguuacaaaauagcuaaacuggucugcacugcccccacuaguuuucagggcagagggcagggagaaggcuugugggaaagaagcuggccugaggccaaggcccuggcccuagcccugcaacagcacagggaacucuuggaaagggauuuccuaaggugggacauuggcuuucuacugcugugaugcaaguccucaucuccccaaaccuucagugagccucucuccacacccugcuguaugaggauguuugaugcaaauuauggaacauguuggaucucacauuggaucaaaggugugcagaauagauuugccucaagcaugacagugaugugacacagucaaagaugacuuccggaauccugagaagucccagggaggaugcugggcuuuccaaaaccuaaguuuaggauacugaggaccacaccccacaccccaaacacuucuccuuagaauaaguauagcaagccucagcauacacaaaucucagagugaacggaaaugucucugcaggcccaaggguggggucugaguagcgggggcgcugaggaagacaggcagugacagagccaggacagggucaacccugagcgugagugagcccaggaaacggaaagagagcaacacagccacccacacaacuaaaaucgacccacccgggucuccaugcugcaggaagucacugucuaggucucccaagacacauuuucaggggaagguuccaggcagcaagagcagcccuaggaaacuuuaauauacaauggaaucuggguuaagcacuaucuucuccaagaguugagcucacaggacauuccccagaaaccucuggagagguggggaggaaaguuucuggaggucuuuggauggagaaaacaaaaaaguggccuugauuuucaagacaaaauuacacaggaagaaaaaaauguuuuuaaucuaauuaagagcgaucuuuucaccuucaucacaacaucgcggaaaugugccaguucuuaacuucacacaauaaucaaagcaauuagugagggagaagccuuggaaaccggugcagauguucucagaauguuuaauggggaaaugaguugcaggccucauucucagcauccggcuccaggcccuggcuaccaaauccagacaucugcuggggccccacccccaggccccgagggcgcgggcuugagaaacacaggucccuucccaggccaccucccagccaggccagaacuggggccgagaggcuccccauagcuucucaaauuggagccuggacacagucagagccaccccagaacuggggggaggcucaacaucaaaauuauguuaacaacugaugucaaaaguaaucaacucagcuuggcucccccacugcugcuggcugcaggagggcugugaguaggaggagagcaagcggccccagagggacccucggcuaugacccccucagccugaacacuacuucaagaaaagaugugguggcaucugucugguaugguccugugggcuccauuccaaugcuaauggacucuuaaggggcccaggaaucaaaauggucaacacuugaggaauuuccaguaaucagagaaaacguauagaaaugaggaugaugcuuacuuaggaaauggccuauuacaggaaacagagggccacguggcuaaugucagugagcugugggagagacagagaccccagguggggcaggcagaucagcaaaucuuggaggaccugcuauguggcaggcacuggagacauggagguaaagaacacaauauccauguucucagggacacacucauaugcccuuagcauucacguucuucacacugacagcuucuuaaugcaagcccaccagauacuuucauaagcacuaccucugacuucaggcacuugcugagcugcacacagggcaggccaaaaggaauggaaagugagccaccaccggggcagcacucacuagugaaagauaaauaccccagcucucucagccgcuuguagaacucugaggaguguucugugcagcuucccagcugcccaccaugaagcucuuucucaauaagugaccagcacagcuuaauuccugaauuaagcugugugugcugugagacugacacaagacagggugacaggaagcugucggaacauuugaguagggaagcagcaagauccacuguacauuuaaagaacucccuugagcuguuaugugaagaauggaguacaggaagcaagaguggaaaucaagagaccaguaaugagguauggacaacaauguaggcagagaaaugguggugguuuuaaccagggagauagcuggagagacuaggugugggcaaauccagagaguugauaagacauacugauagauuagaaagggguacuaagaaaaaaggauaauuuaaaaaagacuuucagccaggcuuggagaaaaauagcaugcugcuccucauccccucugacuauaaaucaucucacucauccuccccuaaaagcauaaaaucaguaagugcaaauaaaaccacaugacccaugcuguuagcaguauuaggagaaagaauaccuucaaauugccuguggguagcaaagugagccaaauuccaauagcauucuaguccccugcccagcacugcaaaacugcauacagaaucagagaagaggcuuaaaaugcuuugucaaaaaguuugaagguaguuagcaacaucagcaaaaauagaggaguaaguaccucuaaggagccuucuugccuucacagacauccuaagcaccaagcagccuaagccacugaugaacuugcagauaccacugauguggauuauagucuaauuaauuguagagacaccacacuucugcacugaaccagaaccaaagccaaagcacccuacccaaaugauacuacagacgcguguacaggaaaaguccuuacuaaggcuacuccauaaaauuggaagucucuguuauuccagauaugcagauaucaacuuggggacacaaaaaacuuggggggaaaaaaacaagaaaacaugacuugccaaaagaacacaauaauucuccaauaauagacuccaaaguaaaggaaaucuuaaggaaacccaaugagauacaagagaacacaaauagacaauacaaacauaucaggaaaacaauucauuaucuaaaugggaaauccagcagaguuagauaugaaaaagaaccaaacaaaaauccuggaggugauaaauuaaaugaaugaaauaaaaaauacaauugaaagcuucaaaagccggcuaagucaagcagaagaaauaauuucuaaauuugaagacagguguuuugcaauaaaccagacagauuuaaaaaauaacaauaaaaaagaaugaagaaugccugcgugacauaugagacacuauuaagcuaacaauauuucacauuuugggaguuccagaagaaguguugggauaaggaccagaaaaucuauuuaagaagauaauaccugaaaacugccaaaguuugggagagaaagagacuaacagauaaaggaagcucacaaaucccuaaauagauucaacccuaaaagggccucucugaggcacauuuucaucaaacugucaaaaaucaaagagagaauuuaaaaaacaagagagaagcaugaagucacauauaagggaaucaacagcagauuaacagauuuuucagcagaaaccuucuaggccaggaaagaauugaaugccauauuaaaagugcugcaagguggggaaaagcucacaaaauugcuagccacaaauacuauacccagcaaagcuauccuucagaaaugaagcagaaugagggaagaaauuuugccucccucagacaagcaaaaacugagggaauucauuacuacuaaaucagccccacaagaaaugcuuaagggaguacuacaucuggaaguaggaggaugauaucuaccaucaugaaacuacaaaagcauaaaacacuaguagagcagauacacaaaugagaaaggaaaaggaauaaaagauuaucacuacagaaaaccaaaaaauugcaaagaaaaacaaugagaggaaacaaaaguauacaaaucagucagaaaacaauaaaaugacaggaguaaguccucaccuauugauaacaaucuugaauguagguaauuuaaauuucccaaaugaaagauagauacuggcuaaaugaauuaaaaaaauaaaacccaauuacaugcugccuauaagaaacugacuucaccuguaaagacacccauagacuguaagggaauggauagaaaaagauauuccacacaaacagacaccaaaagcaugcaggaguagacagacaaaaaauacugagucaaaaaaaaaaaaaaaaaaaaaaagaaaaagaaaaaagagacaaaggaggucauuauauaauuauaaauggaucaauucagcaagaagauauaacaauuauauaugcaaccaacaacacuggaguacccagguauauuaaacaaauauuauuagugcuaaagagauagaccccaauacaauaauaguuagggauggcaacauuucauacucagcauuggacaauucauuuggauggaaaaauaucaacaaggaaauauuagauuugaacugcugcuucguuagcacacagcacauucuccaggauauaccauauguuaggacacaaaacgggucucaauaaauuuuuaaaagucaaaaucuuaucaaguaucuucucagaccacaauggaauaaaacuggaaaucaauaacaagaggaacuucugaaauugaacagauacacggaaaucaaacuacauguuccugaaugaccacugugucuaugaagaaauugauuuuaaaaauuuaaaaauucuuugaaacaaaugaaaauagaaacacagcauacaaaaauguauaggguacaacaaaagaagugcuaugagggacauuuauuucaauaaacacccacaucaauaagguagaaaguuuuuaaacaaauaaccuaauaaacgcaucucaaggaacuagaaaagcaagaacaaaucaaaccuaaaauuagaaggaaauaaauaguaaagaucagagcagaucuaaaugaaauagagauaaaagguaaaaaagacaaaagaucaaugaaaugaggccucccccccaccccccgagacacggucucacucugucacccaggcuagagcgcaguggugugaucuuggcucacuguaaccucugcuuccugggcucaagcaauccuccugccucagcuucugaguagaugugcagcaccacaccucgcuaauuuuuuuuuuuuuuuuugguagagauggggguuugccauguugcucaggcuggucucaaacuccuggacucaagcgaucggccugccuuggccuuccaaaguacuggguuuacaggugugagccaacaaacccagccaaaaaacugauuuuuugaaaagagaaaaucaauaaaccauuagcuagacuaaccaagaagacccaauaaauaaaaucagaaaugaaaaaggagacuuacaauggacaccacagaaauacaaaagauuauuagagaccauuaugaacaacuauaugucaacaauuagaaaaccuagaggaaagagauaaauuccuggacauauauaaccucccaagauugaaccaggaagaaaaaaaaucugaacagagcaauaacaaggaaugagauuguaucaguaauaaagucucccaguaaagaaaaccucaggauugcacggguuuucuacugaauucuaccaaaccuuuaaagaacuaacaugaauucuucucagacaauuccaaaagacugaagagaaaggaauucucccuaacucauucugugaggcaagcaguaucuugauaccaaaaccagauaaggacacaauaacagcaaaaaagaaaacuacaggccaaucucccugaugaacauagaugcagaauccucagaaacaaaacacacacacagacacacaaacuagcaaucugaauccaaucgcacaucaaaaagauaauacaccauaaucaagugggauuuaucccagggauucaaggaugguucaacauauacaaaucaauaaaugugauacaucacauuaacagaaggaaggacaaaaaaauacaugaucaucucaauagaugcagaaaaagcaucugauaaaauucaaaaucucuucaugauaaaaaaaaaagcucaucacauaaugucuagaaggaacauaacucaaugaaggucauauaugacaaacccacagccaccuggggaaaagcuaaacaccuucucucuuagaacuagaacaagacaaggaugcccacuuucacuauucuuauucagcagaguaagaaaaguccucaccagaacaauuaggcaaguaaaagaaaaaggguauccaaauuggaaaagagaaugucauauuguccuuugcagauggcauaaucuuauacauagaaaaaccuaaagauuccaccaaaaucuuuuagaacugguaaaggaauucaauaaaguugcaggauaaaaaaaucaacaaacaaaaauuaguagguguggacaugauggcucaugcuuguaauuucagcacuuugaaaggaugaggcggguggauugcuugagcccaggaguuugagacuguccugggcaacauggcaaaaccucaucaguacaaaaaugagcugggcgugguggccugcaccugaaguucagcuacucaggaggcugagaugggaggaucacuugaaccucggaggugaagguugcagugagcagaaauugcaccauugcaccccagccugggcaacagagugagacccugucugcacuccccugccucccccaaaaaaucaguagcauuucugugaaacagcaaauuagccaaaagagaaaugaagaaagcaaucccauuugcaauagcuacaaaaaaaagcaaagcuuaaccaaggaggugaaagauuuccacaaugaaaacuauaaaauacugauaacaguaauugaagaggcuacaaaauuuuuugagacaucccaugcucauggauugaaagaaaaauguuaaaaugaucauauuuaccuauagcaauauacagaugcuaugaaaucccuauccagauaucagcaggggcuucaagauggcugacuagaggcaucuggcacucaccuccuccacaaaauauagcaaguagguaaccacaguuuauauagaucgccucugagagaaugcuggaauucaacugagaaguaauaagaaaaacccaaugcaagggauaagaggggagucaggcagucugcuucuaugggacuggcugggaucaugaagagacuccucgaugugcagaaagguaaguaagugagccccuagugguccacauucccacagcagacuccugaaauccuagucagagaacccccugacccauagaugccuugagacuaacaagaggcuaccuacagacugugaaauggcaaugaacagcucccagagagggagaucacccugaauccucaggcaauucacacauccccugaauccucaggcaacuucaggaaagucccauuuugauagcccaacccccaccagacugcaucugcugugggccccacaucccucuaucucaucccuggagccccauggacaucccuuacacaaagcugguugccacuccugacugcucccuccaggccaaagcaugagccauuggcaauacucugcuaccuccgaagcaaggcugccaugaggaaaggugacccugcccauagucaccaccuggggccgaagcaugcauugcccaacugccuguuuauagcugcugccacugaaagcaaucccacucaacuuccccaggaguagggcugcaauagaguugcugcugccccaacaugagcauucagcaggguauacagggaucuuccugugccugccuaccacagucaguacauucuugcauuacuggagggccucaggacaggcccaccuggccuggucccacccucuuuucucccagugccagcgcauaccaucucugggccuagggaucacccugcccuauccaguauuguuggcaccugagcacuccugggggcuugaggacugcccuacccaacugaccauuaccaccacaacuggcauucacuugaauuugccaccugugggccuugggacaagcucauccagcuuaucccagccaucccaauaccagcauggacaccuugggaggcagaagauuguucugccacugcuacugccauugcccaagccauaucugcugcucagagcucaaggaccuacccacccuguggcccagcucugucaucauuggcaccugagcaaguugccuggaggcccaaaauugguuucccuggacuugcuaacacugguaccagcauacacuaccauugggcccaaggauaagcauucggggccagccacugcugccacuggggccugaggacuggcccagcuggugucccuauccccagccagacuuuaccacagccuccaccaacaacugcauccuaaacuacagaggaacucccagacacuacuggugcuguuuacagcugaaaaaaauuccauggagaucacacuacugcaggcacccagaaucaaaaccaaagugcccugcccaaagaacaccauagauauaucuucaggaacaagacucucuuaggaaagacagaucaaaaaauuggaagaaacuacuguuacaccagaugugcagauaccaguguaagcacacaagaaacaugaaaaggcaaaacaugacaacuccuaaggaaugcaauaauucuccaacagauuccagugaaaaagaaauugaugaaaccuugaaaaauucaauauaauauuaaagaagaucugauagacuauacaaagaaaucagaaaaaacaauucgggguaugaaugagaaauuugcccaagagauagauauaaaaagaaccaaacagauauucuggaauugaauaauagauugaaugaaauaaaaaacauauuugaaagcuucaauaacagaccacaacaagcagaagaaagaauuucacaccuugaagauaagucuuuugaaaugacucagacaaaaauauagaaaaaauagaaaagaaugaacaaaggcuaugugacuauaggaugccauaaggugacaccuucagugucccagaaggugaagagcaaaccaaaagauuauaaaaccuauuuaaugaaauaauaccugaacacuucccaaucucccaagagauuuagauccaaauauaggaaucucagaacccuaaauagauacaauucagaaaggucuuuuccacagcacauuauagcaaauugcccaucccaagacaaagagagaaucauaaaaccagcgauaaaagagguuguagacacuuacaagggaacaaccugcagacuaacagauuuuucagcagaaacuuuacaggccaggaggaugggauuauauacgcagagugcugaaagaaaaaacaaaaccaaaaaccugccagccaggaauacuguacuuagcaaaguuauauucgucagaaaugaaggagaaauaaaguauuucccuuaaaaguaaaagcucagggaauuaauugccacuacacuggcacuacaaaaaaugcuuaagggagucuuacaggaagaagugaaaggacaacuucaugaaagcacacaaaauaaucagaaaucaauuaaugacaggaauaagcccucacauaucaacaauaaccuugcauauaaauagauuaaacuuucuacuuaaaagacagacuggcugaauggacuuaaaaacaugacccaucuaaaugcuaucuacaagaaacgcaucucaccuguaaagacacauaguugaaagaaaggaaugggaaaagauauuacaugcaaaaggaaacaaaaaccaaacaggaguagcuauacuuucaucagauaaaacaaagguuaagcuaaaaacacuaaaaagagacgaagucauuauauagugacagagggaucaauugaccaagaggauauaacaauucuaaacauauaugcacccaacaccaaagcacccagauauauaaggcaaacaucaaaucugaagggaaagguagacuucaacacaauaaucuugggaacuucaauucuccauuuccaguauuagacagaucaucuagacaaaaaauuaacaaagaaacauuggauuuaaacugcacuuuauaccaaauggaccuaacagacauuuacagaccaguucauaaaacagcugcagaauauacacucuucucaucaguacauggaacacucuccaggauacauuauauguuaggacacuaaguaugauuuuaaauauauauauauuuuaaauuggauucauaucacauaucuucucagaccacaauagcauaaaacuauaaauaaauaagaggagcauucaaaacuguauaaauaaauggaaauuaacauguuccugaaugaccaaugggucaaagaagaaauuaaggcagaaauaaaaaauuuacugaaacaagugaaaauagaagcacaacauucugaaacuuaagggauacugcaaaagcaaugcuaagaggaaaguuuauuguaauaaaugccuccauuaaaaaagguagaaaagaucuuaaauaaucuaaugauacaccugaaggaaccagaaaagcaagaacaaaccauacuaaacauaaaauuaguagaaggaaagaaauaacgaagaucagagcagaacuaaacaagaaacuaaauaaauauaaaggaucaaugaaaugcaaaaucgguuuuugaaaagaaacaaaauaaccaguggcuaaacuauccaagaagaaaagagagaagaccuacaugaauaaaaucaaaaaugaaaaaggggauauuacaacucauaccaugaaauacaaaaaucaaaacucuucagucugaucaauaaauugauuacaguuacaggauuuaaaaaucaggcuuauuucuauauaccaauaaagaaccagcugagaaagaaaucaagaaggcauuaucuuuuacaaccacuacaaaaaaucuaggaaugaguuuaaccaaagaggugagaaaccucuaacaaggaaaacuacaaaagucugaugaaagaaauugaaaagaacacacaaaaaacaucccauucucauggauugggagaauuaacaaaauuaaaaugaccauacuacccaaagcaaucuacagauucaaugcagucucucucaaaauaccaaugccauuuuucauggaaauagaaaaaauccuaaaauucagauggaaccaaaaaagagcuggaauagccacagcaauucugagcaaaaauaacaaaguuggaugcaucacacugccugauuuaaaaauauaaggcuauagcauuaaaagcagcaugguauuggaauaaaaacugauagaccaauggaacagaguagaaccuggaaguaaauccauguauuuacagccaacugauuuuugacaaagaugccaagaacauacacugggaaaagagcacccucuucacuuaauggagcugggaaaauaagauauccaugugaaaaaugaaaccguuucuaucucuugcuauacuaaaaucaacucaagauggguuaaagacuuaaacaugaggcaugaaacuauaacaucacuauuaaugaaggagacauuggggaaacacuuuaggacauuggucuagggaaagauuuuauggauaagaccucaaaaacacagacaaaaacaaaaauagacaaaugggacuauauuaaaugauaaagcuuguacacaacaagggaaacaaucaccagagugaagagacagccuguugaaugggagaaaauauuugcaaacuacucaucugacaagguacuaauaccagaauauacuaggaacuccaauaacucaauaguaaacaacaaauuaauuccaauaaaaagugagcaaaagacauggauagauauuucucaaaagaaaacauacaaguagccaacagguauauuuaaaaaaaaaagcccaacaucaguaauuauaagggaaaugcaagccaaaaccauagugagaauggcuauuuuaaaaagacaaaaauuaaccaaugcuggagaggauguggagggaacucuuauacacuguuggugggaauguaaauuaauacuauagaaaacaguuugauuucugaaaaaccuaaaaagagaaauaugacauaauccagcaaucucacuacuggauauuuaucuaaaggaaaagauaucaguauacuaaaaauguaccugcauccccguguuuauugcagcacuauucacaacagcaaagauauggacucaggaaccuaaguguacaucaguggauaaauggaaaaagaaaaugagguaaauauauacaauggaauacuaauugaccaaagaagaaugaaaucauguccuuugcagcaacaugaauggagcuggaggucauuauuuuaagccaggcacagaaagauaauuaucuuauguuauuaucauaugugggagcuauaaaaguugaucucauggagguagagaguagaaggauagauaccaaaggcugugaaagguaugucuggagggugaagagagguugguuaguggguaaaaauacacagcuaguuagaauaaauaauuuauaauguuugauaagaguugguugacuauauuuaacaauauaauguauauuucaaaauaaaaaagaggacuugaaauguuccuaacuauagagaugauaaauugagggugauggauacccugacuugaucauuacacauucgaugcauguaacaauagcacauguaccccauaaguauuauguaucggucaaaaaaaaaaaaaaaaggaaaucccagugcuuuggggggccaaggcagaaggaucgcuugagcccaggaauucaagaccagccugggcaacaaugcacgacccugucucuacaaaaaauuaagaaguuauccaggcaugguggugcaugccuguagucccagcuacuugaggggucaaggauggagaaugacuugagccugggaguuaaagauugcaguaaguggggugguuccaagauggccgaauaggaggagcuccagucuauagcucccagcgugagugacgcagaagaugggugauuucugcauuuccaacugagguaguggguucaucucacuggggcucgucaagacaguggguacaggacagugggugcagcccacugagugugagacgaaguagggcgaggcaucgccucaccugggaagcacaaggggucagggaauucccuuuccuagccaacggaaggggugacagacggcaccuggaaaacuggaucacucccacccuaauacugugcuuuuccaauggucuuagcaaacggcacaccaggagauuauaucccgcgccuggcucggagggucccacgcccauggagccucgcucauugcuagcacagcagucugagaucgaacugcaaggcggcagcgaggcugggggagccugccauugcugaggcuugaguagguaaacaaaguggccaggaagcucgaacuggguggaguccaccacagcucaaggaggccugccugccucuguagacuccaccucuggggacagagcauagccgaacaaaaggcagcagaaaccucugcagacuuaaaugucccugucucacagcuuugaaaagaguagugguucucccagcacggaguuugagaucuaagaauggauagacugccuccucaagugggucccugacccccgaguagccuaacugggaggcacuccccaguaggggcagacugacaccucacacggcuggguacuccucugagacgaagcuuccagaggaacaaucaggcagcaacauuugguguucagcaguauucgcuguucugcagccucugcugcugauacccaggcaaacagggucuggaguggaccuccagcaaacuccaacagaccugcagcugaggguccugacuguuagaaggaaaacuaacaaacagaaaggacauccacaccaaaacuccaucuauacgucaccaucaucaaagaccaaagguagauaaaaccacaaagauggggaaaaaacagcagaaaagcagaaaauucuaaaacucagagcaccucuccccauccaaaggaacgcagccacucgccagcaauggaacaaagcuggacggagaaugacuuugacaaguugagagaggaaggcuucagacaaucaaacuucuccgagcuaaaggaggaaguucgaacccaaagcaaagaagcuaaaaaccuugaaaaaagauuagacgaauggcuaacuagaauaaccaguguagagaaguccuuaaaugacaugauggagcagaaaaccauggcacaagaacuacgugacaaaugcacaagcuucaguagccgauuugaucaacuggaagaaaggauaucggugauugaagaucaaaugaaugaaaugaagugagaagagaaguucagagaaaaaagaguaaaaacaaacgaacaaagccuccaagaaauaugggacuaugugaaaagaccaaaucuacaucugacugguguacaugaaaaugacagggagaauggaaccaaguuggaaaacacucuucaggauauuauccaggagaacuuccccaaccuagcaaggcaggauauuauccaggagaacuuccccaaccuagcaaggcaggccaacauucaaauucaggaaauacagagaaugccacaaagauacuccucaagaagagcaacuccaagacacauaauugucagauucaccaaaguugaaaugaaggaaaaaauguuaagggcagccagagagaaagguuggguuacccacaaagggaaacccaucagacuaacggcggaucucucagcagaaacucuacaagccagaagagagugggggccaauauucaacauucuuaaagaaaagaauuuucaacccagaauuucauauccagccaaacuaagcuucauaagugaaggagaaauaaaauccuuuauagacaagcaaaugcugagagauguuauaaccaccaggccugcccuacaagagcuccugaaggaagcacuaaacauggaaaggaacaauugguaccagccacugcaaaaacaugacaaauuguaaagaccauagaugcuaggaagaaacugcaucaacuaacgagcaaaauaaccagcuaacaucauaauggaucaaauucacacauaacaauauuaaccuuaaauguaaauaggcuaaaggcuccaauuaaaagacacagacuggcaaauuggauaaagagucaagacccaucagugugcuguauucaggagacccaucucacgugcagagacacacauaggcucaaaauaaagggauggaggaagaucuaccaagcaaauggaaaauaaaaaaaggcagggguugcaauccuagucucugauaaaacagacuuuaaaccaauaaagaucaaaagagacaaggucauuacauaaugguaaagggaucaauucaacaagaagagcuaacuaucuuaaauauauaugcacccaauacaggagcacccagauucauaaagcaaguccuuagagaucuacaaagagacagacucccacacaauaauaaugggagacuuuaacaccccacuguuaacauuagacaaaucaacaagaccggaaguuaacaaggauauccaggaauugaacucagcucugcaccaaguggaccuaauagacaucuacagaacauuccaacccaaaucaacagaauauacauucuucucagcaucacaucgcacuuauuccaaaauugaccacauaauuggaaguaaagcacuccucagcaaauguaaaagaacagaaacuauaacaaacugucucucagaccacagugcaaucaaacuagaacucaggauuaagaaacucacucaaaaccgcucaacgacauggaaacugaaccaccugcuccugaaugacuacuggguacauaacgaaaugaaggcagagaaauaaagauguucuuugaaaccaaugagaacaaagacacaacauaccagaaucucugggacacauuuaaagcaguguguagagggaaauuuauagcacuaaaugcccacaagagaaagcaggaaaaaucuaaaauugaugcccuaacaucacaauuaaaagaacuagagaagcaagagcaaacacauucaaaagcuagcagaaggcaagaaauaacuaagaucagagaagaauugaaggagauagagacacaaaaaacccuucaaaaaaucaaugaauccaggaggugguuuuuuugaaaagaucaacaaaauugauaggccucuagcaagacuaauaaagaagagagaagaaucaaauagaugcaauaaaaaaugauaaaggggauaucaccaccgaucccacagaaauacaaacuaccaucagagaauacuauaaacaccucuaugcaaauaaacuagaaaaucuagaagaaauggauaaauuccuggagacauacacccuuccaagacuaaaccaggaagaaguugaaucccugaaaagaccaauaacaggcucugaaauuuaggcaauaauuaauagucuaccaaccaaaaaaaguccaggaccagacggauucacagccgaauucuaccagagguacaaggaggagcugguacuaugccuucugaaacuauuccaaacaauagaaaaagagggaauccucccuaacucauuuuaugaggccagcaucauccugauaccaaagccuggcagagacacaacaaaaaaagagaauuuuagaccaauaucccugaugaacauugaugcaaaaauccucaauaaaauacuggcaaaccgaauccagcagcacaucaaaaagcuuauccaccaugaucaagugggcuucaucccugggaugcaaggcugguucaacauaugcaaaucaauaaacauuauccagcauauaaacagaaccaaagacaaaaaccacaugauuaucucaauagaugcagaaaaggccuuugacaaaauucaacagcccuucaugcuaaaaacucucaauaaauuagguauugaugggauguaucucaaaauaauaagagcuauuuaugacaaacccacagccaauaucauacugaaugagcaaaaacuggaagcauucccuuugaaaacuggcacaagacagggaugcccucucucaccacuccuauucaacauaguguuggaaguucuggccaaggcaaucaggcgggagaaagaaagaaaggauauucaauuaggaaaagaggaagucaaauugucccuguuugcagaugacaugauuguauauuuagaaaaccccaucaucucagcccaaaaucuccuuaagcugauaagcaacuucaacaaagucucaggauacaaaaucaaugugcaaaacaucacaagcauucuuauacaccaauaacagacaaacagagagccaaaucaugagugaacucccauucacaauugcuucaaagagaauaaaauaccuaggaauccaacuuacaagggaugugaaggaccucuucaaggagaaguacaaaccacugcugaacaaaauaaaagaggauacaaacaaauggaagaacauuccaugcucauggauagggagaaucaguaucaugaaaauggccauacugcccaagguaauuuauaaauucaaugccauccccaucaagcuaccaaugacuuucuucacagaauuggaaaaaaacuacuuuaaaguucauauggaaccaaaaaagagcccgcauugccaagacaauccuaagccaaaagaacaaagcuggaggcaucacgcuaccugacuucaaacuauacuacaaggcuacagucaccaaaacagcaugguacugguaccaaaacagagauauagaccaauggaacagaacagagcccucagaaauaauaccacacaucuacaaucaucugaucuuugacaaagcugacagaaacaagaaauggggaaaggauucccuauuuaauaaauggugcugggaaaacuggcuagccauauguagaaagcugaaacuggaucccuuccuuacaccuuauacaaaaauuaauucaagauggauuaaagacuuacauguuagaccuaaaaccguaaaaacccuagaagaaaaccuaggcaauaccauucaggacauaggcaugggcaaggacuucaugucuaaaacaccaaaagcaauggcaacaaaagccaaaauugacaaaugggaucuaauuaaacuaaagagcuucugcacagcaaaagaaacuaccgucagagugaauaggcaaccuacagaaugggagaaauuuuuugcaaucuacucaucugauaaaaggcuaauauccagaaucuacaaagaacucaaacaaauuuacaagaaaaaacaaacaacccuaucaaaaagugggcaaagguuaugaacagacacuucucaaaagaagacauuuaugcagccaaaagacacaugaaaaaaugcucaucaucacuggccaucagagaaaggcaaaucaaaaaaccacaaugagauaccaucucacaccaguuagaauggcaaucauuaaaaauucaggaaacaacaggugcuggagaagauguggagaaauaggaacgcuuuuacacuguuggugggacuguaaacuaguucaaccauuguagaagacaguguggugauuccucaaggaucuagaacuagaaauaccauuugauccagccauccccuuacuggguauauacccaaaggacuauaagucaugcugcuauaaagacacaugcacacguauguuuauugcagcacuauucacgauagcaaagacuuggaaccaacccaaauguccaucaaugauagacuggauuaagaaaauguggcacauacacaccauggaauacuaugcagccauaaaaaaaggaugaguucacguccuuuguagggacauggaugaagcuggaaaccaucauucucagcaaacuauagcaagaaugaaaaaccaaacaccgcauguucucacucguaggugggaacugaacaaugagaacacuuggacguaggaaggggaacaucacccaccagggccuguugugggguggggggggaggggggaggggggagggaaagcauuaggagauauaccuaagguaaaugacaagguaaucagugcagcacaccaacauggcacauguauacauauguaacaaaccugcacguugugcacauguacccuagaacuuaaaguauaauaaaaaaaagggagagagagagaaaagagaaaucuaaaaaaaaaaaaauaccaaagacaaucuucaccgaaauagcaaaaacacaauccuuaaacuugcauggaaccacaaaagaccacaaauaggacaaacaauacugagcaggcagaaugaagcuggaggcacuacacugccugacaucaaaauacagucgacucuucaacaacauagauuugaacuguauagguucauuuauacguggauuuuccccauaaucuaacaaggauagaaugcaauauucacaaaagugaaaacuauguauacagaugacugacauuuuguauaugcgcauuacacagggcugacucugggacuugaauauacauggcuuuugguauauacagggggucucggaagcaaucccccuuguauacaaaacaaugguaaccaaauuagcaugcaaugggcauaaaacagacauauagaccaauggaacagaauagagaacccagaaguaaauaaauuuauuuacagacaacugguuuuugacaaaggugccaagaacacacucuggggaaaggacaccauguugaacacaucauguugggaaaacaggauaucauaugcagaagaaugaaacuauacuaucucucagcauauaaaaaaaucaacucaaaauugauuagagacuuaaacaugagaccugaagcaaacaguacuagaagaaaacagaagggaaacccuucaggauaugggucuagcgaagauuuuauggguaagacuuuauaagcacaggcaacaaaaacaaaaauagacaaaugggacuguaucaaacuaaaaaccuacacauaaaaggaaauaauaaacuauuaagagauauccuguagaaugggagaaaauauucaucugacaagggauuaauauccggaauauacaaggaauucaaacaauucaacagcaaaaaacaccagauuaucugauuuagaaaugugcaaaauagaacaacuggccaacagguaugugaaaaaaugcucaacaucucucaucacagaaaugcaagucaaagccacagugagacauuauuucaccucaguuagaauggcuguuuucaaaaagacaaaacauaacaaaugcuggcaaggaugcagagaaaagggaaauaauacacuauuugugggacuauaaauuagugagucauuauggaaaauacugugguguuuugucaaaaaaacuaaaaguagacuaucauacaguuugacaauccacuaccggguauugacucaaaggaaaggaaaucaguauauaaaaaagauauuugcauucucauguuuauugcaguacuguucacaacaguuaagauauggaaucaacuuaaaucuccaucagcagaugcagagaaagaaugugguauguauacacaauggaauauuauucagucauaauaaagcauuaaguccugucauucacagcaacauggaugaacuuggauaauauguuaaaugaaauuaggcacagaaagauggaggauuuugacugcucacaaaacagagaaaugauauuugaguugaugaauaugcuaauuacccugauuugauuaugacacauuauauacauguaucacaauaucacuguguauaucccauaaauaucuacaauuauuacauguugacuaaaaauaaaaggacaaagaaaaagacuccuagaagaaaaacccacaaggagcaucauaauggugaaaagacuaagagcuuuuccucuaagaucaggaauaaagcaagaugcgcauuuuagccauuauauuaaacauaguaguggcuuucuagccaaagaauauggaaaagaaauaaaggcaucauuuagaaaggaagaauuaaaauuauguuuguucauagauaugaucauauuuguagaaaucccugaaaacucaccacaaaaacugaauaaauuaauucagcaaaguagcaggauaguaagucaguacacaaaauucaguugcauuucuuuuuuuuuuuuuuuuuuuuugaggcagagucuuggucugucgcccaggcuagaguguaguggcgcgaucucggcucacugcaagcucugccucccgaguucacgccauucuccugcuucagccucccaaguagcugggacuacaggcacacgcugcuaugccuggcuaauguuuuuguauuuuuaguagagaugggguuucaccauguuagccaggauggucucgaucuccugaccuugugaucugcccuccucagccucccaaagugcugggauuacaggcgugagccacugcgcccagcuuucaguugcauuucuauacauuaaucacaaacaaucugaaagggauauuauuaacacaacucuauuuacacgacagcaucaggacacucagccuuggccaccaaggaccuuuguaauguuugccacugcugaccucagcugauggagcugcaagaagaguauuccauuauauccucaucugggcuacagcugcugcacccuaccuacuuaacacuccaucaagugagcagauuucaauucauuguaacaagaaacagaaaaaccaaggaaacauagcacccaccugagaaauacaauaauuuucagggacugacucccaagaaauugggauacauuaauugccuuacagaaaauuaaaaacgacugauuuaaggaaguucagugugcuaccagagaacagagagacaaccuaaugaaaucauuaauacacaaaaggagacauucaauaaagaaauagaaauccuaaaaaaaaaacaaacauuuuggaggugaagaauauagugcaugaaaugaaaagugaaauagaaagcaucagcagcagacuugaucaaauagaaggaggaauucaucaacuggaggauaaauuauuugaaaauaaccaguagaggagaaaaauaaagaaugaaaagguaacaagggaaguuuacaggauuuaugggacaccaucaggagaguuaauguucacacaggauuuauagaaggaaaguagagagguaaaggguagaaaguuaauucagagaaauaauggcugaaaacuucccauaucuggggcucuucccagauugauggacaucuagguacaugaagcucaaagaauuacaauuaguuuccaucuaaaagagguuucaccuagauauauugccaucaaaauguaaaaaauggaagacaagauaauuuugaaagcggcaagauaaauaaaguucuuacaucugcaggaaccuccauaaggcuaucaguggauuucugagcaaaaacuuuccaggccaggaaacaauaggauuauauauucaaaguucugaaagauaaaaaacugccaucuaagaauacuuuacacagcaaagcuguccuucagauaugaaacagauacaagacuuccucagguaaacaaaaguugaaggaguuuaucagcaacuacucuugccuuacaagauaugccagagggaguuauucaggcuuaaauggaaggaugauaauuaguaacaugaaaacauaugaaaguacaaaauucacugauaaauaaauauacgggcaacuuaagaauacucuaauaguguaaugguaguauauaaaucacauaacucuaguauaaagguuaaaagaaaaauaauuaaaaauuacuauuguuuucauaauuucucaauggauaugcaauauuaaaagguguaccuuggggcaucaaaaauaaaauguagcgggggaaguauaagaucaaaauauuccccccaaacaaagagggaacaaucccaacuuauuuuacaaggcuagcauugcccucauacuaaggccagacaaggacaauauaagaaaagaaaauaacuggcugauauuuuuuuaugacuauacauuuaaaaauuuucaacaaaauaugaucaaacugaauuuaacagcacauuaaaaaaaucauauaucacaaacaugggauuuauccuuaguacauaaggacaguuaaguguacauauacaagaaaugggauacuuuaauaaaaucaaagauaaaaaucauacaaucauuuugauaagugcaaauaaugcaguucacauaauucaacauccuuccaugauaaaaacuaugaacaaauuagguauagaaggaauguacugcaacacaauaaaggccauauaugaauagcccacagcuaacaucauacucaaugcugaaaagcugaaugccucuccucuaagaugaggaacaagaaaaagauauucucaccacuucuauucaacacaguacuggaaguccuagccagaggaauugggcaagaaaaauaaauaaauacacucaaaucagaaagaaggaaguaaaauugucucuguuugcagaugacaucauauauguagaaaaugcuacagacuccacaaaaaaaaccuguuagaaguaauaaucuaacucaguaaaguggcaggauacaaaaucagcauucagaagucauuugcguaucuauacacuaauaauaaacaaccugaaaaacaaauuaagaaaacaauuucauuuaaaauagcaucaaaaagaauagagagcucccaaauaaauccuuucauauaugaacgcaugauuucugacaagcaugccauguccauucaauggcaaauggauucucuuuucaacaaauggugccaggaaaacuggauauccucacgugagagaaugaagucgagaccuuuaccuaacuccauauacaaaaauuaacucaaaguggaccacagaccuaaauguaagaccuaaaacuauaaaacucuuagaagaaaacauggggcaaaaacugcaugacauuggauuugguauugacuucauuuggauauaauaugaaaggcacagauaaaauaaaaaauagagaaauuggacugcauaacauuuaggcauacauuuaaccaaggagauaaaagaccuagacacugaaaacuaugaaacauugaacaaauucuaagaugauacaaauaaauggaaagauaucugguguucauagaucaauagaauaaauauugccgaaauagcuauacuacucaaagugaucuacagauucaaggcaaugccuaucaaauuuccagugacuuuuuuucacagauauagacaaaaaaaauccuaaaauuugaaagaaacuacaaaagaccuuaaagaucuaaagcauacuugagcaauaagaacaaagugaaagauauuacacaugcuuauuuugaauuauauuucaaaguuaugguacugguauagaaauaaaccaauggaacagaauagaaagcauagaaauaaacccacacauuuauggucaacuaaucuuugacaaagacaccaagaguacacaauggggaaaggguacucucuugaauaaauggcacugugaaaccaggauauccacaugcaaaaaaauuaaauuggaaccuuacccuacacuguagagaaaagugaauaagauuuaaacauaugaccugaaaccauaaaaccuauaaaacagggaaaagcuccuugccauugguuuuugugacaauuuuuuagaugugacaucaaaagcacaaggaauaaaacgcaaaaauaaauuagaacuacaucaaacaaaaaagugucugcacaacaaaggaaacaacaaaaugaaaaggcagcacauguagcgggagaaaauauuuccaaccauauaucugauaagcuauuaauauccaauauauauaaggaacucauauaacuagcaaaaaaacuuaauaacccaauuaauaaccuguuaagauggacaagggacugaauagacauuuauucaaagaagacauacagauggucaacagguauauaaaaaggugcuuaacaucacuuaucaucagggaaaugcaaaugaaaaccacacugagauaucaccucauaacuguuagaaucgcuauuaucaaaaagucaaaagauagcaaguguuggugaggauguggagaaaaggugucccuuauacauuuuuguuaggaauguaaauugauacagucauuauggaaaacacgauagauuuucuuuaaaaaauuaaaauuggaacugcuauaugauccagcagucucaguuccggguauaucuaaggaaaacaaagucaguaucuugaagagguaucugcacucccauguucauuguaguguuacaguagucaagaaaugagcaacauaguauucauaggcaugguggcuuguaccuguaaucccaguacuuggggguggccaaggugaaggauagcuugaacacaggaguuugagaccagccuaggaaacauagugauacccuaucucuacauaaaauuuuaaaaauuagcugggcaugggggugcaugacuguggucccagcuacucaggaggcugaggcaggaggaucacuugagcccaugagguugaggcuacagugaacugugauugugccacuguacuccugccuggaugacagauggagacccugucucaaaaagaaaggaagaaaauaguguguguguguguaucaccaaauucccaaauaaacacaucacauacauauacauacagacacacacacacacauauauacacacacacaaugaaauauucauccuuuaaaaagcaggaaaucaugcaauuuaugacaacauagaugaaccuggaggauauuaugcuaagugaaauagccagacacagaaagacaaauacugcacuaucccaguuacauauggaauucuaaaaagcuugaacucagagaaacggagaguagaagggugguuacuaggggucagggaguaggggaaauaggaaauguugaaggguacaaacauagaguuaucagaugaauaaguucuugacauaacguccagauuggugacuauaguuaauauauucuauacuuggaauuugcuaagagaguauagcuuagguauucugaccacacacacgcacacacauggcaacuauguaagguauauguuaauuggcuugauuguaguaaucauuucacaguaggucaaauauguucuuaaauauaugcacuuuuaauuugucaauuauaccucaauaaaagcugaaaaaagcaucaagaauaacaaacuuaggaaccaacuuuaccaaggaggugaaagucuuguacaaugaaaauuacaaaacaaugcugaaagaaauuaaaguagacauaaagggaaaacaccuccuauguucauggauuggaaggccaauauuguuaaggugucaguaccacacaaaacaaucuacaaauccaagguaaucccaauaaaaauccuaaugauguuauuugcagaaagaagaaaccccauccuaaaauucacauggaaucucaagggaccuugaauagcuaaaacauucuugaaaaugaugaacaacauuggaggacucacacuuucugauuugaaaacuuacuacaggccagguacaauggccuacaccuguaaucucagcacuuuugaaggcugaggugggaggacuucugaguccaggaguuugagaccagccuggggaacacagggagaccucaucucuacaaaaaauaaaauaauuggccagguguaaugguacacacuucuauucccagcuacucaagaagccgaggugggaggauugcuugagccugggagauugagguggcaguaagcagugauaaugccacuguacuccagcgugggcaacagaguaagaaugucugaaaaacaaacaaaaaccccaacuuauuacgaagcuacaguaaucaaaacuaugugguauugacauaaagauguagagaccaauggaauugaauagagagcccaaaaauaaacccuuguauacaugaucaaaugauuccugagaagagugccaagaccauucaauagggaaagugcuguauuuucaacaaauggugccaggauaacugaaguugagacccuuaccuaauaccauacacaaaaauuaacucaagagaaugaaguugagauccuuaccuaaccauguauaaaagagaaugaaguugagacccuuaccuaacacuguguacaaaaacuuacucaaaaugggucaaaguccuaaaacuaugaagucuuauaaggaaacauaggggaaaaacuuuacaucauuggcagugcuucuuguaugcgacaccaaaggcacaggcaauaaaaguaaaaauagauaaauuguacuugcacaggcaauaaaaguaaaacuagauaaauuuuaaaaauuuacauugugugcauuaaaauaauaucaacuaagcaauaagacaaccuacagaaugggagaaaaauuugcaaaucacauaccugauaagggauuaauguccagauuauacagagaacuucuaaaagucaucaccaaaaaacaaugcaccugaaaaaugggcaaaagggccaggcacgguggcucacgccuguaaucccaguacuuugggaggcugaggcgggaggaucaugaagucaggagauugagaccauccuggcuaacagggugaaaccccgucucuacuaaaaauacaaaaaauuagccaggcgugguggugggcgccuguagucccagcuacucgggaggcaggagaaugaugugaacccaggaggcagagguugcaguaagccgagauggcaccacugcacucagcuugggcaacagagugagacuccaucucaaaaaaaaaaaaaaaagggcaaaggacuuggacagacguaucuccaaagaagauauacaaauggauaauaguacgugaaaaguuguuuaacaucucuagucauuaggaaauacaagucaaaaccacaaccuuacauacacucagaugacuacuauuaaaaaaauaaacacagccuaggcaacauagugagacccaucucuaguaucagcuacgugggagguuaaggugggaggauagccuaagcccagaggucuagguugaggcugcagugugccaugaucaugccacugcauuccagccuaagugacagagccagaucuugucucaaaaaaaucccacauaaacagaaaauaaccacugcuggaagggacauggagaaauuggaauccuugugcacuguuagugggaaugcaaaaugguacagccucuguguuaaacaguuugguguuccuucaaaaauuaaaaacagaauuaucugauccaucaacuccaccucuguguauacacccagaaggauuaaaagcagucucaaagauauauuuguauacccacgauuguaguggcauuauuuacaacaguuaaaacaucaaugcaacccaaauguccauggaagaauggauaagcaaaaugugguauauacauacaauguaauauuauucagcuuuaaaaaaaauagaaauuuugacacaugccacaacauggaugaaccucgaggccauuauguuaaaugaaauacagcagucacaagaagagaaguacuguauguuuccacuuauaugagguauguagaauagucaaaucagagacauagaaaguacaaggugguuuccaagagauggcggugguggggggguuggggaauuauuguuuaauggauauagaguuucauaauuacaaaugacaaguguuauggagauggaugauagugaugauugcacagcauugugaacguaucuaauacauucacugaauuguacacuaaaauugguuaggaugguaauuuuuauguuaaguguauuuugccacaauaaaagauuuggaaaucaacaacaaauagaaaucccagaagauaacauaggaagaaaucuagaugaucuuuaguuuggugauggcuuuuuagauaugacaccaaaggcaugauucaugaaagaaauaauugauaagcuagacuuuguuaaaaauaaaaguuucugcucuguaaaacauacugucaagaggaugaaaggacaggccacagaagggagacaauacuuguaaaagauauaccugauaaaggacucauccaaaauauauaaagaaccuuaaaaacauaacaauuagaaaacaaacaaucugauuacaaaauggacugaagaccuuaacagacaucucaccaaugaagauauacagauggcaacuaaguauaugaaaagaugccccacaucuuacgucauuagggaaauggaaauuaaaacaagaaaugugauauaucuacacgcuuauuagaauggccaaaauucaaaacacugacaauaccaaauacuugccaauauguggggcaacaggaacacucauccauugcuggugggaaugcaaaaugguacagccacuuugacauauaccauuaaugggaauguaaaguggugcagcccugguggagaagaguuuggugguucuucaaagaauuaaaaauggaauuaucauaggauccaucaauuccacuucugaauguguauacauaucccccgaagaauccagaguauaucgaaaucagugguuucuuauaaaauuaaacauauucuuaccaugcaguucagcaaucacauccuugguauuuacucaaaggaggugaagacuuauauucacauaaaaaucugcacagagauguuuacagaagcuuuauuugugauuguugaaauuggaagcaaccgagauguccuuccauaggugaguagacagauaaacuguaguacauccaggcaaugaaauauuauucaucacuaaauagaaaugagcuaucaagccaugaaaagauauggagguaauuaaaaaacauauuacuaugugaaauaaggcaaucugaagaaacuacauacuguaugauuccaaucauauugcauuuuagaaaaggcaaugcuauggaggcaguaaaaaguucagugguugccaaggguuguuggggaagaaggguugaauaggcagugcacagaguacuuuuagggcagugaaaauguacaaauauauguaaauauacguaucuguaugauacuauaaugguagauacaugcauauuaguccguucucacagugcuauaaagaacuaccugagacuggguaauuugugagaaaagagguuuaauugacucacaguuuuguaggcuguacaguaagcauggcuggcaggccucagaaacuuaaaaucauggcggaaggcaaaggagaagcaggcacaucuuuaccauggcagaacaggagagggaaagaaagugagaugggaagugccacacacguuuaaacaaccagaucucaugagaacucacuaucaugagaacagcaagggggaaguuugccccccaccaggccccuccccugacacauggggauuacaguucaagaugagauuugggugggaacacagagccaaaccauaucaacauguuacacauuuguagaaacccacagaauguacaccccaacagugagcccuaauguuaacuagggacuuugauaauaauguguaaaugcagauucauaaguuguaacaaacgugccacucuggugggagaguugguaaugggaaaagcucuguauguaugggugcaguggguauacgggaaaucucuguacuuaccucucaauuuugcuggaacccuaaaacugcucuaaaaauauaaagucuuuaaaauacacauacacacauacagacaaucgaauagagaaucauaaugguacacuaucagaaaaucaucaaacacaaaaaaaggcaguaagggaggaaauguuguauuuaaaaaauguaaggcaaaagaaaaggcacaaaaugucagaacuucuuuuuuauaaguaaguacuuuaaauguaagucgauuaaauucuccaaaaagcagagguuggcagaauggauuuaaaagaaaaccaucaaccuaugcuguauauaacaaacucacuuuuggucuaaagacacaaguagauugaaagugaaagaaugaaaaaugauauuucauacaaauaguaaccuaaagaaagcuggagguaauuauacuaauaaaagaaauaaacuugaauuuaaaaauuguuauaggagacaaaggaggacauuacauacugagaaaauggaaaauuacucaagacuucgcaauuggaaacguauacacaccaaaauauagagccccagaauauaagaaaauauacugacagaauuggagugagaaagacaguucuacaauaauacuuagggacuucaauaacguacuuucaguaauggguagagucaaagaagaaaugaaaacagaaacuuaaaaauaucuucagacaaaugacagugggaacacaacauaccaaaagcaaaacaugcagcaaaagcaguucuaagagggaaguuuacagcaauaaaugccuugccuacauuaaaaaagaagagauauuucaaauagcccaaaauuguaccucaaggaauuagaaaaagaagaacaaacuaaagccaaaguuaacagaaggaaauaauaaagaucagaacagagacaaguuagaaagaaaaaccauaggggaaaaaagucaguaaaacuaagacuucaauuuuugaaacaaagaauugauuuuugaaaaauaaaaucaacaaacucuuggacuaagaaagaggacaaaaucagaaaugaaaauggagaauauauuacaacagguacuucagaaauaaaaaggaucauaagggacuuuuaugaacaauuauaucccaacaaauuggauaaccuagaggaaauggacaaauuccuagaaaaaaaccaaccugcuaagauuaaaucaggaauagaaagccugaacagaccaauagcaaagagaucacagugguaaacuaaagagcuucugcauagcaaaagaaauuaucaacagaguaaacagacaacauauagaaugggagaaaaaauauuugcaaacuauucaucuggcaaagguccuauguccagaauccauaaggaacuuaaaccaaucaacaagcaaaaaacgaauaauccaauugaauuggcaaaggacaggaacauacauuucuuaaaagaaaauacagaaguagccaaacaaaaaaacauucucaugaucacuaauaaucagaaaugcaaauaaugaggccaggcacgguggcucaugccuguaguccuagcacuuugggaggcugaggugcguggaucaucuggggucagguauucgagaccauccuggccaacauggugaaaccccgucucuacuaaaaacacaaaaauuagccagguaugguggcggucaccuguaaucccagcuacucaggagucugagacaggagaauugcuugaacccaggagguggagguugcagugagccgagauugcgccacugcacuccagccugggagacagagcaagacucuuucucaaaaaacaaacaaacaaacaaaaaagcaaaaaacagacaaaaaaaaacaaaacaaaacaacaacaacaaaaaaacaccaaaccauaaugggaugccaucucacaccagucagaauggcaauuauuaaaaagucaaaaaaauaaaaguugcugggaaggcugcagagaaaagggaacgcuuauacacuguuggcaggaauacaaauuaguucagccacugugcuaagcaguuuggaguuuucucaaauaacugaaaacagaacuaccaucugacccagcaaucccauuacuggauauauauucaaaggaaaauaaauuguucuaucaaaaagacacaugcauuuguauguucaucacagcacuauucacaacagcaaagacauggaauccacuuagaugcccaucagugguggauuggauaaagaaaaugugguacauguacaccauggaauacuaugcagccauaaaaaugaaugaauucggccaggugcgguagcucucaccuguaaucccagcacuuugggaggccaaggcggguggaucaccugaggucaggaguucgagaccagccugaccaacauggaaaaacccugucucuacuaaaacuacaaaauuagcuggacgugguggcgcaugccucuaaucccagcuacucaggaggcugaggcaggagaaucacuugaacccgguaggcggaggcugcagugagccgagaucaugccauugcccuccagccugggcaacaagagcgaaacuccgucuaaaaaaaaaauaaaaaaaaaaaauauauauauauacaugaaugaacuuacguccuuugcagcaacauggaugcagcuagaggccacuaucuuaagcaaauuaaugcaggaacagaaaaccaaauacugcauguuaccacuugcaagugggaccuaaacacugaguaaacauggacauaaagaugaucaguagacacuggggacuacuugggggaggaauggagaggugggcugaaaaccuaccuauuggguacuaugcucacuaccugggugauaggcuuauccacacuccaaaccucaucaucaugcaguauacuccauauaccaugcaacauauagaccuguacauauacccucuaaaucaaaaauaaaaguuaaaaaaaccccaaaaccucaaacaaagaaaagcccaggaccagauagcuucaugacugaauacuacccaauauucaaagaauaccaauacuucuuaaacucuuccaaaaaaaugcagcuauagggaauacuuccaaaaaaaaaaaaaugcagcuaaagggaauacuuccuaacacauuuuaugaggccagcaucaccuugauacccaggugagccaaaggcaucacaagaaaaggaaacuacaggccaacauaacccaagaauaccgaugcaaaaauccuuaauaaaauauuggcagacuaaauuuaacaauacaucaaaaagauuauauaucaugucuauguggaauuaauuucuggcaugcaaaucuuauuuaauauacauguagcaaucaaugugauacuaacagacugaaagaugaaaaccacaugaucaucucaauugacacacaaaaaguauuugaugaaguugaacauccuuuguugauaaauucuaacaguucagguauagaaggaacacuccucaauauaacgaaugccauuuaugaaaagcccacagcuaacguuauaaucaaugagggaaaacagaagcccuucuacuaugaaccaguacaaggcaaggaugcccacucuagcuacuacuacucaacauaguacuggaaguacuaguacaaccaaacagacaagaaaaagaaaugaaagacauucaaaucaggaaguaagaaguaauauuaucuuuauaugaagaugacaugauccuacauauagaaaaccccgaagacucugacaaagcaaccuguuagaacuaauaaaugaguucaguaaaguuguaggauauaaaaucaauauaaaacaguaguugcauuucuauacacaaauaaugaccuggccaaaaaagaaaucaagaaaacaaucccauuuaugauagcaucaaaaaaauugcuuaggaauaaauuuagccaaaaagaugaaagaccuguacacugaaaacuaugaaucauugaugaaagaaauuaaacaagauacaaauaaauggaaagauaucccaugcucaugaaucugaauaauauuguuaaaaugucaauaauauccaaaucaauauacagauugaauaaaaucccuaucaaaaucccauggaaaauuuuuuuaaauucuaaaguucauuuggaauagcaagaaccuuaaguagccaacgaaauucugaaaauucuguucugaaaaacaaagggagacuucauacuuucugguuuauuuuacaaaacuauugaucaaacaguaugguccuggcauaaaaaacaaacauguagaccaguggaacagaauagagagcccagaaagaaauucaaagauauaugaucaaccaauuuuccacaagaacacgaagaaaacaaugcagaaagauagucucucucauaaaugacguuaggaaacccaguucuguggcuuguccaacccauggcccacagaccacauguaagcccaggauggcuuuaaugaggcccaacacaaauuuguaaacuuuguuaaaacauugaauuuuuuugcauuuuuuuagcccaucagcuguuguuauuguuaguguauuuuauguguggccuaagacaauuguucuuacaguguggccccgggaagccaaaagauuugauaucgcugccuuacaccauacauagaaauaaacucaaaauggauaaaagaccuaaacauaagaccaaaacccacaaccagaagaaaacauaggggaaaagcucgacauggcucuggcagugauuuuuuggagaucacaccaaaagcucaggcuacaaaaacaaauaauugguauaccaucaaacuaaaaaacuucugcacaggaacggaaacagucaacaaaaggaaaaggcaaccuauggacuagaagaaaauauuugccaaccauauaucuuauaagaggauaauauccaaaauuuauaaggaaugcauacaacucaauaacaagaaaauagauaacccaauuaaaaaaugggcaguggaacugaguagacauuuuugcaaagaaguuauaaaaauggcaaacacauauaugaaaagacauuuaacaucacuaaucgucagggaaaugcaaaucaaaauuacuaugcgauaucaccucacacucaugagaauagcuauuaaguguuggcuaggguuagggaacucuuguacaguguuggugggacuguagauuggugcagucauaaugaaaaacagaaugguggcuccuaaagaaauugaaaauauacuaucaucugacccacuaaucccucuucuagguauauucccaaagaaaaugaaaucuccaccucauaaagauaucugcgcuccuauauucauuguggcauuauaugcaugagucacgauaugaaaacuuacguguccauugauggaugacuaaacugugguguguaugucuacaauggaauauuauuccgcauuaaaaaaggagauccugccacuugccacauggaugaaacuggaagacauugugcuaaguuaaauaagccauauacaaaugaaaaguuuuaaauaaucucaccuauauguagaaucuuaaaaagaaaaaagucaaauauacagagauagaauaaacuagugguuaccaugggcaaggugugggggaagaaaauggaaagauguaggucaaaggauaccaaguagcagauauauaggaugaacaagucuagagaucucauguagaacaugagaauaguuaguauauugcauuuggaauuuuugccaauugaguagaucauagcuuuucucacucauacacacaaaagaauaacugugagaugauggacauauuaauuugcaucacuauguuaacgauuuaacuguauguuuuauacacuaaauaugcauauuuuuaaaauuaaaaaaaaaaaacacaacaagauaauguacagccagacagaagcccaauaagaaaagagaggacuugaacaauaccauaaaccaacuagaccuacaaacauauauggacacuccacccaacuacacauucuucucaagugcacauggaacauucccuaggagggaugauauguuaggccacaaaagagucucaauaaauuuuaaaauauagaaaucauacaaaauaucuucucuaacuacaauauagugaggccagaaaucuguaacagaagaaaaaccuaaaaauuaacaaauucagggaaauaaaacuacacacucuuuaaaaauuauugugucaaagaagacaucagaagggaaauuauaaaauacuuucaaaaagugaaaaugacgacacaacauacucagacuuaugggauguagugaaagaagugcucagaggaaaaauuauagcugugaaugcccacacugaaaaagaagaaggauccauaaccuaauauuauaccuuacguaaccagagaaagaagaacgaaguaaaccuaaaguuaaaagagagaaugaaauaauauguaugaguggagauaaaacugaauucgagcuuaaauaaacaacagagauaauuuaacaaaaccaaaaguugcuuguuuuugaaaagaucaaaguugaaaaccuuuaacuagaaugacuaauaaaaaauuagagaaguugcacauaucuaaaaucauaaacaaaaguaggaacacaacaaaaaaaaacaaaaauaagaaaaaaaaacaaaagugggaacgauauaacugaucuuacagaaauaaaaagugugauaaaagaauacuaugaauaacuguauaccaacaaauuauauaaccuagauaagauggacgaauucacaaaauacuaauacagaccaaaacagaaauugaaauuaugagcagacccauaacaaguagaaaguuugaaucaguaaccaaaaaccuuccaaugaagaaaaugcuacacagauggcgucacuguugaauuauaccaaacacuugaagaauucacaccaaucccucucaaacucuuccaaaaaacagaggagaaaaaacuuugcaauacauucuaugaggccaguauuacauggauuccaaagccagacaaauauaccacaagaaaagacaaacuagauacuaaaaucuuuuauuuaacaaaguacuaguaagccaaauucagcagcauauuaaaaaggauuauauaucaugaccacauggaauuuaucucaagaauacaagggugguucaguacaagaguaucaaucaauguaauacaccacauuaauacaaugaaggauaaaaaauccaugcaaucauuucaauucacucagaacaagcauuugacaaaauucuacaaccuuucaggauaaaaacauggaacuuucaaaauguguuaaagaggauuugugaaaaauccacaacuaauauacuuaaugagaaaaaaaacugaaaaauuucucccauaacaaagaguaagauauggcuguaugcuuuacccagugcuauugaacaauguacugaaaguuuuaaccaugacaauuaggcagauaaauaaacaaacagguaaaugaauagcauccaaauuggaaaggaagcaguaaaacucuuuauucaauaaugacaucuucuaucuagaaaaucaaagaauccacaaacuaguagagcuaauaaacaaguccagcaaaauugcaggguacauguucaacauuuauuuuaagaaaaucauuugugccucuauauaccaggaaugaacagcccaagaaggaagucaauuuuuaaaauuccacuuacaauagcaucaaaaagaguaaaauagcuaggaauaaauuaaaacaagaaggugaaagacuucugcacuaaagacuacaaaacacuguugacaaaaauuaaagaagacuuaaauaaauagaacuauacauccuguguucacagauuggaagauuaaauauuguuaaguuggcgauauuacccagugaucuacagauucaaugcaacccuuaucaaaaucccaagggccuuuuuauuugcagaaauguaaaaacugauuuuaaaauguaaauggaauuuucccagggccccaaacaaucuaaaaucauauugaaaaagaacaaaguuggaagacucaggccugccauuuucaaaacuuuuacaaagcugcaguaaucaaaacaaugugguacugacacaauguggucucuaggacacaaggauggacauauagaccaauggaauauaauagagaauguagaaauaaacacucacauauaugaucaauucauuuucaacaaauguaucaagaauucagugggaagaguagucuuuuaacaaauggugcuggggcaacuggauccucauauaucaaagaaugaaguuggacccauaacucauagcauauaaaaauuaucucaaaauguaucagagaccaaaaaauaagaguuaaaggcauaaauuucuuaguagaaaacaggaguaaaucuuuaugacuugagauuggaaauaaauucuuagaaaagacacaaaaaacacaauauuguaaauguacuaagugacacugaauuguacauuuugaaaugguuucuguuacuuaaaaaauuuaaagggugcacagaagacuaaaaagcagcacagacagaauuaucaccagaaaaagaagacucuauauuaaaugucaacauggagaacacaugucagaaauagguaguccagagcagcagcuauaguggaggcucuugcaaaugacuaagauuugagguggcacccucagagaaucaccucuuggggguagauucgauuuauggaguagauguaucucagagacaugguaggaaagccaaagaauggugagcauagcugccaucuagaaaccaccuacacaugcaagcauaagagauugguugaaagguuauagcacagucacacuaaggaauacuaugcaacuuuagcaaugcaaugagaaagaucucugugaauggauguugagugauuucuaggagauguuguuaggugagaaaagcaaaguucaaaagggcauauacagaauaguacuuuuuugggaaaugagaaaauaaucaugucuuauaaagagcaaacacacacaaacuauaaacuagaaaacacugaaacugguuaccuauaauggguagggggaauuaggauggaagagauaugggugagaggaagauuucucucaguagcuccuuuuguuuaguauugacuuuuggaaguauguuaauguuauauguauucaaaaaauaaaauuaacaagauagggaccacuucugaggugguggaaugagcaccuugauauaaccacucccugaaaagcaaugauaaaacuggacaaagaaauauaaaauugaaaagugcuaauuaaagaaaaaauauuaagccuuccuaagaauagcaggguuaugauuuaacguggggcugccaucuccccacccaagcucaggggcacgguaggcuugaggaccagcaacaaagaaggcucaucugauuuugaauuccauagaaaacccuaugcacuauguuaagcaacaaggauuucaguggcaaauaauuggaggcaacccacaucacagcaaccuaauguuucaauacugguugggcaagcgacagauuaagaaaaauuuuaaaaggaauucuggagauauggaaguuguacaugcuugcaggagagaucagagagguuuccugcuaucuacuuauccuuggcugacugugagaccuuuugcaagcagacaguaaaauacaggacagaguuauaaagugccugaacuuugaaugucccaacccacacauagauccccucagcagaggguggaagauucacuggcucaagauguuuaaacaaaugucugacuaaucauggcuugaccacuagguuaugcugauccaggggugacaccaaugaagccaggcuuacaaaacaaacauaagaauuaaaacaaacaaaacugagcaaagacaccaguggcugcacacugcaggagaacacagacucugcagaauccaugcagagaaggcauacacaagcgagcaaacaaauaaaugaguaacagaaaucaucccugguuagggagaagaacuagaauccagaguuucuacgauauauuaucuaaaguaaguuuuuaacaaaaaaaaugagauaugcaaagaaacagaaaauugugacccuugaacaagaauaaugagcaauaaauaggaauuaucucugaagggccccaaauguuagggcgcgauuucaaaguaaguauuauaacuauguucaaagaaccaaaagaaaccacauuaaagaaugcaagugugaugacaaagacucaucaaauagauaauaucaauauagagauagaaauuagaaaccaaauagaaauucuguaguugugaaauauaauaacuuaggugaaaaacucacuagugcggcuaagcaaauuugaccuggcagaagaaagaaucaaugaacuucaacgcagauccauaaagaugauucagacugaagaauagaaagaaaaauaaugaagaaaaaugaagagauacccauuggauaccauaauauagugguccccaaccuuuuuggcaugagggaccaguuuuguggaagacaauuuuuccacagccaguugggggaggcuuuaguuagauucucauacggagugcacaaccuagaucccucacaugcucaguucacaauaggauuugcucucugugagaaucuaaugccaucacugaucagacaggaggcagagcucaggcaguaaugcuugcuugccugcugcucaccuccugcuguguagcccaguuucuaauaggccacagacugguaccaguccauggcccugggguugggaaccccuguccuaacaggauguguaacaauguauguguaauuaaguuguaacauauauguaauuaagaguagaaaacauauguggaauuaaggaguaacaacauauguguuaauaagaguacugagaaggagagaauagggcagacaaaaauauuugaguagauuauuaaccugaagcagauuguuuuugcuuaagcugcuuauuguaaccuccagauuacacuuuaaaaaugggggaaauaaacuaacaaaggaauuagaaugguacucuagaacauaucuauucaaccugcagaaggcaguaaaggaggaagagaggaacaaaagugauaugagacauauagaaaauaaauaacaacaugguagauauaaauccuuccauaucaauaauuauauuacauauaagugaauuaaaaacucaauaaagagcagagauugccagacugccuuaaaagcaggauccaaauauauauggucuauaagagucacauucuagauucaaagacauaguugaaaguaaaaugauggaaaaagaugacaugcaaacaguaauaagaaagcuagagugacuguacuaaaaucagacaaaauuggcugggugcaguggcucacaccuguaaucccagcauuuugggaggcugaggcagacagaucacucgaggucaggaguucaagaccagccuggucaacauggugaaacucugucucuacuaaaaauuagcuggguaugguggcaaaugccuguagucccagcuacuugggaugcugaggcaagagaacggcuugaauccgggaggcagagguugcagugagccaaggucacgccacugcacuccagccugggcaacagagugagacuccaucccaaaaauaaaauaaaaauaaauaaaaucagacaaaauagacuuuaaaaacaaaccauguuauuagagauacugagaagcauuuuacaaugacaaaagggaaaauuuaacaggaagaaauagaaaucauaaacagaagucauaaagaaauaaaaauuuauaacagcuaaaaacacagcccugaaguauaugaaauaaaacugucagaaaugaagagagaaacagacaacugaacaauaauagacaacucaacaauaauaguacuaacucuuguugauuuucugucuuguuguucuaucaauuauucagagugaguuauugaacuauuacccaacuacuauucuuggaugaaauggugggaggugaggcuauguggcacucugcuuaauacccuccccuguucuggugucagggagacaaauguggagcugacuuuucgucagaaacagugguacccagaaaguagugggguaacagaucccaagugcucaaaguaaaaaaaaaaaaaaaaaaaaaaaaaaaaagccaaccaagaauacuguguccagaaaaguuucuuucaaaaagaaggcaaaauaaaagcauucccagauaaacaaaaacagaauuccuuguuagcagaccaguuuuguaagaacuacuagaggaaguucuucaggcaaaaaggaagugcucccaggaaguucacauauauccaaaagcaaagagcaaggagguaaauaggagcaaagcuguucuagaguaaggaaauaccaccaguugguaacucaaauccauaaaaaccaaaaaaguggaucaaauauaugauauaaggagguuaauaaaacagaaacuagaaauauauacuugcucuccuuucagcuucuuuaaagauauaucauuauauaguaugaucauuauaauagcgcauaauaaagauguaauauauguaacaauaccacaaaaagugguaaaacugaauaaacucauacaggaauaacuucuguaucucaccaggauuaauauaaauaugaaguaaauuuugagacgauacauaagguaagcccuagagcaaacacuaauaacaaauagaauauugaagaaucauaaaagaaaugaaaauuuauauuagaaaguagucacuagauggaaaagaaagcagcaaaggagaaauagaggaacaagaaauaguacauagaaaagaccaaaaguaaaacuguggauauaaaucuaauuauaucaauaauaauauuaaaugugaauggauuaaacaaucuaaucaaaggcaggaauuaucagaccagauuugaaaaacaggauccaucuguauuccaucuauaugaggcacacuuuagaugauaaaugccaacugaaaguaaaaggauggaaaaagauauaucauguaagcagcaaccauaaguaaccugaagugcuauaauaaagucaaaggagauuuuaaauuaagaauguuacugaaguuaaauaugaauaucucauaaugauaaaaugucaauucaugagaagauacaaugauuauaaacauauauucaccuaacaauagagaacuaaaacauaagaagcaaaaacugacagaacugaacagagaaauagccaauucaacaauaguaguuggagacuucaacacuccacuuucaauaauguguaguacaagaaagaagaucaauaaggaaacagaagauaugagcaacaccauaaaccaacuagacucaaaagguaauuauagagcacuucgcccaacaaccaacauugaauauacaguauuuucaagugcacaugagacauucuccaagaaggaccauaugcuaagucacgaaacaaaccugcauaaauuuaaaaggauugaaauaauacaagguaucuuuuucugaauauaaugaaauaaaaguagaacucaguagcaaagaaauuagggaaacauacacauguggaaauuaaacaacacuacauucuuaaauaaucaaugggugaaagaauucacaagggaaauggaacguacuuugagauuaaugaaaaugaagauacaacauaacagaacuuaugggauacauuuaaagcaguguaaagauggaauuuuauagcuaugaaugccuauaucaaaaaauaaggcuucaaaucaguaagccaacucuccaccucaagaaacuagaaaaagaagagcaaacuaaaccuaaagcaaguagaaaaaacaaaauaauaaauauuagaguagaaauaaaauauagaauauaaaaauaauaaagucaacaaauccaaaauuugguucuuugaaauuaacaaaccuuugauagauugguaagagagagggagagggagaagaaaagaaggggaggaagaaagagggggaggaggaaagacagagagggaagugcaugaggcaaagggggagagagaaaacucaaauuacuaaaaucagaaaugaaugacaguuuuacaaauuaaagcaaaaaaacgaggcuagcugcaguggcucacaccuguaaucccagcacuuugggaggccaaggcaggagaauugcuuguggccaggaguucgagaauugcuuguggccaggaguucaagaauagcaugcacaacaaagcaagacccuaucucuacaaaauauuuuuugaauaacagcugguguuguggugcacaccugucauaggcuaaggggcaaggaucacuugagacuaggagaucgagguuacagugagcuaugauuacaccacucuauuccagccugggcaacagagagagacucuguuucucaaaaagaaaaggaaaaaggaaugaaugagggaaguauacuaccaaccugacagaaauaaaaaggauuaugaaggaacacuaugaacaauuuugugccaauaaauuauaaaacuuagaugaaauugacaaauuccuagaaagaugaaaacuaugaaaacugacuaagaaauaaguagaaaaugugaauggaucuguaauaaguuaaagagauugaauuaguuaugagaacacuaguugaaaagaaaagcccaagagggccagaugagugaaucuaacaaauaucuaaagaauaucaauucuuuaugaccucuuccaacaacaaaaaaauagaagagaaggaaaauuuuuccaauacauucuuucaguccaguaucacccugacaccaaaaccagacaaaaacaugaaaagagaacuuauaaaauuuauuuuacccauuuuagguauauaguucuguggcauuagguaaauccacgcuauugugcuuuaugcuuucuugauguuguaaauagaauuguuuucuuauuuucagauuguuuuugacaguguauaggaauacuauugauuuuuguauuucauuacaauaacugugaugaaaaugauguaaaacccucaaaacccucaacaaaauacuagcaaguaaaaucaagcaauguuuaaaaaggauuauacauuauaaccaaaugggacuuauuucaggaaugcaagguugaauuaacaucugaaaaucaauuaauguaauacaccauuaucaacagaauaaaagacaaaacaccacgauuucugucagucuguucagacuguuauaacaaaguaucacgaacugguggcuuauaaacacagaaauuuauuuuuugcaauuuuacaggcuuggaaguccaaggucaaggcacuggcagauucagcaucuggagaggacucgcuuucugguucaugaacaguugucuucuuguguccucauaugacggaagaaaaaaaggagcucacugaggucucuuuuacaagggcacuaauccauuccaugaggucuccacccucaugaccuaaccacuucccaaaggccucaccuccuaauaccaacauuggggguuaggauuucaacauauacauuuugaggaaacacacacauucagucuauagcaauuaaugauagaauaaaagacacagaaaagcauuugggugauaaaauucaacacccuuccaugaugggagaaaaagcccuacucaauauacuaggaauagaaaggaacauccucaaccugauaaagggcaucuauuaaaaaucacaguuggccgggugcagugguucacaccuguaaucccagcacuuugggaggccgaggcggguggaucacgaggucaggagaucgagaccauacuggcuaauauggugaaaccccgucuuuacuaaaaauacaaaaaaauuagccaggcauggcagcaugcgccuguagucccagcuacucgggaggcugaggcagaagaauggcgugaaccugggagguggagcuugcagugagccgugaucacaccacugcauuccagccugggugacagagcgagacucugucucaaaaaaaaaaaaaaaaaaaaaaaaaaaaucacagauaauaucauacuuaacagugaaugacugaauguuuccccguuaagaucaggaaugagacaaagagaucugcucuuuccacuucuauucaacauuuauugaguguuccauccaggauaauuugggaagaaaaagaauccagacugaaagaaagaaguagaacuauuuggagaugacauaaauuugugcugguccaguuuuguguuacuauaaaggaacacccgaggcuggguaauuuauaaagaagauuuuaauuggcucacaguucuucaggcuauacaggaaauauggcaccagcaccugcuccuggugagggccucaagaagcuuacaaucauggcgaaaggcagaggggcaggcauaucacauggcaagagcaggagcaagguggagggagguagcagauucuuuaaacaaccagcucuuagcauaaacuaccagaguaagaauucgcucauuaccacggggaugguaccaagccauucacgagggcuccguccaugauccagacaccccccaccagaccccaccuccaacauugggaaucauuuuaaugagauuuggagggaccaaacauccaaaccguaucaauguuguauacagaaaaccccaaggaauccauugugaaacaauuacaacgaaugaguucaguaaggcugcaggagacaaaaucaguauauaaaaaucaauuguauuucuacacacugucaaaaaacaaucugaaaauauaauuaagaaaacaauuccauguauaacaucaaaaaagaauaaagcacaacagugcgaauuuaccuaaugccacauaacuauauacuuaaaaugaguaaaauaguagauuuuauguauauuuuuaccauaauaaagaaaaaauaaaauaccuugggaauaaguuuaacaaguacaaaacuuauccucugaaaauuacaaaacauuguugaaagaaaagaagauacaaauaaauggacagacauuacaugcucauagacuggaagacuuaauauuguuaagauggcaacacucccggaaucgugcugaucuacaaacucaacacaauccuuaccagaaucucagcugguuucuuuguagaauaauaagcugauguucaacuucauaugaaaaugcaaaggacccagaauagcaacaauuuugaaaaagaaaaguuggaggcuucauacuuccugaucuccaaauugacuacaaaguaacaguauucgagaaaaugugauacuggcaugagauagauauguagaucaagggaauagaaucagaguguaaaaacggagccauauaucuauggucaauugauuuuugacaaggaugccaagaauguucaaugcggaaagaauagucuuuugaacaaauaguguugaaacaacugauauccacaugagaaaaaucaauugguccacuccacaucauauauaaaaauuaacucaaaguggaucaaagacauaaauacguaacagauaaagcuauaaaauucuuaggguaaacauaaggguaaaucuuuaugaccuuggauuuggcagagguuucuuagauauaacaccaaagaacaaggaacaaaagaaaaaaaguagauauauuggacuucauaaaaauuaaaagcuuuugugcuucaaaagacaccuuaaagaaagugaaaagacaaccuacagaugggagaaaauauuugcaaauaaucuaucugauaggggacuuguuacuggauauauaaauaacuccuucaacucaaaaacaaaaagacaaauaucccaacuuaaagaauggaugaaaaaucggaauagaaauuucuucaggguugacauauaguuaauaaacacaugaaaagaugcucaacgugaguagucacagggaaaugcaaaucacacccaaaaggagauacugcuuaacaaccacuaagauggcuauaauugaaaaaagauaauagcaaguguuggugaggauauggagaacuugcgcagugcucauaugcugguggugagaauguaaaaugaggcacccacuuuggaaauaauuggucaguucuucaaaaagauaguuaucggccaggugcuguggcucacaccuguaaucccagcacuuugggaggccaaggcggguggaucacgaggucaggagaucgagaccaucucggccaacaugguaaaacccugucucuacuaaaauacaaaaaauuagcugggcaugguggcaugugccuguaaucccagcuacuugggaggcugaggcagaggaaucgcuugaaccugggagguagagguugcagugagcucagaucgcgccacugcacuccagccuggcgacagagcaagacuucaucucaaaaaaaagauagugaucauuugacucagcuuuccacucccauguguuuucauaucucuuucuuuucuuccuuucuuuuuguuuuuuugaaacagucuugcucuguugccuaagcuggagugcaguggcacagucucggcucacugcaaccucuuccucccggguucaagcaauucucuugccucagccucccgaguagcuggaauuacaggcaccugccaccaugcccagcuaauuuuuguauuuuuaguagagaugggguuucaccauguuggccaggcuggucucgaacuccugaccucaggugauccaccugccuuggccucccaaacuguugggauuacaggugugagccaccaacacacccagccuuucauaucucuuucaugcccaggagauaugaaaacacauguccacacaaaaacccacauguucuagaagcauuauucauaguagucaaaauguggaaacaaucuaaaaugcuuaucaacaaauaaauggauaaacaaaauguuuauucauuguauaucauacgauggaagauuauucauucauaaaagaaugaagcacaagggccgggugcaguggcucacgccuguggucccagcagguuaggaggccgaggugggcggaucaccugaggucaggaguucgagaccagccuggcuaacauggcgaaaccccgucacuacuaaaaauacaaaaauuagccgggcuugguggugcgugcccguaaucccaccuacuugggaggcugaggcgggugaauugcuugaacccgggaggcggagguugcagugagccgacaucgcgccacugcacuccagccugggcgacagagggagacucugucucggggaaaaaaaaagaagcacugaagcacaaaccuugaaaacaugaugcuaagugaaaguaaccagucacaaaggaccauacauuguaugauuccacuuauauaaaauguccagaauaggcaaacccauagagagaaagauuaguuauugccuagggcugagggggauggaauaguggguuugggggugauauuuaaaaggcacuggguuucuuuuuggaaugauaaaaauguucucaaacuggaguggcaguugcacagcucuggggauacacaggcacacuucacuuuuuugcacuuuguggauauuguguuuuuaaaaaauuaaaugugugugguaagccugcacugagcaagucuaucagugccauuuuuccaacaacaugugcucacuucauucugggucagcauuuuuuagcaauaaagugucuuucaauuaagguaggcacauuguuuucuuagacauggggcuauugcacacuuaauagacuacaauauaaacauaacuuuuauaugcaguggcaaaccaaaaaauuugugugacuugcuuuauugcaauauuugcuucauugcaguguacuggaaccgaaccacaauaucucugagguaugccuauacuaaaaaccauucaauuauauucuuuaaaugggugaauuguaugguauguaaacuauaucuccacaaggcuguuagaaaaaagcuauagcagaagauauuugggguccagggccaaagacuucuuagaccugacaucagaaguguaauccauaaaaaggaaacauugaaucucaucaaaauuuaaaauguuugcucuguaaaguacccuguugagaugaugacaaugaaagcuacaaugaauaaauauuugcacccuguuucugacuuaagauaaguaucuagaauauauaaacaucucccaaaacucgacaguuaacaaaaagucuaauugggaaauggaaaaaugauaucaacaagaauuucacugcauagaauacaaaaauggcaaacaggcacaugaaaagauguucaguaucauccuaaugaggaaauguaaauguaaaccacaaugagaucucacuacacaccuaucugaauggagaaaauuaaaaacagugugaacaucaaaugccagcaagaaugcagagaaacuagaucacuuagaccuugcuggcaggaauggggaaugugaaauggugcagucacucuggaaaaucaguuugguaguuucuuauaaaacuaaacaugcaacugccacacaacucagcaauuacaagcuugggcuuuuaucccaaagaaauaaaaacuuauguucacacaagaaccuuacaagaauauucaugucauccuuaucaauguauaagguucccauggcugcuguaauacauuuccacaaacuuaguggcuuaaaacaagacacgcuuuuuuuuuuuuucucacaguucuagaggccagaagucugaaaagagucuuaggggacgaaaaaucaaggugucagcagggcugguuccuucuggaggcuucaggggagcaucccuucccuuuccuugccuuuucuucuggaagcguucuuugguuugugaccccuuccucaaaucacauugccauuuccugccccugcuuccguggccacguaacccuuuuucucuucuguagucauucuucugccucccuguuauaaggacccuugugauuacaccgggcccauucagauaacccaggaugaucucuccaucucaagguccuuaauuugacacaucugcagagugcccuuugccauagaaggcgauagucacagguucuaggcguuaggaccuggcuacuuugggggccauuguucagccuacucugauuuguaauagcccaaacugggaaugacccacauguccuuggaugagggaaugguuaaauaaacugggguauauguccauaccgugaaacuccacucagcacuaugauuuaaugaacugucgcgauacaaaacaaccggaaugaauccagagaaugaugccgagccaaaagaccccguuucuaagauaucguguauugugugauuccauuuacguggcauuuuugaaaagacaaaacuagagaaucagagaacagaugaguggucaccagggauuggagggaugggaugggagaaaguccguguaaaaggacaaauaaugggaaccccguggcgacgggagcacucugcaucuggacucuugcuguugacauccugguuaucauauugugcuaugguuuuagaagaugcuaccacugacggaaacuaacuaaagggugcaugggaucccuauuauuucuuaccacugcauaugaaugucuaaaaauaaaaagcuugaaagucucauuuuuuuaaacgggcaaaagaucugaauaaauauuucacuaaagaagauacacaauugggcacuaggcacguggaaaaaugcucagcaucauuaggaaaaugcaaaucaaaaccacaaugagguaaccauuccaacuggacaguauuuuuuuuucuuucuguacuuucguggaaggggugcuagaguuggaaaaugaucauuuuugcaacuaccacaguaaagccugguuuccaaaagcauuuaaaucuggagagacuuuuuuuuuuuuuuuaacaaguagcaggguauaugcauggccuuaaagaaucucccccgauuguuuauugguugcaaggcaaaauauaguaacuguaagguagaaaaguggauaacggccucaauuuggugaucaaaauaacaucguuaauaaggggcagauacacugugugccucaggaugugauacacugagaaggacaucaggucacuuacagaguacacaacguggaucuaaccugaggaaacaucagacucccccaagaaguggcaggacuguaucuuuaaaaaauaucagugucauaacagagaaagagacuagaaauguuccagauuaaacaagacugaagagacacaucuaaaggcaguacugacccugaacuggaucuugcaguggaggaaaaaaugccacaaaggacauugucauggcaacugacaaaaugggaacauaggcauuaaauuagguccaaguauuauauugauguuuaauugcagaagucaauaacuguauuacugcuuucaaagauaauaucuuuauuuuucagaaauacacagcaaaauguuuaggggcaaagagcuguggaguaugcaacucacagauguuucagaaaaacauguuaugugaauauaauguagagaaagggguucaaaugauaaagcaaauguggcaaaauguaacaauuaguaaacugguaaaucuuagugaaggguauguagguguuuuuauaucucgugcuuguaauuuuucuguaguucaaaauuauggccaaauaaacaguuuguuuuguuuuaagaaacaauccugagggacugcuuuagcucagcaggucacaacugggggcaauuuugcccuccaggggacauguagcaacauguggagauguuuuugguggucauaacugaggccggagaugcugcuaaacauccugcaauagacaggacuuccucccucaacaaagaauuauccggcacuagauuucaauagagguacaguggagaaacucugccccacuuggcugacaauaagucacucugccaggacuggugggcaggaaugccggccgggaaagaggaacccugccuguggaauucaaggucagacaaaacgagaaaaacaaccuggcuacaucacugaaauuaacaagccuauuccugugucacgggcugaauugugucccacaagguuugcaguugaagcccuggucuuuaauaccucggcacgugacucagcauguuuggagacaggaccuuuaaagaggugaugaagcuacaaugaggcuguuagggugggcccuaauccagugugacuggugcccuuaaagaaaaggauauuuggacacacagagaaacaccagggugcaagugcccagagcaauggucaugugaugacacaggaagaaggcggccaucugcaaggcaaggaaagaggccucagggaaagcagccuugcugacaccuugaucucagacuucuauccuccagaauugugagaaauacaugucugcugucuaagccacccagccugugguauuuuguuauggcaguccuagcaaacuaauacauccuggaaaguuaacacauagaaauaaaaguucuguacauagaaacagguucaagaaccuauguucuugaacaaaaugaauuuuaagcgauagagaacaucacagaguauguacaccaaaggaaauuaagcagagauuauaaauuuuagaauagaauugaaauagaaauaaaauucaauuagagauagaauuaaaucaaaauaaaauuguuucagcagccuuagaggcauuuuuacuauuuuacugauugagaaaaacaagaugcagaaagcagguaugauaugaucccgugaguuuggaaaacaaugauaaugccuucauuaugucacauguauuuuauuucauugaauauuauaugaacaucaggaaaaauguaagacaacaaauccuagauuaucaacauagguaacagagaggaggggagcccaagcaaacauaagaaaaaaguucuguacugaaacacaucuauuccauucuacucaucuguaaaguuaaagugugaauauuggaaaguaauacaacauuaaggacacuaaaagaaagaauagccccuauucagaucugguauugauagagccugaggccaauuuggcagcagacagagacacaagacuguuugcugcauauggguccugggugagcacuuacauguucuaacucacucagucaacacaggaguccugggagcaggcaguuaggauccugauuucacagauguggaaacugaggcacagagaaugcaguagcuugcuuagggccacauaagaaaauggcagagcugggcuaugacccuaaagaagguuggccauauaggcugugcuccaaaccacuccaugaaaccugccacucaauuuuuagaaacauaauuguacaggaagauuuaauuuuccugucucagaauuuggcagauguauuaggguuuuuuuuuuuuaacuaagggcagagcagaccuaaaugaggcaaugaauaaguauguauacacaauccaucucaauguacauuuugucuguccauguauacaaauaaaacuuuguguuauacaaauacagaagauauuuucugaggucuguggagcauuuacaaaaauaaugauguuauuuucauacuuggagacaaagaaaaucuucauuuuaaaaaaaguggagacuucauaggcuacauccuuucacuguaagccuacuaaauuagaaauaaauaacagugauaaaaauuuacugcuuaaaaauuaagaagacauuaaaagaacucuaaagagaaaaaucaaaacacaaaauuaaaacuaucaagaaagcaaugaaaaggaacauauuucauaaucagaucuacgugucacagcuaaagcugcaaucagaggaaaauuuauagccuuuaaaaaugccuuuaguagaagaacuucaaauaaaugaacuaugacucuuaaguaaaagaaaacaaaaauagaguuagccaagaaaagggaauuaauagcuauaaaagcuuagauuaaugaaauagauaacaaagaguacaaagauaguuuucugauaauaaaauauaaauaaaacauaaauuucucaugugcuugauuaagaaaaaaggagaaaaaccacaaaaguucaggcauaaaggaaaagaaaaacgaagagaugauagagaagaccauaaaaucacuaaaggaaaaaaucaguugcuaccaaguggcaacacaauugaaaugcuugaggaaauuaaauagcaaugaauaaauuacuccaaaagaugcaauaaacuaauuuagaacaacauaucauaaaacagacuaaaaagaaauuacuaaagauauccuauaaaacauguaucaggcccagaugguuuuacaacucaauucuauuuaaccucuacagaaaagauaaucccaauguucuucaaacaguuccaagacacagaacaaggaagguagauaaaacuuuguuuuguaaaccauuguauuugcccccacaugauggcagauuucauacucuucugaaagauguacuguuauuucuaggaucagauaucagggauguccugcaucagugaugagagugaagcuucacaguuuugauggcuguuuaacggagauaugauacuugaagcagaccuccacugauggguaugucggugguuugcaauuuuuugcuauuuaacaauugcagaaaucaauauccugaugauggauuauuuugcaaauguguaagauauguguagaauaaauuucuagaaugauucaaaggcauaugcaucuuuaauuuugauugaaauugccuuauuuaucuccacagagguuuguaucaauuuauuuuucuaacaucaaugacugagacugagaguuuccauguacacauacccauagaguguuaucaaacucuuugauauuuaauaaucagauaaguuucaaaaaccccauugcuuuaguuugcauuucucuugucauaauugaagucauccagcauauuuucauucuuaagaauuauugguauuuccuuuucugugaacuguuuuaauauccuuuaacuucuaucuugauuuacaagagcguuuuuauauagcaauuaaauuagccccaugccuauaggugaguggcaacugguuucuuuagguuaucaauaaaaaauuauuuucaguauguuuuuuugcuaugcaaaauauauauuauauauuuacauuauauauuauaaacaguuuuauugagauauaauugacauaacuugcuuauguuuaaagugugcaauuugguaacuuuugacacaugaugaaaccaucgccaugauuaugauaaugaacauauccacugccccaaaaguuuuuuugugcccuuuuguccuuuucccuccuacuacuaccccugauccccagguaaccacugauaaccacugacuuguuugucacucuauauuaguggucauuuucuagauuuuuacauaaauaagauaccauguacucuuuuuuuuuuugucuggcuucuuucacucaccauaauuauguugcaauguauccauauuguaggcauaucagugguucauuccuuuguauuucuaaguaguauuccauuuuaggaauauacuacaacuuugaaaaaaaucuauucaaauguugauggguauuuggguugcuuccaguuugggguuuccaguuuuuauaaagcugcuaugaauauuccauguacaaaugguggcaugcauaugaucuuauuucuccuggauaaauaccuaggaauagaaucgcuguagaauaugguagguauguauuuaacacaucaagaaacugcugaacuguuucccaaaugguugcaucgcuuuggacuuugcauucucaccgggagcauaugagaguuccaccuccgacacaucuuuaccaacacuugguaucauccaucucccucauuuuauauaauauaauaauugggccgugguauuucauuguguuuuuuauuugcauuucucuaauaacuaaugauauuucagccacaucuucaggcuccacuucuaauucuaguucucuugcaguuuucacaacaucaguaguuacuuccuccacugaaaucuucaaccccucagucauccaugaggguuggaaucaacuuuuucccaauuccuguuaaugcugauauuuugacguucuuccaugaaucacuaauguucuuaauuucaucuagaauggugauuauuuucuaaaauguuuucaauuuacuuugcccagauucaucaaagcaaucgcuaucuauggccgcuauagccuuauaaaauguauuucuuaaauaauaagacuucaaaguuggcauuacuccuugauuaugggcugcagaauggauguuguguuagcagccauaagaacaacacuaaucuuguacaucuccaucagaggucuuggaugaccaggugcacugucaaugagcaguaacauuuugagagggaucuuuuugucugagcaauaggucucgaaaaugggcucaacauauucaguaaaccauguugucaacagauguacugucaucgggcuuuguugcuucauuauagagcauaagcagaguagauuuagcauaauucuuaagggcccuaggauuguugaaaugguacgugaguacuggcuucaacuugagcaagguugccacaaaccuucaauuuguaaaaaaugcauuaucagcaaagugcagucaauaagaaugagacacgccuguauuuuaaaaaucucaauuucugguuauuugcugcaagaauauaugaauggaauugauuuuugcauauuaaucuuguaucugccaccuuacuaaacucauauauuagucauaguggucaucuugcauguucaucagauuuucuacauagauaaccaugucuucugcaaauaaagacaguuuuauuuuauaaaauaaaacucucuucucaauauauguuacuuagacuugcucucacaggagauugggguuucuguuuacacugcauagguugucuagaagaucccauaucuaaaacauggaucaugaagguccuggauugguucacugggucacccuguacaagcaaaagugcagcuucuccagaggcauguaccuuauacaggauacauaggaaccccacaaacaaaaacauccaccacacaaacucaugaucuaaauugcaaacccacaaugaaaugagccaucaugagcaagagucagaaaaaacuacagugaacagaauuagacucuccaagaacugcagaugaugaaaugacaggauagaggguacaaaauaugcauguucaaaugaccuaaagauuaaaaguuguaguuuaaaauaugagaaagguacaagaugcuaaaaucaagcaaauuaaacccccauacaaggauuuauagggaaggaaaaaauauauaacugaaagucucaguggguagauaaagcaguggaacagaaacaucucaagaguuagaaacugcauagaaaauucugugaaugaagcagagggagacagagauagaaaaucuaugagacagcugaggaagacaaugagauggucaaauagaaguuucuggaaaagaucagaagcauuaggggaggcaauauucuacaacauaaugguacugacuuuccacgguugaugaaagacauaaacccucagauucaggaaucacaacaaaguguaggcaugauaaauaaaaauaaugcaccaccuugguacaguacauugaaaccucugaacacuaaagucaaaaggaagguuucugaagucacuagagguagggagggucacuuacaaaggaaaaucaauuagccugaugacccacagaagccaggagacugcaguguuacagcuccagagucuucagacaaaauguacauauuaaccuguuacuuucucccaacgaaaccaucauccaagaauaaaggcaaaguaaaaauauuucagacaaacugaaacugagaguuuaccuucacugaaagaaacacagacuucaggaaaaaggaaauuaaauccaaauggugagacagaaaacugcaagucugugaguaaauaucucaauguaugcagcaucaacaaaaagaggauuguuuaaaagacaaaaccaaaauacugggcaacaaaggcccaggaaacggcaggaggcaguaggaucuggagcaccuugaggucccagugagguuucagaggaguuggggugacuuuugaucucaacuggcaaagcauucaggauuuaauccuguggcagccaccaaaagugcacaaucagaacacacggcuuugaauggaggagugcaugaaaggccaggcuugguguguugggcugaggacgcggagccgggagcaggaggaggcuacagccugacccugugagaaccaggcucacaagugcagaagugagaggugaggcuguuccaugacgcaugccuccagaaagcacacacacgagugugaacgaugaguccccagaccacacuggggaccucuggguaugugaugcaugcuccuccagcacgcugccccacuucacaaacgggaaaccacacaauagucccaggucaccuggcaaacacguggugacacacacaggcacagcuuugaagacgccuccccagaagcccuucagaaucaccuccaggccagguggaaaggugcgugcugcccgauccuacgucacagaccacgaccuuacagcccaguguucucugagcagcaaaaggccucugagguggccuccccgauccuacgucacagaccacgaccuuccagcccaguguucucugagcagcaaaaggccucugaggcggccuccaggaccagugaauuuggggaagucuccucuggccuccuaggggcauucaggaggccaccuccggccagcccuacucugacaaccugccuccagucccuuugucaagacaaaacccugguggcacagcccugcauuuuuaucguguacccaccauggguuaggcaugguaccagcuugggaagggucaguggugaaagacaaagggccacuccccuaugaggaggggacuggacaaccuggucaauggugaccuggcuguggagacaacuggaguggaggaggggcaggguaggcagcucaggauggaggcggcuccuucaggacuccugggauccaggaaagacaguuccaggcagagugaauacaguggcucugaggcagggacagcgaggcagcauggccaguaugcggcuccagcccaggccucuucugaccugcagauguggauggccaugcccgcuuggacccucugggcaggaggcugccugugugucugcccccaccccacaagcauacagaggaucuucaggacgcccaaggcagcagcagccgggcugugagugucaggcuccccaggcugggcacagacaauggccaccgcauccucgcagguccccagucccuuugacacugccaagccaaguggcaugcgguuggguccccaugcauccuucaugaggagucugugacgcuucacugcaaagacucuagggcuaggcuggccagccccugcugugcucuggcucucgggcuggguggcugcugacauuccccucccuccccacccaggucagaagguugagggagcagcagcgggcccugcugcgugggaugagggcuggugccuccccucagugaggcugcucuacagggaccacacagcccauuuuugcugcagguuagucuguguucugaugcuaccaugggggaccuucuaccuucccagccucccuccccugaggucugccacugccauaccugccugugccucucgacaggcucagugaggugucaggacacacagguguccucaggaguuccccacauggcccuggccuuccguuucuccaucuauaaauggggccaacaccgcacagcaccagcuagagcacgagcugaaggggcuugugugcagguggauggcgcagacagguagcagcccugaggcagggucaaggggacuucugccuaaccugcagguucacacaacagaaagcacagccagacaaggucgaggccuggguuugacuuugcgggggacucaguguggcuguucguacccgccuugcgggaguggggcuguggggcuuccccaggaguggcaucugcccugggaucagcaucuccuucuccccaagccagggcucuccaagagccuccugggcaaaggggacuccggauuaucaggggucgcucugucccugggggccaggccaacagcucaggcuccagaaagcuggugguuccagccugggcugacuuaucaaguuaggaaagaacaaacuccagcaggaaagagaaaucuucuccguggaggagcauuccacaaaaggcgccugacuuucuccgcacuugccccucauuaacauuccgcagacagcacuaaugacuucauaacacuaaccaggcugaauggacggcaucgauucgggcugccccgcauucagcaagcagcaagcgaugcuucuccaggccgcacacaggcuggguccccagcccccggccacgcccaccugcccguuagcaugcgcagaaagcccccauuugcauggagacaauggucucagcccugaauccggagcugugggggcacugggcauugguuggcacaaucgcccuuugugccggcuccagcgggcaggcgggagcacgucccgggggcucacugagauguggucgggucccagcccaauccugauggcaucuaaguccuggggagccuggugcccaguggagcgggagccuggacuuggucuugccugcugacuuccacaugggaugcccaggaaagccccaaggggcagggaacaccacccagccuccugccaaggagguggggaugcaggugagccauccugaaugaacuggagcuuggcgggcugggcuggugccugcgagcacaaaggguugcgaacacuguggguuuguccccucucugccaugcauaagaugugacagcauccuuacaacugcugguaagcugagacauucggguuagucccaggcacugggaagagguccgagagggagagauggaugcagaaaugaccaaaggguaaagggacggcugcugagaagggaauggaucauauuacuuggauggcugagcacauacacagcaggugaccuguggugaugccagggcaucagcgcuuggccucccacaccuccucugccaggcauagaacccuggccacuuggcacaacugaggcagggccuggcuuccaacagcccagaguccggaacagugggguccagccuccaagggacugggccacauggagcccucccauggggcauggaaggcagagaguggggagcaggcccuccaggguggggucaagccuccuuagagggacaugccuuggaaucauggaagaagggggcugagacuucaaggagcagaaaccgggucagcagagacaaaguaagcaggaaccaaugcaaggcccacgugcgugaugucugucuggacaacagcaaguggucaaaggggagugggcuucaaaugcugugcuccccccaccaccuggaagaugagggcucucccaugcugggagggcaaggccacuguuucauguggggccuaaacuagugcuuucuggcaccaugauaaccaaguguuuucaaaacaggugcccuuuuccuccaagggggaccacgcccugggacgggggcuucugcgaacauuugccagggccucugcauuggugcugcagugcagcaucgggcaagugccaucuuuguaucagaacacagucacuacuaugucugccucagaggaagcagcgagcagggccacagauggcaccuuugcacgagguacuagggagcaaacaggcuuugcuguguuuucuccugggaagacaaggugcacgccccuguccugguggcagcacagcuaucucaaauaccccacgcugggcucagaggacagaaaaagccagaauccuucacauuugguuuuaagagagcugcuagagaauuuggcaguuugggaucacaguccccagaagugggcacugaagucacaugcaagagaaguuggagcucccagggagaaguggggucccuuccaccucuccuaacucucaagggcauccguggcauccguggccagugggcaggaggucuccagccccucacacucuguagagcuacccaguucacgguccugcccuauaggauguuugucucaaaacuggucccgagaugacggaugcaucacgugugccuccugaugcagccaggaggccaggucugcccuggagcaguguggggaggccaagcgcugaugcccuggcaucaccacaggucaccugcugugucugugcucagccagcugcacuucugggaacagcagaaguuggcgggaggcaugggggggccacaaccagacacugcuguguuccugccguguggcugaagcacaugggcccagccuccagggccucacucgugggagccacaaccgggcacugcuguauucccgccguguggcuggagcacacgagcccagccucuagggccucgcucuccacaucugucaaagagccacgcuuacgaguuagcguggguaaaaccccucaccagggauggaggacaucuaaacccuagacaggucugccauccaaucgucaggucccgcagaagguagcuucaucccagcccccgcugcaggggugagaggagggacgcagauccgagccacaccaucacgcacagacucggggccccugggcugcaugagaagggccugucccgucaggccccccacguuuuacccgggccuggugcugcuccuccagggccccauccccaaaccccuucccucuggcgucccugccaguaggcccagaggucacccuagccacuuuccaaccagagcccgugggcucggcugggaggaagccaggcagcuggaaucaggaacacacccuucccucaguacagccggauggagccgacccaccccaucaccugcccaggcuuccucucgcaacagaaggcguggccagcuccuccuugggaagacucugaggggaaggcaccuggaagguuuacagaaguuucuagaagcuccacccucugucuguucauaccucguugucagagaccacagcccaagggagaaacucacuggcuugcucgggcucccaaaaaaggcagugaccuucccggccccgcggcccccaacugccugagggguucucaccagaacugucauagccgucgacagagaagugguccagccgccgcucuucuggggggucgcacgugauaugggggacugugagcaucuucucuccaggagucaccccauugucuuuguccagcuugaacuuuuuuuucuuuaccuaaaaaaaacaagacaacagauuagcgguuccuggacaucgucugccaggcccuacgccggccccagagugccugugcagccgccccgagcccagcccccgccacauacacccggacagggaccugaggccuggggccagcuccagugucuucacacagagacagggcagggcugcugggggucacguggggggcuuggcccaggugcugcccugugagcucacggccucgcuaacaggacagcaggaagcagauaaacguacaagauggugccaguggaggugguaacaggggcugugaccaguaggggagaaugcauaucgggggaacaggcugggggccagcagggcaugaagagggcgccugaagugagggagcaggcuguguggaaaucugggggaacauuccagcacagggaacaguaggcacggaggcuccaccggcagcuggaaacugggaaggccaggucucuccacagggggugggcacgggccaggaaggggaaccaugccagcgucagccccaaccccuuaugaccccagccaugucacaagacuucugcccagcgccugccaaacuccacugcccugugaccuccagacccccuucgcugcaccccugccucaccucccuccccugcugcuccccucccaccacccacugcgcgcggcccccugcccacugcucaccacccacugcgcccgguguggaaagcccaacccugaggcccucugaagagccuucuuuccagcccguccugcucccagagcucuaucucuggagcucucaugcccuggcccuggaaugaccgguccuacauacccccaagucgggggacauugggauggcaggaaccuagcaucggguguauggcccagugucccgaacgaugcugacucccugacacaggcuguaccaagccaaaugcauggugagaucccagccucgugcugcggcccccacggccuccccaccugcuagcaagaaggcccugcccugguggcaggugggcuacucaccaccacagacuucuuggguuuggggcugggugacagcagaguguggcuccggggggccuuccggauguagaucuuccagguggaggagucgggguucucggcagcauagcaccuccaugcggucugaggucgggcagggggacaggcugucaccugcugagccacccggcgggggcccuuauggaagcuacagcucccccucccuguuccccaggccuggccccuccccucuggguggcagggucugggaccucagagucacaggcuugacauggucccagcucccagacccucugcccaggcagccuggcuuggucccuugcugcaccaggcagcucacugccucaugggcuaauuguuacccacagcugggacaccacagaggucuuuaccagcccugagccagccuugagccaaaggagagacuugcaaaggugggcaggucgcacaucauccccaggugccaggguacacagcgugcauaggagaccaaugcggaaaugggcaaccaguggccacacagugaggaagggcugagaaagaggggucgcccaggaccugcaggugcugagcagggggcagggagaggcaggaucccuagggcuggcaggaggugaggucucucccagaggccuauaccaccuugcaguugggggagccucugauggcacaugggugcagcucugaagccagcauuucagagagaccccauggcagcaccacaagggaagggugggaggaggggacacuaucggcaggggacccggcgggggagcaguugugcagcguccagaugggcaggaggggcucccagggccuuguaugaggacauguccugguggccuugucaucacuggccacaugagccugagagagggccgaguggagaauguucccccacacugaugggcuccugggugacagccccagguagacacagcagcuggcgaggggcaccugcagcccucacucccauccagcacccagggacaggcaggcgagggcacaagcccagccuuccaaggcccgaguguuacacacacaggcugagcacuccacguggucccccaacccuggcaaaccccaugaccccugcccugcuccugugcacaccugccaccuggggccccuacuccaguccucccacagugugugcagcuuccgagggaaccccuuucaaaggaccugugguucccagggagugggaccaggaauccaaugugguccccugccaggcgugggcggccagcaugcucaugcugggaccaaggcggguuuacgggccugauuuauggucucccaggaaggagaaacugugaagccauaaaaccaggcuaagggugggagcacacagcccccccgauggcugagccaggagugcaggaggacugcgacuggccccugacagccugggccuugccuggggcagcgagcucacgaggacugcaggggggacgccagccagcgggggcugcccagguccugggccuuccugggggacaucaggcccagugugcccagaggaacugacacugugcucccagccacugcacugggcggaggcccuauccccagugggcacuugucauucaacccggcaacgcccacccucugggcaccucagcggcuguuccucagggcagcccuggcccugcaguggccaacaagagagacccacagggacgcaauucucaagugacuccugugccaaguccuugcuuacguuaacagagcagucccauucucugguggguccuggagagccuggagugacagagccagagcccagcaucccagagcuugguacugccugccuccccaccugccuccagaaccuuccugccccuguugcuccagggcucugccuuucccagcccacuggccuugugagcccagagggaggcccaugccauccaucgccaguccucaccuccaggcaccagggccucccgagcccugagggaugccaggcccuccagaaggcaccaacugcacagcuggguccuaccucccuuggggacaaucaccuggccaccccacucccagacucagcccucagguuguugugcagugggagggagaaugggagcacaagggagccucagagccaaccacguccacuccuggcauggccacggccgugccuccucuccagcccacagggcauggcccuugaugggagcagcuuuggaggaagacaggcuccaaugccccgugcucaccccaucaccacagcagccaaggcuuccacaagcagaguaugccccacaggccagccaagcugaugcaggggccaaugaugguucugacagguggccgugagggcuggaugcaacaauaacagugaccaaaaugacagugaccagggccuugcaggcaccgcaccugaaugagugaggcugccgccgggaucugccgguugaagugcuucugccucugcuucugcugcaccuucagggcaaaccccgagccaagaauccccugggaaggaauggacaggaggcucccguccacacaggccacugccagcugggugcagccucaggacgugguuaccggucaccguugugggaaggccagguauggucagugcuggaagcccccccaagucccaccucgggcccagccugccuguccugggccagcauggggggcagaacuuauaccccaggucuuauccagcaaggggcccagucccauggggcagggcugcagccgcucuaacccauucccagggaccauucugggggccaggugggcugguccaucuguaugugcccaggaaggggucauacugggcacugggauuggggucgcaagugagaaggcaguccucagcugaggaggacccugcugcugccucgcccaaggacgguugaugggaugcaaaggacccacccugaagcuagggaacuccgugucuacagaggagaucacguggugcacgugcaugugugaugcacacacacacacaauagauaugcacacuaacacacacacacugacacacacacaaacacuaacccacacacuaacacacacaaaaacacacuaacacacaaacacuaacacacaguaacccacacuaacacacacuaacccacaaacacacacaaacacuaacacacacaaauacacacuaacacaaacacauacuaacacacacacuaacacacaaacacacacacuaacccacauacuaacacacacuaacacuaacauacacuaacauacacacacaaacacaaacuaacgcacacuaacacacacacuaacacagaaacacaaacacaaacccacacacuaacacacaaacacacuaacauacacuaaaacauacacuaacccacacuaacacacaaacacuaacacaagcacauacuaacacaugucuacaugucaugugcacacacauauacgcacauagauguauaggauacauaccugugacacagauacauaaauacacauaugcaaacauacugauauacauguauaaugcauacaugugcacacaacacagcacacauacuaaauacaacauaugcacauacaauauguauacacaguaugcacgcacacauacaguacauacacacccaugugauacauauacacauacccauaguauacagguaacauaaaauuauacacacacaacacaaacacauauuaugcacauacgcacauaacacacacacacacacccacauacaggcauugugaacuagacacaucaccuuacaaucugugguuucuggaaaggacauggaacaaaacccccccagccacagcguggaagugcccucuccaggcacaagauucugccuccauggggcgugguagcagcauugcccacccacccagggcugagugagcaggccugccccacacugcgcccaugcacagccacuccaggcugccucccacacugccugcaaggaccccaguggggacugcaaacgggaagucugcauccagggccccagggagggcagguggggcucuggaguauagcaccuucuagaagggaagcacccucuugguucugaacguaagugggucugcucacagggaggggcgugcagccaccccaggaccccagcuguccaaggagccagggaaaacgcacccacggggcaccuaccgcugggagcgcaaagaaggagauggcaaagacagagaagcaggaggcgauggucuucccgacccacgucuggggcaccuuguccccauagccgaugguggugacugugaccugcagggagagggacaguggucagccacggaugggacuggagccucgggagggccaacugccuaacccaaacccaccacucugaugagcggagaggccggcaagagacccugaccaccaggacgaccccgugugacucggcgaaagcaccaggaacagagccgcgggauggcacaugucucccaggcucucggcgucacacacaagguaugucccaccagcacauguaaggagcccagcacccacgaagggccaggccugcuggcugggaacgugggccugggagcucgccccacaccggcugccucaucugccugccuguccccaggaggcugggccccugggccaccgacguugcugugcgccggcccccaggagaccgggagcucccacugaggcuggucgucaacaaagagcaggggcugggaugacgcgcugcuuccugacgccacuccagggcaccagauguuuuauuuuccucuuuucugagaguacaagaugcagcucaagccuucuucuuggugggagagccauccguccaggacguguggugggacaauagaaggcuccccccacccuuucccccgcgcuggcaucugagguuugcuuccuggggauuccagucugagccuggaaaugucauucugcaggacguaggagccuacccuggcugggccugguccgugcaggcugccugcuggguucuucaggagcuggcgcugagcccaacaaggagacccagaguggcccucaggcacagcucacccuguggacacacaggcuccugccugggcucaucuggacagcaggcaugguggcccagaccauggcuguggcugcgggaggucuuugcagcccugcucugggcaccacacucaggacagcacagcauuuaccggcuuggggcuucuggucaaggucaagugacggccaccgcuugcaggcccaggaaugccccagcugggaaccacauggagacccccacuggauucccagcccuaugggcccagugcugauggcaggaaggccugaggccuguuuaacacacucugauggaaggcaagaacaaaccccggcccaccugagcccccacgagaccagggucccugggccacccugugguuuccaccagccacugaggaggagggaggguggggagaagccccauggccacccccgggcaggggugcacaggcgcacacgcggacagagaggcaggugcacacggcucacgcgacugcccagaacugccacagcaggaggcucggaggcucagguagcagaagcggccacauugcgggaaaccaggcuguaccgaugagcacguuaacgaacagugaugaacgccagccaccgccgccaggccacagggcgggacaggccucugcugagcccuggccgccacccaggccccugccccacuagugcccugaccgcacguucgcuuauggccaggaugcuucugcagaggcugcuugcaggcuaccucccacagcugcacacggagcucucccugcagcgccacuguccuuaagagacacacacaugcccccaugccccugccacacacacaaugugcacaggaagcuguuuacugccaggcccuuucaguggaccacccggcucuguguaugugggugcacacucacaagcgugccccaugcagagaugggaugcuccacacgugcacgugucugugcuugugcacacacacacggaaacacacgacccggcacacgcacgugcgucacacagaugacaaggucaugugaaaagggagcugguccccauguccgagccugacacucucagggcacauucaggugcagacaccuugaacgcacagcgcaggcacacggagcgcagccaggucccugcagggugaagccaggccaugggugaggcugacaguggcuggcagagaggggggcccugggggaaccggagccccucgucugcaggguguccuccccagagggccugcacccacaugcacaggcugggcugccgcuaccuuccccagagggcccaggugcacugggguggggaguugcagaggcagacacagggcugcaaagugggcggggcaucggagacccugugccaguccugcccuggggagugacuuccaccuggugagcucucagcccaaaggggcucagcccagggucccagcacauccacuguuuaccaagucuacagcaaguccaagaaagcacacacagguggcccagaaacgggccuagaagggccugggcagggcagggacccuggccuauccuggccuugagcucggagggccccugcaaccuggagcaagagggcuccagagucugucuaauccagauuuuuuggggggacacucaccccuucaguaugaacaugcugauuccuacuuguucauccagcaaccuccuauucaucccucagaccugugccugggcuggcgcagccccugccaaugcccugaggcagugcucaccccuccacuccgggcucugccuccgcucugcagaagggccccucucagcaccgucugccuggcuggcacgugcagcccgagacuugaggagcagcccagcgcaggcccaagucccaccccgccuggacauccuccuagcacuggguccgggaggacaaggucaggcugaagaaagcagggguggugggguguggcagaccagcgcccaaggugggggucagguaugagaagcaggguugaagggcugcguccaggacagggcugucuguguuccccaggcaaaugugugcugaugaucugcuggggcugggcucagggacggcagcacucucuguggcuggggggcacuaacaggcacuccugcucccacccaagcguaagcagugggacguugcucuucacagacaguuccgggacaggcguggggauccccguccucuggggagccaggcuuucuggagauuugcaaaaaugcauauuuuucuuucgauaauauuuguuuuggaaaauauagaaauuuuucaugacauuaugaaaauguaaugggucuauuauuuuaauaaauuaauauggaauuguuuuuacaugccuccacuguauuaaauagugauggcacaaugcccacgagccaggcuucuccgucaggggcaccaaggggcccugagaccaagaggccugggcacggcugccucccgaggcagccgaggacaaacccaagauaggcugagaggcaggaauuggccugaggggggcugggcggcaagcaguugggggaggccaguggggagcuccugccuugcgugccaagcguaaggggcgccagcaaacccaggcaucaagacaaauggcacgggcuggcauauuaaacauuguucuaauaacaacauuaaauuauuuuaauauauuuuaaaagcauuacuuuuuaaaugaaaauaccauauuuugauuauuuaaaaaucuaauacagaaacugcaugaugaagguggaauggaguggggcuggccuggaagucagaguggaguuggggucaggugagcaggugagguagccaccugcucgcguaaggacacccgagaccaccuuccaaaccugcccccaaacagacgagagcugcugagggugggggugucaccuccuggggcugagcugggugcacgugggcuccugcuggcuggcuggguggucaguagaaggcaggggugccccgagagggagagaaaggccagccccagaagugccccugggugucugcccaccguggagagcacacauacagcaggacgcagcuccaggaccccaccuucgccuggucugccugucugcccagacccggccccagacccucauccucaaguuaacaaggaaacggccccucccugcagaccuguuuguuuuuccugcauucagacacaggcagcucaggaaugggcuguuuuauggucaccaugcuggggauuagucccugauggcccaccaccuggaaugcagauccacaugucugucuccugggccguggcuccuugccagggcaccagccauaugaggcacacaaagucacgcccauggcaggaacugugggggcgagcggggaacgcacaccccacuggucaguguguuucccccgcccuccugcuggccugugccuucacucccaugugaaggggcgggaggcauggggagccuucuaguccccccauguuccucccugagaaacacugggauucuauucccuccuuucagaaguagccuccucaaggcuggccucgaggggaggacagaggccagcccagaaaccugagcuccagccgcaugccaagcccuggcucccagagcucacuggccccggcuggaaacgugguagucauuugcccagaaggaaggggugguccuggcuggagaugugguggucgucuguccagaggaagggguggucaagagcgggaggaggggguagcccagaggugucacaccccagcuggcacucucaggucaagaucaucuacgaaggaggaaacugaggcugggcagucacugugcugagggcuccccauuagaaaguggccaggcagacagcuggaccaaggccugcaggacccacguuccccgcuguggccaccccgaaggcagagaugggcuaagaggcugcuucagccauugcaggccccgaccuugcccagccucgagagcccagccugcccgugaggaggcaccuaaggauggagucaggagagcgcagcacccaagcucagccccacagcuccaaggagggcggcaggggcuccgggacaucccaugcggccacagccauucccaggucacugugcuggggccccagccaugaggaggccccuggcucuucauggaggcucugggccaagggcgcccucccaggccugcuccccucuccagggcuuggaaggaagcccaugcaggaucucgcagagcugggcccucggccucagugcccccaguaggcugagcacacagagguccaggcagguguccccucucguggcacgaugccugucucagugguuccaggggaugugggacaaugcccuaugagugagggccucgggccccaccuggcaccgucaccuugccuggaaguccuguggcugcccugcuggcaaggcugggcuggcaccguggcucugaguguggggggcaguucucacccuguccgucuggccucaggcaaagccccagcauguucuguaccucaguuucccccucucgggaaggugcaugaucacaacacacuucucacgggcugccugcugggugagggcuuggcacguggccagccugucacucacuccuggaauuuguaaagugcuuuggugccccuugcagacuuagagacccagucuagagccugucuagagccuucugggccucugcuagcuggugggcuccccccaugcagggcucagagacaugcacuccucaggacagggcaggacagggccccacugaccugggugacacuacagagggcagggccaaugaagguggaggaaaggggccuagggggguggccugggaaagggggagccguggacagagggaggccccuggguggggggcaggacugucucugggacagagaaggguggggccagcgguccuggggcucuaacaggccaggcacucacauuccaaggggacgcccagcccccguggggccgcccuggagacuccggccugucucucaggaacagccauaaaggggcugacgccaccaggugggggugggggaacaagccagcaggcuggcaaacucucaggguaaaagcaaaagcagacacacaccccaaaauaaaccugcuuccuuucagcaggagaaaguaaauaaacgaacaccaauucacgagggccaggccuccccgucacauggaguccucuccucacucacgaagcccggagccccacacacgggcugguggugaaaccgucaacacccccauggcacccaggccccaggccgcgucuuccccgagguacagccaggcucagcgcccugccggaagguggcccaggugacugugucuugaggucucagcucagcugucacuuccucaaggaggccucccugcuccugggccgaaacaguccugcagggacacuccggcggugcuucccauggccaccugcgaaccaccacaggccagccccagcucacaccaugcuucucgcuccugacugugacagagagagcaagacagggcugcccgaaccccugccggugccuggcacacagcaggaccgcaaaccacacgccucaacagugaguccacaaacggagacccagccucaccaggaggcccuuucgguccagggaaagucuccgcagcagagggaucgguugcagccucugggauuacaguccucagcagcccuugcagcgggcccugcauuggcccugggagacggacugcugucucccaugugcagauggagaaacugaggcacacagcaggugcguacucugccucuguccccaggcccacucaguagggcagcugaacucguuccccuuugcacggaacuccaggaggaggaagaacgcugacccaggggcucgguggguggccagguccugccgccccucggcccacggcgccuuggcuuccccagcucuuccugacaccaccccucccgcugggcagugccaacagggcuggccugugacugucugggaggcccugcccucacgcacaccccugcaccagcccccagccccuucuggccuugccccgccagggugcagcguugccagggaggcgggaauuucuggaggcuccaggugaggagagagugaacagcaggcagucagacucgacuucaaaaggcggcugaaauguaggaaugggguuccagcuucuuuacuuucaauucuaaauuuaggugcagaggggcaaacacagcccggcagccuccuguuuguagagacccccgggcgcugaacagagaagcccguguuugcaaaaacugcuucucccuccacucaaacuuuaacacaaacaaacgcauuuuguuccaagggcaaagaaaagucuuaaauucuccccaaacgccuuggcagccagggcaggcgccacacucaggggauucgagaguucucacauccaaguugcguauccccaccccggcgaaggggacaggaggggacacucaaccacugagccggcgccuucgcuggacagcuguggaaacugguggccggcaaggggagggaccuucccaggaaguccaccugggccacccacuguccuaggcuggacugcauccccccuaauucauauucaccuggacccacagaaugcgauauuuggaaauaggcucuuugaagauucaaucaagaugagcuccuccuggaucaccuggguggacccuaaagccaacagcaaguguccucaugagagacagggccugacacagaggaaagaggcggccgcacaccgggcacgccuggagucuccagccacggggagaggagaggaaauuucucccugagcuuucggaggggcaggcccugugcacaccucgcuucgggcucuggccucuagagcccaugaguuucuguugcucugggcccagcaguucgcggacuuuguuguggcagcuccagcacccucucagggugugucugaggggugaggaguccacagaguccaggcaaggucuggggcagaugcagcaugaugaucagaauggccuggccuccaggaagccaccucccacccaguaagggccuguggcagccccgacggacggacagacauggagcagcccuggcugccuggccggcgagggcguacuucacuccccgguggggugaaggaagcaggacaaaggagcugaaagaaaacaacugcucagggcgcaguugcaaauuggcaaaacuggcuuaaaagcccccaucugggcugcugccccuucuugcguuucucaaguucuguuuguccgagaaaugccaggaacacagcccauaacucaggccucaggggccgcuccccccagacagcugcagggcagcugaaugggagcuguuugccccacagcccugggcgguggggggcccagggcgaccaggggcgcggggccuggcgggaacaauggccaggccagggcgcgcgauggccgaggcucgggcugcagcugacggugugggccggggcacugaugccaagccgggcacaaaggggccguguucccggccagcgggcggauguuugcacaggugugggagugggagugccgcucugcugcgggcuggggggcuggggaguagcguccgcugcccacagcuccagugggcggcugggaaggcaggcagggcagcagcgaaggcugggcacugcuuaucagccgugccggggccaguacccacuggcuuuugcugcaccgccagcuccucacugcccaccuugccaccagccucccgggaacucuccuggcucugggccguccaucccccgagcacgcccuacccauccacacucacugcaggcaggcucccgcaggggggcugggcccugcugcccaaaccugcucaggccugccacacuggggccuucggggacacaggcccccaggaaggcgggaagaggccgaaaguggggccugccccaacccaggagcugugucagcaugccccugccaucccugagcauugcagcacuuuggaagcuuccagaaaaccugcugacuuggccuacgucaggagccacugcugagugucuggccucaugggggaagcggcgguugagggggagggaggaggcacagcaaucgcagggacacgugccugccuggggagccaccgggaggcuucucaccccacccagauaugcucugauggugguggggggucccgagagccagcaaguccgguccuuucuggaaggaggacucggggcagacggacuggguccuggcaccaccacguguuucccacggcugcccugcccgcccccaccuccagcccccgugcggcccccaggccuuggcucccacccugugugggcuucgacggccuccuccccagcccccagccccuguugcuaccacgauuccaucuaaccuguuaucggacugagugagcccggaggucgguagacaagggcagacgcgggggcaggcuuguggcggcagaguaggggucacccugucaccucggcacuugggcuucucgguccccacccagggccacuccccaaggugugauggugccacccugggccuuaguggccuguggacggcccaccuggcccugcagcuguggggggagaugggauggagucauucccucccugcacucuggccuccagccagcuacuccccucgggguacccacguguucccccuagaagcagcccuugagcuccaugcauauauaaacgccgacuuucacuggaggauuugaaggcagccaccagcucccagagggacacuggcaagcuaggccugcccccuaaaaaugccucagccagcguccucugagccaugagaaacugcugcugggcccacaggccagugacuugggacuuggggagccugcagcucggagggcgcacccugauuccugcagcugcauccucaucggaacaucucccucucccacgugcaagccugagucccucaaggaagcccccacagacacggcccaagacacccugccccaccccucccgcacagccucucugagcuuuggguggcucgguguuccagugcgggaucugccugcugcacaccggcuuccccaaggcucccgggcugcucuagguggccggaacccaccuucacagccaggggcagccucugggcccacaggccgggucccugcuucccuaggcccagcugcaccuaugucgccacugcccaggcccggcuccagaacuugcaggcccagcauccacuggaaacacgggggcucucugaucucugcuggggucucuugagccaucauggucuuuccuguuugcugucucaugucuggcuccuuggggacaggggcacuuacagggccuguguggacccucagagacacgcgagguaugcaucugacgccgcucuccuugggcccugccagggugagggccacgguggaggcagggaaugggcaaccuaggacgauggcgggaggcagagccaugggggagccgaaaccgcuaagcccccaacacacgcuccagugaccccuccgauuucccucucaaaucucaaguucaaggaugagaccauucagaacuucaagauggugaugccaaaggacucaacacugagcguggggaccugugccagcggcuccaagcacagguuuguggacagaggccugugagcgugcaggugagaagccccugccaaggcccgaagucucaagacaccagugcccagauguccugcccacuccucagccugagcugccccuguccccaugccuggaaguuuccgacuuaccaccccccaccacagcgcaucugcguagcugccgaacuccacgcggccugacucguucaccgcguccuucucagccagguacacaaaguacgaggagaagaugaggcccaggaagccgauguacagggugguuaucagcuccuaggccagaaaacacacagugucgggcuccaggaaccgcaggcugggagccuccugugcagacgccuaaggcagcgagucccagcgaucacugggcguccuacgccgcuccagcgcgguucacaugcacagggccggcuucaauauagcccacuccucacaacuccgguaaguggcggguggggguuacccccagaaugaggcucagcccuggggucgcccuaggcccacugucugggccggcgcgggcuccacugauugcccagcucucuuuccugccacgugacagaaccaagaauggaccaggacccaggagauccucagggagaggaaggguccccucaccccacagagccaggggccagugcagccugaacccaucugagugcagcccucgggagggagucugguggcccugccuugaccggguccuugauuugccuggguuuuucauuucugacuuucugucuucauuugcccccagcucagaggaaggugagcacaccaucagccuggcaggccagggucacuggcaccaggcugggguggagcauccaggcugggcucaagcuugggcuugcucugagauccugggccccguucagguaccccugcgcccaggcacccaccggcccccggggccucagcgcaucucaagcuguccuagugugggcugcucugcucccuccguccuguccccaaccugggccccgcaccccuaacccgggccacccaccuggcgguggaugaagaccacggagcccaggagccuccaggugccucccuggcggucgacguguagcauccucaggaucugcaggaagcggaugccccugcgaaggagaugguguggggcugagggagccaggcugggcucagcuguucacgccgggccuagggcuggccgauggcaugggugucccugccccugccccucccaggcguccacucuggguggggaggcuggguauauguccaucccgacaggggccugggaaucucccucucaggcgcagccccccagagccugcucugaaucugcccacacagggcugagcugggggucggccagguaccuccagauucccucaguccccagacugccuucuggggggcuccuugggucaccccaguuugcagaugggcaggcugugugcccagauggucagguuaccacccaaguccuggaaguucagaggcgcuagugcugggccagagccuagggcugccugaggcaucuuggguugagccgugcccuccacacuugccugcacccacccugcuccacccaucccagcacauggcucagugcccccgggggcagugggcaccaaggcaccuugcaucugagcaagguggauggggcgugagaccacccgcggcucaggaggggugcucgggguggggcggcauggcggggggagcuuguggcacagacgcaccugauggccgacguggcaaacaccugccccuuggagcccacgcagaggaccaccauggaggccacgaccacgaugaggucuguggagugcaggagagggggagcuuuucgugaucgccacagccagggccccagggaagagcauacacccugcucucgucuggggaaggggcuugcuggucagacgggucacgcccugaugaccggggacauggagacaccucggauagggaggcaggcagcaucuaaacggagagacccaaccucuguccuggccauguggagcccccggccuaggcugggcccugugcugagcccugcaaguggccagaaagggcagggccucaggccuggaccaugguucucaggcugccgagggugacuggcccaccaugaagcuaugcugggcugugaggcucaugggaaucugugagggaccaacccccuacccccaacaccaugaucagcgucugagugcagaggcugcugagggcugccaaugcuccugugcuggguccugggcagucacccccugcuggccuugggguuccccaguccuuaggggacuccaucugguaggggucaugagguggggguccuuccuggucuggaaaccugggcgugaccuccacagggcaggcaugacucaccgaugauggaaaugggcuuccgggcaaagcgcagccgcccccagaggcccacguacuugcugcggcagccggcggaccagaggcggaccacguacuccgucccgaagaacaccaccagcacgaucuccugcagggacagagugggacgcucacugcaggcaggcucggccuugaguggcuucagacccugcaaccuguuugaacccagccaugcuggagccuccgcugaaggacacccugagaacagcaggcccggguccuggccugcugcggauggugaugccugcgcacagaggcccuggaaggcugagcagcuucagcucauguccauaggcaguggagcccaggugaggcugcagcucucaggccaggcccacccaggccagaggaggccccacaccaggaaccccagccuuggccagagggggccccacaccaggaaccccagcuugggccagagggcguccgacgccaggaaccccagcuugggucagagggggccccacaccaggaacuccagcuugggccagagggcguccgacgccaggaaccccagcuugggucagagggggccccacaccaggaaccccagcuugggccagagggcgucccacgccaggaacccuagccugggucagagggggucccacgccaggaaccccgggugcccuccgugauaagcacuuucccaccagauccagccccggaaagccucacagcuggccuuugagccugguguaccugcgguaggggcagccucuggaucacuuugcccuuacagggagucaccuggccccuccacaccccaacaccuccucaacuccaccgacaccagagggcggagguuccuggaggagugggaagaagacccucggagcuggaucccacccccuaggcacagaaguggaaagcugggccucaguuuccucagcuguauaguguggaugcagcagggccaggcucagugggcuugguggggacuuauugccaaaaugcagcuuucaugugaagugcagcccauugugacacuuaaagugcagcggccaccugcaggcuggagcccagcgcccaggcagccgggguguacgggaggcccuuggggaagguguguggggcuggaagaugaaaccagcccccacgugugagaggcgcuagccacacaaagccacaaagccacaggcauacggcgucucaggcccacuuccggcggacuccugccuguccucccucagaagccgggcccuggaggggacuucugcucccacugggugacaguggcuggccuugcucccaugccacgcccccaccagggaguccacuaugagcagucagcuggacacugccaucgcuggcucccaaauguuauuaauuaggauggaaugauacuuacaccauccggcauguguuugggacaagcccaauggauaaggggagacacgcugggagcuuaguugcuuuccuuuugcaaaaauguuuuuggcucaugacgucaaauccuucaggggugugugggugugugcggacaggugcauacuggagauggcagggguguaagguaaagaaagggugugggccaggugcgggggcucacgccuguaaucccagcacucugggaggccgaggcaggcagaucacgaguucaggaguucaagaccagccugaucaacauggugaaacccugucuccacuaaaaauacaaaaauuagccuggcaugguggcgcacgcccuguaaucccagcuacucaggaggcugaggcaggagaaucgcuugaacucgagaggcagagcuugcagugagccgagaucacaccauuguacuccagccugggugacagagugagacuccaucucaaaaaacaaaaaacgaaaaacaaaaaucaaaaaacaaaaacaaaagguguggacaccugcaggcucuguggccucauggggggggugugggucccaccucuguccucagcuccuggggaccagggcucuaggcugagguccggcugagcuccuuagagaagaggcuaccuuggucuuauccacccccauuucccaggccccagaacaggaccugcuccagucagugcucaacauggacaugcugaaugaacgaaugaaggaacaaauaaaugacuauuccaaugagccggccuagggcucucugguagcaggagcucugucucgucggucuuugcuucugagaaacugcccguuagggagaccgggccuggacaccauaacacccgccuuuguuuggucaucgugaaaaaggccacggaaacacagagcuccaaguccccggagcugagacagggugcccaugacggcacagaggccggcucacccgacuauugguggccuugauggggaggcauagcggcucccagcccagcucugcugacccauccaccacccagcagacuggcccuuagcaggguuuuucuuguuuugaugcacuuuauuuauuuauuuauuuauuuauuuauuuaugagacagagucucgcucugucacccaggcuggagugcaguggcgugaucucggcucacugcaaccucugccucccagguucaagcaauucuccugccucagccuccugaguagcugggacuacaggcgcaugccaccacgccuggcuaauuuuuuuguauuuuuuuaguagagaugggguuuugccauguuggccaggcuggucuggaacuccugaccuuaggugaucugccugcuucggccucccaaagugcugggauuauaagcgugagccaccgcgccugaccuuguuuugaugcacuuuuaaaauuacuuaaauaccuucuccaggcauguccuaggcaggucugaaaugauaggugugucuuauguuauacccugaaauagauaaguaacuauuaaggauugcuguggauagcugcgugucuuuuuaaaguuauuuugaccuaacacucagggaaccuguuuaggggcuggccuucgaagauggcaggacuccugccugugggacaaggugguaggaaugauuaaaaacaacacugauccccaaauccagcuggaugugggaaggcagugcaaggcugcauggcuggggaggccccgcuugucagguuaauuaggcuggugcugcuagcaggccaggaaagagccaaggaaaaguccccucaccaucucuaggcuggaaacagcaagauggaauguuugcucagagauaaaacuaucuccaccaccaucagccucaaacgcucuccugggcugugugggacaacacccagggccaaggccacagcaagaccccagggagcucacacucagcuggggacagggaggagggcuggucccccacgccaugccauggcccaccccugauucacgggaccacauccccagucuaaagcaggcucacagaauggcaggccugccucccccugguuccagcaguccagaccccaggugggugaugccccagccacccuccuaacccuggguucaucuguauuugcagacuugguccuaaguuccaaaggugaacuaaaggggccucaagcuccuccccagaaccugcacacauuugguacuucucccuugcccaccuugcucaagcagcugccauagcuccugcuguccacacugagggugacagucuagggcugucccugaggccuccuucccaggggcucaccgcccagucucccccagagccucccgugggccccaggugccccccauucccuggggcaccccugccuccucaggacccugugucaggagugcucucucccucccccacuccacccccuagguuaccccacccuucucaggccagcucagcacccccaucacccccaaucccucugagagccccauccacuacagguacagaaccgggguacuuccugacucccccacugauaacaaggccagccccagggccuucucugaggggcacccaggaucauccagccccacaaagcgccucucacaagaucuauguggugccugcaagccccccggggucaaggaugcaauggcccgggaugcugauggagugcggcccugagcucugccccguagauacgagaagaagagccguccuuggucuccacugagaccacaaacagaccaaagggacaaggaggccccuccuacccuggucacucuccuucagacuaaagcaaggccgccuccuggcugcagauggcuucauggacaaaagggccucagaucugggcaccgagacgugcacagagcaaacacagacccacauaaugggggugguggccucuguucacauuuuacagaggaggaaagccaggcucaacuaggucaggucacccgcagcuuaggggagggaagacuggcguccauggcagagagagccccgccccgggacaagguacagguguccucgggugugggagaggacacuggcaggugaggccaggccugccauggagggcugaccacucucaugcacagacaugaccugggcaugguggugguucuggaaguggcccuguuacugccagaugagugggugcaggccaaaggcuggaggacccuuggcaaaggggacccagacaugagauaaggacaccaggcugcaaaaguggcccugggagagagaggguaaccaagagagacuccagagccuccagcccugccaggggacagggaggugucucagcccuguggggugagguggggaagacaggccugggccucacagagccgucagcaccaccagccgcccugccuugguggucaucuagugggcagccgggaagcuggagagcugggucuggccuggagggagggugugggugucagauggccccaaggcgggugcaggcacaagagccaccaggaccacagcacccuccuuccuccagacccagugaagggccugggacaaagacguucagggucaggaagccaaaccccauggguucugccccucccugagacaccuucgcagaaacaacagaaaagacaugugaagugggaagaaacgccucggagccuuggcugaugccacugcacuccacaucggacccacucguucgacuguaugcuuuucuagcaaggccugaaagcaaugaguuucugggucccugccccccaaaacaagauaggccacgggucuuuccccuggccacaagucagcccaucccacacugcacccucagcucuguucuaccaugagugugaauccauguccauccuggggcguguuauaaguuggcucucaggugucuuauuugugugcuuuaaaauuauuuaaaaaaccaaaguuccuaacaacucaauuuuuaaaaaauaggcaaagggcuuggacagucauuucugugaagaagauacacagauggccaagaggcacacggagaggugcccagugucacuaaucaucagggaaaugcaaaucaagaccacaacgagaugccaccucucauccauuaggguggcugccaccccaaacagagugacaagugcucccaaggauccggagaaguugggaccuugugugcugcugggggauguagaaugccacagcuccuuuaaagcgugaaaugaccagccgcucgauuuugcugugaaccuaaaacugcucuaacaaauagucuguuuaaauaacaugccagaaaaaaaacagaauuacuguaugacccagcaauuccacuuuggagucuguccccggucucuuuaaaggagauccauacacacccauguccacagcagcaacauucacaacagccaaaaaggggaaccagcccagugucccucagugcaccgacggagacggaagauguggucccucccuaccacggaauaggauuuggccuuaaaaaggaaggggauucucacacaggcugcaacauggaggaaccuugaagacauuacucucagugaaaugauccaguuacacaaggacaaauacuaucugcuuccacucacgugaggucgcuacagucaucagauucacagagguagaaaguagaugaugggcgccaggggcuggggaagggggaguagggagugaguguuuaauggggacagacuuucaucaguuuugcaagaugaaaaaagcucuggagcuggaugguggcgauggucgcaaggaacugugaucuuaaaaaggguuaagaugguaaaacauauuuccauuuuauuuuauuuugagauagagucuugcucuguugcccaggcaggagugcaguggcaccaucucagcucacugcaaccucugccucccagguucaagugauucuccugccucagcccccugaguagcuggauuagaggcacccaccaccacacccggcuaaucuuuuuguauuauuaguagagacaagguuucaccauguuggccaggcuggucucaaacuccugaccucaggugauccgcccgccucagccuuccaaagugcugggauugcaggcaugagucaccgcgccuggccuuauauuucaccauaauguuuaaaaagaacauguuugucaggaacuaggagaagggcaauggggaugguuuuccuuuugaggugaugaaaaagcucuggaaccggagacagguguuggcugaaccgccuugugaacauacuaaaugccaccaaauugcacgcugugaaauggcugaaauggcugaaauggcugaaauggugaauuuuacguuauguguguucucugauacugaaaugagugccucgaggggcccuggcccguggcgguugcucaccugggcucccgcgggucaggucuccaaaaggauucugugggccuucagggccacccagcggccccgaguaucugccgcacuccagcuguggucaucuguagcuguccuugagccuuuaguucuuaaucuucacugacuauuguuaguucagcauucaacgaaauagcuaagcacaagccauuugucaauugcaaaauggcaugcagaccuugagcccucucaggaugaagacagaaaacaaauagcaggcagugcaaagggcccuggguggaaaaacacaggcaagcuguaaaauuccccuaaucuuguuucaucggaacgcugacaagacuuauguugaauggugcucggugccauccuucacggggggcccuggaugccaacgggacacccuaaggcacagucacugccacugacggcuucgcuauugguacugaaaucuugucauuaggcagacagacccugggacccucaaccucaacccaggggaaaucagugcauggugcggaaggaaaauggaagcucaagguagcucaaggucacacaggaggagacacauggccccgcaggccgaccccaugcugguauccgguguugugggguuacaguggcauaaagaggagaccugcccgaagccggagggccagcaagggucuagcaaagcaggugcuuaucugggauuuuuagucuccgagugaacagagcggggaaaggucgcacuuuggcucaaacguguugcaaccggccguggaaccgguguucuccgagaaggcugaaggucgaccuggccaucuuaucuauuguuuugcuuuuaucagccggcgaaucuccaacauagcgaagauuuucugggguucaauguguuuugaaguuccaugcugcuggaaccacauaauuuaggacccuagagaaggucccugugucaaucaaucacgugggaaagaucacagggcagccugaaauaacugguucugaccagcugcgcucacauccugucucucuggaugaaauauauagauuuuuuugcaaaacauaaaggaagccucgcagacccuuaucgcgaggacuuuagugucucugauauuacucuucuauuaucucuuuugucuauuuuggugucucugauguuacugcucuacaguaucuuuaaaggaaaauuaauuuuaaagacggcggaagaugaagauuaaauacgaaggaucagagcugagcuuuguggaaggggccagggucaaggaugcagaaacacagccggccucccuggcgcccccauagacuuaggccuggggaccuuccacuggagccaggaauccacccacccuugaaaagccugagaucuguacccacacuuuuuaggagacaaugaggccucaucaggccaagauggggccuggagacucugaagagggguggacacagggguuaggcugagggugcuguggggacccgggauuagggucucacccccucccauagcgaggaagccagagggcugggccugugcugagccaggcgcuucccugugggggcagugguccccacagcauagagcccggcuggcgggcuuuggggccagcuguuccaacuccacaccggcccggcccugauaagccacagagagagccagccucggcuccggggagggucagcuggccggagggcaaugcaggcacucaggcagcucaaagcgcccuuugucccagggccugccuguggccagcugcucccagccgccagccugugcugagagcuugugggcccccagugacgugcugggcacagcuggggcccucauccacacucacccccgcccucacccccaccccccggggaguaccaguccccaccccgcccaagguagccuggccuggggcaggcgccacagugcagccggccaggcccaggugagaugcaccauccacugggcugaggguggcacagucgggguccggcugcccuguccuggccuuacugcuggggacaugacccugcccugccacagccccuccccugccaaguguccccuuagugugggcaccgcuggggugccacccugaggcagccuuagucgggcugcauccuucugcucggcugcuuccccaggccccauggaacgugcagcccgugaccuugaguggggcccucugugucccuccugaggcccuggccacccaaggcccugcccgcccaagguagccuggaacaggcccaccuccucggaggggagggcuucugggccccugcacagcuagcuccaggcagccagggguggcacugggaguaugguggggggacccgcuaccuuggccaggcccccugagagccccuugucccacacauuagcaagagaaaggaucgcuaagcaggaggaggaugggcacagggcaggagcaggcuggugugaggacacugguggcaucccaggcgggggacccagacgagcagcucagccucucugugcucagcauccacaccuguaaaauggggcaccagcagugcccaccuccuaggacuguggggagggcgaaaugacaacaguggccugggccuguggaaagggcaugggaauaguguagcaggaagguggugucccaugugcucaagagggaagcgaccuuguccucggggggcaggguccugaguacaggugggguacagacucucaugcugcacacagcacagaagagccccgcugaccugacgccccgucccgugcuggcccagcugccuggggcccuccacgucaccuggccuuccuggcuguggaaguuccuaucuguccacagcuccacccugggaguuccuuuuuuuucuuuuuuucuuuuuuuuuuuuuuugagacggagucucgcugucgcccaggcuggagugcaguggcgcaaucucggcucacugcaggcuccacccccugggguucacaccauucuacugccucagccucccgaguagcugggacuacaggcgcccgccaccucgcccggcuaauuuuuuguauuuuuaguagagacgggguuucaccguguuagccaggauggucucgaucuccugaccucgugauccgcccgccucggccucccaaagugcugggauuacaggccugggaguuccuaucuguccugcagggcaccgcgcagccucacucucccugcagugaagcccucccccauccacugcugccucugcugggaucccuccuuuccuccacgucuguccucaucccacccagagcgcccuaaagucaggggcccgccuucuccaccugcaagcucagugcugagaccagcucacuacccaccuugugcccaaaauccugcugagaaacuucaggcaggggacaggugugucucccucccaggcaccugccuugugggugcuguacuugggguguggaaggggaggcugaggggcccguaaagaccugaagacccccacucuggacaucaucccccauguuugggauguuacugucucccccaggauggacgucacccccccccgcccccccagaaggaacaucaccuucccccgucccccaaggaugaacaucacccgcccccaggauggacgucaccccccguccccccaggauggacaucccccaccguccccccaggauggacgucaccccccagucccaggauggacgccaccccccaguacccccaagauggaugucaccccccccauucccccaggauggacgucaccccccuguucccucaggauggacgucaccgcccccacucccccaggauggacgucaccgcccccacucccccaggauggacgucacccccccaucccccaaggauggacgucacgccuccguccccccaggauggaugucaccccuccccaggauggacaucaccccccucauuccccugggcuggacaucucccccccaugucugagaugcuaacccccuccugaccggaugucacggccccccauggcugagaugcugcuaucuguccccaggcuggcgguacccccucccccguguuugggacgcugccucuccccacagggcaccucuggagcuccuccuggucuggcugccccucucugaagucacuggaacacucuggggguccuggcccugcaggaagacacacccaggaaaccagcggaagccacacaccaggccccacccugacuucccaugggaccccagagacagagagggaggaaggagccccugcccaggaagcaggcagcagagcccuagccacaggccuucccacagcuggcggccaucucugaccuucagagcugcaaucggccagcugcucugugugcuugucuccccguuaaugauuucggggugacucugggaggcacgaggccgcuuucccuccagaacuagccccaccugccagcugcccggacgugucuucuuccuggugagcgagagaggcaagggacuugcugggucgucauggggauggccguucccauccaccgggcagccgggcccugcaagugggugacagcugucgucugguccccacaucccggacaccauccugacaggcggcaugaggcccaguguccccugugggcugucuggggagacucucaggaggcuaaaaccacaggggcuggcccucccccugccccgggcucuacgucuaaguagccacaagggcacaucccggggugucaacaagauccagggcuuuccugauccucccugugccugcgucuaccccuggccuaaggggagccauguucacacauuucucuacgacccuccaggccccaggacugauuccauaaggccuugggugucgaaugcauccucuccacgggcuucccgggaagcaccucugggaagacugccugguaggcuuucagagagcaacgaaagugcaauauuuugcucaagggacacuccuugagcaaaaccucccugcaggccaaggcucaagugaccccucuugcugagccggugccuccagccccaccuugccccuuguccguagcucugggaguaacugcaaacucuugacauuugucacucagguaccucaccugggucugagcaggaggugcucaaggcagcuggccccauguguggguguagugggggaggcuucucaggguggagggguuagcuaagaaaggaacuuggaccacacccugggccuagcacauucuugggcccauuaucauuggggccaaaucuuucccaggacugccggcuuccgggccuuggccuccccaugaaggcugcccacccauggaggggaggagaguggggccucucaguaauuuuaauuucacauguacugccggugccuuacgggggccgacuagaguuacacacguuucaggcgguuuaaugaggugccuccagcccugggacccagcucgcugcgcaagccggcgggguggggguucccgaagcgcggcccacuuccucccccaccuggguguucucaaggucaggaggcggacacagggcgcagcagccaccugacaccugccuggggugggagaggcagauggcgcuaggcagagugcccacaggcuggcccaucuagucucugcuccgaacugggcuuaucagcagauucugaugaagcaaaaacuauguggacccccccgccuggagacccccagcacacugaaucaacccaucaccuggcaaggggugagaacccaggacgcacugaauaaacacguaugcuuacacagugugcaaggcacauacuucauuacuuucaggcaauagaugaauuucaauccacgugggggacaacauuugcaaacacagugaagccaccagcaagcgaugugggcacuggcauggaauuuacaaaauaaaagcaucuacaguuggugcuggggggcagcuggagugauguaggggcuggggcaggcagcggggccuacgucucauaacgcccuacagggcccgcacuucccacaucaaucucuucuuucuggcuauuuaggagaguguuguuuaauucccaaauagguaagggauuuuucuuccccaaucuuuuaaucauuuauuucucaugauauuggguuuugaucagagaacauggccaguuaaaucucaauuuuuugagguagguuagauuuguuuguagccacaugaaugauugguuuuguaaguguuccgcagacauaagggaacaaaacaacuccauuacuaggguucgaagugauagugcugguuuuaaagcacaguccuaugaaguucuuugccaguccuccccaacugaaccugggcucugugacaccugcaucaggagaauacagccagguggcucucagucccuggcacugccugucuccuggacuguucauuucugagaugugaggaauccaugcagccuuggagaagcccucaugaacaggagccuuaccagccauguagaugcaaugcuguggaggcuccagccccagcugauacuaugcagaggggagaugagccgucccacugagcccugccagacuguaggcuagcgagcucaggcgugaugcguauuuugaaggugcuagauuuguggaugguuuguuacauggcuauagauaacaagaacaggaguuauuucaaauuacuguuagaaucugaaauugcucaugauuacaacauuuaccuguccauguccucacuuauuuugugcccacuagaacuguccuauuccaaaagagguacauuaaaaucuccucccguuaucauauuuaaccuuccuguccuugcagauuuucaauaguuuuugcuuuauguauuuuauguuguaugaugccuuaaagauuacagucaggucuucuaauagugccugaucucauucacacuugucuuguuugggcuucaguguugauauucauccugaucucccuguuuuuucucuccuuuucuucuuuuagcuugcaguuucuuggccucucuuuggccauuccuuuauuuuucaaccacccauuauugcuuugccuuacuuaaugcugcugagcaauguauuuguuaaaagauaaaagcccagagcuacggcacggccuucucugucuuucaaagaggaauucaggcgauuuacauuuggugugaaguuggaggcauuugauuugacucuuucuguccuuauauuugcuauuugacucuguugacuucucccuuuugcuuuugguuguuuaguugagccacauguuauccauguucugauccucaugaaguugaggaugucacugaacucucauuucacugguuccucaaacucacagccaggucugcuacucucuaaagacaguguccacuguagugggcucccuaaggcuuucuccucaggaagauaagaauuugcgugugacugcauuucaccccucucccuucaccccaucaacggcucuguggguauagaaagcaaccuccaacauugucuucauaguuuagaacagggcuugacaagcuuuuucucuaaagccagauaguaaauauuuuaggcuuugcaggccacgcgauuucuguugcaacaacuccagcagacaauuuugugcuguuauagcacaaaaacagccagagaugagauguucacaagcacacguggccgugugcuaaucaaaucuuauuuauacagaucagcagccagguuuguaggcuaugguuuacggacccuuggauuaaagaauccucugacagguagguauuccuaccggcuaaacugugucccccgccccgcaaauucauauguugagguccuagacccuccagcacaccucagagugugaccuuguuuggaaauaggguugcugcagaugcuauuagguaagaugaggugguuagggugggccccuauucccauacaacugguguucuuaucaaacgggaaaccuggacauggacuugccggccggggggcgcuguauggaggcggaggcagggucuggugcgaugcgucgaccgggaacccuuccacaguagcugggggaggccuggaacacucccucacagccucagaacgaacccaccucgcugauaccuggagcucagacuccuggacaggcagggggcugcagcuggcacccaggggcuccaggucaucagcaaggccaggccagaggucuguucuagggucucuagagagguccaggccauaggccucagggccugaagcuucucucuccccaggcggggucccugugggccuacaagaaagugggcccugucucuccaagaggucuaucagccuaccccugccccauuccaccagaaaacccaggcucugaaggcagaacucaaugugccaguggaggcacuccaggccgaugaccagaagaaaaggcccaggggcaggaaaaugugggcauaugggaggcacucagggcucugaacagucaaaaaggcagguggggcugcccgcaaaucaggcccugaauccucugcugagccccacaguuugggagcugccucccaggaaucauacccagggccccgcacacacaggaguggcccaagccggcugcccugcaauuuguggugggggagcccauggcccggagacgcccacgccuggcugcagacaccauuagccgccuggcaggcagcuuuacacguauuuaaagcaaaucccccaucuuccccaggcagggcuguuuccgucuccaggccaguuaaacgaggauuuaguuucagccugggaaccccacugcugauggcuguuaaccccaaagacggugcaccccucugaucacugucuuagcuagaacugggauagggggaaaaggggguggagcgggggacauuauuuuuaucugccaggagccgaagcuucuaaaaaugucauauuuaagaauuucaccagcacuagaaguuuggcaaaccaaagagaccaggggcugagcacccuucuuuugacuuggggagagugcugagaaggccgcaggguugaacccuguuuacuuuagcagagauugaggagcugcaacccacaccggcccuucaggggcccgcgcaguguugggacaggaaggccugcgguuauuaaaggcugcccuguggacgugugugugugcacgugugucagcgcgugugugcacacgggccugucuagucuguuuucugacugcugaguaccucacucugauucugcaaaucuagagauuuuaauaacaggcggugaauuuaaacaguuguuuucccccccuuucaggaauguuuuaagggauugagaggaaauugugcacggauuuugcuguuuuaagagcuaauaugugaacaacuucagaaggauguauguuguuuuagggcugaaguuuacacaguaaacgggagagucaaaagcagacuugucgugaaauuguagggccugucuucuuaaauuucauuccucugagaagggacugccucccuggggagcaaagcuggaaggaaacagagaaagucugaucuuugucccccgugccccuuacgguguccuguugcagaaucccuggggaggcagugcccagugggauggccagcagcagagaccacccagcccaggcccccucucagggcacugaggagggucccccugcagauggcugcauucagaggucugcaaaccccacagccccuaagcugcucaggaaugacaugucagcacaacauggucuuguuuccaaauuugggcuggggcuucugcuccuuggggacaaauacuuucaaagacaugaacaaucaaaaccucaucaagaagaaauagacaaccugcauagcccuguaucugcugacuuuccaauggcaaacuucuccacaaagaaaacuccaggcccagauaccuccacauguucuagcuaucaaauguuuaagggagaaauaauugcaauucuacacaaacucuuccuaaaaauugaagagcaggaaauauuucccaacucauucucugaugccagcggcaucugaugccaaaaccagacacaacagccaacacauggcaggugacgcccucgugagcgugggcguggaaguucuacacacaaccgaagucagucacauccaaaaagguguuuuaaaacgcaucaugacagcugggcaugguggcucacgcuuguaaucccagcacuuuggaaggucaaggcgggcagaucaccugaggucaggaguucaagaccacccuggccaacauggugaaacccuaucucuaccuaaaaauacaaaaauuagcugggugugguggcgggcgccuguaaucccagcuacucgggaggcugaggcaggagaaucacuugagccugggaggcagaggcugcagugagccgagaucacgccauugcgcuccagcuugggcaaaaagaccaagacuccaucucaaaaaaauaaaaaauuuaaaaaaguacaaauacauauaaaauaaauaaauaaauaaauaaaauaaaauaaaauaaaaauucaucaugaccaagugggcuuuguguaagggaagcaaguuugcuuugcuauuugaaagucaaucagugcgauuccccacacuagcaaauuaagaaagaauuugauugagauuguugcaaaugauaugauuaucucaauagaggcagaaggagcacuugucaaaaaauccaacagccauucuugacgcacucucuauucccagcaaaccaggaagaggaggaacuucuuggccugauaaguggcuucuacuaaaacccuacagcucccaccacaccuaauggugaaagauuaccucacuucaccuuaggaguaagauaaggauagcagcccucuccccacuggcagacacugucaggugcauucaaguaaaaacaagaaauaaauaguauauggacugaaaaggcaaaaauaagacugacuuaauuguggacaacacaaucaucuccauagaaaauccuaaagaaucuacaaaaaaacaaaaaaaaaaaaaacaaaaaaaaccccaaaaacagaugaacaagaaaccuucucaaacuaauaaguaacaugagcaaagucacaggacgcaagguuaauauacgaacaaaucaauuguauuucuauauccuagcaacaaauaauccaaaagugaaacugagaaaacaauaucauuucaguagcuucaaaaacauaaaauacuuaggaacaaaucuagcaaguuucacaccacuaaaaauuacacaauccugaugagugguguugaaaaauaucuaagacaccggggagcaagaccguguucguggaucagaaaacucgguauuacuaagacgugcaugaggcacuggggagcgagacaguguucguggaucggaaaacucgguauuacuaagacgugcaugaggcacuggggagcgagaccguguucguggaucggaaaacucgguauuacuaagacgugcaugaggcacuggggagagagaccguguucguggaucagaaaacucgguauuacuaagacguguaugagauccaaauuuaucuacauauccaaugcaaugccaaucaaaauucuagccaauuuuuuuuuugguagaauugacgagcugauucuaagauauucaugagaaugugaaggagcuggcagaacagcucacucuugaaaaugaacaaaauuggaggauuaacaggaccugauuucaaggcuuagcguaaaagucacaguaaucaagacagugcuuuccuggcagaacagaugacaaaguccagaaaucgaacccacacacacggccaacugauuuucaucaaaggugccaaaguaauucaaugggaaaaaagucucugggacaacuggauaaccacaugcagaaagauuuaaccuccauccauaccugucaccauauauaaaauuaaacucgaaaugaaucacagaucuaaacaagaaaugugaaacuauaaaauuucuacagaaaacaggagaaaaaacuuuguaaucuuggauuaggcgaauauuucuuagacagaacacaaagaacaugaacccuaaagaaaaaaaaaaagaagaacccugaugaauugaacuucaucaaaauuaaaaacugcugcucuuuugaaagauccuguuaagaaaaugcaaagacaaagccaugacugggagaaaauauuuguaaaacagaucuggugaaggacucauauccagaacauagacacaacucuuacaacucacaugauuauucuaagaagacaaccuaauuguuaaaaccagcaacaaacuggacagauccuccaucaaaggagauauaugaauggcaaauaugcccaacaccauucgucacuagggaaaugcaaaugaagaccaugacggaauauggcuccagccuuuaggaugggcaaagcuuaaaaagcagacaauacuaagugcuggugagaauccauaggagccagaaugcucguacauugaugguaagaguggaaaacgggccuaccauuuugcaaaaugcuuuggcaguuucuucgaaaggaaaauaugcaucuaacacaugaucccgcaaucccacucccagggauuuaccccagagaaaugaagacauaugauuacucaaaaaacugcacgcaauauucauggcagcuuuaaucauaacagcugaaaacuggagacagcucaaauguccaucagccugugaauggauaaacaaacugugguacauuuuauccuuuccaaauaaaaggagacaaacugcugaaugcagagaccaugacacggaugggccucaaaugaauuaugcuaagugacagaagccaggcgcagaggcuacacgccgcgagauuccauucacaugacguucuggaaaaggcaaaaccauggggacaggaaacacguccacgguucccaggugcggggaggggcuagccgccaguggguaccagggagcuuucgggugaugggaacaccuuggaucuugacuuugggggugguuacaggaccauaaauguuugccaggacucaucgaacuggacaucuacagagggggagaguuuuccuguauguaacuuaaaccucgacaaaccuaaauuuaaaagaagaaauuagaaaauaagaaaaccuaagaaaugcaugagucagucaacaauacuuuuuaguuaaucuauuuagagggagaggcagcuaugaccccaccaagcccacugagcucagcacagccuccccugccuccugcuaccaccagagucuggccugggagcagcuguaccccauggauggaacacggggacccugucucagucugugccccccccucacuuggcagccuccccaggcaccccucgccugccaucugggcccccggggagccaggugcuaggugaagccuggcuccuguccaugccuuguacucgggacuccagcccuauuugcgcucugguccugggcugagccuggugcugcccugcccuuccugugaggcuccuuccagaagccccugacccuacaucagccgggacaccaucucuguuggcccucaacucgccaccccagcacccuucauucaccugcucagggaggcgcccccucuuccggucacucagcucacguguuggcauuuguuccccuacccugccuggcacucuggccuaggcgaggaugcaugucaggcaucagcucccagggcgggcagugcccuuggcugcuuuccagcuccggggcccgcgcauggagcugccuagggaggaacaugggugucugggccacugcgacgcucccagaacgugggcuucucccaccuucuaccuaugccuuuucauucaacccccagagggacccuagcagggggugugaggggugacggcaaggaugcagaugcugcagugugucggaaauccaggcgccgcgccacggcucugcaacugcaaagacccucucaccccgugaucagaaaaguucaaacuccaggcacacggcccagucccggcaacggcaaagagaggcgggggagggacgugcacugccugcgggauguccauccaggccggggcucggcagcucugguucucuacagacaacucugagcaucucucaucugagcuccgcaaagacauacagauacauccacacccagaccugcacauugggguccaguucugggguccgucccucucgaggcccaaacaguccccugcacccuggccuccccgucucugggucuacuggagguggagcuggcucccuuccugcuccucuacgcggcucgcgcuggguggcgggggcggugggcaaggagccggaacccccagauugaguggugcagaaggaaaagccagggagggguguccugcccaggggucucuccgccacccagggccagucauggggaaggaggcgcauaggggccugggguacucaugacugggggccacgugcugcugcucacguccacugccccccaggcacccccacaccaggccuggggagcccagggccacccaugcagaacacaaaacgccucuuguucccaccccaggugcuugggaggaggaggcccccccacgccccuaccccgggccucgcagagcagucacuggaagugucccagcugugcuaugagcaggucacgaggcuccacaacaggaccugcccacgccgggacacccggugacacuccacucccucugcuuuugcagcccccgggggacccuccucgagggccccaugucuucuggguuccaucgcuuugagguagaaaaucugaggccucaaacugcccccaaagcaggcaaaggucagauguguggagagaggauggcgaggauggcaaggacggccaaggagggucgccccaggugccuggacccagguuugucccgcaccccgcacccuggcccacaugucuuccuuccccauagccccaccccagcauccuggcaccagugggcuccugguggcacuggcuggaugcuguagccugcugauggccacuagcacgugcuggggaccuaaagccacaugguugagacaucaucauuugcuccacaacccccuagccuggcuucucagaucucagccugcccccucuccacccagccacucucccuuggguggaagcuggauguacucuagaacccacccuggagacagccccugggaugaagaaaccaggucguguccgggccccagcaccugucaccaaacauccuccaaagugaggauuuuucagucacaggggcucaggagggcuggggcagugguagucgggggacaguagggccccuuuauucccgccagacagguccucacuuuaccccaaagucgacaauggcgaacuucuccucagacacccacccaccugggccaagucaggcugugugucuguguguguacgugcgugggcauuugugcacagccuaagcacccccaggccaccgccagagcccaacaccgugugugcacacgcauaaacacacaaaccuggugcuaucugagaugcaagaagaagaugucaccuugaagugggucacuguauccaacagccccacacgcaccuaugaaaccgccuuaagaaacuuuucacuaagggcuuggcgggcuccugagaugucuuagcagaauguagcgguuugcagacacguaaacguguccccccacccccagagcuuaggacacuccaccuacaccuacaaggcugagaaagggaauauaaacugcuauggaaaaauuauaguuauaccggaauuuuucuuuguucgcuaugaaaucuuucaaauaagucagaauacagcaacuaaccugaccgauuauacgcauggauauucccaucccauguucugcuguauuuucuucugccacgcuugauucagacuuugagaaacaaaauccaagggaagcagcaaaagacguucccagucuaccucccuggacgaagccaccaucuuuccaccuacguuucugugcucacacgacucgugcaaucaggacaaacacgcaugacccugggaccucgggucugagcugccacugcuuagagaccugccugccgccaccuuauccugggccuggccucuaccagucagaggggcggcguuaagucugagucacaccaugccaggccccaggcuccugucaugcagagcgaaacccuaacuccccagagucgccccaagcccucacacgccagguccugccaccucccugaccucaucccccaccgcucccugcuccccugucucugaaugcuacaggcuccucacagcucccuccacccgcgccaggcacacgccccauccgggucuuggcacgugccaugcucucugccaggaaugcuugacccugaaaccccaacaucuggaccuucaccuccauacagagacucgcagcccggccgcuccacugagaacugccgccccuccccuuccaugccacucaccauuucuuacccgcgaaguagucaguaguccacccaagguugugggggucugaacuuauaaaagauggaaauggagucagcuuauuguuugugguauaggcacuaaguagaaguuaaggcagauuaauaaaaacgguaagccagacaguaaaggguuaaaugagaaaccagggaccaaggaaacuuugaaaggcauauguauaaagguaacuauuaggacaaaaauacaggcugggcacgguggcucaugccugugaucccagcacuuugggaggcugaggcgggcagaugacuugaggucaggaguucaagaccagccuggccaaaauggugaaacgccgucucuacuaauaauacaaaaaaaauuagccaggugugguggcgcccaccuauaaucccagcuacuugggaggcugaggcacgaaaaucacuuaaacccugggagauggggguuucagugagcugagaucaugccacugcacucuagccugggcaacagagggaaacuguuucgcaaaaauaaauaaauaaauaauacaaccuccuaauuacccaaauguuuuuaaaagaaaauaauacacauauuguaaagaaaacuacaacagcaaccgugacaaaauacacguaauuauaaaagacaaugacagaguugagaccaagaaugucaguccuaugaauaaaugcaaauuagcuguacuuuucaggagaaaaauaguuugacucacaaaauaagacucaacuauaugcuucauaugaaaaacaaguuuugagucuaaagacacaaaugguuugaaaguaaaugaguaaaauauauaccaugcuaacaaugauaaaaagaaaaagccagaauagccauauuaaucucagacaaagcagauuucagagcaaagaaaguggccagggauaaagaggcaguuucauaaugacaaauguguugacuucucaagaggacauaacaauccuaaaugcuaaugcacccaagaacgaagcuucaaaacacauugaacacaugguauacuuguauugaaauaucauauguacuccauaaauauguacaacuauuguguauccacaaaaaugaaaaauaaagaauguaaauaauuuuuuaaaugacaaaagcaaaaaauaaaauacauuaaacaaaaaacuaauaaagaauaaagaacugaagaauaaagagagaaauccacaaauacaguuggagauucuaacauccuucucccaagaaugaauuaauagaacaaguagauacaaaaucaguaaggauguaucauuacugauguagacuuggacaaugccaucaucaaccacauuagucucauugacauuuauagaacaguccucccaacaacagcaguacacacucuuuccaagcacacaauggaguauuuaccaagauaaaucauauucugggcccuaaaucaagucuuaauauauuuuaagagaccaaauuauauuaaguguuucuauagccauaaauaaauuagacaucaguaacagaaagguaucuugaaaaucccuaaauguuuugaauacacuuuuaaauaaugcauacaccagagaagaaguuaaaaaggaaauuagaaaauauuuuaaaugggauaaaaaaacacaaaauuuguggauguuuauaccaccaagugccuguauuagaaaggaaaaaaaaauuucuauucaaugaccucagcuuccaccuuaagaaacgagaaaaaaaagaacaaauuaaaacuaaguaggcagaauaaaauaauuaaaauuaaucaaauaaccaaaaagaaaaaaaauaaugaaaccaaaagcugauucuuugagauccauaaauuugcuaaaacuuuagcugacugauuacacuaacaaagaaagaggcacaaauuacuaguaucaggaaugagagaagagacauugcuacaaauucuauagcuguuuaaaggauaguaacaggauauucugaaaaacuuuaugccaauacaauuaacacccagaugaaaugaacauauucuuucaaauacacaaaauaccaaagcccacucaagaagcaaucaccugaauaccacuauuaucaaucaccugaauagaauuaucaaucaccuaaauagaauuaucaaucaccugaauauaauuaccaaucaccugaauauaauuaucaccuaucaaucaccucaauguaauuaucaaucaccugacuauaacuauuaucaaucaccugaauauaauuaucaaucaccugaauauaacuauuaucaauuaccugaauauaauuauuaucaaucaacugaauauaacuauuaucaaucaccugaauaaaacuauuaagucaauuuaaaaucuaguuaacaaucuucucaucaagcaaaguccaggccuaccuaaacaacuuuccugauggaguccaccaaacacagagggaagaaauaagaccaauucuacacaaacuccaccucuaaaagggagagagaacacuucccaacucacuccucaugccagcauuacucuaauaccaaagccaaagacguuacaagaaaauauauagacaauaucccucaugaaccuagaugcaaagguuguuagcaaaauuuuaacaagucaaguccagugauauacaaaaagaauacuagagcaugaccaagugugguuuauccaggaauacagaaccugugaaaaugaaucaguguaauuaucauauuaagagacugaaguagagaaagcacaugaucauaucaaaagauguaucaaagagcauuugacaaaauuuaacacccauucauauuaaaagcucucagcuauaguauuagaggggacguuuccuuaaccugguaaagacaucuauggaaacccagagccaacaucacccuugacggugaacaaugaugugugucuucuaaggcuggggacacagcaguguucacuuguauuggacacugcaguggaugagccgcccagugcaaucaggccagaaaaagaaacaaauaggcguccacauuugaaaaaaagagguaaaacugucucuauguucagaaaacaucauucauauaaggaaaucaauggaauucauuuuuucaaaagccacuggaacaaaugaguuuagaaagguugcaagauucaagauaaauuugucaaaaugaauuucaguucuagauuagaagaaauaccauugaccauagcauaaaaaauaugaaacacuuagguaccucaaaagauguacaagaccuauacacuaaaaacuaugaaacaucucugacagaaguuaaaaaucuaaauaagugguauauaaccucauauguauaugagauauauaacccuuauaagagauauauaaccauauacauauuagguauguaaccauauauauauauacacacacauauauacacauauaugcacacauauauauacacauauauauacacauauauauacauauacauacacauauauauacauagauauauacauauauacacauauauacauauauauauacacauauauauacacacacacacauauauauauacacacacacacauauauauauaugagauagauaaucucauugaucagaggauucaauauugguuaagacaucaauucuccccauguugaucuuuagguugaaugcaaucccaaacaaaauucuaccaggcuuugcaaaaauugguaagcagcuuccaaaauuuauauguaaaugcaaaggaccccgaacaaccaacacaacuugaaauagcaaaacaaaguuggcuaaauuacccuaacuuauuuuaaccguauuauagggcuguaacaaucccagugugugacuggcaaaaggacagaucaacggaucacaguagaguguccagaaagagacaauuuuaugauaaacugaaccucuuaaaaggagucaagaugauucacuggguaaaggauacucuuuucaacaaaugacacuggaccagucagucauccauaagaaaaaacacaugaaucuccgccuaugucuuacaugauagagaaaaauuaacucaaaaugcauccuaggccuaaagguaagcacaaaaauuauaaaacuacuagcagaaaaucuuaguaagaguguguuugguaagcauuuccuaaauagaaugugaaaagcaugaaacauauuuaaaaggaaaaagcuauauuugacuucauaaaauugaaaauguuuggucuuuaaaagauacuauugggccuggagcaguggcucacaccuguaauuccagcgcuuugggaggccgaggcaaggggaucgcuugaggccaggaguuugacaccagccugggcaacaaagugagacccugucuguacaagaacuuuaaaaaguuagcaccugugguggcacaugccuauagucccagcuacuugggaggcugaggugggaggauccucggagcccaggaauucgagguugcagugagcuacguuuacgccacugcacuccagccugagcacagugcaugacccagucucaaacaaaaaaaaaagauacuacuaaauaaaugaaaaggaaagccaccgacuagagaauacauguguaaaacaaauaucuauguaaccagaauauacaaagaacuuuuacaacucagaugacaaacagcccaauuuuacaaugggugaaacauuuaaaaagauaugucaccaaagauguuuccuggaugccaaugaaacacgugaaaagauauucaacaucacugguccuuaggaaaugaaaguuaaaaccacagcaggaugccacgcacaccucuuagacuggcuaacaugaaaaugacggaccacgucaaggguugaugaguuagccaguuucuuaaauaguuaaaaauauacacucaccacauuauccagccauucuauaccuagguauuuacccaugcagaaaggaaauauaagucccuacaaacacuuuuauacagaguccgccagcacacaaguggauaaacagacugcaaugcguccguacaaugggauacggcucagcaaugaaaaaggaaugaauuauuacaugccacagccuggaugacucucaaauauggaaccagacaauaaaaaccacacacuguaugauugcacugacaacaagccccagaaaacgccaaccgucuacacugacaagacagaccagggguccccuccggagccaggagcagcggaggaggggccagcgacgggagcgagaagccuucugggggugacggaugugccugcugucucaauuguggugaugguccuguggcguacacccauguccagauuugucaaauccuacauuuuaaacaaggccuuccacucuaugccaauuauaccucaacaaagcugauuuuuuguuugagugagcagaauaaauaaaacugaggcuauggcgguuccuggcugaggccccuccuucgcaauuagcgcgccuuuggugggcacggggccccuuacaccggcuuccccuagcacuuccuuccccgcccccgccaggggaggaggcaucguccaccaacacccuuuugcccucuuggccauuggcucuggacugagaaccuucaugcccaauguccccacacccucggcacagccccaggaacugagguccugauaugaccugaauuucacacaugaggaagcugaggugcagagaggauuggugacguguguggacccacggggaagucucaggagucuggauacccccauauccuggaguuuccccagcaaggucugggagucuuucugcaaucccaggcuccagggccauggagagccacagcaggcacggcgacagccucugaggcccaccccaagccaggggaccccacggugcagcucugcgccggccuuucacaggaggggugcagaggccuccagaggcugccgacuggcccccaaacccccuuagcugaugucuaugcgaggaccagccacaggaccugggccucagcgccucugacaggggcuccaugaacucuggggagaaacuacaaauucuuacaaacucccgggaugagaggggguuuuccaaagguucuagaacuccuaaguggucuaacagauguccucauuuaaaaaaaaaaaaaaacucaaaacaccugagccugagaugaagcaagagaacuugagcagaagggggcuuucugggaacguucagaguauccuaacgguggggacaaagcccugcucacaagcaucccgaaaacggcguccccauggcuuuguccucaaucccaggcuuucauagccaccgccagguccagggaccuggcuggguaggccacacugagaacuaaccaacgaaaagggcccagcucagucccucccccgaggacagcagccaucccugacccuccccagccaguuucagaaaacggucagugagaagagacacaggccccgcuaaagaaagcuaaaaugaaauaaagacgcccgcccuucccccagguuccccaccaaaugcugcucugaaugcacgcaucauucucagcacauggugcucggaaacugaccagaucaucaccccgccaggaaaaggggcuggccugcgccucucggcacacacuugacauuuuguucucauccaggcuucccaugcugacaguuucuggauuaaaugugcaaauggaacgcggccccaagggggucucucucccugccugccugagguccagggcugggugugcacgugugcacgugugcaugcaggcacgugucugagccugaacgugcacacacacgugaguguguccacauggguaccuaugugugcauacguccacacgcccauccgugcacauaugucugugcgugugugccugugcauccucuucuccauaaggcaucugggcuggacacgaguguguuuuucaacccccgacuucaacuaccuugaccaugaccaagucuggaaaacucaccaccagcucacagccgcccaggacuuuucucagcccaacagggauuggcuucaccuaaaaaucuaaaugcaguccccucacagcaaguccccaggcugugcucucugccucccauugccacccuagagggcacaaagcugugaggcccagaggaccagaacgcaccuucccaaguggccaggagucaagacugcauauuuggggaggagacuauuguccccaguugccaggguccuaaagacaccugaagggaacauccacuccuccugaggccagcuggagcugaccuugggguugagagcaucucccacaagcuacugaggaggcugcuggccgccccuggccccagguaccccagucaucccaccaggcaucccguuggccaguuuuauacccgggagaaagaaaaucucgugggaagagcugucuaggccuggcccugaacagggggcugggauccgaggugcucgagccguggcuccugaccccgugaggccgcaccgagcccuguccccccaaccugcaaagucacaugaugacacacuucaauggugcacggccagggccucugguuuucacucugugugaccugggaagccaagaacauaauuagaacucaucugaauguaaugcccucuaggggguuccccuggcaccugcccagcccccuccccaggcugcugcccagcgucagaggagaccucaggcuaccuccuuguucagggacacagcggguggaccccacugugcaguacuccauggccagugggccccacaggguggauccuauuaucccccaaugacuucccuagcagcccccuaggagccccacgugcagugccagugccagcucccccaagccugccugcgcccggccugcucagcccgucccguuguguugugucagcugcugcccugcgcuucaagcgaggcucuccagcuggccagggucagaugugaaaacaaggacauaacccaacccggcccgccggcuccccugcaccagagacccccaccgaacguggcacucacugaugaggcucuuuccagcccucaggcagaacauaaaggaaacaccuguccccauggccgcacacucuaaucccacuaaacccgaauggagaagccugggggccccugcagcaggcgcaccccccaccaaggucugacuuuuguccuggacuauggggaaggcgggagagaaaacacgggaacuggccugggagagcuggaaagccgcggccgcccuucaccagggaugcaacuuccaaccagacccagggcugcagagagcagagcaccauggcgguguucccuucggccagcacagccaucggcuuggcucccaggcugccgcgguggaguccgcacagggucacacgcuuguggggccucucaccagagcucccgcaaagaugucagguauugucuaagaugccagcgccugccuagcguaagcccguuccucuagccacucaaugcucuggaaagauugcgcuccuguagcuugaaaacagggaagacgauggaaccagccgacagggccccagacucuucaggcagcagcagguaggagcuucuaccuggccauuauggggucuuucuggggcccaagaggacuugccaccaggcacgagccaggcccccauccccuuuuccuucagggggcgcaccuggcggagaucuggaggagguguucugguggaggagcaauggggaacaggcaccuugccccccagagggaccacgggcugccgacgggacaucauccacucaugccucggcugccccaccccuggccggagcaccaugggcugagaccgccucccuugaagccccagguuccucaaacccagguggggcucacugccuucccucugcacagccucccuggaggaaagacgcugacuggugguucccagguuccagcccaggggugucaaccccauucucacaaaucgcuuggacagaaucggguuacguguuuuuggagaagguuuaaaaaaucuugcaguuuccucuaccuccugccccaggccccucacugccccccaccccaccccaucuuguucugaacaaacuugauauauaugacaauucuggccugcagaagauaacgugaggcccgugugugggcugcacagaggaagccuuuguuacagaaaacgauucaccguagggccccuccacacacaaggccccguauacucagggaaguuuccgguuccagcccaggauuccuauguacucggggaacguuccgguuccagcccaggauucccacuuucacgacucucccgcaagcagauuucgcaugaaagaaugucagcuguccuccucccaagcagcugccuucagacaggaacgcagccaauccaaacccugucaaccgcgguccugggacaggggaccuggcuggggcauaaaugauguccaucgugguggagacagccugccugcugccucugcccugggccccacagaggggccugugagcccuccaacucguccacacaacauccguggggccaggggacuguccccaagccuccauguccaccgcccuucccugcccaagagagagaccaagaagggaaggccgggcagggcugcuccaggucaaagaagcugaaaccgcgugacagccaugugcaaugagaaaaaaccagccacacucacugggaccagugacgagccuuaaaugcaggcugugaaauggacagcgguguccugagagucggacacccuggcuaaguugaagguccucauuccagaggauauacacgggcuuuauacggagaaacggucauacugccuccaacuuacucucaaaugacucaggauaaaaacaaagcaggcugagugcagugguucaugccuauaaucucagcacuuuggguuggccgaggugggaggauuguuugaacucaggaguuuaagaccagccuagguaacauggcaaaacccuaucucuacaaaaaauacaaaaauuagcggggcaugguggcacgcacccacagucccagcugcucaggaggcugaagugggaacacuugaggccaggaggccgaggcugcagugagccgugaguaugccacuacucuccaaccugggcaacacagcaagacccucucucucucaaaaaaauaaaaauaaaaaaccaacaacaaaaaaccccacaaaacccauauagguuuuugcauauagagagaaacgugcagagcaaauggcagaagaugaaagccacugcugaccuggcagagggugccugggagcugcucguucugacaagccugagauuaaaucaaaauucagacacccaggaagaaagacacagacuguggaaccaaaaggcccugcgccaaccugggcacuguagaaacguggggcacggugggcuggcccggggcacacgcucucccacuucuauuuucccaaaaaauaaaauuguuacuaauucgacugcaaguuuaaaugccccuagcaacugcucuuuccaaaauuauccugcuaaauaaauagcguggcaaaccuuuccuggaaggucagguaguagaaaucuuaggcccugugggcugcauggucuccauggcaggacucaaaucugccauggcacaaagcagccagaggcauuaggcccucaaguauguggugcugugugcuaauaaagcuuuauuuacacacacagggagccacccugugggccaugguuuggagaccccuggguugcccucaaauucauaugaugaagcccuaauccccaguacucagaguaagaccuuguuuggaaauggggucccugcagauaugaucaguuaggaggggggucacaguggaguaggguagccuccaauccaguaagacugguguccuuacauagaggagaaauuuggcuccagacucacacgcagggaggaugcccugugagguaaagggagggacugggggggauugggguacuacaucuagaagacaguugcuagccacccucagaagccgggaggggccucagaagaaccagcccugcccacaccugggucucggcccuccaucguccagagcugugagagggcgaccuccacgguuuaagccgcccagccuggggucccccaucacgcagcccaggucgacucucgcgacccacguggcuggagauaggcccagcggucccucuggcaggcugggagggagagccacgcccuguguccgguuuugaagcccagccugggaagccacugcuguggcccaaaccagcucuguuggguuccagacccgccugagagagggaggucccaagaagcuguagcggguggccucaaaaucacauguuacccucccgacccucagugucucgcugggagggcucagcaugucuccccagguccucugcccccacaggccaggcaacugcugagcccugccagccacccuguggggcagggcagcgccagccuccacuccaacaaggcacucggggcacccaccccagccucccuuccuuccauaacucucggggguugagcaauggugcacgagagacuccuguaagagccgcaggcagugcggaugguguguuuaucaccaaguacaggaagccugguggggccggagucucugcugcagccuggcacagcaggaaauuucuagaaucccuuaacaccguggagccgcggcccagcugagcgccccugcugcccugagccugagcuccugucacaggcagggagcggaccagccuuccuucagcagccccugucgccgcguggccugugcauggggcuggguggcuggggacagcagcgggugugcucggcagagcauguggccagugaggcuggaccaaggcugucccgggggaacagaaccaccgggucuucaugccaugccccgugggccucaggcucugagacuguggcuucagcagcgccccugcccccagcugugcaucccacacccugaagcagaacacuggaggcagggugcccaucacaagcacuggcugccuccggggagcagcagcgccgggguuccucuccuaaacagcccucaaagcaaggcugauccuacgcccagcaaagcggccucagaagggagcauuuugauggauucccagaggcagggggccuggucccaggucuucaggggguaccagucaccugaccgcccucucucaggugcagagugggugauagagaugcuuucaggaagcucuacggccagcgcaugagagagacgccacagggcucugaaaggcagugaguggguugcacagggcuccccaggaccaggagcuccugguggauggggauuucaacagcuucagugucacuaaaggggaaggcaggagggacuuguauccggugguccucagugaucaacacugggcuccggagagccggccaagucacuucuccuguccccacagggcaguggcuucaaguuccgcuugguggauucugagccuuuguucuuggaacucuugccgggacaucaggggucgacccugacccgggaggagccuuggcagcugaagcuggguggcagcugaaguucagcccaccuggguguccccagcugccccagacagacacuugggccuacccugcuccaccugccccugguccacuuucaccuucgcuacccuuacccgcccaaagccugcaggccagugucuagcguccuuucacccugaacaggcuccgagagccucugucucccuggggugggcuccaggcaggucucaggacagaugagugagaaguuucuccuacaggcucauggggcagugaccugaagucuggcugggcagagcugcaggccaccccgugcccugggggcugugcagacagagggcccacaucugucaaguccucugggccuagcuccaggggcucagugcagacaggaaccagggcuccagcccgcacauacacagggcccugcagugaggaucccaggggugcggaaucucaguccagcucugccuuucaugagcccaugggcugcuugcacauagauccuggcacacaguaggugcuuaauaaagauuugcuggcugaacaaaugcaggcggaaacaacccugccagggagaagacgaccgcguucugaagccucagaguggccugggugguggggaccggucuuagcuggguagcucccaagugacagggacaaaaaggcaagugagcccacaggcccacagagggacacaacucuucccagagcacccugcagcccugaggagggaguggguacccccgucccugggcaaccagucuaguggggaguugcccccgaagcaagugugcaggacggggcuucgucagacccauaggagcucaccaggcagggcgaggcaggcagggaggaagacaacccucagcgggcggcagcugcagagggagucagaccucgggguggguggaggaaaauccugagucacccacugguuccccaaccugggcaaaggugccuuugcucugcgucuuuucccggcagcggcagaaauggugcugcgggaaaccgccccaggccgugcgcagagcaggcuccucaucagagcagcugcgggucccaggugaaaaacaccaggugaggaccugcgggccugcgggcgcccugagcaaguggaggccagggcgcugaggacaggacccgaccuuguuccacagagagggccgcccagggccgucacggaggcccagagacucccuacagggucucacuuugcugcugggagggaaacugaggccuugcucugagcugggagggaaacugaggccucgcugugugcugaaggcgcagcagaaacccaggcaguggaggcugcagcuggcgggaggggugggccaccgggcggggcggagggagccucagcagaggggaggaagccgcagcgaugaccucauccccuaggccuccggggccgcagcucacgggguuuuuuaaccacaggcauugcaggacaauucccugguauguucaccaccaaaggcgcggacuagccguguuuguguugugcuuuugagugccucucucuuuguguggaguuugacaaaagcugugauccuggagacaaaagccaggcccucaccugggccagggcagggucucuuacugcagagagcagggggccaguuucuagcagcagcuggcuucggcaagaaacaggagagccacccaaaccgggaacuccuucccaggcaagaacacgcaaagcacacacacgucagacacacgugugcacacacacaccaggcauauguguacgcaugugcgcacggagcuacccacaggcacgcacacguacacugagugcacacaugcacacgugugccacuuccacagacauggguacacagacgugcacaugcacguacguacacacgugcacacacagcccccucugaauucagaagccagguuggggcccucuuugcagcccaggaaguggcucuccucccugggaggccuugaggaaaucucccugcccagcagauuuccgacgugguguucacgugguguucacggugccggccggaccccagccgagaccagauuccucccgaaauggcuuuuucaggcccaccgcauaucccugguucagcagaaugccuaaucccuccgaggccgcgcugggguuuccuuagcagugcugagauaacagcuuucuggcacugcaaagcugggcguacgaaaagaaacgagaaaacaggggcucccugggaacacaucgcuuugauccauuuuuucccccaacauuuaaacaucgugcucucggaaucccucaugcggguccugcacccgcccggccccuccuggguuccccaaggcugugguuugggcuccccgcgcucagcacuccuuggcgggugccagcagcuccugaguugcauguagcacgagcgcccucuggcgucuacaggccuucccgccgccuggccccaagggcugcaaacaccuuugcuucucguaccuccccgaagcgcccccaaccguccuuccugcaacccugcacagccucccucugcuggaaucaagaacccaacagccguccucacuccuccaggccugaagccucgggaaccugcugucaggugacuucugccugugcucugauccccacagcccugugccugcuguccgcuggaagcugugagcccugggaggggucccugccugccccgccagcaccagcuuaccuccuucucacugugccccucccaccugagcgcccccuccuccaagcaaguggucacugucuccccacccagagcccacgccucagucucggcccugaugugucuguacauccgccugucaaggccaggcccacggcugccucacucucugcuguguccccaacgugcccccaccauggccaugacugagugacagcuggacccucaaauccccuugaaggauuuguuuccacgcggccagugcuucgagagacugcugggaaguguggcaaggcgagugggagggugucuccaucacgcaggggcagcugaagccgggagcacauaccaagcugggucauccucgcugggcaacucuggccuaugcauuugaugcagggagggacaugcacggccaggaagcgccaugcagagcuugugggguuagcgcagccacggggucccacccucagggaguguggaauggccugaggcagacagaugcuugugagccucccagagccccaugaacccagaacagggcaggucggcggggauggugugcaggauagugccaagcagaggccugaaaccugacaagaggcugagugcugacacucccgaggacagccagguccagagaagagggcuugcaaaggcccuggggcagccaggaauguccaaggcuuggccuggagugagugagcccaggcugggugaggugggguggguaguguuacaggugaugggccugaacguggcaccaccuuggggaauguagccuaaacgucacagggagcuucuggaaugaucagguuuuugucuuagaaaguccuccccagcugcuguuugcaggguugccuggugagacgcaagguguggcagggaggcagcuggcaugacagauaaagggacaagggaggcggccagggucucucugccuuccaagcaguggaaaaggcagaggggacugcaagggggacuacagcagaaagggggcucuaugcuuggggccacgggcugcuucucugccaugccaccccggaggagagggagcugcagggcagugaaagggccgguuccugcugaccagggguuuguggccacaguucagcaaauagccaccagguggcgcacagaccccagggaugcgcagacagugggcagggcugcugggaugaggaccaucuuggaggcuucccugggggcacagcucagcacuguguagggucugcccuccugccugggcagggcugcauccuagggagcaacccuaccuggucugcuccaugccccuguccccugccugguuuagaugccgcaugggggccuuggggugcugcuggugauucuagggcugcagacgggcacaugaagcccagggcacgucuaauucucgagcugcagacgggcauguggagcccagggcacgucuaauucucgagcugcagacgggcauguggagcccagggcacgucuaauucucgagcugcagacgggcauguggagcccagggcacgucugaaggucccugcagguccagccugggugcaggcuucuccaggcuucgcccucccagcugccugggagauaaccaccuaggaagugaggaccugaacuuggacgcuguggugcugacagacagcccuggcugggcaggagcaccugggugggcucacguuagcaccggggcuccauuuaaaaccaggcaagucccaggccaccugggggcgaggggcuaaccaccuagauccagguuaguacgugagggaugggacaggcaggaucucacgucucacacacagcacaggcaugaacacacguacauacacauagguacacacacgcagcgacacauagcuauacauaaauacacacaacacagccaugcauaaacauacaauacaugcucacaggcgcacacuacaaugugccuauauguggccacauucacacauguacacgcucagauacacaugugcacacauguacacacauugaaacagagccaaacaugcgugaaaguccccacgugcucauguguaugcacacuuacauaauacucagauacagaugcacacuuaagcacacagcucacccauaaacacgcacaugcguguacacauucccgugcaugugggcacucacauacacacauguacacacaccugcagagguacaaagggccucacacggagacucuccaggggaauguuuggcagcgcggcucucacagccugggaaccacuggcauccuuggccccaggcccuccagggacaacuaccaggucagggaccccccacagacccgccccauggcagaaccagcaaaggacaugccgugcccacuccugcaguugagccaacccugucaguuggccggggcagaacauccuccugcuagacauggccagagacuuggcugggugcucaucugagagccaggucuguggugggugaggaggacuuggggauccugggcagguaccuuggggaccccauaaaacaugaggcccaugcugccaaggguauuggacaucgcccugugggggaaggacggccucaccccaaccaagauggcaccacaagaugacacacacaccccacuucacagggcagugcaaaagucugaacaaagcaugagaguacaaugugauaggacaugaaacucacacgccaggaccaaggggguuuauuccaggaaggcaaggggggccccucacugacaggagcaccucacagaagcaggaaagaccccugaccagaauccacauggucaccguaaaaccacgccaggcaucggaccugaaggacccuuccugagcacgggaggugcgcaccccccgccuggcagccggcccgcccacagaagccaggagggccccgcuggccgcagguaccacccccagcucuggacagacccaagcagcaaucugcccuccuggaaggcaucccuuaucuggaaacgcaaaagaugcaaaggacagagggaaaaacuucuacgaccacagucacgagaaguagcaggaccacaggcuguagcagaaauuaacagcuuucgcagacgccaggaaagugccuggaaaacaugauagacuagaaacucccuaugugauggcaacaauaacaacuuauucucucaauauuauuaugaugaggaauagacuuaaacugccugcaaucuacauaaugaaaccauaaaaugcugcccauaaacacacacaccaugcuccuggagaccaccgagaugucagucucccccaguuuauucacccgcggccuucgaguuucuucccggggcuggauaaggugauggcaacguucacugggaaaagcaaggcugcaagcgccaccaggaaacccccgaaaaagaaagcccugccgaggcacaaagugacaucaugaaauugauuuuaguaccgggaccaccaagucaguagggcccugguaaaggaaaaguccaggagaccagugggacagaauagaaaaaccccaaagcagacccuuccuacugccucuggacgucugguuuacagagaagacggccccuccagucaggcaggacagauggacuguggaaaacauagugcugggagaacugggaagacgagggaagagugacagcaggccugugccucacaccacuuacccaggaaacucccagccaccauggagcacacacaguuaaccuggucagggcuggaggaaaccacaggugaguucuuccagcuauggcucaagguccagaagcaacaaaggaaagguaaaacggacucccuagaaaugagacggauaccacugccgaggccaucgcgagaggacucuggaccccggagggacgggcuccccuggccaggaagacacagugccagaaagcagcaugaaaccagcccagaucugccugugcaugccgggagcugagucgugacacucucuuccuuuguagauacuagaacuauuccacgacaagacaggaaaacacaaaagccuggccacggagaggugcuagacccaguccugccagaguccugcugcucacggcccacauucagguggcuuccguggggaccccgugggcuccagacacagcuggcccccugcaccccaccuuccaggcagccucacggccagaucaacuuugggguuucccaccaggcuaugagccugcccugcccugcucucagcaccugccuggcagaaauggcacagacaccgcucaggccaauggaagggaccauccaggugccuggggugggggcugcugcugggacaccagcagggccugugugccagccauaacccaggaacagagucacccagaccccagggacacgaaggcucgggcaggccuuugcuggccacaccagcucuacccuaccuccuccuuccuuccuuccagcccagccuggaagccccuccuccaggaagcccuuucagaccaccagcuccagguuccccucaguccuuggucccccucgccuguggcacauacaucccaagucacuuggcaagugugggggcuggggaggugcccccuguaucagggcaggaccaaugugugggcaaggggcugggaguggcucugccccccaccuuauggggcccagcgccagggagaugccagcuuccaaggcagccaugacauccagccaugcccucagaugcuacguaccauccagaagagaguccccguggccagggcggcauacugcucgaugguggacagcacgcugaagaugaggcagaccaggacgaugaggaagcugcaagacagggacacggcagucagcaucacggccucugcccaucccacagaugcaccuggggaguggaggggccccuggccucagccccgcccccagguaggaacagacagugcuucgaaaacccagucauccauuagcugguaagcacacacuagagguagguccgcacgagggaugccgucccgccacgggaagggacgaagcaccaacacaugcugccacguggauggguccgagaaacauggcgccaaggccagacacagacaggugaccaccugcugaccaccugcaguguggcuacgcccuggacagccagagccacagaaacagaaagcaggcugguggcugccccagggcgggacugcugugggcgugggguuuucuuuugggguaauuaaacguucuggauguggaugguggugguggcuacacaacucugaacauucuagagccacuuagggcccuagagccacaaaugaacugcaguguguaauuacgucucuacaaagcugauuuuacaaaucacuuccagagagcagucaacgcccccuguccaggaguucagggcccagggcagggguguugguggucacagcacagaagccagcccgccagguggggguccugacaccugcaccaagcgucugcuucccagaggagccuccaggcggcaggcugugggccgcucuccuccaguuucacuuccuccuuuccaaggccccgaggccgagccacagaacucaugaaagggaaggcgcacagagccccacccuggggccaacguucugggccugugggcccgcagagaaaagacgggccgccuucucugaucgccggaaccauaaagauagggagcugcugccacugcaaacguacccuccagggcccgcccggccuuccucccgccucuagggggauucccacgggcuccggagacuccagggacccccguggauccucagcgaccggagagccaggagauggccacauggcccccagggccaggggagacacaaacagagaaagccacacacagacccugggggccccggcauagauccucugccuggcauagggugccccaggcucccuccgcucccugagauccugccauccugaguggcuucuaacccaccccaggacagccagaaggcccccugcauugccucucauccagccuccugaagucagccccacccagaacccauccucuuccaccuguccagauguggacagcccagcccacccuccccaggcccccagagcccacaacaaacaggcuaccucccagcacagccugccucggcucauccuccugcugcacggagguuucuggggaagguggggcucuggccccccacccccuuccccaagcuccuguggacaggacaauccuuuccuggccucugguagcccuacccaaaggcccuugagggcucacucagccaaagacccugcucaggcccccucccuggguuccucccuccccacagccauagucccgcugcugggacuggggccaaaaccugcagcuaccauuuccucagccaccugccucaccgacacccugucccugccacaccggucagcucuaccugcagagccgaacccagccagccccugucugcacccugcccauccauccucaucucccccugaccacagugcccaccuccacccucggcgcccccagcccacacacccagccagucagugaacccuccaugucgugccccaguauuuacaccacgauggccccagaucaccccagcuccucccggcccuuguugccaguccugacugugcccagcccggcccaccucagggcccgugcaccugcugcugcccagccuaaaagcccagcuugaggguccugccagcgggcccugucucauaggcagaggccagcucugaugucugacccuggcccccacaacaccccaacuguguccuuuauacucaagcaucaucgcugggaccagagucuguuguccacccccuagaccaugagcaccccaagaguggggcugugggcugcaguccaugcccgggacgcagccuggugcacaguaggugaucagccccgugggacuuccuucauuuaaucucuaagccccaaugcugcugcuucauccccaccaccaugacccuuccucugcucccugagguuacucccccacugggacauucgacccaaagcacaagucugaucagccacgugguucccaggagcaccuggaaggcuggcaugcagcccuaccccuccuugggccucagucccccugacucccgccugcccaaagcgcuggcugcauaagcugccuggcauuugcaaacgcggugcuuccagccagggacgcucucugcacccccacccuccacacugcuuuggcucugaggacuccuccuggccagcuuggacaggauguccaggcccugccaggcucccucugggugcuccuacacugaccaccccugcucucaucugucucugggacuauaauccgcacagcgcuagcacgcgguggaugcagaguaauuuguucaacagacacagcuggagccuccgggccaacccuguggggagcccuccguagggugaaucuguggaucucacggggacacaagcaaagguugguuggaagggugagugcccaucugcacugggcaccauuccgggcacugggaaugggcucagacuggcucaccuugcacacagcaugcugcccacugccggagcaggguucccuccagguucuuagaagagucuuugugccaagcugcaggcccuguccccacacccugcagcccccagggcugggcugggucucugccccuugcuggugcaacuguuggcucucuccacccuaccagggcucccuccgccaugacugccacacuuaauccuccuggacgucuguuuguuuugauuugcagugagcagggaagugagauuagacacagccuggcucagccacgaggaagcagagccgggcugcccggggcagaagaugccaccugccugcuccccaggcccacggcgugcagagagggccagggcaccaucugcacauggagaugcagugcccacuggugacccaggcagcuccccugccucaguuuccuuaucaacacaaagaaguggcccacaggugcuucuucccaggcuguggagggaagugucaccugacguccagcagggaaucagcagcgagcgucgacuucacccugaggccuuggauaagccggaagcugccagugcugucuacugcaaagauguggcaaaacccaccacccaccaggggcccugggaaggauccacuaaguugcugucuguucagcaacaggaagugcuccuggggacugcaggccacugcccgcuacccacgccccugcucacugaccacuggcccagccagugcuuugcagacaguaacacagacccccacgagacccugccagacugugacaucacugccacacuaucaucaaacacaugcuacaaguagggaaacugaggcuccaagggcuucugaggucacaauugggguaaacugaggaggagacacaggacugcagccugguucccugacccggcauggcuggggucccuggaggcugggcccugggccccuuugacccucgguaugagacgacuugccaggcucuggucuuggugcacgugagcagggauagggcugcggugaggguggcacagcagcuuucccgucgccgagccuggcuuccauccucccgucucuuccuccaacucagauccuccugcuucucuuagaagaauccucacaaucacagugagggcucacccggguaacccaggacaaccuccccucucacgagccaucccucagucacccugcaaagccccuuuggccacacaaccuaacuuguucacaggacaaggacacagacaccucaggggccaccguucagccaagcgacagccaugucugcgagucaugcacccgaauccacgccacugccccagccucucagugaccugcacggaaggcgcugcacuccccccacucucagaugagcaaauggaggccugaggagggaagggggccaugggcaggacccaggucugcugacccugcagccuccaggcccagguugaaagcuuuaaacuuucaaaaaaaaaaaaaaaaaaaacuguaaacuuccuccaaggcagaggcgagcgaacagaauuaccugcagcuccucugcccuucacaggggcaccgugaugcaauguggaagcugagauaaccccacuucacagcugcccuucuaaaagaccacaggcgacgcugccuucugcaucugccaucacggcuuuucgauucucgugcuguuugggugacagccguccaucacaguggcaguuggugaccucggccacagcauagaaagcagugguggggccgggcgcggcggcucacaccugcaaucccagcacuuugggaggccgaggcgggaggauugccugaggacaggaguucgagaccagucuggccaacauggugaaaccccgucucuacuaaaaauaugaaaaaauuaacugggcgugggugguggugugcuccuguaaucccagccacucaggagauugaggcagggggauugcuugaaccagggagguggagguugcagugagccgagaucgcgccacugcacuccagccugggugacagagcaagacuccaccacaaaaaaaaaaaaauuaaauuaaauuaaaaaagaaagcagugauggaugcugguuagcaccaugugcagggugggcacucacaggccgcaggugagggcuugaaaacuuggugacuggcugcaaauaccacgcgccugggcuucauggcgcggauuccagcugcaggggccucuccugcccauguccugugcucaggagacacagcuggcucagauauguggaguuacugcagcaggaagauucuugacugggcguugcgggagaauacaggauguggccagggaagacugcacaugggugguccuggaccagcccccacagagugugcacccaagugggcguccaccccaacuaccugggcagaggugccugggaaagucccgugcaguggaaucgcggcugaggcagaagacagggcuccaggcccggggguugggagccagcaggggcugaggaacguucccccgcaggccaggcagaugguggggacaggugcccaugggccaggcuggcugucagccuugccauauucugaaggcuaaaugauucuuccgauauuuugauauaccgugcuagccucagaaggaauuauaugacaaagcuuacuuuuaucuacuccagauaaaaagaguuuuaucuuauuuaccgcuuuaucuauucuugucucgggcggagcugggaaccucacaggugccgagcuggggucccugcccuugaggcacucagggccuggggugccuguguccccuccugccucugcagggccaccuaccacccccucugccucagcuccaaggccaggcagucacagccccccacucugcagagccgggaaacuaaggcccugggagaggacgaauccuaugcguguuuuggacucggagugggaagcaggacaggcuagcgaaggggugggggagagaagacaccgacccccccccagcucaugugguccccugaaugcugucccacccgagcucccaagagggcguggucaugcggggggcggggagcugcaugagcggggagcccaccgcaccccagaaaacaaccuccuacuuguuccccuugacagcaaauaggccucaggagcagugacggcgaguaccagccccgaaggcacccggugaauuauccgacaucauuucaacaucucagccccgggugcccgggaacacaggagaaugcaggaacccugccagggucauagcccgagacgcugugggagggcucccccggggugcaggcagcgggccugggugggcuccacggcucagauggccuggggcuaacgcgagcugaaggcuggagacuccaugaccugcccugccgcacacacuagggccccugaguggugcuccuaaaugggccugguugauccaggugacccgccaagcaaauccaguccgggugggggcugugccgggacucuggccuuccaugcccacucggggacaggccccacacacagugagugacagccucuuuagcccauggggggcguuuuguaacccugagauguuucccaauaaaguugaggaaccuuaaagagagccaccuacuucacgugcaaagacacgugggcagcucaaggggugcccuuagaacuccagcuggaagccacugcaccauggaacucacccagggucgaagcugaaaccccggggcguguaaccacuggagcguuucacagaacuuugcacucucgugaccguaugcuuaauuucuugaaucuguaaacauuaaaaauuacguuaauacuugaagaguuuugucagucugaaagcaucaugcauggaaggacaugagcagagaggcaccuugaggacaccggauaacacacagugccagucacagaagcgcaaaggcccagagcagcgaaauccaccgucgcagggaagcggacagcggggccgagggagaggggaucuguggacauggggaggacggauccacgguugcggagagcaggauggcggggccggggagagggagugggauuucaugggugcagaauuucaguuugggagagaaguuuugggguggaugguggugacgguugcacaaccauguaaauguaccuauugccacugggccgugaccugacacagaguuaagacgguaaauuguguguuauguguauuuuaucacaauaaaaaaaaaacuuuuuuuaaagcaaacaacauucauagagcaagcaucagaggguucaaaauguuccccguggcuggugaaugagaucgagcaauguucaaagaccccuacuggggacgggaccucgccaggcugauaagcagacaauggguuugugaagcgaaccuaaagccgaaggcaggauagggccuugaauguguaacuucaagagauuaaauauugacgcuuaaaccccaaaccacuucuaggggcuuaaaaaaaaaagucauccugggagacuccaaaugccuccaaaucccaugugccccaggaaggaaacacugggcgcuggagaggacaggcuuccccugcucacucacuggucaccagcaggucucccuccaucccugauguggcugccggcuccagggcugcugagcucagagcccugggauguggacgcccaggggcagaggucucacagccugccagggcuguuccccagggcugaaucugcaccucagaaaaagcuaccagcuggucaccccccucaccaguggcugucaccccccucaccaguggcugucagcaggcagccucagcaggguuuggaggucgccaagguccccacagguucaccugcuuccuggcucugcauggauggagccugggccaggcaucucccgaccccucccaaaggggugagcccuggcccacaccgagggccccacgcugggcuggacacuaggcacagguuccccgcucugaaccccauguggaaggugucacaucauggaaguccuggugaggagacagaagcccuggugaggcacgucuggucccaggcugccccccagaagcccccuggauugggguucaggaggcacuaccaaucgauggggacacugaggcucagacacagcaugggacgugcccagacuggccgacuccaggggccccagcgccaccacuuggugccaugguccugaggcaggaaugccacaucaggccauacgucauccuggggggugggggcgacagggcccuuuucagccuuccagccucugcgggcucccgcguccuggguggguggcggcaucacucccgugcugugcagcauguggccggauccuccuuuguugaaucuguccugucuuuuaggaggacacgugucacuggacuugggcccccuggauaaugcaaucacgccucucgggacccucagccucagcugcaaagggguguuuucuaugucaggucacauuugcagcuuccagggauggaaaccaauguugugggggggggccaacaccugcuguacuauguaaguauuuaauacauuacuuaugaucacuauugguagauuuugaauucuuaaacaacagaauuagguauuggucaaaaacauauauuaguuguuguuguuuuuugguuuuuuguuuuguuuuguuuuguuuuugagacagagucuuguucugucacccaggcuggaggacagugguaugauccuggcucacugcagccucgauuuccugggcucaagcgauccucccaacucagucucccaaagugcugggauuacaggcguaagccaccaugcccggccucaugucuuaauuuuuaaaacauaauuaaaaauguacucaaagcucagaguuuccuuuucauccucucaccuccagauccuuaauggaauugcaucugaaaaaauucuuuuaaaaagagggucacguccacgcccacuggugucagcacagggacgccucucucaccauucagcccacagggcaucacccgaacccugucauguuggagagaagggagcuggggguggugauucccggcacaggcgggacauggcuggcccaucugcagcaggcagcugccacgucgggaguagguccaugaggcucccuagcaccccagcccuucagggaccgccacuucucaccagaacggcaacagcugccccccaaccauugccccucaggcccccacacagcacccugucugccauuguccacacugcccagcugguuggcagggccuuggaagccccuccccuggcagccacaacagggcacaaaccacagaaggagcguggaugugaucccacacccgcuucacagacccacagccugguccuccccguccagcuccgggugaauggacgccuccccaccagacugggccuccuuggcccagggcucccguggccaccccaugccucacgcugucuuauacucuuuaccuguggcuuguuccgcggcagcugagucucauuucuuuaaaaaguucuugaaagccaugggaucccagcccaagggacacaacaaugggugacuugguguggccgguggguaagauuucugcccucauugucucccgaagccccaagugugcuguccccguuagacagagccgccagcccgccuauccaggagccaucuggagauuaaaccugugucccacagcaggaccaaggcuguccccagccucuugggguuucagcugacacuuuuuccaacacagaucuggacugggaaccccaagaaacaggucccuuccugccagcuuucggcuggguccacacagaacuccugugccugcagcaccuccccagaggcuggucccccugccggggccaccaggccugcaccccaacugcagcccacuccccugguccccccgccucugucucuccugucccaaggcagcgucuacccucccauguuacaagaccccccacaugaagccuggaccccaaacccuccuucugcggaggcccuggccugggcuucccugccaggcucucaggaggccuccggcucuggcuugcaccaguucauggaccgccaggcagccacugccaccacugccuccccgaccagagcaggggcuccccaggcaggggcccaccagcugcauucccucccuccgaaggcccagugccaggcgugggaugcacguuugugaaguguuugcugaaugacugauggugugaaugaauguuaggguaaacccucaagcucggugaaugaagucucagugccgccuccuccaugcaggccuccgggugaaucuggaagugaguuaggcuccuuagacucuguucuuuuccuuccuaucccaccgcacaccacaggcucagccuagcucgcaaguggccuuugagcaggacgugguacugaggcagcguuccgccaccccucacccccaggcugcaugccaacagcacagguugacagaucgcugggagccuccuggggugggcucugacgugagcugcgggcgcaggcauggcccccccagcaggcaggugugagcgggcaggacgugcaggcauaugcucccagggccauggucccacuggccaaaccggucccucuucccugaagaagcgucuuaggggcugccccagaagaccaagucaggacaggugcaggagguggggauccugccagggggaaacccugccaucccaccugguugccacgccacaugccuggauguccugggacaagguccugccuuuacuuccauucugccugaguccugccagacagagaggugaggcgccacaggccagacagugacgcagcggggacucaacacgcguggggcccuggggaacgcgccccaaauccaacccgucccagggcuucucagcccugagcccccuucggugcagacagaaugccaugucucccaccagagcccuccagggugucccaggagcuucccaccuggagguccaucaggugcaucucaccccauccccaucgccaggaaccuggaugcccccgcaccaagaggugacaggugugcauucccucuucaacggcccugcaggguggggacugauggguccagcugcgcacggggcuccuggacgcucaggccuugcaguggggaugagggcuggccccgccuggcaccuaccaagggcucauucccaucucacccggacgcccagggcccucgaccacaccucagugcggagcguggagccugggcccugaucccuccuuuccaggagcagccuggggggugaacacagccgugcuugagggcccugccaugccaucccgagugucacgucaaagcccuucagaggcccuagagggacaggugcugggggacccucgggcagccaggaagcuucccggugacaccaggcaaacucuggggggucguggcaaggugggggagagaucaggaggggccagaacaaugucccuccccaccagaagagcccagugcagcccuggcacaccucugggccagagaggaaauguccuaggcgugguggggcagguggccucuguggcaauauucggccgggcauggcuguguccuaauaaaacuuuaucgacaaaaucaggugguggccguagcaugaggaucccggcaaagaguccugcugagaacccagggcucuggcaggauggcaugugggugucugcaccuguguguugguuucaggggacccgcuacacaaucaggagcacccaacaguggcauguaaacaucaagcaagggcaaccgaauugggaagguccagcucccuguccaucucaaaggcuuucugggggccaauuuugagcccggagauugagaauucaaacaggaacgugugcccccagagcuggccgccacauccccuuuaaaaacaggcucuaugguggcccccaagaaucccggugggucagcggucccaggcaugaggggacgcugggacugagccauuuaaagcccaccuccuccugucgccucuaaacuucaugagaagccugagaaguggacccauccuuuguucacaggagaggaggaagcucagagagguuaagggaccugccucaagucacacagcaucgagcgguuggcgagaacuggacuccgggucucccugacagcaucacagguccccacagcaccucgaagcaccccgaaaacuacaacccagaaguaagccuggaguggugggcauccaggcagccuggccuuccacagggagauuccagcaggagcccuggccugggcgugggcggauaggcccaggggcucagugaggagagcugugggaugcccggccccuggggucugggcugucacugcagccauggcacacauagagguggucagggccucagcagaggacagggguggccaggcucuggggugcaagcaggaaaggcaugagcuucuccuggggcccggagggugcagguggcccggcagagcacaagccccccagggccgagggcugcugggaacggggcucugugcucccagggccggccacaccaagccuggcucccugggcugugauaagacacccacagagaguauauuuagaaggcgccgggaggacaaacugaagugaccccauggauguggcccuaucugcccuaggacacucgucuugucucugugagaggccugccuagggugaggaggggcugggcagaccagaugcaccugugcaccccccaccccagaaauggcgaggcucugccugggcgaggccuggucccagcagccuuguccccucacccccacugauggcggcugcgcuguccuggagcagagggugguggucuugcugggcagcaggggccucggggacgggugggagggguggacaggccuccccgccccugggccaggggcuccgcccucccucacacagggcaggcguuaaagccuccaagaagugaaugaaaucauguccuuugcagcaacacggauggaucuggagaccaugauccuaagugaacuaccggaaacagaaaaccaaacacggcacguucucacucaugaguggaagcuagacagaugggaugcuuggacagaaagacggagaaaggucacucugggacuccaaaggggagguggagagggugagagggggaggguugaaaaauuaccuauugaguauaacguccaauauccggcugaugggcgcacgagaagcccaaaccccaccauuacgcacguaacagacaaguauguguacuccucaaaucuaaaauaaaauaacauaaaaaaacaagaaagacuugaggaagcaggcagagcucccagagcaccuccacucgggaagggggcgaggugcggaaggacagcgaaggccucaggugcccuggagcugccaggucaacacgacccacuggcggcucaggguguggguccucaggguucaucccuacuugggaaagucccuccucacaucuagcccaagucucuuuucgagacggagucuggcucugucgcccaggcuggagugcaguggcgcaaucucggcucacugcaagcucugccucccggguucaugccauucuccugccucagccucccgaguagcugggacuacaggcgcccgccaccacgccgggcuaauuuuuuguauuuuuaguagagaugggguuucacaguguuagccaggauggccuugaucuccugaccucgugauccccuuggccucccaaagugcugggauuacaggcgugagccaccgcgcccaugagccaccucgcccggccaagucuuucuugcuguagcuuggucuccuguauagggaaaccuccuacccacuacagagaacacugggugucccuggaaauggagcugcuguguggccuccuugagccuugguuuccccacugggacaugggaaugcgucaagggcacccggcaaccugagccacauucauccucagaucagccccagccacaccucaauauuccagagauggggcagccccaggaucugggaccacaggcaccuggcaagaugcugccgggcucuaugaccaggcuaagagugagcugggaggcagccaguguccugcacggaaaugcgccccggccagcucccucggcucuucucacugccuccauggccgccagcgagguaagguacgauaauggcaggggaggggggcaucucccacuccguggagggccaagccaggagcugagggcagcucagguuggggaagcugaccagggcaccaggagugaccugcacaccccccaaauggagacaaagagucccccagugucacuguggggcccgggagccacuugccucucugagcagcugggugagccagcaugggacaggccccaugcacacaccuugcaggccggggggcaucagaggccuugaaauaggcagguggggcuuuagccgggcaggugaauucucuuucugcaccuggccuuccucccucucccagcccacuggaaggggcaauaagggagggcuucucagagguggaggcccagucuaggcagagagaauggcaaccugugcagaucccagaggagagaggagaacccaaccugcagggauggauggaacucaggagagaggccggugcggaggcagagaaacagcggccaggguggcugggacacccccaggcucuggugauggaggcucccgacagcaggcggguggcugucucucccaguaggccccagcaugguggacuggugccuguggaacucugaacacggcagggaugccuugggcccagcagggaccucaggccagcaggugccugggccaugcccuggggaagagggcccaagacccccuaggcucuauggcucugagggacugcccagcacuuugagggcagggcagguggaucccaucccagacacuccccuuugauccacagggcaaacagcugccccacccucaagucccaugggucccuugaggucaugaaaccuuuccagcugaguccagaacugacacuuagagauagucucugcguggccauaucagggaacagccaagaagagcaaagagggcucaggugagugacggccccuggaguugugcaaugacacggccaggagaguacaaagguccuggucggagggugggggagucccugcacucacaucacacagggucaggauuccccccagacaagaccugguggcccagagcgcagcacagcaucauggcuuucuccucgggagcucucuccuccaaggaccgcucuucccagugagcaggccggggcuugagcagccuccuuccugagccgccaacucuccauccucccaagaucccugcuccaggguccacugccuucccagagccagagcuccuaaagccccaucaucugcuccccaagacccugggccaggaaaacccucugcugacacagcaaggaucucgccaaggggacagaccgcccuggggagcaggacacgccaacucccacggcuaggggugccuccucagugggguuguuuaccugaacuccaggcgggcagacaggcaggcgcccccagccuccaugaccagugguggcccugaggcauccccuguaacagcaggcuggaccagagaguguggccccagacacccagggaccuagcccagcucagccucaggcccaaggcacggacaucccugcucagagagcaagaggcggccagagggccucagggcagggcugcacauccccggaagccacugcgggacacuucaacucacacccugcuggccccaugcggucauggccacacuugucuugagggaagacugggagggguugucaucccagguggccgugugucccauugcaaaucugggugugugggggcaaggaugagggggaaauggggauucagagagggagguaggcauauugggauaggagacagacaguucuccuggcugcccaucucgggggcaucccuuuucugccaaucccaguggccccaggcaucgacggggaggaugcagaggcaggggcagccugcggcccucucccgccccggcuccagcacccguagggcccugaguccagggaaggcugagcaugugcgguucucauugucaccggcugggcaggccaagugcucagcgagcuuauggcccagguuuugugcaaaucuuguucgacugaguguguauggcccaugggaagcccuggcauuugggaggcaccuaacccugggaugagacacaaaucuugcacgccgagcccgacagcgcagccccugaugucucugcccuccaggaagcagccccauuuccuuucuccagcuggcccgagacaaaugcucacgcuuccucugcacugcuuccucaugcccuguccaugcccgcucugaccugugcccuccaccagggaaaaccgcggguuuuucccugcacagggggcugcaggccaggccgggcuccacagggcagauugaggggcccgcauguggccaagcacccccuccccugggcuccugcauggagguucccagcucccagagaaccuuccgggccacaauuccacuaggccuggcuuucaccaaauccaggagucacucaugggccuggagggaggaaguggcuaauuuugcaacaggccuggcauggggcauugaauuauucaacaacagaugcauuuagcaguuuuauuucugucucgguauccucagucccgcccaacaggagcccagcucuggcaggaggggcagguuggcaccucuacacagcggcugggagcauggagaccacucacccgucaccugccacaaaccacuagucauggaggguggacucccaggccacagacugaccaggacucagguaagccauauuaccacccaugcagagacugacccugaagggcugcugggccugacgaggugguucugguuccaugggggugggggagagugagagggcauucagaaacaggaaucaggcggugccagcugccuccccaggaagcccuccaguggcaaccucuggcucucaauucuggcccugcugccaggaacaguaggggcugcccccuuccccaccccacgucuccuccuuuuccgugacagucacacccaaggugcaucccacaagagccacaucccaugccuggcuuuugucccugcugcccccaacccaggaggcacguagugugugccuggcaccacgcugggcuccaggggugcagagacagauaacagacacagggagagagaaaauaaaccguaaaugaacacauaaaaccaccaccaauggggaaaagagaaagggugacgucucggggagaggcagggcaagagggcugccccaggagcuggugugggaucugaaucggguagagagcuagggacagacccugcaggcagagaaaacugcacgugcagaagcccugaggcauggccuggucugggccaggggagcagagugaugggcagggagauucgcucacacugugaucggaggaaggccacgcccaggagugcaucugagcgugccagccuucccaggaccuggaggcaggcucuggccuagaaucugcugcuaaccagagaagcaucuggccugggccucagagaccagcuggaaggaaggguggaacaacaccagugcggcuucaauuucacggacauugcccagaagcagagaaagcccaacauguuagccuuguuuguuccuuugagaaagggccugguucugacacccagacuggagugcaguggcacaaucugagcucacugcaaccucuacuccugggcucaagugauccucccaccucagccuccaggguagcugggacuacagaugugagccaccacacccagcuaauuuuuguauuuuuaguagagacgggguuucaccauguugcccaggcaggucaggcuggucucaaacuccuggccucaagcaauccacuugccucagccuccccaaaugcugagauugcaggcgugagcuaacauguccaacaaaccuuuauuuauuuauuuaaaaauuuuuuuuuuuuagacacagggucucguucugucacucaggcuggagugcaguggcaagaucauagcuugcugcaaccuugaacuccugggcucaagugaugcuccuaccucagccucccgaguaguugggaccacagguaugugccagcacacccagcuaguauuaauauuuuaauuuuuuuuuuuagagauggggucuugcuauguugcccaggcuggucucgaacuccuaggcucaagcaauccucccacuuuggccucccaguguacuggauugacaggccugaggcaccacgaccgaucccaauuagccuuuaaacaccaggaaaccaaagucagaugccaggacauaucuaaagagagaggcagcccuggcagugggucuguucccggcugucacuugucaccuccaugggcauuucccaagccaggcugcaucacgccaccauuggccggccccgccaggguucccuguccacaccucccaguccacuuggcucagccagcagccgcccagccccgcuccccacccccggaagccccucuuuucuuucccuaucccaggacugucuccuggcccagucccagacaguucacagcugaggaggaacaaagcagaggaaagggacguggcgugacgugcugggagugaaacgcugacaccuccguggccaucugggaccacgaccugcacuacugcccucacacccggaccuggagcugccacuuccugccugcuucccagaauagcugggcucauccucugagcaggcugcccugccuuccucugucucugcucaggacagagacuccuccuaggacaccaaacaccccccacacagcacagacccagccucccagccaacggccacucacuggagcaaagggagccaagucuggcuuuggacaggaagaugggguuugccaggcaaggggugcagagaugcugaacuugaacauggaggggaaacaaugaugaugccaagggaaggggcccugggauccuaccagacccuaccccaaaguccgaagccacucuucaugaaauaauaugugauauuaaaaacuuaaauuuucaguuucaugaaacagcaaauaaaagccuugagauaguugcucucccaaccugugcugugugcuuuugguaacagaguccuucccccagggacccccaaauuccccaguauggggcauguguuguacuaauuucaagaccucuauuucacccugagcaauagcuccuccuccaggaagccuuccagauugcucagucaaaucccaugcagacucugcacacccuugcccagggcugugccccuuccccacggcccucauccagcuggagcucuacauucuucguuugccucugugacuguagggugcccuccagugcccacaagggccaggcugugugcaucaggcacauggguguggagggagcaugcauucaacugugacuuuccuuagcccuccucaagccuguaugagagcaggggaauugauggcuuucuuccuaaaaagcuuaguucaacagucuuucccaucccucccauucggggaguuucuauagaggaagccagguggucacugccaucuucaaggauucccugggggucucugagcaacaacaggauaucugggucacccacacccucugugcucugagaagcccaccugcuagucugggagucuggguccuggugggucccagccccguacauggaggcugggacccugccccgaaaccucucaggugcgaacacccagcugguuauaucaucacccucucugcaugacagaugggacacuccacucaggacccacacuccuccccaugcagagcagccaggccucgggagcuguguccugaccugaggugcaguguccagggcacugucuggacagugcuccccaaagcuugcccugccaagcccagguuccaggacaaugaugggcuccuggccuaaagucuuuccaagacauaucuccgccggguaacggcaagucagacaagccaguaugguccccacaggagcccaaagacccuuggugaccaccauggguugguggagguugugguaccucaaacaugcaugccuaguguuugcaaaccucaccuucagcagcagcaucccugggaaaccccagcuccacugccguggggccaaggcaacacagaccccugcuggggcccaggccagcucuguggggccgagcuggguguuugugucugagagguuucagggcagggucccagccuccauguacggggcugggacccaccaggacccagacucccacauacguguguggaauaaaacucauaaccccacaucaccaagucaaggccaguuccaaaaccucucaggagggcucaacacagaguccuuuguucuuccuccauugccccuguggaggcugcaggacacccaaccucccggacuugccuuccuugcccucagccuccacagcugccaucacuuggcccuugcccucugcccuuccacccacccaggcuacaggaggcccugucuagccccugcgcucaugucauuuacacacugacaccuccccuaacuugugagcccagcccgcacucucuccccagagcucccaccugcaggucuuacugccuucaacccaccucaccuggcugccucacaaacaccuccaaaauaacauguccccagcuggacuccuucgccccaacccugacccaugucagaaacagaaagugcauccucccaggugcgaggggucccagcagcauccuuuucucuuccucccgcugcacccgccaccuuaucuaccugcaaacccuguuuucuacagcagugguccugacuucucacccuuccuucaaacccucuagagcaaaccacgccgucccaucccacagccaccucagucacagccuccugcgcaucucguguccugcccgaugaccccacacuccaugcuccacuuagaggccagaggggccucgugaaggccccagccaguggggugaacuucuaaggaagaggucucaggccacucucugagaaaagauuaccuuagaucaugcacaagagcaaacuccaaacggacaaggagcuaaaugcugaagacaagaccccaaaccuccagaagaaaacacaguggauuccccuuaaccucgguggaggaaaaagcucucaacuguggcccugaauccggagucaguagaaagaagcaugauaaauuugaugauauaaacaugcgaaauuucucauagcaaaaagcaccauaagcaaagucaaagacaagugaccagcugggaaaacaauucacauuaguccagacaaacguucccacaauauaaaugacuuaaaaauugagagaccaagaaccaaaaacccaauggaagaaguuggaaaugagaagacagacgauuuacaaauacacacacacaugacuuuuagacacagggaaaacauucaaauucaauguaauuacagaaauacagauuaaaacaaagcuauggaccuggcaaaaaguggugugacagcacgcugcuggcgcaacuguagaaaaaaccgguaugcucaugcauugcugggggagugcaaaugugcaaccguucugcagggaaauuuggucacauccaacaaaacuacgggcuucucuuucagcccaacacucccauuucuaggaaucuacccugaagauaacaccuccaacaauaggaacauccauaccuacgaaguuauucuuugcaacauuguuucaagaauacaauagacauauguauaaggcuauacuuugcaacauuauuuaucauugcacaauaucagaacaaccuaaaugcccauaaauaggagaggguuugaauaagcauggcacauccaaccauaaaguaugggguggcuguaaaaaagaauauggaaggaccccacgaacugauauguaguggucucuaggaaauacuauuacgugagaaaagcaaauucaaaaaguucacguauagucuuuucgacaaaugauggugggauaacugaguaucuacaugcaaaagaauaaagcuggauauaaaaaauuaacucaauaugggucaaagguauaaauguaagaccuaaagcaauaggaacacauaggagaaaauagaaagacuuuggauuugaggaugauuucuugaauacgacauugaaggcacaggcuccggugaacagugccgcaguaaacguaggagugcgcaucugucccugcuggacugauuuucuuucuuuuuggauauauaacuagcagugggauugcuggaucacaggggcuaagcacguggacaaauuaaauuuuaugaaaauguaaagucuguauaucaaaaggugauaucggcaguggcagaauagauaaacaugauccagcuacaugcugucuacuagagacucgcguuagagccaaagacacaaaaagauugaaagugaaaggguggaaagaguggagaaagagguuccaugcaaauggcaaacacaaaaagcagaguggcuacacuaacaucagccaaaaaugguuuuauaauaaaccuagaaaggucacaagagacaaaagaggacgcugcacacuuaaagguucgaggcugcaagaagauguuacagauaaccauuauaaacauuuaugccucuaacagcuaacgaucaaaagacacaaaggaaaaauuuacagaaccgaagggagaaauaguucuacaaugauggugagagacuucaguaccacauucucuauaaugaauagaacaaccaggcagaagauaaguuacagaauagaggacuuaacacaauaagccaccuagaucuaaccaacaugcagagaacacucgacccaugaccacagcaugcaugugcaucccaagugcacguggaaauguucccaggagagaucaggccacgaauuaagucucaaaguacucaaaaagaugccagucauacaaaggaucuucuccaacgauaaugggauaagcuuagaaaucaauaauagaaguaaaauggaaaaauuaacaaauguauggaaaugaaacaacauacucuuaaccaaugaaucaaagaaaaaggggggcagagggagagagagcaucagaauaaauaguuaaugcauguagggcuuaacaccuaggugauggguugacaggugcagcaaaccaccguggcacacauuuaccuacguaacaaaccugcauguccugcacauguguccugggacuuaaauuaaaaaaaaaaaaaaucagaagggaaauuagaaaauacuuaaaugcaaauaaagaugagaagacaauguaccaaaacuugcugggacacaacaaaagcguuacuaacagaaaaauugauacccauaagcucuuuuucuuuuugcuuuuuguggguacauaguagguguauagguuuaugggguccaugagauauucuaacauagacagacaguacauaauaaucacauagagguaaauggggguaucuacuaccucaaacauuuaccccuugucuuacaaacaaccucauuauacucuuuucgucuuauuuauuuagagacagucucacucuguuacccaggcuggagugcaguggcgcgaucucagcucacugcaaccuccgccuccugaguucgagugauucucaugccucggccacccaaguagcugggauuacagguguaugccaccaaguccagcuaauuuuccuguuuuuuguagagaaggggguuucaccauguuggccaggcaggccucgaacuccuggccuuaagugagucauaugacucggccucccaaagugcugaaauuacagcugugagccacugugcccagcucucuuuuaguuauuuuuaaauguauaauuaaaucauugacuauagucacccuguugugcuaucaaauaccagguuuuaaucauuuuucuauuuuuuuuuuguuuccauuaaccaucucuacuucccucacaacccccacuacccuucccagccucugguaaccauccuuuuacucuaucucgaguucaauuguuuuaaucuuuaucucccacaaauaagugagaacaugcaaaguuugucuuucugugccuggcuuauuucacuuaauauagugaccuccaguuccauccauguuguugcaaaugacacguucucauucuuuuucauggcuaacuaguauaccguugcguguauacacagcauuuucuuuauccauucaucuguugauggacacucaguuugcucccaaaucuuggcuauugugaauagugcugcaauaaacacaggagugcggauccuucucugcuggacugauuuucuuucuucuggauauauaacuagagugggacugcuggaucagagguagcucuauuuuuaguuuugaggaaccucgaaacuguccuccacggugguuguaguaacuuacauucccaccaacaguguacaaggauucccuuuucuccacauccucacuagcauccauuauugccuaucuuuuggauaaaagcuauauugaccaggguggggucauaucucauuauaguuuucauuugcauuucucugaugaucagugacguugaguaccuuuucauuuauuuauuugucauuuguuuuuuuauuauuauuauacuuuaaguuuuaggguacaugugcacaaugugcagguuuguuacauauguauacaugugccauguuggugugcugcacccauuaacucgucauuuagcauuagguauaucuccuaaugcuaucccuccccccuccccccaaccccacaacaguccccagugugugauguuccccuuccuguguccauguguucucauuguucaguucccaccuaugagugagaacaugcgguguuugguuuucuguccuugcgauaguuugcugagaaugaugguuuccaguuucauccauuugucuucuuucgagaaaugucuauucaggucuuuugcccaucuuuuaauuggauuauuagauguuuuccuugugcgguuguuugagcuccuuacauauucugguuauuagucccuugucagaugggcacuuugcaaauauuuucucccauucugcaggcugucucauuguuuccuuugcugugcagaagcuuuuuaacuugaugugaucccauuuguccauuuuugcuucgguugccugugcuuguagggauuacucaagcagucuuugcccacuccaauguccuggagaguuucuccaaugucuuuuuaguaguuucauaguuugaagucuuagauuuaauucuugaauucacuuugauuuguuuuuuuuauauggugagagauaggggucuaguuucauucuucugcauauggacauccaguuuucccagcaucguuuauugaagagacuguccauuucccaaugcauguucuuggcaccuuugucaaaaaugaguuugucguagacauauggauuuguuugcuggguuuucuauucuguuccauuggucuacgugucuguuuuuaugucaguacauacuguuuugguuacuaugacucuguaguauaauuugaacucagguaaugugcucccuccaguuuuguucuuuugcucaggauagcuuugacuauucugggacuuuagugauuccauauaaguuugaggaguguuuuuacuauuucugugaagaaugucauugguauugugauagggggugcacugaaucuguagauugcuuuagacaauacagacauuuuaacaauauugauucuuccaguccaugaacaugaaauaucuuaccauuuuuggguccucuucaauuucuugcaucaguguauuauaauuuucauuguagagaucucucacuucuuugguuaaguuuauuccuagguauuuuauuuguagcuauuuuaaaugggauuacuuucuugauuuguuuuucagauuguucacuguuggcauauagaaaugcuacugauuuuuguauguugacuuuguauccugcaacuuuacugaauuuaucaguucuaauaguuuuuuuguggggucuuuagauuuuuccaaauauaagaccacaucaucugcaaacaaggauaauuugacuucuuucuuuccaacuuggaugcccuuuauuuucuucucuugucugauugcucuagcuaggauuuccacuacuguguuaaauaacagugaugaaagugggcaucuuugucauguuccaggucuuagaggaaaggccuucaguuuuuccccauucaguauguuacuagcugugggucugucauauauggcuuuuauuauguugagguauguuccuucuauaccuagguuuuugacaguuuuuauguugaagggauguggaauuuuaucaagugcuuuuucagcaucaauugaaaugcucaugugguuuuguccuucauucuguugauacgauguaucacauaaagugauuugcauauguugaacuauccuugcauuccugggauaacucccacuuggucaugaagagugaucuuuuuuaagguguugcugaauuugcuuugcuaguauuuuguugaggauuuuugcaucaauauuuaucagggauauuggcccgugguuccuuuuuuuuuuuuuuuuuuuuuuuuuuuuugauguaucuuugucugguuuugguaacaggguaauacgggccuuguagaugaguuuggagguauucccuccuccucuauuuuucauaauaguuucagaaggauuaguauuaguucuugaaaucuuuggcagaauuuagcagugaggccaucaagucucaggguuuucuuuguuggaagauuuuuaaauuacagguucaaucucauuacugcuuaguggucuguucagguuugcauuucuuccugguucaaucuugguagguugcacaugucuaggaauguauccauuucuuccagauuuuccaauuuauuggcauagaguugcucauagcagccacuaauuauccuuugaauuucugugguaucaguuguaaugucuccuuuuuuugucucugacuuuaguuacuuggaucuucccucuucuuuucuuagucuggcuaaagguuugucaauuuuaucuuuuaaaaaaaaaaccaacuuuuuauuuuguugaucuuuugucuuguuuucuucacuucaauuucauguauuucugcucuaagcuuuauuauuucuucuacuaauuuuagguugacuuacucuugcuuuucuuguucuuuaagaucauuagguuguuuacuugaaguuuuucucuuuauugaugcaggugcuuuuaacuagaaacuucccucuuaauacugcuuuugcuguaucccacaggauuuuuauaaguucugggguacaugugcagaacaugcaguuuuguuacauaggcauacacgugccauggugguuugcugcacccaucaacccgucaucuacauuagguauuucuccuaauucccucccuccccuugcccccaccccccaacagaccccggugugugauguuccccucccuguguccauguguucuccuuguucaacucccgcuuaugagugagaacaugugguguuugguuuucuguucuuguguuaguuugcugagaaugaugguuuccagcuucauccgugucccugaaaagaacauaaacucaucuuuuuuuauggcugcauaguacuucacaguguauaugugccacauuuucuuuauccagccuaucauugaugggcauuuggguugguuccaagucuuugcuauugugaauaguggugcaauaaacauaugugugcaugugucuuuauaauacaaugauuuauaauccuuuggguauauacccaguaaugggaucacugggucaaaugguauuuggguucuagauccuugaggaauugccacacugucuuccacaaugguugaacuaauuuacacucccaccaacaguguaaaagcguuccuauuucuccacauccucuccagcaucuguuguuuccugauuuuuuaaugaucgccauucuaacuggugugagaugguaucucauugugguuuugauuugcauuucucuaaugaccagugaugaugagcacauuuucauauguuuuuuggcugcauaaaugucuuuuuuuugagaagugucuguucauaucuucaaggagaacuacaaaccacugcucaaggaaguaaaaaagacacaaacaaaucccacagguuuugguaaguuguguuuccauuguaauuuauuucaauaaaauuuucaauuuccuucuuaauuucuuccuugacccucuggucauucaggagcauauuguuuaauuacuauguguaugucuguauaguuuccaaaaugucucauuauuaacuucuaguuuuauucuguacuggucagagaagaugcuugauaguauuucaauuuuuuagaauguuucaagacuuguuuugugaucuaacauauggucuauccuugagaaugagcuaugugcugaggagaauguguauucuucucuuggaauugcuggaugaaauguccuguaaauaucuauuagguauauuuggucuacagugcagauuaaguuagauguuucuuugaaauuguuauaucgucuugcugaauugaucccuuuaucaugauguaaugaccuucuuugucucuucuuauaguuauuaucuugaacucuacuuugccuaauacaaguauagcuacuccugaucuuuucugguuucuauuggcacggaauaucuuuuuucaagcccuuaauuuucagucuauguguauuuuuauagguugaaauguguuucuuguaagcaacagauaauugggucuuuuuuugugggggcagggguccauucaaccacucugucuuuugauuggcaagguuagcccauuuacauuuaauauuauuauugauacguaaggacucacucuugccauuuuauuauuuguuuucuggugaagauauucucuuccuuuguuacuucccuucugucuuccuuuuagugaaggugauuuucucuaguggcaugcuuuaauuucuugcuuuuuauuugugugucugccauauguuuuagaucugagguuaccaugaggcuugaaaauaucuuacaacucauuauuuuaaacugaugaugacuuaacacuaauugcauaaacaagcaaaaaaacaaaaucaaaaauucuacacuuuacaucuggcaagauggcagaauaggaagagcuccagucuguagcugucagugagaucaacacugggugauuucugcauuucugacugagguaccaaguucaucucauugggacugauuaggcagugggugcagcccacggagggcacacagaagcagguggggcaucgccucaccugggaagugcaaggagccgggagaccucccucccccagccgagggaacugcaaacaugcaguuugcaugcaguugcugcacccaucaacccgucaucugugauacccgggacugugauacccggccuggauacuaugcuuuucccauggguuuugcaaucugcagaucaggagacuccuucaugugccuauaccaccagggcccuggguuucaagcacaaaacugaguugcuguuuggacagacauugaacuagcugcaggaguuuuuucuguaccccaguggugccuggaaccccagcaagacagaaucauuuacuccccuggaaagggggcugaggccaggaagccaaguggucucacucagugggucccacucccauggagcccagcaagcuaagaaccacuggcuucaaauucucacugccagcacagcagucugaaguugaccugggaugcucaagcuugguggcgggaggggcauuugguauuacugaggcuuuaguaggcgguuuuccccugauagugcuaaggaggcugggaggcuuggacugggcagaauucaccaaagcacagcaaagcagcugaggccagacugcuucucuagauuccuccucacugggcagggcaucucugaaagaaaggcagcagccccagucaggggauuauagauaaaacucccauuucccugggacagagcaccuggagaagggguggcugugggcacagcuucagcagacuugaacucuccugccugcuggcucugaagagagcagcugauccugacaagggggauucucgcagcacagugcaugagcucugcuaagggacagacugccuccucaagugggucccugagccccaugccuccugagcaggcaagaccucccaacaggggucaacagacaccucaaacaggagagcucugguuggcaucaggcuggugcccuucugggacaaagcuuccagaggaaggaguaggcagcaaucuuugcuguucugcagccuccacuggugauacccaggcaaacagggucuggaguggaccuccagcaaacugcagcagaccugcaggacugcaggcuugacucuuagaagaaaagcuagcaaacagaaagcaacaaaaucaacaucaacaaaagggaccccccacacaaaaaccccauccaaaggucaucagccucaaagagcaaaggcagauaaauccacaaagaugaggaaaaaccagcacaaaaaugcugaacauucuaaaaaccagaaugccucuucuccuccaaaugaucacaucuccucuccagcaagggcacaaaacuggacggagaaugagacugacgaauugacagaaguaggcuucagaagguggguaauaacaaauuccucugagcuagagaagcauguucuaacccaaugcaaggaagcuaagaaccugauaaaagguuacaggaacugcuaacuagaauaaccaguuuagagaggaacauaaaugaccucauggagcugaaaaacacagcaugagaacuuugugaugcauacacaaguaucaauagccaaaugaaucaaguggaagaaaggauaucagagauugaagaucaacuuaacgaaauaaggcaugcagacaagauuagagaaaaaaugaugaaaaagaacgaacaaaaccuccaagaaauaugggacuauaugaaaagaccaaaccuacaauugauugcuguaccugaaagugacggggagaauggaaccaaguuggaaaacacacuucaggauauuauccaggagaacuuccccaaccuagcaagacaggcuagcauucaaauucaggaaauacagagaacaccacuaagauacuccucaagaagagcaaccccaagacauauaauugucagauucuccaagguuuaaaugaaggacaaaacguuaagggcagccagagagaaaggucagguuaccuacaaagagaagugcaucagacuaacagcaaaucucucugcagaaacccuacaagccagaagagagugggagccaauauucaacauucauaaagaaaagaauuuucaagcagaauuucauauccagccaaacuaagcuucaugaguaaaggauaaauaaaauccuuuccaaacaagcaaaugcugaggcuugccuuacaagagcuccugaaggaagcacuaaacauggaaaggaaaaagcaguaucagccacugcaaaaccacaccaaaauauaaagaccaaugacacuaugaagaaacugcaucaacuaaugugcagaauaaccagcuagcaucaugacgacaggaccaaauucacacauaacaauguuaacguuaaauguaaaugggcuaaaugccccaauuaaaagacacagacuggcaaacuggauaaagaguuaaggcccaucagugugcuuuauucaggagauccaucucaugugcaaagacacacauaugcucaaaauaaagggauggaggaauauuuaccaagcaauggaaagcaaaaaaaaaaaaaaaaaaaaaaaaagcagggguugugauccuagccauuuuuuuuaauuuuauuuuuuauuuuuuauuuuuucugagauggagucucacucuuuugcccaggccagacugcaguggcgcuaucuuggcucgcugcaagcuccaccucccggguucacgccauucuccugccucagccugccgaguagcugggacuacaggugcccgccaccaugccugacuaauuuuuuuguauuuuuaguagagaugggguuucaucguguuagccaggauggucucgaucuccugaucucgugauccaaccaccucagccucccaaagugcugggauuacaggcaugagccacugcacccggccaagauccuagccuuugauaaaacagacuucaaacuaagaaagauaaaaaaagacaaagaagagcauuacauaaugguaaagggaucaaugcaacaagaagagcuaacuauccuaaauaaaugcacccaauacaggagcaccuagauucauaaaacaaguucuuagagaccuacaaagagacuuauauuccuacucaauaacagugcgagacuuuaacacuccacugucaauauuagacagaucaaugagacagaaaauuaacaaggauauucaggacuugaacucagcucuggaccaagcggaccuaauagacaucuacagaacuuuccaccccaaaucaagagaauguacauuguucucagcaucacauagcacuuauucuaaaauugaccacauaacuggaaguaaaacacuccucagcaaaugccaaagaauggaaaucauaacaaacagucucucagaacacaguacgaucaaauuagaacucaggaugaagaaacucacuaaaaaccacacagauacauggaaauugaacaaccugcuacugaaugacuacugaguaaauaacaaaaucaaggcagaaauaaagaaauucuuugaaacaaaugaaaacaaagagacaacguaccagaauuucugggacacagcuaaagcaguguuuagaggcaaauuuauagcacuaaaugcccauaucagaaagcuagagagaucugaaaucgacacccaaacaucacaauuaaaagaacuagagaagcaagagcaaacaaauucaaaagcuagcagaagacaagaaauaacuaagaucagagcagaacugaaggagauagagacaugaaaaacccuuccaaaaaaaucaaugaauccaggagcugguuuuuugaaaagauuaacaaaauagacugccagccagacuaacaaagaagaaaagagagaagaaucaaauagaugcaauaaaaaaugauaaaggggauaucaccacugaucccacagaaauacaaacuaccaucagagaauacuaaaaacaccuccaugcaaauaaacuagaaaaucuagaaaaaauggauaaauuccuggacacauacacccuccaagacuaaaccaggaaaaagucgaaucccugaauagaccaacaacaaguucugaaauugaggcaguaauuaauagccugccaaccaaaaaaagcccaggaccagacggauucacacccaaauucuaccagaggcacaaagaggagcugguaccauuccuucugaaacuauuccaaacaguagaaaaagagggaccccucccuaacucauuuuaugaggccagcaucauccugauaccaaaauuuggcagcgacacacaaaaaaagaaaacuucaggccaauaucccugaugagcaccgaugcaaaaaucuucaauaaaauacuggcaaacugaauccagcagcacaucaaaaagcuuauccauggugaucaagugggcuucaucccugggaugcaaggcugauucaacauauguaaaucacuaaacaucacauaaacagaaccaaugacaaaaaccacaugauuaucucaauagaugcagaaaaagccuuugacaaaauucaacaucccuucaugccaaaaacucucaauaaacuaggaauugauggaacauaucucaaaauaacaagagcuauuuaugacaaacccacaggcaauaucauacugaacgggcaaaagcuggaagcauucacuuugaaaaccagcacaagacaaggaugcccucucucaccacucccauucaacauaguauuggaaguucuggccaggacaauaaggcaagcgaaaaaauaaagaguauucaaauaggaaaagaggaagucaaauuuucucuguuugcagaugacaugauuguauauuuagaaaaccccauugucucagcccaaaaacuccuuaagcugauagccaacuucagcaaagucuugggauacaaaaucaaugugcaaaauucacaagcauuccuauacaccaaaaauagacaagcagagagccaaaucaugagugaauccccauucauaauugcuacaaagagaagaaaauaccuaggaauacaacuuacaagggaugugaaggaccucuucaaggagaacaacaaaccacugcugaaggaaaggaaaggacacaaacaaauggaaaaaaaauuccaugcucauggauaggaauaaucaguaucaugaaaauggccauacugcccaaaguaauuuauagauucaaugcuauucccaucaagcuaucauugacuuucuucacagaauuagaaaaaacuacuuuaaauuucauauggaaccaaaaaagagcccauauagccaagacaauccuaaguaaaaagaacaaagcuggaggcaucacacuaccugacuucaaacuauacuacaaggcuauaguaacgaaaacagcaugguacugguaugaagacagauauauaaaccaauggaacagaacagagaccucagaaauaacaccacucaccuaaaaucaucugaucuuugaccaaccugacaaaaaagcaaugcggaaaggauucucuauuuaauaaauggugcugggaaaacuggcuagucauaugcagaaaacagaaacuggaccccuuccuuacaacuuauauaaaaauuaacucaagaugauuaaagacuuaaauguaaaaccuaaaaccacggaaacccuagaagaauacccaggcaauaccauucaggacauaggcaugggcaaggacuucaugacuaaaacaccaagagcaauugcaacaaaagccaaaauugacaaaugggaucuaauuaaacuaaagagcuucugcacaguaaaagaagcuagcaucagagugaauaggcaaccuacagaaugggagaaaauauuugcaaucuauccaucugacaaggucuaauauccaaaaucuacaaggaacuuaaauuuacaagaaaaaaacaaccccaucaaaaaguggguaaaggauacgaacagauacuucucaaaagaagacauuuauguggccaagaaacauauggaaaaaaaagcuaaucauuacuggucaucagagaaaugcaaaucaaaaccacaaggagauaccaucucaugccaguuagaauggcgaucacuaaaaaaucaggaaacaacagaugcuggagaggauguggagaaauaggaacgcuuuuacacuguuggugggaguguaaauuaguucaaccauuguggaagacagcguggugauucuagaacuagauucuagaacuagaaauaccauuugacccagcaaucccauuacuggguauauacccaaaggauuauaaaucauucuacuauaaagacacaugcacacauauguuuacugcaccacuauuuacaauagcaaagacuuggaaccaacccaaaugcccaucaaugauaggcuggauaaagaaaauguggcacauauacaccauggaauaauaugcagccauaaaaaaagaaugaguucaugucuuuuguggggaugaagcuggaaaccauucucggcaaacuaacacaggaacagaaaaccaaacaccauauguucucacucauaaguggaaguugaacaaugagaauacacggacacagggaggggaacaucacacaccgggaucuguggggagaugggggccaaggggagggagagcauuaggacaaauaccuaaugcauguagggcuuaaaaccuagaugauggguugauaggugcagcaaaccaccauggcacuguauacguauguaacaaaccugcacguucagcacacguauuccagaacuuaaaguaaaacaaaaaaucucuacacuucaacuuuugucucuccgcuuuuuaaguuuuuuugucucuauaucuuauuguacugccuauuguaccgcaaaaguuguuguagucauuauuuaucaguucuucuuuucauccuucuacuuaauauaugaguaguuuacacaccauaauuacaguguuauaauacuauuuguauuucuguguauguauuaccagugaguuuuguaccuucacaucauuucuuguugcuuauuaacacccuuuucuuucagauugaagaauucccuuuagcauuucuuguaagacagcucugguguugaugacauccucagcuuuuguuugucugggaaggucuguauuucuccuucauguuggaaggauauuuucaccagauauacuauucuagagcaaaaguuuuuuucuuuuuuuuccuucagcaccuuaaauauguccugccacucucuucuggcccauaaaguuuccauugaaaacucugcugccagauauaauggaguucaauuauaagucuuuuuuuucuugcugcuuuuaggauccuuucuuuauccuugaccuuuggaacuuugacuauuaaauaccuugagguagucuucuuuggguuaaaucugcuugguauucuagaaucuucuuguauuugaauauugguaucuuucucuagguuugggaaguucuauguuaguaucccuuugaauaagcuuucuaccccuaucucuuucucuaccuccucuuuaaggucaauaaaucuuagauuugcccuuuugaggcuauuuucuagaucaugcuucauucguucuuauucugucuccucuguguauuuacaaauauccugucuucaagcuuacuaauucuuuuuuguucuugaucaaugcuguuaucaagagauucugauacauucuucaauaugucagcugcauuuuucaacuccagaauuucugcuugauucuuauuuuaaucucuuuauuaaauuuaucugauagaauucugaauuccuucgcuguguuaucuugaauuugaguuuucucauaacagcuauuuuaaauucucucucugaaaggucacauaucucuuuucuucaggauuggucccugaugcuuuauuuaguuuguuuggucaggucauguuuuccuagauggucuuguucauuggugucuaggcauuaaagaguuagguauuuauuguagccuuugcagucugggcuuguuuguacccaucuuucuugguaaagcuuuccagguauucaaagggacuuggguguugugaucuaagccguaucugcauuaggcagcaucccaagcccaguaacacugugguucuugcagacucauaaaaauacugccuuggggccaggcgcaguggcucacgccuguaaucccagcacuuugggaggccgaggcgggcagaucaccugaggucgggaguucaagaccagccugaccaacauggagaaacccugucucuacuaaaacaaacaaacaaacaaacaaacaaaaauuagccaggcaugauggcacaugccuauaauccuagcuacucaggagacugaggcaggagaaucgcuuaaacccgggagacagagguugcggugagcugagaucacaccauugcgcucuagccuuggcaacaagagugaaacucuguuucaaaaaauaaauauuaaaaaaaauacugccuugguggucuuagauaagauccagaagaauucucugcauuacgaggcagagacucuuguuuucuucucuuacuuucucccaaagaaauggacucucucucuaugcuaagccaccugaagcuuggggaggagugacacaagcuuaccuguggccaccaccacugggacugugcuggucagaccugaagccaacacaucacuggguuucacccaaggcccgcuguaagcacuaccuggcuaccaccuauguucacucaaagccccagggcucuacaauuagcaaaugguaaagccagccaggcuuuuguccuucacuuuaggguggugaguucccccaaguccaagguggguccagagaugccauccaggagcaagggucuguagucaaagaccuuagaaaccuaccuggugugguauacuacagaggcuaagcuggcacucaguaguagcacaagacaaagucauacccagaauuccuucuccuuuccauaggcaaaggagccucucccuguggccaccaccacuacaggcccauaggcaguacugucaggcuaccaugguuguccacugaaggccugagggcucuucagucagcuuguggugaaggcuucuaggcuguggacucaccuuucaggucagugggcucccuucuggccuagagcagguccagaaaugcuguccaagagccaaggccuggaaucagggaccccaagagcccauuuggugcucuaccccacuguggucaagcugguaccugaagccaguauauuucagaaucucauucaaggcccacaggauacuaccuggcacugcugguuguucaggguccaagggcucuuuagucagcugaugaugaauucugacaagacuagguccuucccuccaaggcaguggauucccuucuggcccagggugugucuggaaauguccaagagccagggccugaaaugugugcccauugacucugcccaguguccucuccuacugugguugagcugguauccaagaugcaagacaauguucucuuuacugcuccaucuccucucuuuaagcagaggaaaagagucacuuuuguuucugugagcugugcugccugggguuagccacccuggcuggugucucacuagguugugugccccccacauccacuggcucugagcccaucucagcaauaggacuugccuaggaauugcaguuauuguggccuagacugccuuacaaguuuauuuagaaccccagagcacuuuagcccgugguggcaagguuuucuggaacucaguuucugaccccugagauaugugauuccccucuggcuagggcugguuuaaaugcucccucugugcugggugugggcugaauuuagccugguucugcuuucuguggcaacagggaaucacugagcucgauggacagucccaaagcacugcacuuucccucccccaagcucucagauucucucuccaugccacauagcugggggaugggaggcacagugcugucagugauucaguacugucucucuugcccucuucagugccucuuccagcaauauaaaguuaaaagcagauacugugauugcuuaucugaauuuugguucuuaugaaggugcuuuuuuguguagauaguucucaaauuugguguuccuguuggggaggacaauuggaggcuucuauuuggccaucuugcuccacucccucccuauaaauuguuacauuaauaaacaagaaagaucuccaguaaauaaccuaacuuuaccacuuaaggaacuagcaaaagaacuaaacccaaagcuagcagaagaaagaagauaauaaauaccacagcagagaccaacaaaauagagaauagaaaaacaauagagaaaaaucaauuaaaucaaaguugcuucucugaaaagauuuuaagaauugacaaaccuuuagcuagauggacuaaguaaaaaagagagaagacuacugaaaucagaagugaaaauagggacaugacuaucaauucuacagaaauaaaaaggauuauaagagaguauugugaacaauuguguaucaacaaauuggauaaccuagaugaaauggacaaauucugagaaacacgaaaccuaccaaaacuaaaucacaaagaaauacaaaaucuucauggaccuauaacuagugaggagauugaaucaguaaucaaaaaacucucaacaaagaaaagccuggaccugauggcuuccccaaugaauccuaccaaauauuuaaagaauaaacucccauccuucucaaucuuucccaaaaaauuaaagaggaggggaaagguuucuaacucauucuaugaggagagcauuacucugauacuaaagccagacaaagacuacaagaaaacuacagaccaauaucccuuaugaaaacugaugcaaaauucucaacaaaauagcaaacugaguucagaaacauaguuaaaguauuacauaucaugaccaugugagauuuaguccuggaaugcaaggaugguucaacauacaaaaauaaauccauguaaaagagcauauuaacagaaugaagaaauaacacucacaugaucacaugaucucaauugauacaaaaagcauuugacaaaauucaacauccuuauuaaaaacucucaacaaacuaggaauagaaggaaacuaccuuaacauaauaaaaaccauaugugaaaauccacagcuaacaucauaaugaugagacugaaauuuuucccucuaaggucaggaauaaggccagggugaccacuuucaccacuucuauucaacauuguacugaaaauucuagccagagcaauuuggcaagaaaaaaauuaaaagaaauaaaaggcauccagaauggaaaaaaaagacguaaaacuauuucuauucacagauaacauaaucucauauguagaaaccccuaaagauuccacaaaaacuuauuagagcuaauaaaugaagucagcaaaguuacagaaucuaagguaaacaugcaaaaucaguugcauuucuauaugcuaacaaugaacaaucuaaaaaugaaauuaagaaaacaauuuaauuuauaauagcaucaaguagaauacuuaggaauuaacuuaaccaaggagguaaaagacuucugcagcaaaacccacaaaacauuacugaaagaaacuuaaaaagaugcaaauaaauggaaacauaucccauguucauggauuagaagacaauguugagauaucaauacuacccaaagugauuuauagauucagugcaaucccucucaaaaucccaaugacacuuuuugcaaaaauagaaaaacccauccuaaaauucauauggaaucucaaggaacuuaaaauagccaaaagcaauauugaaaaagaaaagccaagcuggaagccuaacacuuucugauuucaaaacuuuacuauaaacuuacaguaaucaagacagugugacacaggcaaaaagacagacauauaaaccaauggaacaugagacagcccagaaauaaaccguggcauaaaugguuaaaugauuuuugacuaggguuccaagacuauucaaugagaaaaggacugucuuuucaacaaauggugcugggaaaacuggaaauccacaugcaagagggaagcuggacccuuacuucacaccauauacaaaaauuaacucaaaauggaucaaauaucuaaaugugcaacguaaaacuauaaaaaucuuagaagaaaacauagggcaaaagcuucaugacauuggauuuggcuaugauuucuuggauauaacauugauagaguucagauauuuguccccuccaacucucauguugaaaugugauccccagcguuggagguggggccuggugggugcuguuugggucauaggggcagauuccccaugauuagguaaugaguucaugcaagaucugguuguuaaaaggagacuggaaccuccuuucucuugcucccugucucaucauaugagacaccuacucccgcuucaccuucugccgugauuggaagcuuccugaggcucucgccagaagcaggugcuggcaccauguuucuuguacagccugcagaaccauaagccaauuaaaccucuuuucuuuauaaauuaccagccucagguauuccuuuauagcaaugcuaaauggacuaacacaaagaccaaaggcacaggcaacaaaacaaaaaguagacaacuuggacuucgugaacauuaaaaauuuuuguacaaagacacuaucaacggaguaaaaaggcaccccacagaaugagagaaaauauuugcaaauccuauaucugauaagggauuaauauccagaauauauagagaaguucuaaaacucaacagcaaaaacaaaccucucaauuuaaugaagugggcaaaagagcugaggagauauucuccaaagaagauauacaaauggcuaauaagagcaugaaaagauacucaacaucacuacucauaagaaaauguaaaucaaaacuauaaugagauaccacugcacacccacuagaauggcuacuauuaaaaaaccccagaaauuacaaguguuggugaggaugugguagcuacuguggaaaacggcauagugguuccucaagaaauuaaaacuauaauuaccauauaauccagaaauuccacuucuggguauauacccaaaagaauugaaagcagggcguugaaaagauauuuguacacccauauucauaguagcauuauucacaauagcuaaaacauggaggcaacccaaauguucaucaaaagaugaauggauaagcaaaauguggucuauccauacaguggaauauuauucagccuugaaaaggaaaaggaaauucugacacaugcuacagcaugagugaacuuucaggacauuaugcccaagugaaauaagccagucacaaaagacaaauagaguacucaaugaucccacuuuuaugaaguuccuggauuagucaaauccauagggacgaaagguaaaugguaggugccaggggcuggggaagagagaaugggggaguugguguuuaauggggauggaguuucaguuugggaggaugagaaaauucuagaaauggaugguggugaugguugcauaacaaaaucaauguacuucaugccacugaacugugugcuuaaaaauaguuaaaaugguaaauuuugcauuaguguaucuuaccgcaauuaaagaucuacaagaguauugauagugugcuucccuuuuuguaagaaagaggggauacaggaaaacacacguguauuuucucaucugugcgagaggccugcaagagagacaugaaaggcugaagagcugguuuuguccagggugggggggugggggauggaguggggagggaagggcuggcagggugggcgccuggcucuccucugaggacacucuuugugcaccucugacuccaggagucacagcagcuuuacauucccuucacacagacccccagauaaguaacuaaaaacaaucagaaucgggggacacccaaaauggaauaccaaccuaacagauaaaucuaaacaugucacagaugaaugacauaaucacacugaagggaguacagaaguaaagaaauacucaaagucaccguggggaaaagcacugaugggacgcagugaggcugaagacaagacgcgccgugcacagacgccaugcacaggcgccaggcucuggguggucagucacuucucaugggggcacgcaucagcaaguauggagccaguucccuugcagcugggguuggacgagcaggugaaggugagagagccagguuucucacuauugaagaaagguguuacaacaaagagagagaauuggccccacuggggcagaacuggaguuggagacaguaugagcccacucauguaugaauauaucugcagaugaacacagaagcguagacgugggggugccauacacauauuccccagcuccgucggccgagugggcgcagagcagcagguccacaguggcgaugagcacaccaugcacccaggccuggguuucuaaagaccacucuccaauggaaggaacccuggcuccuuggagaagugggugauuucaagacugaggcaaggaaauacaagcugagcccagagcaucuuggggugccaggaaggcaguguccaagaaaagacagggcccaccaaaggggcauggaagcugaauggaagguuguuucuggggcaaaagccagcacaauuugagcaaugaaaauaaauaaugaggcugggugcaguggcucacaccuguaaucccugcacuuugggaggccaaggcggguggaucaccugagguuaggaguucaagaccagccuggccaacaugaugaaaccccgucuccacuaaaaauacaaaauauuaguugggcguggugguacgugccuguaaucccagcuacucaggaggcugaggcaggagaaucacuugaaccccggaggcagagguuucagugagccgagaucaugccacugcacuccagccugugcaagaguaaaacuccgucucuaaauaaauaaauaaauggaggaaaauaaauaauaauagcauuggcuuauagcccauaacacaaaagaaguaucuaugaaaccaugcugauauacauaagccacuggauacauaaccagaacaaaggggacagcucuuccuggagaagaauccaaauuaacaaacauagaaagaaagugggaaauaaacaaauccccauuuggcaagcaccacagacuuugccugucacaagcaaaaccagcugaugggcacuaaaaucagcggggcaaaaucucaggagaaaaaaggcagcugcaaugucucaauguagcuuccucaagguguuuacuaauuaugaagcggaaaaugguuaauuuacagcugagaagcccagcugacacacuccuaccugaguggucaaggucaaaugaacccgcccuaagacaugcugaccucacacagcccugccacagggacuccucgggacccaacaacacucccgcgguguucuugccaaaaaugcacaaucuugaucuaaucaugagagcauaucagagaauccaaaccgagggacguucuacaaaacagccgcccaguacuuaucuaaaacaucaaggucacgaaagacaaagagagacugaggagcuggcacaggcugcaggacacgaaaggagaccuggcagcugaaagcaacguggggaucacagaacagaaaccggaugcuagaaaaacgcgggauuugaaucagaucugcaguugaguucacgguaauguaucaggugucgguuuuggucaauacaccccguuauuaagauguuaauacuaggaguccacaggaacucucaguacugucguggaacuuuucuguaggucuaaaauugcuucaaaacaaaaugauuuuuuuaaaguacagaagccaagagaggacugauguugucccucaucacucacaccccccgcauugcucucaggaucuuaacccucguggcccucccguccuaucuccagcaccuucccugcacaguucuucacaugcaccaagcacguucccaacacaggaccuuugcaugugccaugcccucugucugggugcucuuccugcagaagcacacaccacccacucccucaauuccaucaggucucugcugaaaucccaucuguguccgacuccccuccacaaaaggcacuccuucacccucccauuccucccugccuggcuccuucucaaggucuuacugcuaagagacacgcaccaugcauuaccacgccaugccgguccaugacucucuccauucucuugcaggucacuuccuggagggugacccucgugcuccacucacuccugguuuccccaacaaccuagaugacagucuugcugcugcaggugcaccaggggcaggugggccagugaauggguggcuaaaauacaaagagcucaacaaacauaaacauacuccccucacuaagaggaggaaggauauucuauuuuugcuucaucauaauggcaguguuuuuaugauaauacccagcuuuguggugcagugugggguggggguuggcggggggagucagugauguccagcagcacaguaggaagcuaaauuaggaaaacacucccggaaggugauuuggccaaaggugucagagccauaaaaaugcaggaacccuuugauccugucagucuucuccugcaaaugugacccaaggaaauaaucuugaguuccaggcaaaaaugaguguacaaggauuugcaucacaaugcuauuuacagcagucaauuaggaaauaacccagccgucaauagagaguugauuacguucaauaacacaggggaaaugccaggcagccauugaaaggucacauuuggaggaagaacagaugugagacaugucugccaugugucaaaagguaagaagauacaaaugaguugucuaguacccucucaauuuuaccaaguauuugcacagacacacauaggcaaguaugcacacacacacauauacacacacacacacgcagugauagggguuacccugcucagcacuuccugagcuggcaagaagcuaagggugcuggacaaugaguucauucaauccucaaaccaccauacgaggugagggcucccaucguucccguuucagagaugaagaaacugaggcacaaauucauaaagcaaacagccgauggccgugguccccaaccuuuuugggaccagugacugguuucauggaaaacaguuuuuccacagaccaguggugugggugguucugggaugauucaagcacauuacuugcauugggcacuuuauuucuacuauuauuacauuguaauauagaauuaaauaauuauacaacucaccauaauguagaaucagugagagcccugagcuuguuuuccugcaacuagacagucccaucugggggugaugggagacagugacagaucaucaggcauuagauucuuauaaagaggaggcaaccuagaucccucacaugcauaguuugcaacaggguacacaccccugugagaaucuaaugccgccacugaucugauaggaggcagagcucacgcgguaaugcgagugauggggagugacuguaaauacagaugaagcuucacuugcucaccugccacucaccuccugcugugcagccugguuccuaacaggccauggacugguagugcuucauggccuggggguuggggacgccuggcugauggccacacagccucggggaagcagccuagcuguagacgugcaacucacuccugacugcacuguguguguacacgcccuuaacacacacacaaagaccaaguagaaacaugugcaugcacgcgcgcacacacacacgccgagaaaaagacuagcaggaaacuaaaagcuggcaucucuggcuuuugguacgaugagucauuuuacuuuucuucuuuaaaaauuucugcacguucucugauuaacauuucugaacuuuacaaucagaaaaacugaucuacuaaaagcauuuucuuaugucuggugaggaguaacuggaauugucaucugcuuuggaugagaacuagugacaucacacaucgcaucaguucacugcagaagagaccaccacccguucucguggcuaugagugaaauccaacaugaugugguaauucucuucuaacuuucgauuuauaugauuucauuucaaacuuauagagaaguugcaagaauagcagaaggaacucccaaacgugcucugcuuagacuugccugcgguuucuacacugcccccguccugcuccauccugucccucuccagacuucccucuuuugguugaaucuuucugagcccuuggagacaccaugccuguuuucugcuaaacgccuccucauggauuucuuaggaauaaggguguucucuucuguaaccaugugguacuguugucaaaaucgggaaacaacacugacaugcacacuacaggucucuauugcacacuacaguucucuaccucacacucucacaucaucagcugcccagacacuggcuauugcagccaucucuucccagacaggauucaacucugauaugguuuggcuguguccccacccaaaucucaucuugaacuguagcucccauaauucccauguguugugggagggacccagugggagauaauugaaccaugggggcaguuucucccauauuguucucgugguagugaauuaagucucaugagaucugaugguuuuauaagggggaaccccuugcacucuguuuucauucucucuuugccagcugccacguaagaugugccuuugcucuuucuucaucuuccgccaugauugugagaccuccccagccauguggaacugugagucaauuaaaccucuucccuuuauaaauuacccagucucagguaugucuuuaucagcagcaugaaaauggacuaauacaguaaauugguacugggaguggggugcggcuguaaagauacccaaaaauguggaagcaacuuuggaacuggguaagaggcagagguuggacaguuuggagggcucagaagaugacaagaaaaugugggagagucuggaacuuccuagaaacuuguugaagggcuugaccaaaauucugauaaugauauggacaaugaaauccaggcugagguggucucagauggagaugagaaacuuuuugggaaguggauuaaagaugacucuugcuauguuuuagcaaagagacuggcaguauuuuaccacugcccuagagauuuguggaacuuugaacuugagggagaugauuuaggguauuugguggaagaaauuucuaagcugcaaagcuuucaagaggugacuuggguguuguuaaaagcauucaguuuugaaagggaaacagagauaaaaguucagaaaauuugcagucugaaaaugugauagaaaauaaaaacccauuuucugaggagaaagucaagcagccugcagaaauuugcauaaguaacaagaagccaaauguuaaucacuaagacaauggggaaaaugucuccagggcaugucagagaccuuaggagcagccccucccaucccaggcccagaggccuaggaggcaaaaaugguuuccuggacugggcccagggccuccaugcugugugcagccuagggacuuggugcccugugucccagccgcucuagccauagcuaaaaggugucaagguacagcuugggcuguggcuucagagggugcaagccccaacucuugguagcuuccaugugguguugagccugugggugcacagaagucaagaauugagguauggaaagcucugccuagauuucagagauguauggaaaugccuggauguccaggcagaaguuugcugcaggggugggguccucauggagaaccucugcuagggcagugaggaagggaaaagugggguuggagcccccaugcaaaguccccacuggggcacugccuaguggagcugugagaagagggccacuguccuccagaucccagaaugauagauccaucaacagcuugcaccaugugccuggaaaagcugcagacacucaaugccagccugugaaagcagccaggagggaggcuguacccugcaaagccagaggggcagagcugcucaagacuaugggaacccaccucuugcaucagcaugaccuagaugugagacauggagucaauggagaucauuuuggagcauuaagauuuaacugccccacuggauuucgaacuugcauggggccuuuagccccuucguuuuggccaauuacucccauuucaaauggguguauuuauccaaggccuguacccuaauugugucuaggaauuaacuaacuugcuuuugauuuuacaggcucauagguggaagggacuugccuggucucagaugagacuuuggacugcagauuuuugaguuaaugcugaaaugaguuaagacuuuggggcaccguugggaaggcaugauugguuuugaaaugugaggacaugagauuagggaggggccgggguggaaugauaugguuuggcuguguccccacccaaaucucaucgugaauuguagcucccauaauucccacgugucaugggagggaccucgugggagauaauugaaucaugggggugguuuccuccaugcuguucucaugguaaugaauaagucucacgagaucugaugguuuuauaaggggaaacccuuugugcucaguuuucauuaucucuuugccugucaucauguaagauguuccuuuguucuuccuucaucuucugcugugauugugaggccuccccagccauguggaacugugagucaauuaaaccucuucccuuuauaaauuauccagucucagguaugucuuuaucaguaauuugaaaauggacuaauacauaacauaguggaaucauagacucccacuuaggcaucacauuucuuccuuccccuucacccugaacgguacuuuauuuagccuucuacguuuuuuggcccuggcauuuucaaaguauucaggccacugugugugucucccuccauguggguuugcccugugucuccggaugauucgacccuggacagcugugucuuuggcaggaguucugcuaccgaggcuguccauccggaggguggugaagcuggccugucccauuccuggugauguuaacuuggaucacuuggcucggguggugucgccagcuuugccucuagaaagugauucuuuuuccuuuguaacuaguaagugguggugggagacacugagacuacaaccaccagcucuuugaaccccugccccugccacgggguuuccuugauggccuuccagcccuguugauucuaacgugagaacuggauuccuuucuuccacuuauuuguuuauauacaugggugugucccuguggaugcauagauucuuuuuucaugaauuauaauccauuaccacuguugugugugcauguguguauguauggucuuuuuuuuuuuuuuaauaaaaagagauggggucucacuaugucacccaggcuggucuccugagcucaggcaauccucccaccuuagccucccaaaguggugggauuacaggcaugaacuacugugccuagccuacauguguggucauuuuuaacacacuauggguuuagucugccaucauaaugaggauuuucauugcucucuguguacauaucacuggucuguaguuuucuuuucucucugcuagugaggcagcagagagaucacuuuguucacagcuaaccugggcacccugcccauugagccacuaacaugacuggcucucucaguagcagacggcauccuaauucaauggugggaagaaccuaggucaccgugggcuggaggcuuuuccagaaaaaacuuuuugaugacuuuguaaagagcauuuccuaccuuugaucccacauuaaaaauuguucaaacauacgggaugaaaacacuguccagugaaugcccauacgguaucuccauccugccuugaacacuuugccaagcauuuucaccacgugccaugucuccacauaucucaccugccaauguguucaccgucagcuguggacguucugaugaggguucagauucaucucacacauacugagauugucuccacuucuuccuaauuuugacuuaacauuuuuucccaaagaauaagccaucucacaacauuuuucaaauucacuggaguacaauuuuacaaaguacugucacauuaaaaacugggcugggugcaguggcucaugccugugaucccagcacuuugggaggccgagguggguggaucacuugugcucaggaguucaauaccagccuggccaacauaaugaaaccuuugucucuacuaaaaauacaaaaaguuagccaggggugguggcacaugcccguaaacccagcuacuugggaggcugaggggggaggagcgcuugaacccgggagguagacguugcuguaagccaagauugcaccacugcacuccagccugggugauugagugagacucugucuuaaaaacacaaacaaaacuuuucuaaaucgauugccaaagagccuucucaugucuaaauuuagauauauacuugggguuuuuccaugauugaaauuauaagauauauauuguuuuccucaaagaaccaagaaucaccucccaaaaagaacccucaagucuguuuuccuguuuccuauuauuuucuauucuuaucucuuauuuacauucacuuuucuuacugugaacuuuuuaacuuacauauuuacuuuuuucaaaaaaggaaaaugccuguagcuauaaauuugccucgguguacagauaugcauauaugccccuuuaauguucagaucuauuacacaguaauauugcugauguuuuuacuucuaaguagacuuuucuucuuuagacuuucauuaauuaaacuuguaauuaauaacauauauuuuaaacauacguugaaaucagagauauccagcauagguucuuaauuuuagaaugucuugaaguuuuugcagucuaguauaugaucaauguuugugaguguuccaggaacacuguaaaagguacaucuuuugcuuuuaaguuacaaaguuugauauaucuauuaauuuaacuauaucaauaauucagauuauuuuuguuuucuugaucuaccagagacucgaagaggugauuuaaauuuauauuuuccuuugcauuuuaaauaguuuuuaauuuauugucaguauuaguccguuuucacacugcugauaaagacauacccaagacugagcaaauguacaaaagaaagagguuuaauuggacuuacaguuccauguggcuggggaagccucacaaucauggcggaaggcaaggaggaccaagucccaucuuacguggaugguggcaggcaaaacaugagagagcuuguguagcggaaugccucuuuuuaaaaccaucagaucuuaugagacguauucacuauuacgagaacagcacaggaaagacucguccccgugauucaauuaccccccaccaggucccucccacaacacagggaauucaagaugagauccgggcagugacaaaccacgucacugucuucaugaaaguuacagcuucacagcugacuaugucuccagccauuuagaaucgcccuccuugcccuaauucuuugagaugaagguugaauggaaugucugcuaucuuuaggugugugugcuugaaaaucuuuagccauuuuuucauuuugauggcaucauacuuaauuuugugauuuucauaagcaacacacauuugaauuuguuuuuaaauccauucuaaguaucaggcuuucaggaaggagccucuagccacaacagccaaaggcagagacagcugcacguaguccauccacaccacagaccacuacucagcucagaaaggaagggaauucccuugcguguuauaacacggcggacagugaagacaggacgcucggugaaggaaaccagacacacagggccacguuugccaugauuucaggcacaugaaacauccagaauagcuaaauccaggggcagaaagugggcuugugguugucaggagcugggggcaugggggaaaggggugacugcuaauuuccucuugcggaugauggaaauguucaggaauuagaaagacgugucggacgccuagcacugcgaguaaaccgaagaccaugaaacauggguuaaaaaggucaauuuuacguuacguguauuuuaucacaacacaaacaaugcacaaaugcacaaaggucagcucugaagucgacgccugguucccaucuggcucugcuccucacuagcuaugcaccccaugccucaguuuucccaucuguaaaagggcccgauguggggcugugaugagguucccauaggcaagucccccaccgugagcaccaccacaccaucacaaucugcacuaauccaccuggccauggacaccuccuucucgccuuaaccuagucccaccagcagcauucccagcagguguggccaccccagcucugggccucucugggagcaggggcccaagcucucagcccaagcucccgccccacauggaacacucugacgcaagggccuuuugucugggcggugaaagagccuccagcugacgcaugaagucauaaauguuucagagaccugggcuccaccgcugccccucccuaagggcaccaaagccaccugugcugagccugcagccucagauggccucugcauuuaauggugccugcuaucugcagccacuuagggcccaucaucuggcggcugcuguuuugcucagcugcagacccaggaggcuucccacagggcucgggugcccacugcagccuggacaccggcacaucaggcaaagagacccacgugagccucacugcccuggcaucugcccuaggcucacccucgcccucuucccuccuaggaggugaacaaaguagcuguggcccgggcgccacaagagucaccacuggucaccaccaggagacucgaggacagcagaguggucccugagacccugacuacccccaacgcuucuugacggacccuggacacauccaguguccccagcacagccccauggugagcccucagugaggaaagccuguuucgaaagaaagacaaaaaaccacuccacacugggugauguguggagagaccacugggccagcgguaggaggcuggggccagccacagcccuuccccaagcagcagguuggcccggcugcccgcuuaccucccucccaagggcccugcagugccccguuccuggcaucaggccuauuuugcggauuuggugaaggaggauguccguuccgggaggcagggcucucccaggcucccaucuguggagggcgaguggugagcgcaugcggcugucugcccagcuggugccacugagcaauggccacccuggccagcgggccccauggcccuaccugugcagagcaaugccucccccagcugucgggggcuucaaccugcaggcugccaucuccaggaccugcccuggcucucaaugggauggaggaaggcucuuggcuggcagccccgcgccaggccaggccaacugaggcccagucccuccagaguucccugaggaugaugccggccgcacacccucgcucuacaagccacaugacacggcugagcgucugugccaugcugagcgcugucccacggcaggggacucaacgacggaccaggacgggaaacggccuugccccuuggauuucccagcacagacccuuuccuuucccaacccgcucaccugggagggcccagccccucacaucuccaaacaccagcucuccugccuccugcuggacgggacuccaggcaggacucacugcaccaugggccucaggucgaauggaagcccuggagguccccaacccucccugaguccccagcaagcccccaaccacuauuuucuuccauuuauuauacaaauauaggaacagcaauaaaugacaucagaauuaauggagcccccucccugccagccccaccccuucucuugccugcucuccuuggcccguccuggccucuccucagccacaggcagcagcuccugcagcuuccagcacaggggaguuaaucccauggacuugagaugggugggacccugugugccacucugcccagaaggcgcuccccacucagggacaugaucuggagggacaugggacagucuccuccaaugacagaggccuucauaugcaggcuucucccagccacgcccaccccaucaccaugagccccucugcucaugcccaucucggugcuggggugauggggggcccuggaguaucaagaagggccccagagcugcaacuuggcucagagccauggagucacccccaugccucugaggacagaaucacaucugccuccacccacagcaugguugcacuuuuuccucaaacaagcuggaguggcagggcugggcagcucuacuggguaccccuagacagggaaggagccugacaaugggcaggggcugacugaggucauagcaggcagggagcucaagucccuggccagcucccuaucccacagaccuacucacaucucacgcagccagugacucagaaagccccgcaugacaccccucccagacgcucugccuugcuuuuuucagugacagagaccaggacuccagcccacaaaguagcccaggccacgacccuccuucucuggguaaaggugcuucacccugagaugaagggaccagccucagccucuccaguucuuuccagcucugcccugugagggacaugcacacaugcauacacacacacacccauaggugcacacacacccagacacaaacacacacaccuauacagacauagguacacacacacccacaaacacacacagacaugcacguauacacacaaaggugcacacacacccacacauaaaacacacaccuauacacaugugcacauacacuuauacacaugggugcacacacacccauauauacaugaacacacacaccuacacacaugugcacacauagacaugcacauauacacacaaaggugcacacacacccauacauaaaacacacacaccuauacgcaugugcacauacacuuauacacauaggugcacacacacccauauauacaugaacacacacaccuacacacaugugcacacauacauaccuauacacacacaaccauacauacaccuauacacaugugcacacacacuuauacacauaggugcacacacacccauauauaugaacacacaccuacacacgcgcacacauacacgccuauacacacauaggugcacgcauacacacaccuauacacaugugcacacacacccauacauaaacacacacaccuauacacacauaggugcacacgcacccauacacgugcacacacaccuauauacacaugcacacacccaaucacaugcacacacccauacacaaguacacacacgcccaugcacacauacacacgcccaugcacacauacacacaccuauacacacaugcacacccauacacaugugcacacccaugcacacacccauacacauguguacacacauccgugcauacgugcacacacccauauacacaggugcacacgcacccauacacacgugcacacacacacauacacaugugccugugaggcugugauacugccaugcuuaggacccagagcugggccaucagcauccuccaaguccuggggaccuggugguguguggggcgagauggaucucgcagguccccugggucucuugacacuuuagugccguggagugucagaggcuguggcguugcugagcgugaaggacacuugggucaggguugggggugcagccaagagcagauggggagagggaggagggcgggagaagcaagcagcauuugggguacagcccugcugauccccacuugcagagcaacacagagguggggucugaaaaguuggggacccugaagccacaccaguuggagguucagaguccuagguccccgagucuggcugcaggaugauugcagccgagucagcccuuguuccccagccguugggagauaucgaugagaugaguugauacaggguggugagggcggguagaacucugcuguggagggaggagggccaucccagcaaaugugcuggaacccgcgggcagaaagggagccuccaccgacaccucccagcuggucagacauuaacucaaaaggaauauccaccucagugugaaaccugacacuacaaaauuucuggaagaaaacagaaaaucugugcccuugguuuagggaaagauuucugagagcaccaaaaaacacaauccauaagggaacaaguugauaaacuggacuucaucaaagucaaaacguuugcucucuaaaagggcacuauuaagagaaugggaggcugaggugggaggauugaucgagaccaggguuuugagaccagucugggcaaugagaaauaaaaauaaaauucuaagcacccccccccccaccuaacugaguggauccccacuuggccgagggaaccccagagaaacccuggaagcugaguucagggccaugauggaugugcgguuggauacguaucaucacacccccucccuugauaacugucauuggguuuucuucccaaagggcugaacagaaaccagccuuuucauaagacgccggcuugucuuccuucccaggcacagaacaaaggcgagacgagauaacgagauguucuuccgccucccugggauauacgcuuccaugcucccucuuuccuccaauauacgucuucuguaaaauguagauuuacugggcucuaacuaaagucucgcaaguauauaaucauuugucucacuugaugccccuccccuuuucaagaaaacauauaaauaugaaugaaaccuccuacgcaccucuuuggaaaaagcagccacagaugcuucugugacuggaguuuuuccugggcgugcccucacguuggcucaauaaaccucgaugauuugaggaguaugcuucaaguccucauuuugauugucagcgacauagccagaccccagcucuacaaaaaauuuaacaaucagccgggcguggugacaugcgccuguggucccagcuacuuaggaggcugagacgggaggauggcuugagcccaggaguuggaacugcagugagccgucauagcaccaagcacuucaaccugggcgacagagugagaccgcagcucuaaaaacaaguuguuuaaaagggccgggcgugguggcucaugccuguaaucccagcacuuugggaggcugaggcgggcggaucacgaggucaggagauggagaccacggugaaacccugucucuauaaaaauacaaaaaaucagcuggauacaguggcgggcgccuguagucccagcuacucgggaggcugaggcaggagaauggcaugaacccggaaggcggagcuugcagugagccgagaucgcgccacugcacuccagccugggugacagagcgagacuccgucucaaaaaaagaaaaaaaaaauuguuuaaaagaacugaaggacuagcaagggauaagggaaggcuucacagagcagguaucugauagaggacuugguccagaauauagaaacauguaacaucucggccgggagccguagcucaugccuguaaucccagcacuuugggaggccgaggcagguggaucacgaggucaggaguuagagaccagccuggccaacguggugaaacccugucucuacuaaaauacaaauauuagccagucaugguggcgggcaucuguagucccaacuacuugggaggcugaggcaggagaaucacuugaacccgggaggcagagguugcagugagccaagcaagaucacgccaccacacuacaaccugggagacggagagugagauucucucucaaaauaaagaaaaaaaaaaaaacucuugaauucaaugaaaaaccacccacguuuucuuaacagacaauuugacagacacuuuaccaaagaagauauguggacaacaacuaagcagcugaaaagaugaccccacacagugagucaccaggaaugccagggagggccccgacacaccuguuagauuggcuaaaauuaaagaccgaccacaccaaguguugacaaggagacagaggaacuagagcugucgcacggagcugcuggacugcaaaaggggauugcugcuuuagaaaacgguuugucaguguccuagaaagugaagcccucacccaccccaugacacagccguuccacuucccagcgggcugcagagcaguucaaccacuugcuugcacaagagaagcaaaagcauuugcucgcacagagacuccagcuauuccuagcaguaucauuugugagagcccaaaugggauacagccgcccacauguccaucaacaggugcauggaucggcaaaguaggcucuacccaaacaacaggccgacacacacaacagacacacagcucaaaaucaugacgcugaauaaaagaagccagacgaaaccagcguuggcugccagaguccauccaaauaaaauuccacaaggcacaagcccauccaucgugccugaugguagggcagcaguggccuggucguggggacagggggacgcugugagggugaugggugugcccacucugcugaugcuggcuucacagggccuccaaaugucaggacucauggaacugucugcuuuaaacuggggcaguuuaccguaugccaagcacgccuccguaaagcuacuuagaaaaaaaaagugcaugccuguaaucccagcacuuugggaggcugaggcaggcagaucgcuugagcucaggagcuugagacuagacugggcaauauagcaagaccccaucucuacaaaaaauacaaaaauuagccaggcgugguggugugcaucuguagucccagcuacucaggaggcugaggcgggaggaucucuugagccagggaggucgaggcugcagugaaccaagaucacaccacugcacucuuagccuaagugacagagggagacccugucucgaaaaauaaaaaauaaacuucugggaaugggccuguggccugugaaagguugggagcccaggagagacagugcauuuuccgggcacagucuaagcacguggcuaacagcccuuuaagaagcugcuguuaucccuauuuuacagaugggguaaaggaaaugcagaggcacauggccugcacccacagggccacugggcagguccccacgcugggccagcccaucagccucccugcccugucccuaaccagguggaaggcagugccuggacucggaggucacagcagccccagugcggguggcccaugccauccagcagugcccagcuccuacccugccccacaccuugaauccaccuggccugggucugcagggaagggaucaggggagcaaagggguccccacagcccccauugcaagacgcacgccugcuggcugugugcacugggcccgugugcccaggcauugacguggggggcaggugucucucaccucaccugggccaggcccggugggcagcagccuguccagcacaagagcaccccaacgccuuugccaaaccccagcucccagccuuccccagccugcacccugacgugaucucaauggucccaugugacucggauugugguucucagcagagauacaaaaccacuuccugaggcuguaucugucuccugguggcuucucagcugagcccccggccacaccauauccucugcagaagccuauaucaagccaggggaccagggccccacaccaucccuggcugcuccagggaagagggagcagccuccuccgugaggaccaaaaggguagaggccgacaccguugaagccaguccugcccuccuccugggccccugccucccugccggacaccaaggugccacgaagggcgcucauggcucagcccaccccauggagcccugugcaauggggagauaaacccagacccccucacagcccacuuccaccccugcagaggcacccuggcccucaccccagggaggcccaggcccucggaccugcugaccaacccugcccggcucuccagccacagcuugcuccuccgaccuccaggucaccuccugccccugccuggagugcccccaucugucgggcuuccccuggaaggcacucccucaggcucccacagcccccugcagcccagcugcccacaaacccaccccaaagccccuagacuguggccaggucaugcucacugcugcaacccagggcuggcccucagagcaggaggccagguguucugggagcgggcagaggagaccacagaggaagagcgcaggggccaggcccucgcucucuauaaacuaaaacuauuaugaucccuguuuccagauaggaugacugaggccaagggaggcuaaggaacauggagcucagcccuguucucaugaggacaggaaggcccucucccucugcccaccuggcaggaggcccccuggacaaggcuggccagcauaucugaagccuggccccaggcagcagccuggcagcaagcucuccugaggacuucuggccugcugauggcugugcccccgggcaaggcuggcaccacacagaagcccccgagccugggcagaugucagugauagcaucuugaaccccacuccacgacaggccagcaagggucagaaggcuguggcugccacagccagcaacaggggccagccccuugccccucuaagaaccacagccccaggcccaggaggggacccccagcacuguguucccucaaaacucacucucuucugggagccccccuccuccugcaaaguaggggacaaaccccagccuggggaggggaagucccagccaggacuucuccccccagcaagcacccaucaggcggggcucagccaugugucaccuccccuuuggagaucgcuucuccacucugggccucaguuuccccagcuacaaaauggggcagcugggccacagccugccugcaucuccucccccaacaacgaaggucacuguuccagcuuccucagcgacacucccuaggcaaagccucaggaaaacucaaaaacgucccugagcccccuggguggaugggcaggucccggcuaggacaggaagaagcaaugcccccauagccagcccgagaacacucaugcaggcccugaagggcgggccccugggagucgaccugagccgucaccaagcuccccaaggaaaggacagggcaggucaugagcccggcaggugcagccaggaaccaaccacaucuagacccgccuggcagcacacagcuccugccugccagccaggcuccaaauggccuuccaggaggcauggcuggagcccaccaaggcccaaggggagccguggaucuguaccauucauuguucccagccugcccggaacacaggcucuacccagagggacaccagacaaggccacuccuccguaaaccuucucccaggaagcucugggaagcaugcuggugggaggcagagcucggcgcccaccccuccccucuccaauuccacccccaagcaggcacugguacaaggcaccuagcgugagcaaggugugagaggggccagcacggggcaggggccggacagggagcucugcuacgcacaagcugugugacccugggcaaguguccacccucucaggccucuacccaaccaagacaagugacgagcucagaggagucucagcccuggugggggccgugguuccuccugacucagauccuggcuggcuggaccuuggaggaucaccuaaggccaccuggcugcaggaggcaguccgcuguggggacagugcacugcccaagagcuuccagcugcagccagggccucagggccucacaccuggacuggaggccagccuggcaggccuuggagaaggggucacggugccagcuugagcccaggaggucgcacugcagugagugaugacugugccacugcacucuaaccuaggcgacagagugagacccugcuucaaaaaaaaauaaaaaauaaaaaaacuucugggaaggggccuguggcccauggaagguuaggagcucuggagggacugcauuuucucggugcggucuaagcauguggcuaacagccccugaaggagcggccguuacccauuuuacagaugggggaaaggaaacaagagcccauggccugcacccacgggggcggccggggcagcucccugcacuggaccagcccaucagugcccagaguuggugcccaggaccccagagauugcugucuuacuuccucgggcaggaggacuuugaacuaccuuaacacacaggaaaagagaagagaagcgcccuguggacuccagcuccuuccaucucugggcagcuccccacagugggauccgccucagccccagcccaccuaggaggggucagcagagccacccuuuccuccucgcccagacuguucuucccaccagcaucccagaguccaacacggaccauguaauccuggccccugagagaagcuggaaucugccacacagaggcacugcccacccccccaacuccugucccccaggccuccccaaggacaggacaugggacucaugccuggugcagggcccaaugugggggcagcagccaggggccaggagcccaugggacccuagcaccauguggacccaggaccacagugcaccugcccccaccccggcacucuccuaggucaaaucacacucaauucauucagaguucucauccaugcgaugccagaagacacuccagggacuccagaauccucuuaccagccucuccucacuuauauauuuuaauuuaaaugaucuuuuauuauuuuuaaaaagcaauauauuuuuaauuagaaaauucagaugagcaaaaaugaaaagauuaaaacccacagcccacacccaggggugaccacgacgaaggcuuguuaucugcuguccgggccauuccacaccuggacguccauguguuccggcccagggagcgccugcggcccacugcguacagcuuguaucugcugauggcaagcaccguaguccacaucccugugccagucaggcccagucguucuaauugucccguggguccugcaaacaucccggcccugccuggauccaccgggcagcaucaguguccauuuuccacaguccugcucugcagagucagggccugucaccccgguccacgguuaucaaaccagacccaacugccgacagugagccugcugggcacggagcccucggugcugccucacaccguggggagaaccuucccccugauccaucagccaaacaaguccccgcacgggggcaucuacacaagcaccuacagggagccuccacgugguagcgggggccgggccauccggcuucagggcugacccccucgcagggcaaugucuugugaggagcagaggccgccacucugaaacucgaguugcacaaacucaggguucacaucucggccugggcacccacagaccuccccgagccccuguguguugagcucagcgcagugcccagcacagggaguacacccauaaacacagcugccccagccccagccccaguccccggaagaggcagggugcccagggcagcgugacuuugagguggcaggcagccugccaaaggggccacgauaagagggagguggagccuguccaggggaccgaagccaggaaggcuacagagccccccagccccgcccgccaccugcaccaaggacaaccagaacauuccaccacuuguccugugggugcugcgccuccgugcagcuguaccaggcuccuugagcagccgccgaucugggggauagagggggcaaauguauccucagcagaaaacagccucuaccuugcaggccagugagaacuucugaaaggccuucugcauuccugccuucugugucacccacuggcagguagggauuaggcucuccaggcacacaguaaagucaauggucccccaaggucacagccgggagaggcugagccagggacggagcguccaguuccccacucugaccaagcacaacccggaauccuggaauccaccccgucccccacuucccacuccccacacccugacagcagguauaucccugaaggaccccugaggacccccgacuggccccacuucccugggcccccugccgccgcugccccgcuuaccaguucaggggccucacccaagacucuuccacccaagggcccacagccuucccccaagacccucccugucugcucagcucacggggaagaaaccugaaccccaggcugggcacggcacauggacccagguuuggucccugucacucugggcugggccccgacucaccagcccagggagggucaagggucuacuuucugcuccucaaaccuccaggccuucccugcccccggcacccucuuugccugugguucuugccagcagcgcccacccuccccuucacuccaccgcccccuccccucaguccuggcccuccaagcugucuaagucacaggcagggucaaccccuaccaagagagcaggccccagggcacacagaagucagcagaaagcaccugcaggauggcgcaugggggugugggagcacgucccugccacucaguaacaggugggggccucacggggggcacauggugggaucaugacagcugcugcccagauuacagcgaggugguggcaaugucacaggugguucccgucaugccaggaagagauggugcauucuagaaaccagcggccuucgccgggagcccccaggcaggugucaagcucaggagcaggcccgucagagagaggaggcaagucagaaggaggaggaggcaagucagaggggguggcccuagacaucgccucugauggcgacgcugcccucguccacagccacacucaaguccagaggccugucuaccuugcaggccuggcagccccaagaacagccaugaagacccacccagcacccaccaauccagaacccaaaccaccagaaggcuccucccuggcuccuuggggcucuccaugagauacacccacagcaacgcccccucagcccagggaaggauucuugugaaucccagaaagacacaguggggcugggucucaucucuggacagcugcugggauggcggaaggagcagcaaugcaucccagcuguauugggacuaggcuggcugaguccacacucaccgagaggcccucuccagaccuucccccaggacagcagacagcagacagcugcacccagugggugcuggaagcagcaugccccauccauuucucucccugcccaucccuccguccacccaccccuuucucucuccacccacccaguacuucaucuauccagcuguccacccaucuacccgccacccauaacugaccacaauucagccccccauccaccugcccaucccuuccucugccuaucuguccacccccgggguaccuacuccaugccaggccccgcacuggcucaggaagcacaggcucuuucccaggguccacagcagccacaggccucaaauucccgagagccagaaaccuggaguugugggugagagcaggggccacguaaacaaaagcagccgugaucugggcugaguaaauccaggcccggcaccagugccauccuacacuccagacacacacaugugcaggcgcaaagacagugccuucccgggccucucacagccccaggccauggaagcugcaggggaggaagggaagaggggccacccccgccccggccggcucacccagucagcaggcuuaucuccuccacacucaagguucccuucccggacagagcuucagaggcuauuucaggaacgacagcaaccagacuacaaaucugcugcgaggcggccugagaagccauccucuccaaggcugaagaaaaggggggcaucagauggccccacaggccuucaaacagcccugcacaugcagaccgagccccacacaccugaucacaccugacccaucaccaggucggacaccgaguuccagccccagagacacaugaggacaaacucagagaggcaagguggcugcccagggccucucaacaccccaggcugcccccagccacggccauuggcucacagaucgccacuccuggacccaguggaggccaggagagugaggcccauccgacucccggacacccccggaaacccagguccugcagcaguaccacccaggacaggggccauccacaggaggccacacccccaugcagcagacaagaccgacaagagggccaccugcacaggcagcaacccucaaccagaagcagucacgccccagccuggggcaaagugcuccuccagaggcuugaagcagucuuuggggccagagagagaucuggucccccacuguggagacacaccuaccacccucucauaagggccucggccacagccacccggaugggggguugcucccacccagccccacugccccacaagagcggaguccccagcguuccccagcagugggcacagggcuuuggcaaaggggcccaugcaaauuugcgguccaagguccacuuacagcugggcugacagucccuguaccugagaggccuccaaaacacauggacacagacuggagccuuucuacugugggccuuggagccacaggaaaaaagggaaggagggagggagggagggagggaggaggccuguggaggccagggccuugagcugggaagcaggacugaugccacagaguaaacaaguaccuguacccgcagggccaccugggggcuugggcaccugcuccucccuuggggcauugcugcccuccaccagccacagagcccuuugaaagaccagggauaugggcgcaguaucuguccagccagagaaaugcaggccagcagcacaggcuccgccgcccugcagccacccugcccggccugcccacagagaaucaggucacgcagggacucacccugccccggaguccugcccccagcugggccacaggcugguaggggucugggcccuguugcaucuccggacaccucugcugcccaugggcacugcaagcaaggacucgagugaggggcccccuggggguggcagucaggacaccaaggccugucuggguuuuggaggaacugagcuuccacaccugcacuggggugcggcucuggagccuagaggagaaacagggguucacgucagcuacuauuaaauucaguuugucugaaagacugcgaaaccacacaccuuuucuggcuagcagauaaccacauuuaaaaaaaaaaaaauucuuacuaaaccaguccucugacccagccgcagguuuuggccaccugugcugcaugggaaggagaguggguuuuaagcagaagggaaucccugccugauuucacgacuccauucaucuaccucugagacccaggccucucaacacaaagggggaacucuuuguaggcaggagggcggagggggccuccgggguggucuggggggagggaccacgcccucacggucagccguucacccccagggccgcccucuacuguggacggaacaacaagcugacuugucccugcccgguuggcuuagaggaagucaguacugccagucgccacagugccacagccugcccccacagagggagcuacagacuggcagugaccccuacauacccuuaaaggaaccagagcugucucagacccgcacagcuccucauuaccuaagacagguaagccuucaccugcucccuccaagcccugcagugaggaacuacaugggguuguccucuaggaacccugauugccccccaccccugccccuguuauggccugaagucagggagugucacaugcaugcuuugucucugcccagcuccaggcaggccacacagucccuggacaccacgccccacauccuaaccucacaccaccgggcgccacggggcgcccagaggagacagaccacaguguccccaccaccgcgucccaaggaaguccgucucucguuuugcaguugagguaacauggccagcugggagcugggugcaaacucuggucugucugcuccagagccccauaaagccccugugccugggaaggaaggaagccauucacaaaagcaucccaacaaccccaaagccucccaacugggcacgggaaucagaaaugcaccauggcaggugcggcaugggcaaaaauggaacaugcagcaaaccagaaguaauuuaauccaauauuugucaucauuuauugaggaccuaacuaaggccauaugucacaauugguggauaggugauucuuuccuccuucucuccguuauuucuuggucauugacuuacugaggaaaucaggucauguguccuacagagccaucccccaccacugggauucugcaaguggccuccuguaguaucauuuagcgcguuccucuggcccgaguauuuccaguaaacuuguacuuagagcacgaggcuuggugagaucgaucgauccauccauccauccauccauccauccauccauccauccauccauccauccaggcaaggaagcauuguggaugggagcacuuucugugcacuguccgaaggccuuuacugcuuuggagagguuggcagcugugacgcugcaugcggaaucccugaccucaccaggagcuggagccuggcaggacuucagcagcacugccgccucaggcaucugcgggagucccaaagaaggacgcaaccccaucagcuacuggguuuccccgaguuacaguucacagguuaaucacgacugggacacaugucagauucucuccguuugcuugccaggauucaacaucaugagcggucucccuauugaccuccacagaucuuuagagaaaugcaaaucaaaguccacugguuuugccccucaguaucaggaugaacuugggaucugaaccccaucaaugcagcucauccacuuccucuguuauuuucagugaggcuuacccacugcaucuucagcuuggggagaagggggaagacaaggaccccuucaaguuccagugacauggcccuagggggccucugauaacuucccugccuucugcugugaugaauacuccaggcuuagcuugcacaucuucugccacagaccuggaauccgccaggggcccugguuucuuucagggggaaaugguaccuagaggccacagucuggggucuagagaugcucuuagcugcugagugguccuugguccugggccuuuccaggaaacagagauauuuaaguaaacgucauccuggaugcauacugauaguccucauucaaaugcagggauggaggauuuuugcguaaccucuucuaacuuacaucuguuuuuuuuuuuuuucucccaugccaaaaguuuccauuuuauucaacuuuuuuaauagguucaggagguacaagugcagguuugucacaaagguauauugcaugaugcugagguuuggaguacaaacgauccggucucccacguagugcgcacagcacccacagguaacuuuucaaaccuugcuccccuuccccccuccccacucuuguauuccccagugucucuuguucucaucauuauguccacauggauuugauguuuagcccucacuuauaauccaugagaccacgcaguauuugguuuucaguuucugcauuaauucacuuaggauaacgaccuccagcugcauccauguugcugcaaaggacaugauuuucacgucugcauaguauuccaugguguauauauaucacauuugcuuuauucgaucuaccauugacaggcaccugaguugacucaugucuuucugccaugaauguuuaggugcauaugucuuuuugguagaacgacuaauuuuucuuuggguauaaacucagcacacgggacugcuggaucgaaugguaguucaacucuugguucuuugggaaaucuccaaacugccuuccaugguggcuggacucauuuacacucccgucaacaggguguaaguguuccccuuucucuacugccucuccagcaucuguuguuuugagacuuuuuaaacaaaggccauucugacuggcgugagaugguaucucauugugacuuugauuugcauuucucugaugaucagugaugagcauuuuuucauguguuugacuguuuguaugucuucuuuuuaagaacugucuaccauaucuuuugcccacuuuuuguuuuuuuggguuuuuuuuuuuuuuuuuuuuuuuuuuugagaccgagucuugcucugucacccaggcuggagugcaguggcgugaucucggcuuacugcaagcuccgucuccuggguucacgccauucuccugccucagccucccgaguagcugggacuacaggcgcccacccccacgcccggcuaauuuuuuuuuuuuuuuuuuuuuuuuggauuuuuaguagagacaggguuucaccauguuagccaggauggucucgaucuccugaccuggugaucugcccaccuuggccucccaacgugcugggauuacaggcgugagccaccgcgcccggcccuuuugcccacuuuuuaaugggguuguuuuuuugcuuguugauuuguuaauucuuuguagacuuugaauauuaggccuuugucaguucaaaguuugcuaauauuuucucccauucuguagguuaucuguuuauucccuuggcagucucucuugcugugcagcagcucuuuaauuaggucccacuugugaauuuuuaguuuuguugcaauugcuuuugaggacuuauuagcuauauauuauuugccaaggccaauauugagaagacuauuuucuuccaggauuuuuucaguuuguaaucuaauguuuacaucuaaucuuuuuuaauuuuuuuuuuuuuguuuugagauagaguuuugcucuugucacccaggcuggagcgcaguggugcaaucuccugccucagcuucccggguagcugggaccacaggugcguaccaccacacccagcuaauuuuuguauuuuuaguagagaugggguuucaccaccuuggccaagcuggucucaaacuccugaccccaugauccacccaccuuggccucccaaagugcuaggauuacaggcaugagccacugugccuggccacgucuaaucugucuuuaauuuuuguauauggugauagauaggagucugacuucauuccucugcauauggggagccaguuaucccugugccauuauugaauaugaagucuuuuccccauggcauauuuuuguugauuuuauugaugaucagauggcuguagguguguggcuuuauuucugaguucucuauucuguuccauuggucuauaugucuauguaccaauaccaugcuguuuuggcuacuguagccuugaaguauaguuugaagucagguaaugugaugccucuggcuuaguuccuuuuuugcuauuucggcucuuuuuugguucuacaugaauguuagaauaguuuuuucuaauucuaugaaaaguggcauugguaguuugauaggaauagcauugaaucuguagauugcuuugggccguauggccauuuuaacaauauugauucuuccaacccaucagcauggaauguuuuuccauuucugucaucuaugauuucuuucagcaguguuuuguaacucuuguguagagaucuuucaccuccuugguuagauguauuccuggguauuuuauucuuuuugugucuauuauaaauggaauugcauucuugauuuggcucugaguuugaacaucauugguguauaagaaugcugcugauuggccaggcacgguggcucaagccugaaucccagcacuuugggaggccaaggcggguggaucacaaggucaggagaucaagaccauccuggcuaacacggugaaaccccgucucuacuaaaaaauacaaaaaauuagccgggcgugguggcagacgccuguugucccagcuacuugggaggcugaggcaggagaauggugugaaccugggaggcagagcuugcagugagccaagaucucaucacugcacuccagccugggugacagagugagacuccaucucaaaaaaaaaaaaaaagcugcugauuuuuguacauggauuuuguauccugagacuucacuuacaguuccagaaggcuuuuggcagacucuuuaggguuuucuagguauagaaucuuaucaucaucggugaagggagaugauuugaguuccucuuuuccuauuuggauccccuuuuauuucuuucucuugccugauuuuucugacuaggaccuccaguauuauuuugaauaggaguggugaaagugggcauccuugucuuguuccuauucuuaaggggaaugugucucgcuuuuacccauucaguaccacauuuaccauggguuugucauagauggcucuuauugagauauguuccuuugaugccuauuuuuguugaggguuuuuuaaugaagggaugaugaauuuuaucaaaaguuuuuuucuacaucuauugagaugaucauacgguuuuuguuuuuaauucuguuuacaugugaaucauauuuuguaaaaccuccauucuuggugauaccaacacaauuacuuaccuuaaccugcaauucccaugcagcacucuuagaauaauauaacaaauaguaucacaacaauuauguggccacugcaugcagcucuauuugucuucagcaguaacccgcuagaaauaugucaccugaaaucaguccuucugggugguuaagccacuaauucagcacacauuuuuaggcucauuuguuucauuucaauuuugagggacuacuuuuucugguuaagauuuauuuagggauuuuucaccaagcgauuacgaacagcuuuuuaaaaauuacgcaagcuauugauuuacauggcuucaaagugaaaucuauaaaaccagguacauucagaggcaucuugauuccauaugccaccuccccccccgccacccuuuugagguaaacuuuuaagauuuggaggcuuccauugcuuucguuuuuaauauacauccagacuugcauccuccccuuuaucagaugaagaauagcugcuauauuuuuauucacugugcuuuuucacuuaaaaagcauccugauacgccaggugugguggcucauaccuguaaucuaagcacuuugggaggcugaggugggaggacugcuugaggccaagauuucaagaccacccuugccaacacagcaagacccugccugaaaaaaauaauuaaauaaauccugauaaucacuucauaauaagagagaucuaugcauuccuuuuuuacagcugcauaauauuccacaaaucucugauucaaccagucuccuacaaugggcauuugcaguuuuccaaacaguacuuucacaagcagcccugcacacgcagcuucuccugccuuugccagugccuucagguagguucuggggaggggguugcugggucacaggucagugaagacaguuuugcuagauguugccaaaucccuuccucacagagucuacccucuugcaugccuaccagcaaaugccaaaggauuucugccagccagaagggaccucagugacauuuuccucgacaccccucucgccaggagugaaggcggcaccuucucacauguucaaggucccccugugggucacuguccugugagugguauucacaucuccugcuggcuguggguuuucuucuguuuucagaaacucuuucuguaguaaacagauuaacccuucgugaaacaucacaucuucccccagccuggcaauuggcuguuucccauuaagauuuuuuuuuuucccugagauggaauuucacucuuauugcccaggcuggagugcaacggcgugaucucggcucacugcaaccuccaccucccggguucaagugauucuccugccucagccucccaaguagcugggauuacaggcaugcaccaccacgcccggcuaauucuguauuuuuaguagagacaggguuucaccacguuggucaggcuggucucgaacucccgaccuaaggugauccgcccgccuuggccucccaaagugcugggauuacaggcgugagccaccgcacccagccaagguugcuucuuucuuauguggucaaacacauaaaucuccuccacgcaucuagcauucaagucauagaaaaguuucuucgcucucaggguaaagaauuccaggcgcuuucuuuagguacccaagugguuuucugacccacugggagucuauccuggugugugaugugacaagugggugcagucuggucacuuuccacauggccacccacccaccccgcagcacgcaugaagccgcccaucuguuccccacugguuggagaugcugccucuuuuacgaaacuucauauacaauggaguuacaugcgguuuuuaaaaagcuguuccauuggugaucugccugccuauaaggcaaugucaugcuguuuuaauuagcaaagcuguauguuuuauaauauuugagccauccuagccaagagcacagacgugacucuucacaagagaacagcuggagacgucacggaauagaaugccaagcccagggcccgucaagaucaaacgcuugaagcgcaugguucccggggcugcuuagauauagccagaggagguucccgccccgucuccagcugcuccccucuuuggggcaggguggggaugccucugggaggggucuaccccucucagucagagcuccuucugcucccuccucuaagcugcccgggcugcucugcguggaagucgaggacacagccccuggccccaggguggggugaggggucccagugcagcugggcugucuccaugcagaggagcauuccagggccgaagggaguacaggggugggggucccuguccagcugcucugccugugguuccugcuuucugaaucucuucaaaucucugccuggagcaaguucagccaggagccggggagagcuacucagagcacccuuucagugcgccccagaguaugauuuuggaaggcagcagagaaaggugugcaccuuagcagauauggagggaaagcuaagagcccccgcccccagggaaccugcacucucugggugagggcagccguagcucacccgcugccaggacgcaggcacagaccaaggcuuugagagccaacucucaaaggggacaguccucagggugcuuccugguggcaagugcuaggugggagugggggugcccauggauacaaacugggccugaggccaggaauagugcaccaccucacuugagaccacagcauccuaagggcuucugggcauccuaagggcuucuggguguccugagggcuuucuggguguggcaugagcaaaguggccaggccuaguugucucaucuguaaggcgacccaaauguccucaucugugaguggaggagcgaaauggggagcagagcccaggccccaggucccagagcgggcaggggccuguccuggagucagcuccccagcccggcucuuccaucaggagaaguuccugccagaggcggccaggcagaugccaacagacuccaggcggcucauccugagaguccggugccgaugagggagccacgacccuccugggagccuuucugcugguccauccacccagugccugggaccacagccagguccuuccagugcucagaacccuccaagggcaaugacagugccgaucccauggccccgagccucaauccucuaagacaggguucuccaaccccggguccguggccuguuagggagcaggccgcacagcagugagugagcgucaggugaaugugcacggccaccugagcucuaccuccuguuggaucagcgguggcauuagauucucacaggagcacaaauccuauugugaacugcgcacacaagggaucuagguugcacgcuucuuaugagaaucuaauaccugaugaucugagauggaacaguuucaucccaagaucaccacugcccggguggaaaaaucuuucuuccauaaaacaggucucugguacuaaaaagguuggggacugcugcucuacggggaacgguguuucugcagaagggcucaggcacccccuuggacccaccacccuuaaccuggauccuucuggaagcaccaugccugcucagauggaccccacacccugaaccaaacauuagaacuucccaggagauggucgagaagugggaagacaccugggucccaucauggaucuuccccaccuccagccagggccugcuccccagagagaagccccuccccagccagcacccacccacguggggcucccagaagagggcugggccaggcagcagaagccacacccuaucacauggucagaugccucguguaaaagcggcccccuggacuagggucacgcggcaucccuguggucacccagccaguaccagagacaccagccgccucccuuugucaaccacgauaauuuugcaucugugaggucugggguuucucauggugguuggaggagcugcuggagagagacagcuacccaccaggaagggguguggaggccaggacggucucaccgacgugcccgcagggaccccagaugcaagcagagcaugguguaggagcauccggggcuggagugacccacagugacagcaaucccauacuggccagccccaaggcaccucccgagagugaagccagacgcugccgcccuccccucuguaaccaaauccuuggggucugggucaaaguggcccaggauggugauauucauugccucauucuccccuccagcagcagauguugggcuucuggaagcuucucugcggcaucuccccgggccgacaccaugcucucccagcacuggccacacaccagcaacucgucuugggcaucugcugucucucagcucuuccugggccuggaauguucuccuggcaucaccgcccuugggagcugucuccucccacagaugccugagaugagauugucccagccuuguuguucuugcccguggacagagucuugaaucacagcaagauaucgcaggggccaaaagccaguuuggaaugucagggcuacggagggcucguccaccucccagacaaggcggguggaaugcagggaacugggggcccugccuagggccgagcaggggcucaggaccaggacgugugcaucugcaccuuggcuacagggaccgguggcauucccaucgcuggaaggcaugagcucccuggacccgcugcaucaggaccccugcgucaggaccagcucccuggacccgcugcccuguuaacagcaucccuaggacucgaggacgcuugcucgugugagcagcucuggaucacacuggcaaggacgucaagugcagaaggagcagacuugaaaccagccuagcagcaggaggggaauucucggcacccaacgccuuuaaaaacgggggcaucagccacccggguggaguugccuggcaaccccugucacucugacacccucggugggcacggugcuccugcccaucucagcugcccccaaaggcacucagcuccgcacagccuguuuccagcucuggagcacacauaggguggguuuggagcuguucacccuuccuguccucugcaagacgugccacaugccaggauggcacguggcagaacucauagcagcagcugacgugccagcucccuggcuccaaccaccugaccccgcacuggccggcccaaaagcaucccaggccuucaggcccagcggaaguucaucccaucgguacccaggaguguccccgcaaagccccucccucagacccggcccugugacacaacgcagcccgcacguuauaugcaaagguuccaguaccucgcaacugccaagcaaaaagggacccuccugcccccaguaccccaggguuguaggcucaagcugcgggcaccaugcccacagggagcuguggcuucagugccaggcacgggugaauguucccuccaaccgaggcacccugcacugaaggugccagcaccaggagccugccacagagaaugagacgcagacucagaaggcccaggacccuggccaaggcagcccagccacagggccaugcccagacacaaagcccugccaccugauccaugcccaccaggcacugcccaggccaccugcaaggacccaagucccuaccacccuccugauccccuguccccacacaggcuggggaggcccuuucucccaggcucuaggcucuugccaccuggacuacccccuccccagcugacggccagggguaagggaugccuguguuccccccaacuaguacgaagccacaguuaggcacucgacauguuggcaagagcggaucuagaaacacugggccgggucugcgauguaggugaggggaccccagacagccaggggaugagaccaagggcucaugccccacagaagguagcacugggaaaagccccaaaaggaauucccaguuuuccugggaaucuagggcugaggaguggguggacagaucuuaaagaagauggagagaaagagaccugauggcucagagagccccguccuccucugugcccagccccaccaccugccuuggccucuggccucccugcccagcugcagaacaacugcccagcagcugcuucagacuccaaugccagagccuggagauaggagggcacuggaguccacaaaguugggugcugcacccugagagcuggcucugcauggccuugucuuuuggggaggcagccagaucagccccauccaccucugggaccugcuucuggcuccauuguugauuaacacgcacccgcgaggguucugccaacaccccuggaaaguucuugggaaacagggaaagccaaggcuguaggagcggggaacaggggcugcugagccagacuuagguuugagagccuacaggggcagucuccaugcacugcagguccccccucaaaucccucuccuuggccacaaccaggaucuccaagcaucucagcaaccagaguagaugccaccuggauguccacaccccuggcuaaggcucacagcaagggagcuaggaccgcugggugcagcagggcuguauggacccccauccccucagcuaagaugggagcugcccccagugggggcgcaagcaaccacagauaacuggggguguugggggcaggaagccuaagcgggcaagaguuguggcccaggugccguguccaccccggccagcccagggaggccagaaggaacacaggaagagcugcucuccuggggaggggggguuccccgaggaggggacaggauauccuggcuggcuuccccaggcgcacacaggagaguucgcccuagcccuguagggucagcggaacaccggcuccugccucaaccccccugcacacaugccugggcccuggcucuucaaggccaggcuugucgucuucaggccagaaaccacaauauuucucauuucacaauccaccuaaggacagggcccugucuccgccaccauugccaagacuucuuacagcaacacaaggcuggacuggcgcaaggcuggaccugauuucgugaggcugcagguggccuccagcuacucugccauccugguucuaugaccaggucuccccucaagagacugguccugccaaccuccuagggcacugagggugggagcgcaucucccaggcccccaccaagccacauguccugcccagucaggguccaccuccagucccaccccacauggagguaccuggguuggaggcuguucaugacaacuucccagggccaggcacacgucuuacaaggacaggacccagaacuggaaaggaccagccccagaucuggccacuucacagaagcaucccuuuccuggccaccccuucacagaagccauccugccccuguccccagaagccaccccugccuugccagcucugcggaggcugggcgaagguagacucuugcugagcaaacuuccgagaccuaaacaauccaaaugaggaagaaaacacaagugcaagcagagacuuccucuggggcguggcgagcccucuuccuccucuuccuccacacggguggcugcagugagcccggaggcauguguccacaaaccugaauacaagugagaauugagggggucugcgggcacuuugccuuggccucuggcugaggaggucuucccacccuuggacaucucagagagucugggguccgggaggcagguggccaccagcacacagcaccugugaaccuggcaucugcuagacauuugcacaguggcaucggacuggguuccccuggggucacugcacacaaauaucucccaaaccccaagccgagcccccgcuguugcagccacgagcagagccagcuccucucacagaccagcagcggcuguggcucaggcacccacugacaugucaggagacaggggcuugggagcugggguggggaaaagucuccaagaucaccccccaaccacaucuuugaggagggagguggguaagacuuccccuuccugauguggaaggccaccucuuagcaaggaaggcaguagcccugcgaccccuaccccacccccucaccugagacgaugcuugaagccauuuggggccuggcuccugcugucacccgcccugaggcccugguggcagcugccagcaggcauggacaggccucuggaugcccuccagccaguucucuacugagccugcccgaggcagaggagaugcuuccaccugaggacgcucagggagaccacccuucagcccucaggugagccccacagccaucagccaugggaugucuggguagaggcucccaggccagaggcuggcaccacaccaaaaggccgcuggcugggcagccaggaaguagggccacuggggcagcgggggaaggccccaggcaggcauggaggagagcagccuggaccuucccggaggugacuucccaggccugucccugagaaauccagugcccagcccugcucaggcacgcuguaccgggaauuggaaccaccugguaacaggggggccaggugccucugcuaccagcgcugcuuucuccgggagcacagcugccucuuagugagagcugcaaacgugccucuccgcucucugcaucaagccagguuuucaugagcuugguucaauuaguuaauguggggcccguggggacggcccguggcaugcugagcccucagggagcaccgccaccgucaccuuccuauccuggacagcccccugccccagaguccaccugggccucagggggucugagaugcggcaccggacaucaggggccuucucucuugggggcuccugagccucgagucucagccgaccuugaggaguuaucuuacugcacccaagggugcgcuccccagcacgcuucucuucccagaaggauucacaccuggacuacccucccggagguguggagccaaauucugggcuccaggugguccccuccccagccggcucccuccccacgccgggccugcgagaagaugcgcacccccagacacagcagcgccucugaacuucaagggagagugcagaguuuguguuucugcguuuccccacuuccuucccuccucugcuccggggucgcagcuccgacggggcagguggcgcugggacagagcucccccacaccagcucucaggaagcaccuucgugccggccgucgccgguggcgauacucacacggcgaagugguaaacgaagcauuuccagccggugggacgcucgaggaaguuguagacgcggcccuggacgugggugcgcgccaacaccgggcggcgcgugcuguagauggagacgcgcgggucuaggcucaccggcggccgcgggccaaggucggaggcaacugggggcgcggcgggcgcggccggggacgcagggggcgcgggaccuggggcgccgggcgcgaugggcgcguagagcgcgccgcccgccgggccgcccuccgccagcuccagcgagaaggggcacuucuuggccaggcccgcgcugccccgccgggcgccuggcaggcggccccaaccccagcgcuuccucucggcccugggcggggaggaggccgcggccauaacgaggagggccugccggggggccggcccgagcggcggcaccgggagcugcagcgaaggcgagcgcccgggcgcagugcgggcagccacugcugccagccccgccgcggggggccgcug

SEQ ID NO: 15496 - RNA, 7339 nt, Homo sapiens
ucacccaaagacaaaguuaacauuuggaucuguuuccuucuagucuuuuuucugugccuguauuuuuaaaaaaauaaaauucaaaucccccuaucgagcaggaccacugacuagaaaggaggaugcugugcugaguuugauuccuguucucuugagagggugagacuuggcagccagcguccccagcugggguagucgccacgcccgaggcugccuuugccaucccagaccucccacuuuccuagaaaacaaaauuguuuuguucugcccugaaaauuuaggcccagauccuggccuugacaaagcaaaggcagccaaagaauuaaagcaucaaaaaccaggacugucuuaggaaagugugacuucauugucaccaggaugcugugcucuuuguccccagggccagccacucuaggcaguucagcaaagggcaccuggcauugcuccgguaccuccugcagagccuggauauccagaugaacugcccuuucaaguacaccaugggcucaaccuucucugcagcugugaguucaggcugugaaauacccacuucagaggugggggugacaagcaagaccuguuagggcacagcacuugcccucaagcccuggccugaaagaggcagcaccagugugucuggaaagagcugaauccccacccacccacccccagcuccccuccaugcucuccuagaugccugaccuggcuacgaccacaggugaaaacagggaagagguggcagcucuggucacugccucccugugguggagaaagcacgccccacagucuccaacacacaagccagcagacaauaaccucuccucuugaauuggaaaaacaaaucuguggaggccuucucugccccuuguuauaggggccccauaugccguucccaggauuaaaccaaaaagcacacauuccucucuggcaggugcaggucccacccacucugggcagccaacugaugugcacauuuuaauuuccuaaaacaccaggacagaaccuuccucaggggucagguggcucacccuuggcccucaggcuuuggagaugggcacuugucaucauggguguuuggaaagcaacucuacguucuagccugugcuccaucguuccuucuacauacaagugaugcaaacaucaaaauauguuuuuucuuucuuccuuccuuuaaaaaaaauugaauccuggaugaaguuuuagcucugucacuugacaacugcauuauauaaccuaggguacuugaaucucagccccaaaucucuaaaaugggggcaguaacaugcuucugccaggucccagaccugugggucuccaaaucugcacauucuucaagccuuacagguccuucccuggucucucuaaggaugucaugggcacagagcccuuucacucugagcccuucuccuggcugugacuaaguaaugucugugugguuuccugcuggaagucugccacucgcccccacgggccaugagcuccugaguuuauuuacauuucccugauugcuagucaggcgcaacaccuuuccacaugcucaucagccuuuuggauuccucuuuugugaugugcuacuuugucuauugcccauuuucuauuaagucauuuauauuuuuccuauugauuuguaggaguccuuugcauuuugugggcacugucuuuucacucuuuaagguguauuuugaugauugggucuuaacucuaaugucaaauuacucagucuucucucucaugguuauugcuucuuuuaaaaaaaaccauccuaaugcugaugucauuaagauauucuucuauauucagucaugugaccuuuauaguuaugcuuuucauaguuaggucuucaauccccuagaaugacaagaaugaauuuuugguauaugaugugagguaauuaaggguccaacuuaauguuuuuccaguguggguauccaacugcuccugaacauuugauugaaaaguccaugcucuucccaggaugugcaggccaccucugauacacagcaagcuuccauauuugugugggcuguuucccaaugcucaauccugucccauuggccuauuugucucucccugugucaauaccacauugcccuaaugaccacugccuuggaagaaguacugauguuugguacagcaaguucucccaccuuguucuucuucaagaauauugccaauucuuggcuuuuugcacuuccaagucgcaguuagaaucagcuugccaaaguucucacacagaagccuugagauuuuuauuaagauuuggagagauuuauucagauuuugagauaaucuuuucaguauugagucuucuagucauuggaaugaaggcauauuucuccauuuauaucuucuucauugucucuuacuaaaguuuuacaauuuucuccagaguucuugcauauacuuaguuagauaauuaauauucuuuugugcuauuguauacagguucuguuuucucuuguuaccucacauuuuuuauuuacagaagagaaacaaaaauaguaccgaguacccacaucccuuucaccagcuuccccuaauguuagcaucuuauauaaccaugguacauugaccaaaacuaaaaaauuaacauugguacacuauuaagcuagaguuauaaauuuauuuggauuuccccaguuuaacuacuaauguccuuuuucuguuccaagaucccaucuaggaucgaucauuacauuuauugucaucucugaucggugacgggcuucucagucuuguucuucauuaacuugacacuuuugaagaauaccagucaggugucauugucccucaguuuggauuugucugguguuuucucaggacuagaccaggguuauagguuuaggggaaggaggccagugaggugagaugcuuuccucauuguggaacaugacaucaacaugguuuaucacugguaauauuaaccuugagccacucguuuaaaguggugucggccaggcuccuccacuguaagugaauagcuguuuuucccuuuccauagcuuagucuuuagaagcgagucacuaaguauagcccacacucaagguggggaagggagggguucaacucuaccuccugcaggagaguaucaaaaaaaaucugcaaauauguuaaaacuaccacagcaauuaaaauacauuucaaggaagaaacugugaaguuucugaguuucacuaacuaauuucagcauucauucauggaucguuuuccugcagcaaauauuaccgugauguacuucuauuuuccucauuccuucuacauuuuuuauuuggaauuccuuuauaaggaagauuugucccucuccuccaauuguuuauuuaauuuuaucaguguggauuugggaguauuuauuuuuugaguuauaguccaauauuauuuauuuuguugcucaaauuguucaagcuguggccacugguggguucauguguccuuuugaugugccccccgccauccuuuucauuuauuuuuaagcauuucuuuucuagcacuugacaauacuucaggcucaucuuuuauuuucccuacccuagcccuagaaucauccauucauccagagagcccuggcucccuggagaaugaauagaaaaccuggaucuaggcacgggguaugcucguggcuacuaggguaucauugcuucagucuccucucaguggacagagcuaggaaauauauguauguauguaaccugaguacacauacaucuuuacauaucuguaucuauauaaagcuaaccaugaguucauacugacauuucugaccagaguucauccuugcccccucccccacaacuuauuuauagcuuuuucucugacagcuagaaaccuggcucccauuaccuacaguucauuuacuuauuuguguaacccuauuguacacguaguacccuaugugaagcaaauuuaccuacuagauuagaguguuuaggacagacuuuugcuuuaaccauagaguguccagucaaaacaguguuuuugaaagcaacauaugccagcuccuccuccuccuuuccuuucacugcuaugucauuuguuuguaacacgcucaucauagucugcuuuucaucguaggguccuccaacauccggguuaauuuuuuaaauuugcauacaguaaaauccacucuuugagauucaguucuguggguuuugacagaugucuggagucauguguccacaauccaguaucauucacagaaguuccauaccccuaaaaauacccuggggugagucuuuugaagucaaguacuucuccccuaaccacuggcagcuauugaucuguuuuaugucccuguaguuuuguuuuucuagaauguccuauaaaugggauccuauaauauguauucuuuugcaucuggcuucuuucacugcuuagcaaaaugcauuugagauucauccauguuguugcauaaaucauuaguuaauuucuuuuuauugcugggugguauuccauugcaugaauauauacauuuuguuuaugcauucaccuguugaaggacaucuucauuguuuccaguauuugguaauuaugagcagaguuacuauacacauuuauguacagguuuuugcgaacauaaaaauucaauucacuugggugggaaaggaaccgauaggucaugugguauguguauguuuaacuuaauaagaaauugcuaaacuauuuccuaaagucacugugccauuuugcauucccaccaguaacauaugagaguucuacauguuccacauccucaagagugguugguauugucagguuuugaauuuuuuuuuuaauuuauggaauuucauugugauucuaauuugcauuuccauauuuauguuaauuauguaucuuuucaugugcuuauuuauaauccauuuuuaaaauuggauuguucacuuuauugucaaguuguaagcauucuuuauauauucugagugcaaguccuugaccugauaggugauaugcaaauauucuuuccaagucugugcuuugucuuuucauuccauuagcagugucuguugcacagcaaaagcuuuuaauuuugauaaaguccaauuuguugauucuuuuucucuuacgaguuaaacuuuugguuucguauuucagaauucacugccaaauccaagguccuggagauuuucucuuauguuuucuucaagauauuuuaugguuuuauguuuuauuuuagauuuuuuuucaguaaguuuguauguaguacccuuuaaauuuucauuuucuaauuguugaucaucuguccuaucaggcauagauacuaaaugcauuaaaacuuuuacacacauacauauguauacauacaacacauucaaauagugaaauuaggaauaaauuuaagagagaauuguauuacgcugaugugggaaaaccuuccuuuuuuauaaagcaaaagauguaucacuuuaaaaacauaaaacauuuucuaggauaaaagcaacauaauucaggugaaaaaacagacuggggaagcuaucuaugccucauauaacaaggaguuaaugucuguaauguauagaaaauuccuacaaagugauaagcaaaagugagcaaaggacaugaacaggcaauucugcaagaggaaacccaaacagaugccaagcccauaaaagguauucaacacagauggaaauaacagcaaugccucaguuuucauccaugcuugauagucccugcaaaaggugcugacaaccuucauucgggcuucauucaacacuucauucaggcauggaugugggaaagcugggggagccugaauugcuacaacuucuugggaaagcaaucuagcaacauuuauuaaaauuacuaaggacacacccucucacccugcuccaguaugucagcuuuuaagaauaaagaugaauauggcaucauagucugaauaauuaagcagcuuaaaacuauaagagccugaauguccaugauauacagaaugguuagcuguggccaaucuaaacuguggacuauuauguaaugacuaaaauaauuaaauccaugccuauauaccuagagaaaaaugaaaugagcuuauguuacagagugacaggaacagagucacagugacaucccaugugcauaaaagcaacucccaccuggcaucugcugcucggaugagcagagagggugggcuagggaucuaguuggcaguuaacacugaugaccuugggggaggaaagccauugugaaucuuugaauuauuccacuucucacagaugaguacuuaauccuuuugcaauaaaauauuuaaaugaagacaaauauaagccaagagcaaauacugauagugucaacagagaguggggagugauaaggaucaguauccugagcuccugugucaaaguugcagaggugggcccaggaaucauaaugugaagccagcuguuggagggacuccugugccucauuggggguacaacugguugauguagcaucguguuuugaggaaggaguucuguggcugcccccaccucccaggcuugccauuccucaugggucagagguccuaucaccccaucuuuccugacccacuacucugucaauguaugagugugacaauguaugguggugggagcuguugucccuuaccaggccugugccugucaccucuguuuuauucuugacccaagugucaguugugaacaugggaagaggcccagaaccugagguggggagagucuuggacaccugagcacagccccaggcacaguuaccacuccgaagaugauucacuggccuuuauucuccucagacacugaggugucaggcacuuuggggccaucuuaaacacccacccaccccaacacccaacuauaaaacugauugucagggcuggagcuuccaggcacaagcuccacuccucaccuggcccugggagcucacaggccuggcuccacagcacuggcagguugggugggaggccuaacgugcuguccccacacuuucuccucaguaaggaagagcccaacacugcuggaagugagcaugccccauuucaugagaaccaacagcuucgccgaggaccuggaccuggaaggggagacucugcugacacccaucacccacaucucacagugagugccuacaugugcgugaagggcugggcuggaggggacuggagcucaaggagucagacuuggugcuggggaagccuugcucucuggccagagugcuaucuacucgccuagugcccaccacuugccgucugccuggccccaacacggaggcaccaggcaagagaggagagcaagggcacuucccacugagccugggaacaugauccucuuguuuugacuuauggaaaaccagacugaucauuuuccacuuguuuucaugcuuugagagucugaga

SEQ ID NO: 15497 - RNA, 2835 nt, Homo sapiens
guuggaacuacgugucagcugccgucccucagccaucuauggcaugggcaccuguggcuugaccaaguuggagguggccuagagaggccgggcugggccugcucaccuucuccaguuagugcagacugaugaaugagugguucucagcggauaccggauccagguuugcaguacacuccaggaggaggacgaguaggguuucccucagagcaggccuggaugggagggcaagggguggccucuaauacugccuuuccuuccggugccuuuaucagccugugccaugcuccucugaacuggccggccccagcauguccagguuacuggcaggagccuguauaacccaggguuccagucacaccagccaggaaggcccaugaggcuggagcgcacccagucucuggcugcucugucugcggaacuaaaagccuuucucccagagccuuuccuacggcugggcgaagcucuuguuugcaauuuaaauguggccucauuuauggaagaaucccugcuccuccgaaaagccuugggcucaaccucccuagcagcccgggccucagccaggagaagaaauggaucuaaaaggccuuucuccugcuaauuguagcaauuagcauuagagaauggggacucgauggggggccagcgccuggcaaaacaagcuuauucccagcuuaggcccaggcccagcuccacacacugcugcuuggccagacucggcccccacccagggucugguuggcuucagggcagggagagagggcccaggccugugggugcuaagagcaguuguggagggugugcaucugaguuguuaagccugguagcuguacagguagcccugggcuaugacuugugguccucucagaaaagggucugacuggaacgcagagccagaccagauauucaugaguggaucacagaguguagacugagggcuaucuggugauugacagaaaguagucuuggggcaaaugacucuuaaagaguaaggagccauuccccucuauggcuaacuggaugccuuucucucccccugcuccagaaaggacuuccuguuccuucacugagcgugcuugcuuaugaggcuucuggaaaccaggagaguucagugggccucauuauugagcguaugggcaggacaaccugcuugggacauaggccaugcuacaguugauuuuagccagcuugcugcaucuacacagcacagugccuucccaggcagugaauuaugucuaacaggcaggggaaugaucauugccucauguuagggaugcagucauucaagaaauauuugucaaacacucagcagguacuagacccuggcccagagggagggauuugauaggagcagggaccugccuacccucccaggguuaguggacaaaggggagaaagacuaacuaauguugaaggaccguuugcacccugaggggagugcugaggccugggagcacagcagguguauagcaggaacccacuggaacuagccuggggucugaaaaacucccuuggggaaaguggcaggggcaggccaagggcccucuggugguagggagccugugagcaccugggauggaaagaagccaagcaucugaacuaccagaaaggcagcugcaggauuaagcaagacccacaggucucuaaacuuugaaaggaugucuguccacugaguagauaauugauuggaauggggcaggggaugugagaaugccaguuaggagaugccugcaguacagagaaaugguggccuaucaggacaguggcaauagggauggagggaagcagggaaccucuagaacuauggaugggugaaguaagccuggcuuggugaugggcuugaggugaugggcagguggugaggaagcggguguaucggaaaugaccccagaacuucugacuugugccacugaaaggaugggugacacugaaaggacaggggccuucaguagagugggcuauaaaaugauggaggcuguggagaggaggugggggcaggugacuggaaugugggucuggcuggguuggagagacauuuggggggucagggccucacagguggucuggaagcccuuggugcugagggaacagcuuagggaaaugguuugcauagagaaaggcacuggcauuuaguggccaugccagaagggaaaaccugccaaggagacugaggauagagccagaaagauggcaagaaagccaggagaacuggagggauggaaaagaggaccuaggggucaugguccuggcagaggucacauuggauccagugcuugugauucucugauugcuggcaguggauggccacuggccugcaaauggcccuaguggaauguccccugccuguguggcucccugugggcugccucuccccuggacagauggggagagaccccuuccccaccugguucucuguuucacccuuggaacuguggcgguaaagaggaccuccccacaguacgugcagggaacaagcuagguugacucccucagggaggccucguccuugcugagguauuucauaaccucaggauagagaaauccccccaacuuuaaugcaaagccaagcaagcugaaaaauggccuugaauaggcugagaugaaaaaacaaagaggcugucaacaucagagacucagugggggcagggagcuucaguggacuccccacagacagcaguuccugggcuucuaugcccagacccagaggccugagcccaagaugucaggauggguggucacuguaagugcaguggauuguagcucaggggugagacaucgccuuuuucuugucagcucuccuuccugauuaguggcucaaacagccuuccgagacuc

SEQ ID NO: 15498 - RNA, 7165 nt, Homo sapiens
ccuaagagcaaucccacuuguuuaagaauuguuguuuaauacauauuauuggauucaguuagcuagcauuguacaaggaacuucugcaucuacauucauaagggaaauucuuuauaguuuucuugugcuuucuaucugaauuuggacaugcucugauucgcaauuuuaaaaaaucccucuagcuggagcauaaauccugaaacagacccacuuuucuccucagcauguuaggaaacacauuaaaauacacccauaaucaagcaacucaauccuuaaauuuuucuccuacugaguaucuggaaaacaggugcagaaauggaucauuugagacaccauagaaaucugguuaauccugccugccugcuuuccuucaaguacugacugaguaaggcuguguaucaggcucuuggcuggguacagagcaggcagcagaaaacaaaacagaguuccucguugggagcuuuuggucuagcaaaaggggcaccacaguaaagaaagaacugguaaaugcacaucaaauguggauauuaucaggaaaguuuuuauacuuugugauaaucuaagacagaacuauucuaccuggaugaauuauucucuuucauaaccagaacagugcugugggaaggcacucuuacucucaauuuuauauaaaaggcuauuugaccugcucagggaccacagugggguacugggaucugaacauagugguggcccuucaagccuacuacccagacugagaccugcaucugaucaacucucaucuccaauaugaccaagagacuucuaccacuaccucucaccuggcaggugaucaccacccccaacucagacugcaaccuuuacuucgcccccuaauuccugacucagaauccccaccuagaggcagaacuucgacuucaauuccugacucccauaccccacugagaccucuaaccccaaucccaaucucuuaacucagagccccccauucagaaccucuacccaaagacagacuccagacccugacuccagucgccaacucggaccucccuuggaucucaacucagagccaugaugcagacuccagaccgggauucagguccccaacucagacucccgauccucugucccuaaugaggcccuaccuaaaaccaccaugcggacuccagacccggacugacugggaccccaacuacucagaucccaacucaggcaaacucccagccaggauguggacccuagacccgaauucugaucccaacuaggauaccuaacucagaaccacaacggggauucccaccuccgauccuaauucgggcccugacucagaaccacuaaguggauuuccgacuccggucccaauucgggcuuugacucaaaaccacaacauggauucccaacuuccaucccaauagcgcggacucagaaccacgaugcggauuccagacuccaaucccaauucagcccacucugaaccaccaugagaacuauagacccggaauccgauccuugggacgcggccaggaacucggaccucgacccuggccacgcuguccauaaggugcagaugggagcgcacugcccaggccaggcugcacugcugacgccugugaucugggacggccgcggggcacacagcucaccucagcaacgccagugaucacccgucccgcgccguccgcccagguccgugcugaccguguucaaacccucccagagagauggggagggccgcgcugaggagagucugggagaaccgcacugaggagccgccgggagagugccgcgcugaggagcccccggggagagugccgcgcugaggagcccccaggagagugccgcgcugaggaggcccagggaggaccgcgcggaggagaaccaugcugaggagcccccggggagaacagaaccgcggcgagaggcccccggagagaaccgcgccgaagaacccccggggacaaccgcgccgaagaacccccggggagaaccgcgccgaaaagccccgggugccccgaggagaacggcgccgaggaguccccggggagaacugcgccgaggagcccccagaagagcgccgcgcugaggagccccgaggagaaccgcgccgaggggcgcgccggggagaaccacgaugacugacgcaccgaggaggaccgcgcugaggggcgcaccgggagaaucgugcugaggagccccggggaggaccacgcugagaggcaccccggcagaaucgcgcugaggggcgcccuggcaggaucuugcugaggagcucccuggagguccgugcugaggcgacgcggcgaccguucugccuggagacugcggcagcgcuccgacugcccccgccgcugccgacguggcgaccgccccccaccugcugauugggcggcagcaggggaaggcuugcggcgggcugcugcacggauuggcugggugcggaaagugaugugccguguccugucauuggccgaaagagucucguuuugaugccacccgggcucagauuggcccagcggguccagcgccgcaugaggcacuggcugggugugagguggcgcgagccgccgcccucccugcccccacccgucgucccugagcaccaccgggggccggggccagcgccagccucagcguuggcaucgccggggugagcuggagacacgggccaguucucugcgugauguguucaccaccccggggugaccgcgugaggacagcggccgcaccccgacacugcugugggcccucgguguggaggccugugggcguccaggccacgcccgagaccagccccuccgccggcgccgcugcagcgacccucgaacccgggcaaggucuccaccgccguggcaccgggugcgggaggcguuuuccccccucccagcggguccaugcaggggaucgggauguucugaagcccccacugcugugccuggaacacccgugucugccgcucaccccugaggacuugggaccucagggggugaguggcagggguggccgggacaugccaggccacccaccuggcaaagggcagcgccgagggcgccccgcgccugccagcgcccggccgggcccgcccugcccaccucccaucccccauccgggcgugacacuugaccgcgucugccggccccuccccuuguccguccccuccgcgccgcuggcgcgcgccuucugaaugccaagcauugccauaaacuccggggacaaaagccugggucacaaaagcccccucuagaaguucacacccugaggcuucccuggcaaggcugggggccguuuggcccuuccauguggacugcaaaaacaguguuggaaugcaggacucuggguauguucucgaaaguuguuacaaccccaacccaggguugaccucaaacacaggaggaagggggaggcuggagccagccaagcgagccagccguccccccaccaaggcacgcaaggaggccauucaucuucacugccucugccgaaaauauacgucuacgggagagccaggaaucucucuccaagggugaccggguuggggguuuuguuguucuucagcccagaagagaaagagaaaauggugucauuuuuucaggcagcaagugauuccuuucaggccuucagcaacgacgcccagaugaguccacucccugccuccugcucagcccacaggcaaucugggcacaagugacacauccccugggcgccugucccuucgcacuggcccagggaguucaugugucugaucagagggcgcaguccacccucacuaucuagcugggaaguuuuugucaucugccuguccgagaggcagcugugcaaccagugccaucacucagagccagugcucaggugcaccccagacucaggguuucacgcuauaaugucacugucuugaaauucuugauaguuacuaucuuugaacuuguguuuuagaagugaagucugaggggaaaauggagcuuggaacuucagcucccaaguggcuuucccaccuuccugccuccucaggacagauuaucagcugccugucugccugcuuccucugugcccagccucucucuugacauccaaaggaucacaacucccacucagugaccacuauuauucucugccccugaccaaaaagagcagggcagggcuggaguccugacccuggccuggacucugcaaugcagagauaccugcaagucucauuuccccgccuguaggauggaggugaugcugacagccucuuggagccauugagauaggaaacgagagagauuaugugagaagacagggucaggaauguugaguugaggguggccucaggccccuguccugcuccuuuuugcugcuuggggugcagcucaauuccagccucacuguggcccccaggccuccucuggccuuccucagccuuccucaggaggccagaauccuccccugaucacccucccugcauguccauuucuaccuccccaggaggucaggggagcaggaucccaggucuucagagucauuucacagauuucaccagaauaaaagucccacucaugugggguuuacauucuggugggaaagacagauuuucgaaacguggccauuuuucuuugggccuuuguuagcugcaucagauggaggagguagccugguggacuccuucaguccucgcucuuggacacagagcugucucccagccuuuguuguuguguucuccaaggaugucgaacacaggcugaaaagcucccuaaaucaauuucacuuaaaaugguguccacccuccuacuaaagagugacaaaggguguugguuaggauuuuuaucuugaaaacugauuuguaaagucaugaaaauugagcuuauuuggucuuacacuuaacaaaacuguggguucuaauugugggccuggauggggacauaucuuacaaguaguugauucauuuauauagauuuucauguucugggcuugccuccacccucuaccuaacccuggaaccucagaccccaagcuccugggcacuuggauuuuucccugacaaauuccccgccugugauauuccaugggcaccucaccuugugugcuugugugaggucuccuugaguacucuuagcagugggguugccaggccaaggagccugucacuauuguuugugaccagcucaccagacguggucaggaaggacaguucuguguccuauguccucugcuccucacccccucgccacacacggggugccgucaaucagccagcgccgccugccagcccagcgcaccuguugugugcccccacucccgccuccucuaguccuuugggggaagaguggagaggaaaacaggccgagacugagagggguuuguugucucgucgggcgacaagagacacgugggaauuggcuagagaagcaugugaggcugggcggacuccaggccagccccagaggcagaugggggcugccaggcaggcugggaggugagcccagggcuggccuugggcaccauggcagaauucugggagggggcugcagucacggccagcucccuuucugaauuguucuguggguuguggaaggcuuugaaauuuggcgccugcaccuugucaccuucuugggacucaaggcugcaggggugggugugagacagagagccugggcaccugguggccacucccugagcuccccacgugacagagggcaggucccauucuccuuuugugucugguuugccucaucuguacaugguaggggcugagcuagcguuccuugcacucccuccagcuuuacucuuugggguucaaaagguucccuugcaagccugugcacccgagagcacgcacgcacacacgcacucacagcugaagagaauuaggcucaaaacguccacucggcuuuucucuugauuccaagguauuuagagugggggugggggauuaggggaggaaguugcugagcuaauucuuuugcauuugccagcacagaagugcagauggggcccagagccccggcggugucccaggggaaacaccaguccucuucugcagugcaaggcaggagaaagaacugcugugggagccccucacccaagcagcaggauguguggcaggcccuggccaaggaguucugugggccucaauucucucccuacccugcccccacccucggagucuaaggguggaaccaucuucagacccagccagguucccaaguugcugcuucccucggaagcugagaggcccagggccacguggcagccuccgcaguccaucugaagaaaggccccaccccacgcugcucucaggaguggacaggaacgugggggagugggggugguuaggaccucaggguuaucccugaguggcugaugcauugccaggaagccugcucuuaaggucagcccuugcaguuggcagucuguggccccuccucgguccccuucagugaggcuuuuugcaugcauugguccacacacccaccacugcagcuguccuggguaagggcucugugauccugcaacgcccaccuucuuccuucacuggucauagguuucugcugacccugcagcccauguccuuguuccagaaucuuccgccuccuguggccugugugucgccugcaccugcauuccacuggggcuucccuuccaacuugaugguuucagguacaugggccuguugucaacucuguucccacugagcccaugagacggcuauuccuuugagacauguuuacuugacuuccugccccaggucucugcuguacccacagguggcauggacucauguccccacccaaaucacauccccaccaggaugggcaggcucuggguccuuuugggccuuguaggcugucgucagaggggaggcacaguggggagucucuaggagguuuugggcaaggcagugccaaggaucagaucucccuucuagaaaggucacucuggcugcugaacagagagagaacugaagagaggcagcagggugagggggaagacuacgggggacuugccgucacccagugagagagaugggaggguuggagaaagcgagcaucuguggaggugugagaagugccaggcugggcucccucaggcggcaacuuugucuagacuucuggcugaggacagggaggagcuuaagguagcccucagcauccaacagggguagcagccuagugcauguaugaccacgagcgagcccaagggaaggacgggu

SEQ ID NO: 15499 - RNA, 7165 nt, Homo sapiens
acccguccuucccuugggcucgcucguggucauacaugcacuaggcugcuaccccuguuggaugcugagggcuaccuuaagcuccucccuguccucagccagaagucuagacaaaguugccgccugagggagcccagccuggcacuucucacaccuccacagaugcucgcuuucuccaacccucccaucucucucacugggugacggcaagucccccguagucuucccccucacccugcugccucucuucaguucucucucuguucagcagccagagugaccuuucuagaagggagaucugauccuuggcacugccuugcccaaaaccuccuagagacuccccacugugccuccccucugacgacagccuacaaggcccaaaaggacccagagccugcccauccugguggggaugugauuuggguggggacaugaguccaugccaccuguggguacagcagagaccuggggcaggaagucaaguaaacaugucucaaaggaauagccgucucaugggcucagugggaacagaguugacaacaggcccauguaccugaaaccaucaaguuggaagggaagccccaguggaaugcaggugcaggcgacacacaggccacaggaggcggaagauucuggaacaaggacaugggcugcagggucagcagaaaccuaugaccagugaaggaagaaggugggcguugcaggaucacagagcccuuacccaggacagcugcagugguggguguguggaccaaugcaugcaaaaagccucacugaaggggaccgaggaggggccacagacugccaacugcaagggcugaccuuaagagcaggcuuccuggcaaugcaucagccacucagggauaacccugagguccuaaccacccccacucccccacguuccuguccacuccugagagcagcgugggguggggccuuucuucagauggacugcggaggcugccacguggcccugggccucucagcuuccgagggaagcagcaacuugggaaccuggcugggucugaagaugguuccacccuuagacuccgagggugggggcaggguagggagagaauugaggcccacagaacuccuuggccagggccugccacacauccugcugcuugggugaggggcucccacagcaguucuuucuccugccuugcacugcagaagaggacugguguuuccccugggacaccgccggggcucugggccccaucugcacuucugugcuggcaaaugcaaaagaauuagcucagcaacuuccuccccuaaucccccacccccacucuaaauaccuuggaaucaagagaaaagccgaguggacguuuugagccuaauucucuucagcugugagugcgugugugcgugcgugcucucgggugcacaggcuugcaagggaaccuuuugaaccccaaagaguaaagcuggagggagugcaaggaacgcuagcucagccccuaccauguacagaugaggcaaaccagacacaaaaggagaaugggaccugcccucugucacguggggagcucagggaguggccaccaggugcccaggcucucugucucacacccaccccugcagccuugagucccaagaaggugacaaggugcaggcgccaaauuucaaagccuuccacaacccacagaacaauucagaaagggagcuggccgugacugcagcccccucccagaauucugccauggugcccaaggccagcccugggcucaccucccagccugccuggcagcccccaucugccucuggggcuggccuggaguccgcccagccucacaugcuucucuagccaauucccacgugucucuugucgcccgacgagacaacaaaccccucucagucucggccuguuuuccucuccacucuucccccaaaggacuagaggaggcgggagugggggcacacaacaggugcgcugggcuggcaggcggcgcuggcugauugacggcaccccguguguggcgagggggugaggagcagaggacauaggacacagaacuguccuuccugaccacgucuggugagcuggucacaaacaauagugacaggcuccuuggccuggcaaccccacugcuaagaguacucaaggagaccucacacaagcacacaaggugaggugcccauggaauaucacaggcggggaauuugucagggaaaaauccaagugcccaggagcuuggggucugagguuccaggguuagguagaggguggaggcaagcccagaacaugaaaaucuauauaaaugaaucaacuacuuguaagauauguccccauccaggcccacaauuagaacccacaguuuuguuaaguguaagaccaaauaagcucaauuuucaugacuuuacaaaucaguuuucaagauaaaaauccuaaccaacacccuuugucacucuuuaguaggaggguggacaccauuuuaagugaaauugauuuagggagcuuuucagccuguguucgacauccuuggagaacacaacaacaaaggcugggagacagcucuguguccaagagcgaggacugaaggaguccaccaggcuaccuccuccaucugaugcagcuaacaaaggcccaaagaaaaauggccacguuucgaaaaucugucuuucccaccagaauguaaaccccacaugagugggacuuuuauucuggugaaaucugugaaaugacucugaagaccugggauccugcuccccugaccuccuggggagguagaaauggacaugcagggagggugaucaggggaggauucuggccuccugaggaaggcugaggaaggccagaggaggccugggggccacagugaggcuggaauugagcugcaccccaagcagcaaaaaggagcaggacaggggccugaggccacccucaacucaacauuccugacccugucuucucacauaaucucucucguuuccuaucucaauggcuccaagaggcugucagcaucaccuccauccuacaggcggggaaaugagacuugcagguaucucugcauugcagaguccaggccagggucaggacuccagcccugcccugcucuuuuuggucaggggcagagaauaauaguggucacugagugggaguugugauccuuuggaugucaagagagaggcugggcacagaggaagcaggcagacaggcagcugauaaucuguccugaggaggcaggaaggugggaaagccacuugggagcugaaguuccaagcuccauuuuccccucagacuucacuucuaaaacacaaguucaaagauaguaacuaucaagaauuucaagacagugacauuauagcgugaaacccugagucuggggugcaccugagcacuggcucugagugauggcacugguugcacagcugccucucggacaggcagaugacaaaaacuucccagcuagauagugaggguggacugcgcccucugaucagacacaugaacucccugggccagugcgaagggacaggcgcccaggggaugugucacuugugcccagauugccugugggcugagcaggaggcagggaguggacucaucugggcgucguugcugaaggccugaaaggaaucacuugcugccugaaaaaaugacaccauuuucucuuucucuucugggcugaagaacaacaaaacccccaacccggucacccuuggagagagauuccuggcucucccguagacguauauuuucggcagaggcagugaagaugaauggccuccuugcgugccuugguggggggacggcuggcucgcuuggcuggcuccagccucccccuuccuccuguguuugaggucaacccuggguugggguuguaacaacuuucgagaacauacccagaguccugcauuccaacacuguuuuugcaguccacauggaagggccaaacggcccccagccuugccagggaagccucagggugugaacuucuagagggggcuuuugugacccaggcuuuuguccccggaguuuauggcaaugcuuggcauucagaaggcgcgcgccagcggcgcggaggggacggacaaggggaggggccggcagacgcggucaagugucacgcccggaugggggaugggaggugggcagggcgggcccggccgggcgcuggcaggcgcggggcgcccucggcgcugcccuuugccagguggguggccuggcaugucccggccaccccugccacucacccccugaggucccaaguccucaggggugagcggcagacacggguguuccaggcacagcagugggggcuucagaacaucccgauccccugcauggacccgcugggaggggggaaaacgccucccgcacccggugccacggcgguggagaccuugcccggguucgagggucgcugcagcggcgccggcggaggggcuggucucgggcguggccuggacgcccacaggccuccacaccgagggcccacagcagugucggggugcggccgcuguccucacgcggucaccccgggguggugaacacaucacgcagagaacuggcccgugucuccagcucaccccggcgaugccaacgcugaggcuggcgcuggccccggcccccgguggugcucagggacgacgggugggggcagggagggcggcggcucgcgccaccucacacccagccagugccucaugcggcgcuggacccgcugggccaaucugagcccggguggcaucaaaacgagacucuuucggccaaugacaggacacggcacaucacuuuccgcacccagccaauccgugcagcagcccgccgcaagccuuccccugcugccgcccaaucagcagguggggggcggucgccacgucggcagcggcgggggcagucggagcgcugccgcagucuccaggcagaacggucgccgcgucgccucagcacggaccuccagggagcuccucagcaagauccugccagggcgccccucagcgcgauucugccggggugccucucagcgugguccuccccggggcuccucagcacgauucucccggugcgccccucagcgcgguccuccucggugcgucagucaucgugguucuccccggcgcgccccucggcgcgguucuccucggggcuccucagcgcggcgcucuucugggggcuccucggcgcaguucuccccggggacuccucggcgccguucuccucggggcacccggggcuuuucggcgcgguucuccccggggguucuucggcgcgguuguccccggggguucuucggcgcgguucucuccgggggccucucgccgcgguucuguucuccccgggggcuccucagcaugguucuccuccgcgcgguccucccugggccuccucagcgcggcacucuccugggggcuccucagcgcggcacucuccccgggggcuccucagcgcggcacucucccggcggcuccucagugcgguucucccagacucuccucagcgcggcccuccccaucucucugggaggguuugaacacggucagcacggaccugggcggacggcgcgggacgggugaucacuggcguugcugaggugagcugugugccccgcggccgucccagaucacaggcgucagcagugcagccuggccugggcagugcgcucccaucugcaccuuauggacagcguggccagggucgagguccgaguuccuggccgcgucccaaggaucggauuccgggucuauaguucucauggugguucagagugggcugaauugggauuggagucuggaauccgcaucgugguucugaguccgcgcuauugggauggaaguugggaauccauguugugguuuugagucaaagcccgaauugggaccggagucggaaauccacuuagugguucugagucagggcccgaauuaggaucggaggugggaauccccguugugguucugaguuagguauccuaguugggaucagaauucgggucuaggguccacauccuggcugggaguuugccugaguugggaucugaguaguuggggucccagucaguccgggucuggaguccgcauggugguuuuagguagggccucauuagggacagaggaucgggagucugaguuggggaccugaaucccggucuggagucugcaucauggcucugaguugagauccaagggagguccgaguuggcgacuggagucagggucuggagucugucuuuggguagagguucugaauggggggcucugaguuaagagauugggauugggguuagaggucucagugggguaugggagucaggaauugaagucgaaguucugccucuagguggggauucugagucaggaauuagggggcgaaguaaagguugcagucugaguuggggguggugaucaccugccaggugagagguagugguagaagucucuuggucauauuggagaugagaguugaucagaugcaggucucagucuggguaguaggcuugaagggccaccacuauguucagaucccaguaccccacuguggucccugagcaggucaaauagccuuuuauauaaaauugagaguaagagugccuucccacagcacuguucugguuaugaaagagaauaauucauccagguagaauaguucugucuuagauuaucacaaaguauaaaaacuuuccugauaauauccacauuugaugugcauuuaccaguucuuucuuuacuguggugccccuuuugcuagaccaaaagcucccaacgaggaacucuguuuuguuuucugcugccugcucuguacccagccaagagccugauacacagccuuacucagucaguacuugaaggaaagcaggcaggcaggauuaaccagauuucuauggugucucaaaugauccauuucugcaccuguuuuccagauacucaguaggagaaaaauuuaaggauugaguugcuugauuauggguguauuuuaauguguuuccuaacaugcugaggagaaaagugggucuguuucaggauuuaugcuccagcuagagggauuuuuuaaaauugcgaaucagagcauguccaaauucagauagaaagcacaagaaaacuauaaagaauuucccuuaugaauguagaugcagaaguuccuuguacaaugcuagcuaacugaauccaauaauauguauuaaacaacaauucuuaaacaagugggauugcucuuagg

SEQ ID NO: 15500 - RNA, 1358 nt, Homo sapiens
gcggggcucaccggagaucagaggcccggacagcuucuugaucgccgcgccguuggcgcuggcggccgcggugccggccgcgggacgucccgaaauccccgagugcagcuggucagcgagaggcuccuggccgcgcugccccugguucgcgcccugcucggcgcucucuugaggcgccgcguccggggccggggccggggcgggggccggggccggggccggggccggggcuggggccggggccgcgacuggagccggggccggagccggagccggagccggggccggggccggggccaggaccgcgaccgcgaccggagccgcgaccggagccgcgaccggagccggagccggggccggggcuggagccaggaccgggacugggggcgggguggacgccggggccgggaccgggacacuaggcagcugcuccggcgccuccucgaggccgucgagggacucagcggccggcucgaggggcgggcugacagccaccgcgaccgcgacgggccgcggcgccagcagcaggcggcagcgccccaccugcaccgucucgcgguagaacgcgggcaccgagucgcuguccacuucgguccacugcaggcguccagggccccgcagcggcauguccugcuggaagucguaaucccagcgguucugguccucggcguucagcucggccaggcgggccugcagcucgcggcucagcuccucgugguccaccggcccgaagaggcugcggcaggcgcuggugcgcacuaguacugggaaggucccacgggcgacaagacgcuccaucguggaugugcugcggagggacgcgucggacauggcccggggcugcgcaaacgcgggcagcgagagaggagaggacagcgagaagaaggggaaaggagaggaggagagggcggaggccgggcgcaagggagaccccgcgccgcccgacucugcgugugcgagggacgcggcggcuaccuggcuguccggugguggacucuucugcgucggguucgccugucucguccggacggcagccgcgcccccucgaugccugcuggcuagcucgcucgcucaggccuggccggcaccccucgagcacagcgcacuuggccuguggaacgcccagcccgccugcgcccccuuuauacgcgcgggccccacccccgugcgcgcgggcccggccgcgauuagcauaauguaguauuuucaguuucaacaacaccacggcgauuggcggccgccccgcugccccgccccgccgcggcccggcccccgcgcaccgcccauuggccgcgcgcacacccaccgggggcggggcggggcgcgcggccggggcgcgcggcugauuggcggccgcg

SEQ ID NO: 15501 - RNA, 9662 nt, Homo sapiens
agcacguuccaguaaaggcggcaagcgcuccucagccugcaucacggucuaccaaacgacagaguagaauaaaauacuuuaauguugugaugacacaaagccccacacugccccgcugcuccugggaggcuccucagucugccagggcuggcacucaggcccuucccugccggcuuccugccacacagacccacaaaugcccugcauugcaggcagcccccuccgagcuccgacuugggcccucuucaguucccacuggacccugauuugagcuggcucuggaaauagcugagaacccagacgcgggacgcaggggcaagggcucaaggaggagagucagagucaagaggcugccacgccaagaugucgccaggagcucuggcgguggccaccaggcccagcuagugcgcacuggccuccagcugggagcccagucucgaagccugaacgugagagggcuccagguuauccgggcucugcuucugccgccgccgucggggcuggacccccuuaccagggggucugggcagcccacucuguagcugccgcaccaucucguggucccugugguccagcacgcggggcaggaacagggaggacuucugugugcggcgggucuugaagccccugcggggccggcccuugccguucacagacacguaccacagucucucggcgcugggcugccggcgggccccaggcguacuagacaccguccgguacagccgggaggcauacguauuauagcccagcucguggauccgcuccacaaacucgcacucggcgcuguagugcuccugcggggaugagauaucauggucagugccccggggagacuguggcagcgucagggcccaggguugccugaugccucccuccccuccugugaggcuguucgguccagugccaaaccccagcgcacucucagccagucacaccuuugccuaggcccugcccucugcccagcauguccuuccuccccugugugccuggugaacuuggccuucugccuaaaggucaccuucacucaaagcugugccagacaacucccagcuccugcucucuggguuccaccagccucugucccccaucugagggcgcugacacagcaaagggauguguaggguugucuguggagcagagaccaggccggccaacccaggugcccuggcagucugcuggcaguguggaggucagcaaggacugggcauuuggacaaaggaagaugacaacacccagaucucuuuuaaagaaauugcagaggcugggcacgguggcucaugccuguaaucccagcaguuugggaggccgaggcaggugaaucaccugaggucaggaguucgagaccagccugggcaacauggcaaaaccccgucucuacuaaaaauacaaaaaaauuagccgggugugguggcgugcgcccacaaucccagcuacuugggaggcuuaggcaggagaaucacuugaacccgggaggcagagguugcagugagcagagauugugccacugcacuccagucugggcgacaagagcaaaacucugacucaaaaaaaaaaaaaaaaagaaaagaaaaaaaaagaaauugcagaaaagaaaaaagaagaaagaacacaaaaagcaggaagggaaggggacacagccagguuugaugagcccagacucuccauuaaacgcugcgcucaggggccccagcuggggucauugaccccugagcaacacucucuuaagcuggaggaucucgccuugcagguugaagagguuacaacacagagcaggggcuggggccuggcaugaggcacaugaucaaucagugccacagauacugcuguucuuaggaugagagcagaagcuggggugucccaccacaagcaggacagagaggacaccucuuugucaucagagauuaaugggacccuugucaggcccagggugcagugggggaagggcagaagggacccugcccucucaaaggcacagugaagcucugaacugaaggagcuuacaccaacauccccaagacuuggccgugggaguuucccucaagggcugccucauggggucuucuuagucuguggcguagggaagagguggguaugccuuaugcagacccacuaggcuucagucccagcuacaggcaagugguaaugccuagggccaccucccucaggggaugacugacaggagcugcucccuccaaaccagaaaggguggugggagguggaagcagcaggugcaaggcagacagcaggaucucucuuuccuccuggggacuggccgcagggaggagucggaggcccucauggucuguccccaucugggguguggugucccguggcagagagagagaguggaaauggccuccagaggcucccagacuggaccgagcagcaucugaccucgcaggaccucagggaacaagaugcuucaagcaccccauccuguuuuucagcgacaugaaagcccagagcagggaaggguggaaggcuugaccuggugguaggggcugccucuccccauaaccccaagccccccugcucuccagcccucuuggaggcccagugcccccugggccacagucuggauguuacuauccaagaccggucuccauguuuauagauggggaaacugaggcccagggguggugccaggcccuacauuacaggggauagaacagugucugaucugugccugacccccacauagccuggggcucagcgacuaucugggaaugagcgggugggcucagggccgacuuccccaccccacacacuggguacaccauguuagugucuggcucccauggcagacugugagaagcucagggcaggacccaagcuucucccaggucccucgauccugcagcaggugaguccucucagggccagagaggccaggaaauaggcuuucucuuuggggggccacuugaggggugggucacugaaggacaggugccugugagccucagguggcagggggcucaggcucucccaaggugggagauugggggcaguguagaucaauugcugacacgugguagggcaccugggguggccaagaugaccagggcagaagguguuggcucaggggccagggccauagacuccagagcuacugcaguugggacucgcugugacaacacuuuccaauguguguccugacacugccgccccaccagaccugguuccacaggccccucccccagggccgcuuccaccccaugaaggguggggaggaagccgacuccgaagcugcuuuguugaggaggugacuucuaaagggagcuguaagggcggggcgggcacuuucucaugggcauuuucuggaggagggcguuccaggcagugaagguguggccugagcaguacagauggcuuggagaguugagggggcuuccggaagccggaggaggcucaaccucuggaugacagccccccugggagcagauggcaccugggcugcugcucuguggguggagcuaaggugccugggggaugccugcgcaucaugggaguccucagaagccaugaacugggcugauuugcuuuuuuaggaagccccuuuaacaugcacuagcagagugcaacacaugguaagugcccaggacacugacuggugaacgaaggacugaaugucagauggguggguggauggauggauggauggguggauggauggauggauagauggguggguggauggauggauggauggguggauggauggauggauggauggguggauggguggauggauggauggguggauggcuggauggauggauggguggauggauggauagguggauggauggauagguggauggauggauggguggauggcuggauggauggauggguggauggguggauggauggauggauggauggauggauggauggauggguggauggguggauggguggauggguggauggcugguuggauggauggguggauggauggauagguggauggauggauggguggauggcuggauggauggguggauugcuggauggauugguggauggguugauggguggauggguggauggguggaugggugaaaggauggaaggaaggagggagcauggacggauggacaugugaaugggcagauggacagaugaacgguuggaaggauggauggaaagaaggaugagagaaaggaaagaaggaaggaaggagagguguauggacagaugggugaagagaauaaaggaaggggaaagaaggaaggaagauggauggauggcuugacaaacagauggacuggagguaggagaggcuggagcagugauccaggugggaagugaugagccugccuuuuaaggcgugcucucagggaugaggcagagggaggugaggugugugggcugaagagaugcaggggcguggucugaggacuagggauggacugaauagcaggaggggucuaccaugacucccagcccacucugggugagagugaguggcugguggggcgaugauuaagauggggagucggggagcugcugaguucgguucgagugucugagucagcaggauguugggggaggguggucuauaccucagaagggaggucagggccagaccaggagugucagggugcagugcucacuggcccacagugagaugagcuggccugagggcaagcaugcugccggcaaaguccagggagccccguggugggacagcacuccuaggcaagcuggccgcacgcaggacugugguaucagguggcagguggcaggugacggaguuggcauccaggcuacuaugccucccagguugucugcagggcaaugggaacuucuccacugggcacucuggaaaguuccacacccuccagccagacugcuuggcuaagcaucccugguggggcuaggagccucuguccacccuucucaaagccaggcugugaguucucaggcacggaagccccaggugggcucugaaccacugggacccccucaugucaugcuuuauucugucucuccaaauccuggcuccccuauggcagaagcuggcaccaugagggccccugcucccagacacagcuuccaggacacugacugaugaauggacugaaugucagauggauagguguauggauggaugggugaguggguggguggauggaugggugaguggguggguggauagguggaugggugaguggaugaguggauggguggauagguggauggauggauggauggauggauggauagguggauggguggauggguggauggguaaauggguggauggguggauggguggauggauggauggauagguggaugguggauggguaaauggaaggauggguggauggguggauggauggauggauagguggauggauggauggguggauggguggaugaguggauggauggauggguggauggguggaugaguggaugggugaauggguggauggguggaugggugaguggaugggaggaaggagggaguagccucuggaccagagaaaaugaaggggcgcaucccggcuuucuggaccuuccuuuagcaaaacggcuaaaaaucugugaugaaaucaucagcuucugcgagagggagcugcgggauguguccucugugagcaggacugagcagagagcucacugcagggagauuguccuugggccgcgucagccaggcuacucauggauggaaaaccucucauugcccaaggaaguaucagccaaauugcauguaaugacuaguuggagguagcaaauuucccugugacauguauuuuacucuguguauuccccaccccuaccccuuaugaagaggggcgcugccauacccacagaguaaggagacccuuuuugguuacacggaggcccaggcaguagauagacugggucccaagccagggcuccaaggcuccugugugcccgggacaugggcgccaucccccuuccccuccuaggcuucagcucucgccuuuccacccuuggagagagccgguggagcugggccagcguccuccucuccaugcucccaggagagcucuggcugccccaaggaacacucccagguugucuuggguccauuuauuuugguggaaauuuggagaacaaucacuucccugcucucagcuacucucaagggagggugguagugaugacaaggaugggggaaaccuuugcuaaccuggcauucuccagaucccaggucccccagggccaggcuccaggucacucgcggagcagccucuaacagacacagccaaagaucacugggcguggagcccugggccagggucugguccuagcuugggucccguguacccuuggcaaagcauucuacugcccacaucccccguccccuggcuugaugugcaggccagaccgcuacuccgucagcgcccacccacgugacagccuggacucaccgaagcauagagucguccccucuuguucauggccagguaccgcccggagaagagaccccugauggccacaaugcccaccuccacugccguuaucuccaaaauaccuagaagaaaugagaggugccucacucccgccgcccccacggagggggcggcugaggcccagcuggcccugcccaaagccacaccccgggcucagggcuggggaggguagcacacaccccacaggucggggagugaguggaaguucaggaagggagaagucaccggacaggagguagagaagggaacaucagggaaggcuucucuucauucaaacuugggaggguaacaaugaaauuaacauucccaccugcugacgcugccugcacccuggcuuucauucgagccucacaacaccuugccagcugccaucaucauccgacagacaagcaaguggggaccacuauggcugggugacugucaggccccugcacaugugcuugagcgggaaaucaagcccuggcggcagccaugggagucugagcucugggacugcacgguccccaaugccugugccugccagcgggaaagcugggcccugaugagccaggcugauaauauaaaccacuggcaauaacacagccagggugccugccacccagaucaugcuggcaauagaccuggcgggagaucauuguacucgccgggggaccuggaagggcaggaagccaguuuagacccuggagcccgcagagggaagcuggacgggucucacccacuccccagggauaagaaaguuuaaaucuccccucccgccuuuccuucuggauacacgagugcuguggugggggcugggggcgggggacuacaucaaaggacggguuggggucauugucucccaauagaggcugcgaggggauuggggcgacugccugcacccucuccaaggcaugccucucaggagcgcccuccuggcacgcgguccgagcacagacgcggucaccaccgggcuuuugcuccagcccaggggugcuguggugcaggcugcgagccucccgccuucccagugcgcaggcugggcggcaucggcggugccugaccggggaccagcgaagcacgagucucgacgcaggacaggggcggcugcgggcgcgcgcccuccccuccccgugagcagccuacaccaagaaguuuggaugcugugcgacuccgagggggagccuggcuuuggagagaaccggagugucuuagugagacgaauuccgcgcacucggacccccuggugacagcuggugcccaccgugcggcuccggaggcgcauguccccaggacgcccucucagggcugcggcuuuccuggaggaagccgcgguuugcugaggccgccgccgccaccuucaagcggcggaaccgcuuccugcgcccggggccggagccgagcgccgcgcggagcacccgaggacagcuguggucuugacugcccucccacgcuccccacgcgguccucccgggcccugagcuccgcuauccugcuccucaaagggcucggcgcgggccucaggucccugugaccagaggagcccaaccguguaguccggcagacucccgcggugagcgcagcccgggccgcggguccugcgugcgggggccggagugugugugucugcacccccaggcccgggcggacaccguuccgcgcucgugauccgcacgucccgacggcgagggccuccacccuccugucgcugugcggccagggcggaggcgggggaggugcagauuccagcgcggggaauaacugucgguggcggccgcggccagggaaccgagcuccgcagggcaagaguccuccgcgcagaggcagcagcgggggcggccaccugggcagccgcgagcggggagggcggaggggacggcggggcguccaggggucggcaggaggaggagaagucgucaaaauaauaaagaggaugauaaaugccuuguccggcuccuuuucuccgacacauucaaagggcuuaaacuugucagagcugcccaaagcagcagagccuggagccccggggucgccuagcucgcguccccucagaccagcgggccggaccggggacggacucugacagccgccggcgcccucuucggacgugaacgcccaugcccccgaguucugcucgaaccccagcgcgcgcucuucucccggacguguagguugaggagggcacccuggcauuccccuucuggcagcgggaggcagacggucuuuucccggacaccccgggcgcaccaugccuucucccgggccagaccccuccccggcgccgccucccccgcggggccccgcagcgcgccuucucccgggcccgaccccucccggcgccgcuucccccggggccccgcagcguccggcacucacuguaggcgcuguucuccaggcugccguugacgcggccgcucgggugcagcuggaggugguacuucguggcgcaguagagcuugcggcgccggggcgccccgccaaggugcucguagacgccgccacggccgcccgcaucgcgccgcaaccgcgccccagggcccgcugcgggccagccgggcuccagcaggcugagcaguagcagccagauuaggcccaucguggcaucgcgcccgccccgcggcggcggcggcugcaggcgagcgcggcgcccauggaaggggcggcagccggacagcugcgaggugcucggagcgggaucccgcgccuggagaugcugacuccggcuucgcgggaaaggugggggaagaagggggaagggugggcgagagagagaaagagagggagagugggagagggagagggagagagggaacgcgagucccuuuaauuuccacccaggagcaaugaaauuuccguugcugcgcaaagcgcugaaagaaaggacgguucgccaacaaaaggccgacgugguccccaggcggaggcgcgggaggggcgggaggccggcggguggggagccccgcggggcucgggguucgggccgggcgccgucugcauacacucgccgccagcgcaccgccgucgagccgcggcuccgcuccgcagcgcgccccacgcccccgaaagcccuccuggcucugaaagguccccuacccgccccucccccgcccccucccccagaccaauuaugccuccgaaaauuauagaccgaggccuugaggaggccgccccaggcccugucacccccucccgcuccccaucaaucccccugcacaauggggccgccgc

SEQ ID NO: 15502 - RNA, 5877 nt, Homo sapiens
auaagaaaugcucgggugucuugggcaccuacccguggggcccguaaggcgcuacuauauaaggcugccggcccggagccgccgcgccgucagagcaggagcgcugcguccaggaucuagggccacgaccaucccaacccggcacucacagccccgcagcgcaucccggucgccgcccagccucccgcacccccaucgccggagcugcgccgagagccccagggaggugccaugcggagcggguguguggugguccacguauggauccuggccggccucuggcuggccguggccgggcgcccccucgccuucucggacgcggggccccacgugcacuacggcuggggcgaccccauccgccugcggcaccuguacaccuccggcccccacgggcucuccagcugcuuccugcgcauccgugccgacggcgucguggacugcgcgcggggccagagcgcgcacagugagugcccgccagcacccccgcccgccccgccgcgcgcaccccaccccgcugcgcgcgccccaccccagcgcccuuccuuccuuugccacccuuaggcuccugcggaccccucaacuccugggaaccccagguuuuggcaccuggacguuaggaucccuccguuaguccccaaacagcgcgggacgcuagggagaagcacaggcuuguggaccgaccgcacccacguggugcgggcccagcgguccuugcugcagcuucucgcuuccccugcgccuagguuugcuggagaucaaggcagucgcucugcggaccguggccaucaagggcgugcacagcgugcgguaccucugcaugggcgccgacggcaagaugcaggggcugguaaguguccccacggggcggaugcgccggggcgggggaccggcgccuguccccgggcggaggccugaaggagagaaaggcgcugguucgaauccaggguuuccucgccuccuccgcccagacccgcgugcaacuucgagggaaagauugcaaagaccgauuaagugcauguccgacgauuuccuacggaaauuuagggucucagccagcagccagagaauaggcaaaagcugccuuugcauuuccaauugagucaaaggccggccuagccggaccgaggaaacccauuauucggccuccuuugauauuaaacaggaaaacccaccucgggccuuuucagccucugccugcgcgugugugguccucgccuccguuucccucccuccaguauaaaagaagaaaaaaagaaugggaaagaaaaaagaggaucuacccauaacuuuccuuuaaaaacaaaucaauugucaagcaaggcagaaaacagugcauuugggauaggagagauuuuuuuuuuagaauuaauuuuuaaucuaccaggagcacgguguggcuuagacgcagaugcgcuggagucauguugcgccaggggagugcuuuuccuccugcgggccucaccuguccuguaaacgcuuucuggugggggcagggggugggggcuggcagggaaggcccagguaaccgcagaggucccggggccggaaguguacgagcgcuggggcucugguggccgggaacaaaggcugggaguucaaaggaacgaacccgcgccccucccgcggccccgcgcgcagaggaggcugugugaggucucggcccgcgcaggccucacacgcagccccggacucccuggcggagcaggggccagggcggggguggccgcgccugcccggggcccccaccccagaaaggaugcagaggcggggccgccuccggcccaaccagcuccuuugugaacagcgggacaaagcauuuuagagucucaaaauugcucggugccucugccgugcuccguguacucggagcgccuguuucagguuuuauggcggaguccugcgugagaggacugcagagaaaggggguggucggcacgcuggacgcugacucccacccagagccgcuccaaacccacccuugcaacuuuaauuuugacauuuacuauggcaggggguguggggguuccuaaugaugggaggccagcaggggacgucaaccuaacccgccauucugcccaaauuggggguugggucaccugaaaucccucugugccuuuuuuuuuuuuuuuuuuuuuuuuuuuuggcagagucuugcucugucgcccaggcuggaaugcaguggccagaucucggcucacugcaaccugugccucccagguucaagcguuucugcuaccucagccucccauggagcugggauuacagguacccaccaccaagcccagcuaccuuuuguauuuuggguagagaugggguuucaccauguugguggccaggcuggucuugaacucccgaccucaagugauccggccgucucggccucccaaagugcuuugggauuagaggugugagccaccgcgcccagcccccuuugugccucuugauccccugugcauggucuaacagaaauugaggaucuuuuuuuuuuuuuuuuuuuuuuugagacggagucucgcuugcucugucgcccaggcuggaguacagugguaugaucuuggcucacugcaaccuccaccugcgggguucaagcaauucuccugccucagccucccaaguagcugggauuacgggcaccgugccaccaugaccggcuaguuuuuuuguauuuuuaguagagaugagguuucaccauccuggccaggcuggucucgaacuccugacaucacgaucugccugccucagccgcccaaagugcugggauuacaggcaugagccaccucgccuggccucuuucuuaaauaaaaaugccacauucuucuagaaacuugaagucauuucguuuucuguauggagaaagugauacuaauuucucccaaaggacaagccaaguaaauagaagaagguccuccaaucauucgguuuuguguuccuuguuuauugaucauuuggcauuuuugggaguuugggagaaaucacgcuugcuguccgaugcuuugucccagccauccgugggcucggcaggagccuggguugcugcaaugagccucuuaucaggagcuuauuagcacagguaccucgucacccaccugcaguucagugaccuuugcagacuuaggcaggaaccugacugaggccguccugcaguguguuuacugcccagcccuuccggcucccgccugcgccuguccugggucgccaagggguaaugacaccggugugggauggcacuugcccacuggcaccucucaaccccguggacuaugaauguucuaagacaaggcuucccucagcacacauuuccggccaccagcugggcgccggccuggccuggccuggccugggggaggggcugcugagaucugccuccuggcagccugccuggaaggcccuuggugacugaauggaggagacagcggggcugaugguucucagaacugcugcagaccagaaggccuuagaaugauaaaggcacacagugauuucugagauagguggggaacagaugcuuucaucugggacccagaucggaucacacgcaauuuauuuaaaagaccuauccuaagaugacaacccaguuuaucaguguuucccaaagugccaaugaaauacccaggaacuuuuuaaaugccaggaguuaugucuguaauguaaagggugagggaaacacagacggcauuccuguggguugauggauauuauugcuuaggacaaggcucucgaaaaagugagguaauuuaguggaaauuauuugggucuauauagaguguauauguaguauuaaguauauacauaaaauauacauauaugaaauaauaaaccucaguuuugucugugugcauguauaucuauauaaagauuauaauuuauaaagguauauaaauguauauuuaauuuauuaauggguuauauauuaacauaauguacauauuauauaugcuuacacuuacaguacauuuauauauguguguguguucucuguguauauauauaguuguggguuuuuuguuuuguuuuuuuuugagacagggucuugcucuaucacccagacuagagugcaguggcaugaucauugcucagugcagccuugacuacccagccucaacccauccucccaccucucagccucccgaauagcugggccuacaggcgcccaccuccaugaccugcuaauguuuguacuuuuugucaagauggaauuuuaccauguugcccaggcuggucucaaacuccuggauucaggugauccaucugcucugggccucccaaagugcugggacuacaggugugaccuacugugccuggccuuaaaguacauuauauauuauauauacuuacauauauaaagguauauuuuauauauacuuacacguacaguguguacaucaggaaguauguauaaaacaugcaagugaugcuuauguggaaggucacugcugguggccaccagggacagucuguagcacaaacguccauguggacccguguucccuguccacuguggauugcucagagcugccuguuuucucugcagcuucaguacucggaggaagacugugcuuucgaggaggagauccgcccagauggcuacaauguguaccgauccgagaagcaccgccucccggucucccugagcagugccaaacagcggcagcuguacaagaacagaggcuuucuuccacucucucauuuccugcccaugcugcccauggucccagaggagccugaggaccucaggggccacuuggaaucugacauguucucuucgccccuggagaccgacagcauggacccauuugggcuugucaccggacuggaggccgugaggagucccagcuuugagaaguaacugagaccaugcccgggccucuucacugcugccaggggcugugguaccugcagcgugggggacgugcuucuacaagaacaguccugaguccacguucuguuuagcuuuaggaagaaacaucuagaaguuguacauauucagaguuuuccauuggcagugccaguuucuagccaauagacuugucugaucauaacauuguaagccuguagcuugcccagcugcugccugggcccccauucugcucccucgagguugcuggacaagcugcugcacugucucaguucugcuugaauaccuccaucgauggggaacucacuuccuuuggaaaaauucuuaugucaagcugaaauucucuaauuuuuucucaucacuuccccaggagcagccagaagacaggcaguaguuuuaauuucaggaacaggugauccacucuguaaaacagcagguaaauuucacucaaccccaugugggaauugaucuauaucucuacuuccagggaccauuugcccuucccaaaucccuccaggccagaacugacuggagcaggcauggcccaccaggcuucaggaguaggggaagccuggagccccacuccagcccugggacaacuugagaauucccccugaggccaguucugucauggaugcuguccugagaauaacuugcugucccggugucaccugcuuccaucucccagcccaccagcccucugcccaccucacaugccuccccauggauuggggccucccaggccccccaccuuaugucaaccugcacuucuuguucaaaaaucaggaaaagaaaagauuugaagaccccaagucuugucaauaacuugcuguguggaagcagcgggggaagaccuagaacccuuuccccagcacuugguuuuccaacaugauauuuaugaguaauuuauuuugauauguacaucucuuauuuucuuacauuauuuaugcccccaaauuauauuuauguauguaagugagguuuguuuuguauauuaaaauggaguuuguuuguaucaaaag

SEQ ID NO: 15503 - RNA, 5877 nt, Homo sapiens
cuuuugauacaaacaaacuccauuuuaauauacaaaacaaaccucacuuacauacauaaauauaauuugggggcauaaauaauguaagaaaauaagagauguacauaucaaaauaaauuacucauaaauaucauguuggaaaaccaagugcuggggaaaggguucuaggucuucccccgcugcuuccacacagcaaguuauugacaagacuuggggucuucaaaucuuuucuuuuccugauuuuugaacaagaagugcagguugacauaagguggggggccugggaggccccaauccauggggaggcaugugaggugggcagagggcuggugggcugggagauggaagcaggugacaccgggacagcaaguuauucucaggacagcauccaugacagaacuggccucagggggaauucucaaguugucccagggcuggaguggggcuccaggcuuccccuacuccugaagccuggugggccaugccugcuccagucaguucuggccuggagggauuugggaagggcaaauggucccuggaaguagagauauagaucaauucccacaugggguugagugaaauuuaccugcuguuuuacagaguggaucaccuguuccugaaauuaaaacuacugccugucuucuggcugcuccuggggaagugaugagaaaaaauuagagaauuucagcuugacauaagaauuuuuccaaaggaagugaguuccccaucgauggagguauucaagcagaacugagacagugcagcagcuuguccagcaaccucgagggagcagaaugggggcccaggcagcagcugggcaagcuacaggcuuacaauguuaugaucagacaagucuauuggcuagaaacuggcacugccaauggaaaacucugaauauguacaacuucuagauguuucuuccuaaagcuaaacagaacguggacucaggacuguucuuguagaagcacgucccccacgcugcagguaccacagccccuggcagcagugaagaggcccgggcauggucucaguuacuucucaaagcugggacuccucacggccuccaguccggugacaagcccaaauggguccaugcugucggucuccaggggcgaagagaacaugucagauuccaaguggccccugagguccucaggcuccucugggaccaugggcagcaugggcaggaaaugagagaguggaagaaagccucuguucuuguacagcugccgcuguuuggcacugcucagggagaccgggaggcggugcuucucggaucgguacacauuguagccaucugggcggaucuccuccucgaaagcacagucuuccuccgaguacugaagcugcagagaaaacaggcagcucugagcaauccacaguggacagggaacacggguccacauggacguuugugcuacagacugucccugguggccaccagcagugaccuuccacauaagcaucacuugcauguuuuauacauacuuccugauguacacacuguacguguaaguauauauaaaauauaccuuuauauauguaaguauauauaauauauaauguacuuuaaggccaggcacaguaggucacaccuguagucccagcacuuugggaggcccagagcagauggaucaccugaauccaggaguuugagaccagccugggcaacaugguaaaauuccaucuugacaaaaaguacaaacauuagcaggucauggaggugggcgccuguaggcccagcuauucgggaggcugagaggugggaggauggguugaggcuggguagucaaggcugcacugagcaaugaucaugccacugcacucuagucugggugauagagcaagacccugucucaaaaaaaaacaaaacaaaaaacccacaacuauauauauacacagagaacacacacacauauauaaauguacuguaaguguaagcauauauaauauguacauuauguuaauauauaacccauuaauaaauuaaauauacauuuauauaccuuuauaaauuauaaucuuuauauagauauacaugcacacagacaaaacugagguuuauuauuucauauauguauauuuuauguauauacuuaauacuacauauacacucuauauagacccaaauaauuuccacuaaauuaccucacuuuuucgagagccuuguccuaagcaauaauauccaucaacccacaggaaugccgucuguguuucccucacccuuuacauuacagacauaacuccuggcauuuaaaaaguuccuggguauuucauuggcacuuugggaaacacugauaaacuggguugucaucuuaggauaggucuuuuaaauaaauugcgugugauccgaucugggucccagaugaaagcaucuguuccccaccuaucucagaaaucacugugugccuuuaucauucuaaggccuucuggucugcagcaguucugagaaccaucagccccgcugucuccuccauucagucaccaagggccuuccaggcaggcugccaggaggcagaucucagcagccccucccccaggccaggccaggccaggccggcgcccagcugguggccggaaaugugugcugagggaagccuugucuuagaacauucauaguccacgggguugagaggugccagugggcaagugccaucccacaccggugucauuaccccuuggcgacccaggacaggcgcaggcgggagccggaagggcugggcaguaaacacacugcaggacggccucagucagguuccugccuaagucugcaaaggucacugaacugcaggugggugacgagguaccugugcuaauaagcuccugauaagaggcucauugcagcaacccaggcuccugccgagcccacggauggcugggacaaagcaucggacagcaagcgugauuucucccaaacucccaaaaaugccaaaugaucaauaaacaaggaacacaaaaccgaaugauuggaggaccuucuucuauuuacuuggcuuguccuuugggagaaauuaguaucacuuucuccauacagaaaacgaaaugacuucaaguuucuagaagaauguggcauuuuuauuuaagaaagaggccaggcgagguggcucaugccuguaaucccagcacuuugggcggcugaggcaggcagaucgugaugucaggaguucgagaccagccuggccaggauggugaaaccucaucucuacuaaaaauacaaaaaaacuagccggucaugguggcacggugcccguaaucccagcuacuugggaggcugaggcaggagaauugcuugaaccccgcagguggagguugcagugagccaagaucauaccacuguacuccagccugggcgacagagcaagcgagacuccgucucaaaaaaaaaaaaaaaaaaaaaaagauccucaauuucuguuagaccaugcacaggggaucaagaggcacaaagggggcugggcgcgguggcucacaccucuaaucccaaagcacuuugggaggccgagacggccggaucacuugaggucgggaguucaagaccagccuggccaccaacauggugaaaccccaucucuacccaaaauacaaaagguagcugggcuuggugguggguaccuguaaucccagcuccaugggaggcugagguagcagaaacgcuugaaccugggaggcacagguugcagugagccgagaucuggccacugcauuccagccugggcgacagagcaagacucugccaaaaaaaaaaaaaaaaaaaaaaaaaaaaggcacagagggauuucaggugacccaacccccaauuugggcagaauggcggguuagguugacguccccugcuggccucccaucauuaggaacccccacacccccugccauaguaaaugucaaaauuaaaguugcaaggguggguuuggagcggcucugggugggagucagcguccagcgugccgaccacccccuuucucugcaguccucucacgcaggacuccgccauaaaaccugaaacaggcgcuccgaguacacggagcacggcagaggcaccgagcaauuuugagacucuaaaaugcuuugucccgcuguucacaaaggagcugguugggccggaggcggccccgccucugcauccuuucuggggugggggccccgggcaggcgcggccacccccgcccuggccccugcuccgccagggaguccggggcugcgugugaggccugcgcgggccgagaccucacacagccuccucugcgcgcggggccgcgggaggggcgcggguucguuccuuugaacucccagccuuuguucccggccaccagagccccagcgcucguacacuuccggccccgggaccucugcgguuaccugggccuucccugccagcccccacccccugcccccaccagaaagcguuuacaggacaggugaggcccgcaggaggaaaagcacuccccuggcgcaacaugacuccagcgcaucugcgucuaagccacaccgugcuccugguagauuaaaaauuaauucuaaaaaaaaaaucucuccuaucccaaaugcacuguuuucugccuugcuugacaauugauuuguuuuuaaaggaaaguuauggguagauccucuuuuuucuuucccauucuuuuuuucuucuuuuauacuggagggagggaaacggaggcgaggaccacacacgcgcaggcagaggcugaaaaggcccgagguggguuuuccuguuuaauaucaaaggaggccgaauaauggguuuccucgguccggcuaggccggccuuugacucaauuggaaaugcaaaggcagcuuuugccuauucucuggcugcuggcugagacccuaaauuuccguaggaaaucgucggacaugcacuuaaucggucuuugcaaucuuucccucgaaguugcacgcgggucugggcggaggaggcgaggaaacccuggauucgaaccagcgccuuucucuccuucaggccuccgcccggggacaggcgccggucccccgccccggcgcauccgccccguggggacacuuaccagccccugcaucuugccgucggcgcccaugcagagguaccgcacgcugugcacgcccuugauggccacgguccgcagagcgacugccuugaucuccagcaaaccuaggcgcaggggaagcgagaagcugcagcaaggaccgcugggcccgcaccacgugggugcggucgguccacaagccugugcuucucccuagcgucccgcgcuguuuggggacuaacggagggauccuaacguccaggugccaaaaccugggguucccaggaguugagggguccgcaggagccuaaggguggcaaaggaaggaagggcgcugggguggggcgcgcgcagcgggguggggugcgcgcggcggggcgggcgggggugcuggcgggcacucacugugcgcgcucuggccccgcgcgcaguccacgacgccgucggcacggaugcgcaggaagcagcuggagagcccgugggggccggagguguacaggugccgcaggcggauggggucgccccagccguagugcacguggggccccgcguccgagaaggcgagggggcgcccggccacggccagccagaggccggccaggauccauacguggaccaccacacacccgcuccgcauggcaccucccuggggcucucggcgcagcuccggcgaugggggugcgggaggcugggcggcgaccgggaugcgcugcggggcugugagugccggguugggauggucguggcccuagauccuggacgcagcgcuccugcucugacggcgcggcggcuccgggccggcagccuuauauaguagcgccuuacgggccccacggguaggugcccaagacacccgagcauuucuuau

SEQ ID NO: 15504 - RNA, 4803 nt, Homo sapiens
agagaaggagggaggggcugagcuccgugggucaggagaaucaaacccagaccagaaacugacucggcuauuaaaaccagcaccuguuuccagggacccaggaggccccagagacaagggagcacccugcagauuccugggcaaaaauccugcccggccacagggcgggcugggccacaagacuguccguggaugugggcccagcuuucccccacuugcaggaaugcccaggcuggcgcaggucucggccugaacaugugagcucucgggcgaggcugaggcaggguggaggccagggugggggagcccagcccacgagggcucuggguggacacccagcaagcaggaggggcuccgugggaaggccgggaaaaaacagucccuggcagaaaaacucaggucugccccaggcuccccuauagcuggcaaggagcaagcaucuaauaaaugucugcugagcugcggugaauucccagggcauggcgacacucaauggcuccauucccagggagcuacucuaugaguugccucgcugauugauuaaugaucaggcuuugugaaacaguuuacaaagcacuucugacaaaucaaacucgggguucagaucucggcccuaccucucaauagcuguguagcugugggcaaaucacuuaaccucucugugcccucaugucuucaacuuaaaaaaaaggagggaugauaacagcacccuacuuccuaagacugggugaauucauauguguaaagcucuuagaauaguacuuggcacccguaagucacacaggcaguuaguggcacacgcaggucucaaacccaucucuaucugacucuagaaucacuacauagcaguucaccaugacagccacugccccgucacagccuccaggcacuucacauguggcugguccaaauagagaggugucgaauucugaaggcuuuuuccaaaaaaaaaaaaaaaaaaaaaaaaagguguaaaauaucucauuaauaaugcuuuauguuaacuagaagagaaaacguguaauguucccacacaaagaaaagauaaaugucgggaggccguggcaggagaaugguauaaacccgggaggcggagcuugcagugagcugaaaucgcgccacugcacuccagccugggugacggagcgagacuccgucucaaaaaaaaaaaaaaaagaaagaaaggaaaaagaaaagauaaauauuugcaguggugcauaucccaauuacccuaacuuaauuauuccacauuguguacauugaucaaaaugucacgacucccaaaugcauacaacuauaucaauaaaaauaucaaaaaagaaugcuuuauaguaguuaugugcugagacaauugcauuuuggaucgauugaauuaaaugaaauauauuauuaaaauacauuuugccuauuuguucuuuuuuuuuuuaaugugacuacaagaaaacgugacaucaugccuuugagguucaccuuggauuucuguccgacacccugccccugaguuuugucuuugacacucucucucucucccaacuuuuaagccccuugcuucucccuacgugaggcacuuuguuuccuccaggagaagcucaauccugaaauuguucccaucucaucaaaacucacccccugcauaagagcagcccgauuucugguggucagaggguguccccagaaaagagguuucauuucagcaaacaggucaucuucugccaaaggagacaaaaugugaauugggugccucuggguauuggccacuagcuagacauggguacccaccagccagacauagguaucacuagccagaugcggguauccacuagccaggcacagguaucacuggccagacacagguaucacuagccagacacgggguaucacuagccagacacaaguacccacuggccagacacggguauccacuagccaggcacagguaucacuagccagacauggguacccacuagccagacaccgguaucacuagccagaugcggguacucacuagccagacauggauauccacuagccaggcacagguaucacuggcuagacacagguaucacuagccagacacgagguaucacuagccagacauugguacccacuagccagacagggauauccacuagccagaugcggguacccacuagucagacagggguauccacuagccaggcacagguauccacuagccaaacacagguaucaccagccagacacagguacccacuagccagacacggguacccacuagccaggcauggguauugaguggaggacugcuauggucugauuguuuauguucccccaaaaugcaaacccccaaggugaugguguuaggaaauggggccuuucggaggugauuagcuuagggggacagagcucucaugaaagggaugagugcccuuauaaaagagaccccauagagagacaccucaccccuuccacccugugagaaagugugguuuacgaaccagccugcccucaccagacccugaaucugcugacgccuugaucuuggacuuccagccuccagaauaaacaucuguuauuuacgagccgcccacccaucuaugguguuuuguuacagcagccugaauggacaaaggcaggacguaaagcuccuugcacaaguguauguauauacacaagcugcguauauuaaggugcccaagggaggugggcggcuggcccugagccuccccauucuccuggcuccuggcuccuggucucuugcucaccaggcagguggaccccucagcagaauccaaaccacccauuugaugccaagggacuccccagcccccaucacggcauggaaaacuacaugcacaagggcuucuggggacaauggauuuagccaacagaaucuugaaagagcgcaggacucaaccccauacugccucugaccugccccuucccucucucugccucaguuucuccauuugugcagggcaagaggucuggaccugaugcucucugagguccuuacugccuauuggauaaaguauaaaacaaagagccauggauggagucugguguuucccaggcugcagcugggcucugggccagggcacacccuccggacuccaugggcaaacagauggggacagucaaaugggccacuuggcagaggcaggcuagacaaggcugggcuggcuggcaccaggcaggaugcccccauggucagcccgggcagcagggagugucugcaggacgggacaugcuugggggcccacgccuccaaccccgagguucccccaccaccuucccucccugggcucucucuccaggaaugagagccucagcagcaggcaggcccaugucccugagugaccccaccuaggcucaggcccagggcugugaggcgccagcagcucauggaagcucgcagugggguacaggucuguggagacuccaaccagccacaagccaucagccucauccucagcccuccgucuucagcucagaugccacuggcuggggccaggaaacgaaggguugugggaugaccugcccaggugggagcugagaaaggcucugacacauggcuggugcaggguggcugcccuggguucaggucccagacacucugcuuuccagcugcacuauuuugaacaagcuauuuccucuuccugagccucacuuucuccaucugugaaaugggcaugaucccagugucuugcucuuaagagaugaugucaggacuacauaaggaaaugaaaugcaugaaacuuuugcugaaagacagcuaaaacaaacugaugauaagaaaagaacagaaaaaaaacugaucuggucuguucuuucaagaauugcaccucacacugggcaucaggaaagauacugauucgagaauccaagguuccugcuggaaggagacccuuccuugggccugucaagaaagugacccgcauuugccccacugggcacucagccccaaaagguggagacuuagcauaaugucagaacccagacauuuuuuuuuccuauuggaaauuuuuauuaucuuuaaauccaauucugaggguacgaaagucacaaauguagccucugugagucacgagccgucggcagaaaaaugcuauugagacuugaagagggcggcagagaucuccaaagauuggguggguuucuuuaagccucucagaaguucucauuucacagccagcugacaugcacauaaaggagcaagacuuuucccaaggaaaugucucacacagccagggcaaggcuagucacccccacagaugccugugaucacugcaucaggccugcugucagcugucccgcugggagggcaaggugcccauccccuccuggccaccaagguguuuguuucuuuggguuucuaccgaugagccaggggcugcugauuuucuuggcuguuucuaaggccaagaaaugugucgggcagccucggguacugaggcaggccaaaagaguucgggugccaggccccagacauccagcccaacugcccaaggcugcuugcucccagucacauuagugacagcccaucccucaccaugagcccucgccaggcucugugugaagggccugaugcaugaggucucauugcagccccacaggaaccccucaaauugcuaucuuuaugcccauuuugcauaugggaaaacugaagcucagagaggugaaaugacaugcccaagaccccacuucuacaaagugguagagcugggauuggaaugcaugucuuucuggcccaguaucugcccccuucaccaugcuucugccuccugaacuuaagucacuaagaguuauuugccagcgacuacu

SEQ ID NO: 15505 - RNA, 8803 nt, Homo sapiens
cgcgcucggcgcuggccugcugccccggcggguccgccggccggaggcgggagucacaggaagagcccuccacaaaaggaggccucggcggaucaggacagcugcagguagcuccaggggcccaggguccaggggaggguguuccaacaaccggggcugcagggugagggccaggcagggaaggaaaaugacgcgggcacuguaggggcagagagguggacgcugucggggcaggcagcucccagaaauccuaaggccccaggcagggagcccugagaccccagagaggcugucacucaccggagaagcuccccugccacuccugaggcuccaggguuccagggccauggaggaacuuuaaaagucccccucccguggcaggaccugaccccucucagcuggccucacccccagccccaccguccagcuccugcucugugcugcugggggugagggcucccucucggucccucccccagccucacuggccauucaagcaugcauucuagaggggcuggaacggaacacccagcaggcagugucccacacacagggagauggcucccccugcucucagcccuggggugcacaugggguguccgugugggcagccacaggauguugggcaacugcagucccaccuucucccaggccugcggccugaugaagcuguuggccuuggauggaggcggcuccuggaaugaucugcaaggucucaguccccccagacaagccucuucaauccaagcuguuaagcaggggacuccagacccggagugaggaaaacagaggcucugugucugggggagcgagacaggccccucugauggcggcacaagcggcuaaggagaggggcugggacagccccagcggcgucggggcugggucauggugggauggagugaagggagaggaggagcuuccugcgggcaaggcugcaggaggcugacagguggccaggccacccuugggcuugcuccgaggggagggucaggugugagcugugcuggcagcuuuuugggucagcuucaguggaaacuaguucugucauagcagcccagaucccacccagaggaacacacauacacauguacugacacgcacgccccauccacgugucacacacauguccuuuaauauggcccaucuggggucugcuggcuucuagaucuuucugugcaugcgugaaaucgcuuuucagguugucccuggcaggacaaggacaaaugcacagggacacccacauaauggagggacgcagaugguagagaggggagcugggggcccccacugcaugcccaccugcagcguaggggggagcccagcccacugccuuuggggcacuaguugguguggcuggggucuagccuggccagggugaauggaugaggcuccugugagucaggacaucucuggaaacaaggcugggggcccagaccuaggggugguggguguccagaagggccaccaaaaagaguaggggcaauggagagagcuuggggggcucuuaccaggcgcccggaaggaugagggcaggugauaggucugggguugcagggcaggaaagcucagacaggccccagagcguggagaaguuacggccugucuguggcaacgggacaauggcccaacuggaguccaaggagggagacuuaagauacaggucgcagcaccagccaucugcaagcccacugcacacacaucacaaugcacuggcucacuccggcacacaaggugcccccacccugggacaccccgaagaccccaggcugagucagccguaggccaggcacaggugcucacaaacgcccuuugaaggcgcagagcggcgcggucuggcagcgcggggccgaggggagccaggccacugggugggaaggguccugggagcggccccuggggccacacuugcgccaccagcuccgggaggcccaggguuaaagagggggcgggccacacgcgcagacggccaccucuucuagccaauggugggcgcggaggccaggaguacggcccgcccccgggcgggaggagugcgcggcgggcgggggcacguggcuggcugaggccgggcggacccgcgcggcgcagaggaaagaauuuccggggaguugagcugagcaggaugcccagcucuccccuugggagaggaggggcccggcagccugcgaccugggcugugcccagcaaggcccuucuccgcucacagccucaguuuacccccccaguacagcagggaauaauaauagaugcuucucugcggggaaggggcacagggcuucacggggagaagcuuccuccaaggggugaagcucagguugggggaccgggaucaauuccagaggacccaaggcaggcagacccaugaggucuggccggccaagguggaccagccuccagcagggucacccccuaccccaggccucccauuggcagcccuagggugggugcagcuuccccucucuaugccagcagucccucccuacggcagcugcucgaaacacaaaucugcaaggcugcagggcaugguguggcuaugggugugccuuugggcaggugaccucacccucuaagcccaggagcgcccaucaaaggggcaugaggauaccuggcccauagcuggucaugaggaccaaaccagaugauggguguaggcgggcuggcaggguaagugguggugacagugaugcugaugaccgggcuguccugccucccaggcacauguaggggaaaggccagaugccuuagcauguuacaaaccgcggcucagccaaagcccuccuccuccagcagguucccccugccaggaaugaucccucuuccccugcuccuccuucugggaccgauugcugggaaaccccuguccccacaccaggcagggcacaaaggaagugccccaaaaauguguguggggaaguaaauguaugucugcaaaagcagccuggcuccagaacucucacaagaaaagggaaaggagagggcuucuuuuccagugagcugcgguggggcugacgcggaguccacaggcaggagggggccgugccccaggggugaccuccagaaucucaccaggacagucccacaaugccccugcugcugaggguguggggugauugccuuuccucuaaggugauggcugagagccacaggccuugggggccuaggcacggggguccaggaaggggaggggucccugcuguccucauccacccucucucugggcuucugccaggugggugugcagacuggugagcugccagcaggggcccagacgcgccaggccuggagauggcuggaaacugcuccugggaggcccaucccggcaacaggaacaagguaagugccacaggcggagggcccuggucuugcccagacgggugugggugggaggggcagacccagcccagcaucuccucccccaucccccccuuccuggccccacuuuccagcucuggacccaccgugggcagugggcuccucugggcuauguggccgggcacaaguucccuggacccuccuacccuccuguccucaucagugaggcaagcaccaggacuggaccucaaggucccucgcugugcugacacuguggucgccuuguagcauccuugcaaggucuuguuucaucucuucccugcagagguggggcagucagcuacuuacuacagccaggcgggccaggaagcccugggacgcugacuccaagguggcccugaugucaugugcuccauggagccuaggggguccugggccaccccgagaguguugccccaggccaggguccauuagucaugagucacccacccugagacucugacaaccccuccaggcugacccuccuccugcccucagccaaccuaguccccuacuucucugaaucccuugaaaauucugggauuuccuucgcucucaacuucgaaggaucucuugaauuccuauccauccucuucugcauuugaggaaacugaggcuuacacccagguaguaacuugacugggaucagccccugggucaggagcagaguggcaacuccagcccagcccuggggaucucacccccacgcccuugggccuugggcccucucccucuuccccguagugaccgcuguggaguggcggccgcaggaggcagagguuggacugguagguggggugaggcagucugcagaaacucccagcgcaaaggcagagcccaggguggggccgggcuccagagcaggcauucuacaaggcaguaugcggcuggucacggcagcuacacgcccagugacucacccggccucccccucugacuccaaggaggggauugcagacuuuuuccagcgugcaugcauacaagaggcacugaguaagcugaccgccuccauccagccccuugaagcccagcucuuucccagcaccugagcugguccucuugggccuguuugggcaccagauccuacggucuaguuccccagcccagaagaguguccaggucacccacaggaaagagaagcuaaggagcgggauuuggggcgaacagaccagccgacagggguugagccuauaaauguauuuagagaauggcagggagggagcagggcccccuuacagugcuugcccugaccucacagagucuccccagaguuuugccaacaccuucaguccuguuuucagauuccccuugaccugagcaggcuaggaggucccucccuuugcaacgggguguccaacccagagaacagucucucaggacccagcuuucugccagagcugggagucaucugaagguggcagaauggauccugccuucauaaccuugccuuugguuuuguuagggagcccugagcagugggaacagaaaccagccuuugaggggagaugcuggaugugggaagaggagugacuguucuccgggcaggcagccuuugccucuggggggaaaggucggagaggacugccggagagcugagccagccuguagauagauggguuguuuggccugcacagcauguuuaaauguuaacauuuaaagaucggguguuccacauuccagucuagaguucaggcuucuccagggagcgggggaggacgaucagccacuccagugcacccaaucccuggcccccaccagcuggagcacagcaggcugcccgcuucgcucaagagaggggcucucagauuugccacugugcucccucucaccuguuccuugcaccuggcccaccugcaugcauuuauacacaagccuagacccugagggcaggaccgauacucagcugggaugcacucuuacagccacaccaacaguuaaaguauugaaaugcuucccugcagcuugauaaauagcugcugccucuccuccaccccagggacccccuggacuuucccacaaucuggaaaccccaggggcaacccuggcucaucaggaagccaccucccaucccacuagaggacaggguccagcuccggggaaggccgagauccacucguuguuuuuuuuuaaauguaacuuacaagugauuuuauuucuucaaauaguuucguguuuguugaaacauugcaagauuuugcaagaauaguacaaugcccgccaauaccucaccucagcucagucaucguuaacccuucaccacaagugcuuucucucuaucucuugacagauaggcuuuuuuucccagaaugauuugaaaguaaauugcaaggcugggugcgguggcucacgccucuaaucccagcacuuugggaggccaagaugggcggaucaccugaggucaagagaucgagaccaguccggccaacauggugaaaccccaucucuacuaaaaauacaaaaauuagucaggcauggcggugcgugccuguagucccagcuacucgggagccugaggcaggagaauugcuugaaccugggaggcggaggcuguagugagccaagaucgggccacugcacucuagccugacaaagcaagacucugucucaaaaacaaacaaacaaacaaaaguaaauugcagacaccaagcccuugaugcccaaauagccuguaucuucuaagaacaaggacguucccguagccacauagugaaaaugugcguagccacaguacauugucacauucaaaagcugcaacaccgaugcaaugccauuaucucugcaucguccauacucacauuuccccaguggucccaacgauauccucugcagcaguuguugagauccagcguauaauccaggauucuaacacuguguuuaggagucaugucucuuugcucuucuuaaaaauggaaaggcucagccaggcgcagugacucacgucuauaaucccagcacuuugggaggcagguggaucacuugaggucaggaguucgagaccauccuggccaacacggcgaagccccgucucuacugaaaauacaaaaauuagccgggcauggugccgcgugcccguagucccagcuacucaggaggcugaggcaggagaaucgcuugaaccugggaggcagagguugcagugagccgagaucgugccacugcacgcuccagccuggugacagagugagacucugucucaaaaaaaaaaaaaaaaaaaaagggaaaggcucugcaguuuuuugugcgacuuggacguuuuuuggacagucuacucugaccggugggcagccuggcacccuuccugggcacugucuggugcuaccucuacuccuauaggcaccauugugugcugcuagcucuagacgcugggacggagaguuaacaucaggugaggucaggggcguuugaggauagaguugcagccaguuagcugcuccacagccacugccuuacagacccccucccugccccaagucccuaauugggacccccccccucccccacgcugggccccagaugcaggucugugggugggggccagccggcaucacaggugucccucucugcaccugcgcagaugugcccuggccugagcgaggccccggaacucuacagccggggcuuccugaccaucgagcagaucgcgaugcugccgccuccggccgucaugaacuacaucuuccugcuccucugccuguguggccuggugggcaacgggcugguccucugguuuuucggcuucuccaucaagaggaaccccuucuccaucuacuuccugcaccuggccagcgccgaugugggcuaccucuucagcaaggcgguguucuccauccugaacacggggggcuuccugggcacguuugccgacuacauccgcagcgugugccggguccuggggcucugcauguuccuuaccggcgugagccuccugccggccgucagcgccgagcgcugcgccucggucaucuuccccgccugguacuggcgccggcggcccaagcgccugucggccguggugugcgcccugcuguggguccugucccuccuggucaccugccugcacaacuacuucugcguguuccugggccgcggggcccccggcgcggccugcaggcacauggacaucuuccugggcauccuccuguuccugcucugcugcccgcucauggugcugcccugccuggcccucauccugcacguggagugccgggcccgacggcgccagcgcucugccaagcucaaccacgucauccuggccauggucuccgucuuccugguguccuccaucuacuuagggaucgacugguuccucuucugggucuuccagaucccggcccccuuccccgaguacgucacugaccugugcaucugcaucaacagcagcgccaagcccaucgucuacuuccuggccgggagggacaagucgcagcggcugugggagccgcucaggguggucuuccagcgggcccugcgggacggcgcugagcugggggaggccgggggcagcacgcccaacacagucaccauggagaugcagugucccccggggaacgccuccugagacuccagcgccuggaggaggcaggggcaggaagcggccuccaagacccuucgccuugggacaggaaugggcaccugcuucugaguccauacaggagaagaaagaucuguuuccucuccucgggccuccuucucccugggcuggggacuccagggguggcugggagacugggcagccaccagcaaacagacccuguggccccugcccggcucccccacccauucugcuccccuagagaccucuuguacagaaguugcccccaggugguggggccccuccuugcccuaggcugguugguaaaagagaggaggucaacacccagccuagccaccucugccucuugggucagcccuccuugacugugucccagccagcaccaggccagcagccucaucccugccauucagggcuguuccagagauucgauccucuuaaggcauuaucagugagcaaaugugaaggaaauggugucuggaagaaaguucugguucacaugccuuguagcuaagucuuucugcaaacaaccucccuuccccccgucgagucauuuggugacuuugauggggggauuucugguuaugucaaggcucuggagacaggaagggccuuuggccgccuuggguaguugaccugccuuuucugacuccgggacgagccaguccuaggcugccuccgggagcacuugagguaucccgcaggccaugaggacccacugggcagcuccuggacagccucuuggcuccagcccccacccgaaaguggacacuggcuccgcccuggccaccuggggacuggcacuguggugcacaguggcccaauguggccaacggaaguuuuauaaaagacaaaauguauaucaauaaacauuuuauaacuugcagccaggaaggc

SEQ ID NO: 15506 - RNA, 790 nt, Homo sapiens
cuugggguccgugggcaacgcuugcucaaagauggagaggacccaccgggcugagggcauuccugaaggugggcugggguagugugguuuccaacuuuggguccguccuguggaggguaaggggccaggagccagcaguguaauaaccuucaccccugagccaggcgccagcaccacaauguuuaauugauucccguuccagcuuucucaaggcacgacaggcccccucuuccucaucuugauuuggauacaagacgccagcuggcaggcaggaggugcugcugaagcccugcacggccccugaaaacugucacggcucaggagcuccaggcugaggccugggggaccucgcaucagucccuccacccacccugcccauggguuucaccacaggcagcuccaugagagccccggccccugcccuggcggcuucugcuuugcgggaagggcccuccgugggcucuggcugugucccugugcucuuccggcagugucaggggguaguggccucggccuggccgccggcccgggccgccugguacaugcugaggauugaggagauggugcccaugaggcccacuagccacggcgggaagcggccggcccacagcacgccccggggcagccagugcacggcguuggccaggucggccagguugcugagaagugacagcgccuccgacugcaucugcgccuccauggcccuccgcuugccccggggcagcgggcuguggggcagagaggggccgcuuacacucacgcucacaccugccugcccuucccaagcccc

SEQ ID NO: 15507 - RNA, 5007 nt, Homo sapiens
cgggggcagcgauggcgacggccgcggcgggcgcgggcgaacuacaagucccagcagcucccgcugcggcccucggccggccccucucgcuccccgggagcgccuggcggggccgcugggccgagggggccgccggcggggcuggcgggcggggggcuuccugcgggcccggggggagccggcggccggcgcgggcgcggcgggccgggcaggggcgaggggcgccgggugagugucccugcgagcgggcuggggccggggcggggggcuggguggggggcgggcgggcgggggagcuccaggcgcggggcgcagcccggggcgaccucuaaucgucccccgcccugcgcgccgccggcccuggcccaggcgagcgggggucgcgggagcgauggggaggggacucugcggccagcuccggccuagcgcacccaucccgccgcuggggcccggggggaaagggccaggagguugggagccuucaaucgggcgggguggggggcgcccgccagcucuggggucuggagcucaggacgcccccucccuaggaggcgauccaggacccccuccccuccugauucgagguauuguucccaccucccgccuggggucuggaguucaggaggcccuguccucaaaagggggaccuagggguucccucuucccccaggacccuaggaagggucccagcgauuguucccuugccccuccagucuuggggucugcaguucuggaagcuccuuucccuggaggugauccagggguccaccugcccucaccccugggaacucaggaaagacuuaagugauuucuccucccaccuuccaguuaagagaugggaauucagggggcuccuuccccuggaggcaaucuaaggguuccucugccccugaugcaggaggggucccaggucuuguuucccccacucuccaacuauggggucuggguugaggaccgccguccaggaacucggcucuguuugccugcacacucccagcuaugggguuguggcucaguguauuccuuuccccagaaggggagccacagguccccccacagcuucucccaggagcagaucauucauuguugacaccucaacacccagccaugggguggggagcucaaggcauccucccggcaggucauccugggcucccauugcuccccagaagugguuccagcuuuugucccucuaccucccagucugccccuagccacaagcuggcaauucaguucaggauccuuccugcaggaagggcuacaagugugcugacacuacccgccaugucccagccaugggaggagaugacucaggcguucccccauuaacuucagaggguccccagguauuauuuuugccuauccuccagcuagaaguuaaaaugcaggaccuucuagccaauagggaaaacagguauacuggccgggcaugguggcucaugccuguaaucaccauacuuugggaggcugaggugggaggaucauuugagcccaggaguuugaguccagccugggcaacauaccaagaccccaucucaaacauaaauaaauaaauaaaacagguauacuaacaacuguccccaccauccugccuaugggguucaugagucucccuacccaucccuccucaccaggaggggucccaaauaucacucuaccaugcucacuaucuggcuguaggaaagggcauuuccgaucugucuaagagagaggauuugacacugacucccaccuggagcugugagcucuggaauucagguuuucuuuuccccagagggcaagccagagucuucuugucuuuccccagugacuugggagggauaccugauguuauuuguuccauauucuuaucccccagacauggguucuagagcucagaaugcugcugcuggaggggggccucccuaccagaacucgcccccuaaauuaaucugccgccuccaaguaugggacaagaauucaggccaugugcucaggagcacagaaacgcugacacccacacuguuccccauguggggacgcccagcaaggggguaggaagcuaggacugucuccuccacaggaccccagcuucccacaagaggagcccagguuggagagaggugcagagccauggaguuggggacuagaaaccucuagugcugggucucaugaccuccguccagguuuggggcugagaggggaggguccuaccaugucccaccugguucccucaacucccugcccuggcugggguaagucagaaaucuccuugcagucagagacaagggaaggauccacguguaugcucagaagugagugggguuuggccaggcacaguggcucaugccuguaaucccagcacuuucugaggccaaggccagagguuugcuugaguccaggaguuugauaccagccugggcaacauagcgacaccccaucucaaaaaagagagacagagggagagagaaaggaaagaaggaaggaaagaaggaagaagagagagaaggaaggaaaagaaggaaggaaggaaagaaagaaagaaagagagagagagagaaagaaagaaagaaagaaagaaagaaagaaagaaagaaagaauugaaguuagcugagugugguggugcaucuguaauuccagcuacuugagaggccgaggugggaggaucgcuugagcccgggaguuccagucugcagugagcuauguaugaucacaucacugcacucuagccugggugacagagugagaccccaucucaaaaaaauaaaaauaaagaaguggggcugggcgcgguggcucacgccuguaaucccagcacuuugggaggcugaggcaugcagaucaccugaggucaggaguuugagaccagccugucuaacaugcugaaaucccaucucuacuaaaaauacaaaaauuagccaggcauggugguggacaccuguaaucccagcuacucaggaggcugaggcaggagaguuguuugaaccugggaggcggagguugcagugagccgagaugguaccuuugcacuccagccuuggcaacagaacgagaccccaucucaaaaaaaaaaaaaaaaaaaaaaagaaguggguucugggggcacaaucgggucccgucucucaucccuaaccagacuccaaaagacacccccgcucccacagaacccaccuacccucuacccucuauccuugcccuugcaggucuugccccagaagcugcgggcacauccacgccugaaaugcggcgcucaguccuggucaggaacccaggccacaaaggccugagacccguuuaugaagagcucgacucugacuccgaggaccuagaccccaauccugaagaucuggacccgguuucugaagacccagagccugauccugaagaccucaacacugucccggaagacguggaccccagcuaugaagaucuggagcccgucucggaggaucuggaccccgacgccgaagcuccgggcucggaaccccaagaucccgaccccaugucuucgaguuucgaccucgauccagaugugauuggccccguaccccugauucucgauccuaacagcgacacccucagccccggcgauccaaaaguggaccccaucuccucuggccucacugccaccccccaggucuuggccaccagccccgcggugcuccccgcccccgccagcccgccccggcccuucuccugcccggauugcgggcgagccuuccgccgcagcuccgggcugagccagcaucgccgcacgcacagcggcgagaagccguaccgcugccccgacugcgggaaguccuucagccacggugccacccuggcucagcaccguggcauccacacuggggcgcggccguaccagugcgcggccugcggcaaggccuucggcuggcgcuccacgcugcugaaacaucgcagcagccacagcggggagaagccgcaccacugcccgguguguggcaaggccuucgggcacggcucgcuccuggcacagcaccugcgcacgcacggcggcccgcggccccacaagugcccggugugcgccaagggcuucggccagggcucugcgcugcucaaacaccugcgcacgcacacgggcgagcggcccuacccguguccgcagugcggcaaggccuucgggcagagcucggcgcugcugcagcaccagcgcacacacacggccgagcgccccuaccgcugcccccacugcggcaaagccuucgggcagagcuccaacuugcaacaccaccugcgcauccacacgggcgagcggcccuacgccugcccgcacugcuccaaggccuucggccagagcucagcgcugcuccagcaccugcacgugcauucgggcgagcgucccuaucgcugucagcucugcgggaaggccuucggccaggccuccagccucaccaagcacaaacgggugcaugagggugcagccgcugcugcagcugccgcggccgcugcagcugcagcagcggccgccggccugggccucgggccuggccuaagcccugcauccaugaugaggccggggcaggucucccuccuggguccugaugcuguuucugugcucggcucuggcuugggccucagcccuggcaccagcucuggccgcaacccugacccuggcucugggccgggcacucugccggaucccagcuccaaaccccuccccggcuccagauccacccccagcccuacuccuguggaaucuucugacccaaaggcugggcacgacgcuggucccgaccuugugcccagcccagaccuugauccugugcccagcccagacccugauccugugcccagcccugaucccaacccuguguccugcccugaccccuguucucccacucguggcacugucagcccagcccucccuaccggcgagaguccagaguggguacaggagcaaggggcacugcuggggccugauggcugaaggagacgccggcauccucgggggccuggggaaguuguguguugugcagucaguaaaauccucccacugccuccgggcu

SEQ ID NO: 15508 - RNA, 5007 nt, Homo sapiens
agcccggaggcagugggaggauuuuacugacugcacaacacacaacuuccccaggcccccgaggaugccggcgucuccuucagccaucaggccccagcagugccccuugcuccuguacccacucuggacucucgccgguagggagggcugggcugacagugccacgagugggagaacaggggucagggcaggacacaggguugggaucagggcugggcacaggaucagggucugggcugggcacaggaucaaggucugggcugggcacaaggucgggaccagcgucgugcccagccuuugggucagaagauuccacaggaguagggcuggggguggaucuggagccggggagggguuuggagcugggauccggcagagugcccggcccagagccagggucaggguugcggccagagcuggugccagggcugaggcccaagccagagccgagcacagaaacagcaucaggacccaggagggagaccugccccggccucaucauggaugcagggcuuaggccaggcccgaggcccaggccggcggccgcugcugcagcugcagcggccgcggcagcugcagcagcggcugcacccucaugcacccguuugugcuuggugaggcuggaggccuggccgaaggccuucccgcagagcugacagcgauagggacgcucgcccgaaugcacgugcaggugcuggagcagcgcugagcucuggccgaaggccuuggagcagugcgggcaggcguagggccgcucgcccguguggaugcgcaggugguguugcaaguuggagcucugcccgaaggcuuugccgcagugggggcagcgguaggggcgcucggccgugugugugcgcuggugcugcagcagcgccgagcucugcccgaaggccuugccgcacugcggacacggguagggccgcucgcccgugugcgugcgcagguguuugagcagcgcagagcccuggccgaagcccuuggcgcacaccgggcacuuguggggccgcgggccgccgugcgugcgcaggugcugugccaggagcgagccgugcccgaaggccuugccacacaccgggcaguggugcggcuucuccccgcuguggcugcugcgauguuucagcagcguggagcgccagccgaaggccuugccgcaggccgcgcacugguacggccgcgccccaguguggaugccacggugcugagccaggguggcaccguggcugaaggacuucccgcagucggggcagcgguacggcuucucgccgcugugcgugcggcgaugcuggcucagcccggagcugcggcggaaggcucgcccgcaauccgggcaggagaagggccggggcgggcuggcgggggcggggagcaccgcggggcugguggccaagaccugggggguggcagugaggccagaggagaugggguccacuuuuggaucgccggggcugagggugucgcuguuaggaucgagaaucagggguacggggccaaucacaucuggaucgaggucgaaacucgaagacauggggucgggaucuugggguuccgagcccggagcuucggcgucgggguccagauccuccgagacgggcuccagaucuucauagcugggguccacgucuuccgggacaguguugaggucuucaggaucaggcucugggucuucagaaaccggguccagaucuucaggauuggggucuagguccucggagucagagucgagcucuucauaaacgggucucaggccuuuguggccuggguuccugaccaggacugagcgccgcauuucaggcguggaugugcccgcagcuucuggggcaagaccugcaagggcaaggauagaggguagaggguagguggguucugugggagcgggggugucuuuuggagucugguuagggaugagagacgggacccgauugugcccccagaacccacuucuuuuuuuuuuuuuuuuuuuuuuugagauggggucucguucuguugccaaggcuggagugcaaagguaccaucucggcucacugcaaccuccgccucccagguucaaacaacucuccugccucagccuccugaguagcugggauuacagguguccaccaccaugccuggcuaauuuuuguauuuuuaguagagaugggauuucagcauguuagacaggcuggucucaaacuccugaccucaggugaucugcaugccucagccucccaaagugcugggauuacaggcgugagccaccgcgcccagccccacuucuuuauuuuuauuuuuuugagauggggucucacucugucacccaggcuagagugcagugaugugaucauacauagcucacugcagacuggaacucccgggcucaagcgauccucccaccucggccucucaaguagcuggaauuacagaugcaccaccacacucagcuaacuucaauucuuucuuucuuucuuucuuucuuucuuucuuucuuucuuucucucucucucucuuucuuucuuucuuuccuuccuuccuucuuuuccuuccuucucucucuucuuccuucuuuccuuccuucuuuccuuucucucucccucugucucucuuuuuugagauggggugucgcuauguugcccaggcugguaucaaacuccuggacucaagcaaaccucuggccuuggccucagaaagugcugggauuacaggcaugagccacugugccuggccaaaccccacucacuucugagcauacacguggauccuucccuugucucugacugcaaggagauuucugacuuaccccagccagggcagggaguugagggaaccaggugggacaugguaggacccuccccucucagccccaaaccuggacggaggucaugagacccagcacuagagguuucuaguccccaacuccauggcucugcaccucucuccaaccugggcuccucuugugggaagcugggguccuguggaggagacaguccuagcuuccuacccccuugcugggcguccccacauggggaacagugugggugucagcguuucugugcuccugagcacauggccugaauucuugucccauacuuggaggcggcagauuaauuuagggggcgaguucugguagggaggccccccuccagcagcagcauucugagcucuagaacccaugucugggggauaagaauauggaacaaauaacaucagguaucccucccaagucacuggggaaagacaagaagacucuggcuugcccucuggggaaaagaaaaccugaauuccagagcucacagcuccaggugggagucagugucaaauccucucucuuagacagaucggaaaugcccuuuccuacagccagauagugagcaugguagagugauauuugggaccccuccuggugaggagggauggguagggagacucaugaaccccauaggcaggaugguggggacaguuguuaguauaccuguuuuauuuauuuauuuauguuugagauggggucuugguauguugcccaggcuggacucaaacuccugggcucaaaugauccucccaccucagccucccaaaguauggugauuacaggcaugagccaccaugcccggccaguauaccuguuuucccuauuggcuagaagguccugcauuuuaacuucuagcuggaggauaggcaaaaauaauaccuggggacccucugaaguuaaugggggaacgccugagucaucuccucccauggcugggacauggcggguagugucagcacacuuguagcccuuccugcaggaaggauccugaacugaauugccagcuuguggcuaggggcagacugggagguagagggacaaaagcuggaaccacuucuggggagcaaugggagcccaggaugaccugccgggaggaugccuugagcuccccaccccauggcuggguguugaggugucaacaaugaaugaucugcuccugggagaagcuguggggggaccuguggcuccccuucuggggaaaggaauacacugagccacaaccccauagcugggagugugcaggcaaacagagccgaguuccuggacggcgguccucaacccagaccccauaguuggagagugggggaaacaagaccugggaccccuccugcaucaggggcagaggaacccuuagauugccuccaggggaaggagcccccugaauucccaucucuuaacuggaaggugggaggagaaaucacuuaagucuuuccugaguucccaggggugagggcagguggaccccuggaucaccuccagggaaaggagcuuccagaacugcagaccccaagacuggaggggcaagggaacaaucgcugggacccuuccuaggguccugggggaagagggaaccccuaggucccccuuuugaggacagggccuccugaacuccagaccccaggcgggaggugggaacaauaccucgaaucaggaggggaggggguccuggaucgccuccuagggagggggcguccugagcuccagaccccagagcuggcgggcgccccccaccccgcccgauugaaggcucccaaccuccuggcccuuuccccccgggccccagcggcgggaugggugcgcuaggccggagcuggccgcagaguccccuccccaucgcucccgcgacccccgcucgccugggccagggccggcggcgcgcagggcgggggacgauuagaggucgccccgggcugcgccccgcgccuggagcucccccgcccgcccgccccccacccagccccccgccccggccccagcccgcucgcagggacacucacccggcgccccucgccccugcccggcccgccgcgcccgcgccggccgccggcuccccccgggcccgcaggaagccccccgcccgccagccccgccggcggcccccucggcccagcggccccgccaggcgcucccggggagcgagaggggccggccgagggccgcagcgggagcugcugggacuuguaguucgcccgcgcccgccgcggccgucgccaucgcugcccccg

SEQ ID NO: 15509 - RNA, 22800 nt, Homo sapiens
gcaggagcuccuacgccuaaggguagacacuggggcuggcacacacagagggucccuaauccuuuccaguaagcuaggcgcgcgcgcacacacucacacacgcgcgcgcgcacacauacacacucaguccuccgcaagcucccuccaccaucgccgcaguccaggccgccccccuccgccccgccccugcugcuccgugcacacugcagugaggggcccgggcggggcgcaggggcgcgccaggguccggguccggguucgggggcggggcgcaccugggcuccuccccggggcgggcccgacgcagcgucgccagcgcaagcggccgcaccuggcucagcagcggcggcggcggcggcggcggcagcggcgguagcagcagcgggcccggcuggggcgcgagcgcggcgcagcccagcccagcccaguccgagcgcggacccggcgcccgcagccccggcgccgccaugguggaggcggcgccccccgggcccgggccgcugcggaggaccuuucuagugcccgagaucaagucgcuggaccaguacgauuucucgcgggccaaggcggcggccagccuggcgugggugcugcgggccgcguucgggggcgcagguaccggggcucgggggaccggggucgggggcggcgggccgggcgcggcaggugcugggggggggcggggcgccgggccgggaaggcagggggccgugggaacaauagcgccggccgccggggguccccgggcucgggccccugccgcgccggggccuccgagcuuccugcucggcccgggcgguggacuuugccccgccggcugcgggagcgcgguggggguggggcccgcggcccagcuccgcgcggggguccccggcguccaagccuccaggugagccgggcggggucugcgggccggguggggucuccccgugcggaccucucguucccgccucccgcacccccaaggccuucccuugcacgccuucuucucuuuuacacacaucacgccccugcgaggaucuccucucggucucuucccccgccacacacccuggagacccagaccccgaccucgcuggggggucucgagcgcuccggucuccaccaccgcacgacccccaggccccaacacacaccccgcgucggcccuggccgcgcugcgggcggcgaccggggagcucugggaacccccuuucgccuccauagcccccuccagcgccuggcagcugcgacuuauggccccauuuuacuggggagguuggcgagcccagcugaagggaaauggguaguacaagaucgccuggggugggccccccgcuccucccggcugcggggccuucucccauuagagcagauccuucacucccucccccaggcccgcuugccugagagcccgagccacccuaauggggaggaugccguaaucccggguccccgggauuagaggcccuggaaacacucagucucggcuuugggcagcuucacaaccccaggccagagcuaggagucagggccuggccagagaagacagggguuaauuaaggucugggcuuuccagcggggagcuguggggguacauccuuuucucccacugguucugcccacugguguuggcacagcccauccccccucucccuggccuucccagaucaaccuguucugggugugggucucagugacagcuguccgucuccugguuccgccccagccugucccucuuucucccagacagucucugucugcgucguuccaugcaugcauuucccacucuggggucuaccucccugcagauauuugcuugaggaagaaagagauugggcauuggacagccaggacagccccagcuccucacuuccaagguuaccaggcuguagagaacucaacguggagugucagaauugaaugugaaguccagcugcaccagaaugcgaauuaucccaauuaucugagcuucuguuuccccuucuauaaaagaaggcguucauucacagacuuaucuguuuugcgaauguuuguggggcaggggcacuugcuauguguagggcacugcuccagugauggagaccccccguuaccucuuugcaagguugcugggaggcguaaaagcuguagugaccacagaauucuucgcguggcacggggcgcgugauacaugcgaaacgguugcucgcugcuggugugauuggcggugguauauuuugaugaauaauauuaacguuauccauuauccccuggccaggaaucagaguagaaauuaucccauuuugaagacagcaaagcaaacuucugaugagggguguuggugagcucccagugcccugacucacccaguucuguucuuguugacccagcucccucugcugugugacacacggcaguggcugccucuaccgugagggucaaguucaaucuguucccuguuccacuccccuaaaaagaggagaagggcugaaggaaaugggagcagaguucuacaagauucaugagcucuggggacucuugacgguaugauaccuaucaggugcugggcugggcgcucaggguguagaggagacggcaggggauggauauggggcagagggggaugggcaggaaaccagaucauagggaagcuggccagcggggccuggggaaagaaauucuugaaaucuuccagggagggaagagaucccacagguggaaagauuugagucuggaaggaugcauggaaguuugacacggagaagagaugugugggcagugggcaaaggcucggaguguggaccagcagggaguucucagagaauaagaugcagguccccgggguggcggugggagauaagggaggcuggucagacugaggaaggcccuucaggccccugguuauggauccaaggguacuggggagccacggacaguguugggaacugacaagaucagguaugcaguggccccgugggaguagugauggcucagaggaagggauaguucuggcaacuccaaggcacaggugugagaaggcugugcagaaauaaaagcagaacacaagcuuggagauuagauaagaaaggguuccaagccuggccaacacgaugaauccccgucucuacuaaaaauccaaaaauuagccgggaaugauggcacacgucuguagucccagcuacuugggaggcugaggcaggagaauuguugaaccugugaggcggagguugcagugagccgagauugcaccacugcacuccagccugggugaaagagagagacucugucucaaaaaacaaaggguuccauguuaaacacauuuggaaaacaccccaugcaguucuuuaugccuucagaacagaugugugaugugugagggaaacucaaguucauguuggacauuuuuauccuggacaaguuaucucagcucuccaggccuugguuuucucaucuguacaagggguauaauaauaagugucguaaggauuaaaugacuggaugcagggaaggucaugguauaaauaaaugguugggugugguggcaugggcuuguagucccagcuacucaggaggcugaggcaggaggauugccugagcccaggaguuccaggguacagucagcuaugaucacgccacugcacuccagccugggcaacagagugagauccugucucaaucagccuuccauccauccauccacccauccaucuacccacucauccauccauccacccacccauucauucauccauccauccacccacccaccuacccacugcacucauccauccacccacccaccccacucauccauccacccaccccacucauccauccacccacgcacucauccauccacccauccauccacccacucauccauccauccacccauccauccacccauucauucauccauccauccauccacccaccuacccacugcacucauccauccacccacccacccacccaccccacucauccauccacccacgcacucauccauccacccauccauccacccacucauccauccuuccacccacccauucauucauccauccauccauccauccauccauccauccacccacccaccuacucaccgcacucauccauccacccaccccacucauccauccacccacccacccaccccacucauccauccacccaccccacucauccauccacccacgcacucauccacccacacacucauccauccacccaccccacucauccauccaaccacgcacucauccauccacccacucauccacccgcccauccauccacccgcccauccauccacccacccacccacccauccacccacccaccuacccacccacacacucucccacccacccauccaccuauccacccauccauccacccacccauccacccauccauccauccacccacccaccaacucauccaccuacccacccacccacucauccacccacccacccauccacccauccauccacccgcccacucauccauccacccgcccacucauccauccacccgcccacucauccauccacccgcccauccauccauccacccacccauccauccaccuacccacacucccacccagccauccacccacccacccucccacccauccacccacccacccucccacccauccacccacccacccaucuacccauccguccguccauccacccacccacccaucuauccuuccacccacccacccacccacucauccauccacccauccacccacccacucauccauccacccacccacccacucucccacccucgcacccacccaccaacucauccacccacccacccacucauccacccacccacccauccacccauccguccacccgcccacucauccaugcacccgccgacucauccauccacccgcccauccauccauccacccacccacccacccccucauccauccacccacccucccaccgucccacccauccaccuauccacccauccacccacccacucgucuacccauccauccauccacccacccaccccccauccauccacccacacacccacccacucauccauccaccaacccacccacucauccacucauccauccacccacccacuuauccauccacccacccacucauccacucauccauccacccacccacucauccauccacccacccauccacccacccuuccauccacccauccauccacccacccacccauccucccacccuuccacccacccacccauccacuuauccacccauccacccacccacccaucuacccauccaucuaucuguccauccaccuacccauucauccauccauccauccacccacccauucauccauuuauccauccauccauccauccacccacccauucauccauuuauccauccauccauccauucacccacccauucauccauuuauccauccauccauccauccauccuagcuauguuguagaccugugcuauucaauaugguggccaccagccagauguggcuacugagucacuugaaaugugguugaucagaaccaagaugugcuguaaauguaaaauauacucaggguuccaaagacuugguccaaaaacaaacaacaaaaaccaguguaaaauaucuuaugaauaauauuuuuauguugauuacauguuaaaauaagagugggauaugucuugggucaaugaaauauauuacuaaauucuuauuguuucuacauauguaauguggcuucuaggaaacuugacggcucauugggcucacauuauacgcauuauauuucuuuuuuuuuucuuuuugagacagcaucuugcucuguggcccaggcuggagugccggggcacaaucucggcucaccacagccuccgucuccuggguucaagugauucucgugccucagccuccugaguagcugggauuacagacaugcgccaccacgcccagcuaauuuuuguauuuuuaguagaggugggguuucaccauguuggccagucugggcacauuguauuucuaucagacagcaguguucugcuguaaauaaugcucaguaaacauuuuagccaggugugguagcacaugccuguagucccagcuacucaggaggcugaggugggagggucccuugaacucaggaguucaagaccagccugagcaacauagugagaccccaucucuaaaauaaaauaaaauaaaauaaaauaaaauaaaauaaaauaaaugaauaaauaaaauaaaaagaaaguggggccaggugugguggcucaugccuguaaucccagcacuuugggaggcuaagguggguggguugcuugaggucaggguuugagaccagccuggucaacguggugaaaccccaucucuacuaaaaauacaaaaaguagccgggcaugguggugcacgccuguagucccagcuacuugggaggcugaagcaggagaauagcuugaacuugggaagcagaggucgcagugagccgagauggcaccacugcacuccagccugggugacagagcaagauugucucaaaaaaaaaaggaaagaaaaauagaauaaguuuauaguauaaggcagugguucucaacuggugaugauuuugacacuuaauugacauuuggcagugucuggggacauuugugguugucauuacuugggaggaauguacuacugacgucuaguaaauacagaccagagauuuugcuaaacaucucacaguguacaggacaggacagcauccccugaauacaaagaauuuuccagccccaaguaccaaugaaccaagguggaagaacaucgguguauaauaagugucugauaaaugucaguguagcccuagcuuaagguuuugguguuuuuuguuucuuguuuuucaucuuaaaggcccugaaaaguccuguaggaaagaaacacgugugauuuugcuggugggagcaagacgugcccaaggccggggcuggggagguagagaggaggguuuggauuugggagauaucaggaaguugaaagccaaggacgcauuaaauguggggugagggcguaaagaaagggagggagggugauuucucacugccuugggggcagggaggaggggaggugugggugagauguugagaauugugggagaugcccagggugcaguggggcccguggcagccgcuguugcagucuucagguggcccuggaagccgucacgggguaggguggccugggguggggguggggcauguccauuuacaaggagacgccugugggaggaagguuucuggaagaaggaggcacugggcacagagcccaggcgagauacgggcccacagauaugcuuuggaggucccugcuggccuuggggagaccggaagccaugagggcagcaucgagcucagggaaauugagggagagguggaggggggcugggagggcagggaggaagugagccugaaauaccucuucuuucaaggagccaagaugagaggggcaaaaagaagguccaagucuacaugcggguggcgcguuaagugggacgguccagugugguuuuagaaggugggaaaggagccaggacagggagggacagaaggcagccaagagugccuggguccucacagguggagaagucccguucaaauauguucugaagcacuagaaccccuuacccuguucuuucuuuucuuuuuuuuucuuucuuucuuuuuuuuuuuuuuaagacagaggcuugcucuaucacccaggcuggagugcaguggcgcaaucucagcuggcugcaaccucugccucccagauuuaagcgauucuccggccucggcuucccgaguagcugggauuauaggcgugugccaccaugcccagcucauuuuuguauuuuuaguagagaugggguuucaccauguugacaaggcuggucuugaacuccugaccuuaaaagaucugccuaccuuguuuucccaaagugcugggauuacaggcaugagucacugcacccggcccccaccccguucuuucaaacacacacacagaaccccaauauacaaaacaagucugggcacaguggcuuaccccuauaaucccagcacuuugggaagccaaggcagguggaucacuugaggccaggaaauucgaaaccagccugagcaacauggugaggcuuccaucuuuauaaaaaaauuuaaaaauuggcugggugugguggcacgugccugcggucccagcuacucaggaggcugaggcagggaggaucccuugagcccagaguucagguugcagugagccaugaucgugccacugcacuccagcaaaaacucaaacaaacagagaaggcugugcaggcugggcgugguggcucacgccuguaaucccagcacuuugggaggccaaggugagcagaucgcuugaggucaggaguucaagaccagccuggccaaaauggugauaacccuguuucuacaacauacaaaaauuagccggguauggcagcaucgcaccuguaaucccagcuacuugggagucugaggcaggagaaucauucgagcccgggaggcagagguugcagugagccaagauugcaccacugcccuccagccugggcgacagagagacucuuaucuccaaaaaaccgcaaaagcugugcagauuagaacaagagcuggacagauucccugcuguugauuucagucaccucuuccccgaccccugccaagccuuccuggccuucuccucuccacucuugguccuacguggauuucugcccccagcccacuguccaccuggggcuuccucacgccucuucccauuguccuauuuagggaccucaggcugucucuaugaugugaccucaccaucucucuaagccccagccuuucacauaaucugccucaaggauguccucaaagccccucacauucaauuucaccccuucaccucccauuccuccugcacccaagcucagucauuaccccucucuucccucuucccccucagacccagcaagguccuggcuaccucccucucugucccuugccuccucccuucaaucaccagguuuacaucacucaacucccucgaugugccuguggugugcccaccuccccugcucgccugugugccccccacucaucccccccugccugcaagcuaagagagggcguccaguuugcugggucuaaccccaguccugguguugaagaguuauuuggccuggggcaagggacuuuccuucucugugccucaguuuccuccucuguaacauggggguugccaauugggcccuggcugccuccuagcguugauguaaggcucagugagucuacauuggcaagagcaggaaggcucuuaggauugccgauguuauugucuuuccugggaccuacaagagccaguccagcuggccugguauuggggguagccuccccuccuuuccacucuaagugcccaucagcucccugaggcaccguguucucucccaccugcugggcuuugcaucugcaggccccucugccuacaacgccaucaccccuuccuccagcaaacuccugcacaucugcacucucagcccagauccccuuucuccuuucccaaugccauccucccugguccagacacacucuuaauccgggccaugugguguguguguguguguguguguguguguguuguaucuggugacccugacccccguguuuccccucuaugcccccacagagcacgugcccccggagcugugggagcccuucuauaccgaccaguacgcgcaggagcaugugaagcccccggugacacggcugcugcucucagccgagcucuacugcagagccuggcgccaggcacugccacagcuugaaacaccccccaaccccucugcacugcuggcccugcuggcgcggaggggcacagugccugcuuugcccgagcgcccggugcgcgaggccgaccugaggcaccagcccauucucaugguaggccccgccacugccuguuagaccacgccuaccaugcucagcuccuccccucaagcuccucccgccaguccuggcuccucccaaguucccucuaucagucuuggcuccuuucaagcuuugucgauuaagccuagcuccucccaucaggcuuggcuccucccccagguuccucccaccaggccuggcuccuccccucaagcgcuauuaagccuaguuccucccacgaggucuggcuccuccccucaagcgcuauccauuaagccuagcuccuaucagucuuggcuccuucccuuaagcuauguccaucaaaccuagcuccuccuaucaucagucuuggcucugucccuuaagcucuguccaucaaaccuagcuccucccaccaguccaggcuccuccccucaagcucuguucauuaagccuagcucuuccccccagcccuggcuccuccccucaagcucuucccaucaagccuggccccucccaucaaacccagcuccccaaaaaggcgcuacucuggcccuugaggauuuguguacacagcccacccuauccuaacgccuagcaucugaccucaaagucccacccaucgugcguggcuuuuccgggaccccauuucuuguuccuucccuuaaggccccacccaugaaccacuggccccgcccccucaagccccaccccccccgucaagucccucccaucugcagguucuuccuuuucccaggcccuugggggccgaggugcgccuccugcagcucucaggucucacccucuagcgcuugcccccacagggagcccaccuagcugucauugaugcccucauggcugccuuugccuucgaguggacaaagacccugccaggucccuuggcccugaccagcuuggagcacaagcugcuuuucuggguggacacgguaggugggguugggccugggguggguucggggaccagcaucguccaguggccagaccacugacccccucccugcccuccagaccguccggcggcugcaggagaagaccgagcaggaagcggcccagcgagccucuccagcagccccugcagacggggcggccccggcgcagcccucggugaggccagggcauagaaccgucagaaggaugggggaccggagaucugggagggcagggcugugcuuccuggacacuccugaaguggggagggggcuagaggugacacacucucucuuucuuccccccucucucaaucucucugugcccugcccguccccugugccgguacccgcugcccuccucucugccucucuggccucagugcccuacgcgcugguacuggaagcugguuccuguaaguggggcugucuguccgccccgucugccugcccugcuuguagcucugucugucuguaugucuguuucugccugccugucugcgcgcccucucauaccuccccaagcugugagcaaaggagguuggaccccaguccugggagacagggagaaccccucugugaaccaagagaaggguagaaucucggccauuaacugagagggcagaccccucccccagcgaacugauggguggggacgaacuuccccucccguuauucagaagggcaagcccuccccguucccauuaaugaagagggugggacccccugaaccugucccccuuagccgagguggggagaccacauaaauuucugaaggggggaccugcagcccaucacaaacguggauccugacccuagcaggcagggcacccucuggccaaggggaagacccuccaaugcagaagaagauagaauaacuuuccuaacugagacccccagcuucccuagagaaaaaucccagcuuugaaaaggaggaggaggcccaucccugaagcuggaaguugaaauuucucucuucccugaaugagcugugugaccuugcagaaguaucuaaaccucucugugcuucauauaaauuacucccauaguagauaaacaaggaggaagugggggagguuuugggcuggcuggcguccccaccuuugcucacuccuucccccacccuggggccuggguugggagguucccuuccugccuacccgcuuccucugcauccucuccccaagcugggggccugggucuuuugugggaggaggauuccccgcauaagaggggguuccuacucuguggggucccuuggggcugggaggagcugggguucgcgaagccggccagagcagucagggagcuggacggccggggcucaggaccagggucagggcuacccccucccccccaaggugggcuugggggcccagcaggucagcaccccucccccuugcugauggcugcuccucuccccccagcacgcaauugccuucuguuugaaggagucggggagcaaaccccccaugguaauguaucccccgccccggggucccaggagucccuguccccagcccccgcugcuggccuggcugcucgaagacaucuccucugccucuugcugcugccccuccccugcuccaggcuggccccccaacucugucucugggacccccagcuucccgcccccucauggcggaaaccccaggccucccugcccagccugcaugaccgcugacccugggggccagccuggccacucaccugaccuggcucccaucugcagauccgauaccgcaaggaccgugugguggcgcgacgugcccccugcuucccgacggugaccagccuccaggaccuggccaguggggccgcgcuggccgccaccauccacugcuauuguccccagcugcuucgacuugagggugaguaaauggauguggaacagaucuugugccggggagcugggcauccuaagucccagccccuagacccuccauccccagguccgcgagaccagcaacgaugcaguggucaugagggcagcuuccggaacuggcaggccugaguuugugucucucucuuccccaaugagcuuugugaccucacacaaguauauaaaccucucugugcuuccaggaguucauuccugcagcagaugaaacguauggaguguggacugugugccagaccuuguuuuaggcacuggggauccagccagaauagagacacacuccccacuucacagacggcucuagcugggagagaaagauacuaaguuuauccaaaaguacuuuuuuuuuuuuuuuuuugagacgggagucuugcucuguugcccaggcuggaguguaauggcaugaucucggcucacugcaaccuccaccucccagguucaagccauucuccugccucagccuccugaguagcugggacuacagccacacgccaccacgccuggcuaauuuuuguauuuuuaguagagacggguuucaccguguuggccaggcuggugucgaauuccugaccucaagugaucugccuaccuuggccucccuaagugcugggauugcaagugugaaccacugcacccggcccagaaguacuuuuugcauacuggguaguccuaaaggcaauggguggucagaaaaagcuuuuuuuaaaaaaacucuuuuuucuuuuuuauuaaaaaaaaaauuauagggcugggugugguggcucacgccuguaaucccagcaguuugggaggccgaggcggguggaucacgaggucacgaguucaagaccagccuggccaggauggugaaaccgucucuacuaaaaauacagaaauuagccgggugcgguggcgggcgccuguaaucccagcuacacaggaggcugaggcaggagaaucgcuugaacccaggaaguggagguugcagugagucaagaccaugccauugcacucuagccugggcaacagagcgagacuccaucucaaaaaaaaaaaaaaaaaaguauaaaauagagauggggucuugcuauguugcccaagcuggucuugaaucccugggcucaaacauccucccaccucagccuccccaagugcuaagauuacaggugugagccaccacaccuggcccggaaaagcuuuuugagcugaggucuugggggagaguguucuagaaagaugcaaaggccuaaggcaauagucaccaacuuuuuggcuccagggaccgguuuuguggaagacaauuuuuccacagauggaggcagggagguggucuugggauaauucaagcacguuaaucuuuauuauguacuuuauaucuaauacguuguaacauagaaugaaauaauucuacaacucaucaucauggggaaccagugggagcccugagcuuguuccugcaacuagacggucccagcugggggugaugagagacagugacagaucaucaggcauucgauuuucauaaggagggugcaaccuagaucccucacacgccagguucacaauaggguucgcgcuccuguaagaaucgaaugccgccgcugaucugacggaagcgggguucgggugguccugcaagugacggggagcggcuguaaauacacucacugcagcucaccugcuguacgguucaguuccugacaggccacgccccggggguuaaggacccccggccuaaggacggucuaucauauaauucaccucggccggguacaguggcucacgccuguaaucccagcacuuuggguggcugaggcggccggaucaugaagucaggagaucgagaccauccuggcuaacacggugaaaccccaucucuacuaaaaccacaaaaaauuagccugguguuguggcacacuccuguaaucccagcuacucaggaggcugaggugggagaaucacuugaacccgggaggcagagguugcagugagcugggauugcgccacugcacuacagccugggugacagagcgagacuccaucucaaaaaaaaaaaaaaaagaauucaccucucgaagggcaccuggcagaagcugggcucauaggaggucuuccgugugugggggacugcuggucccuggcuucccuggggccccauccuccuccucauagaguuggggacccacuccuccuguccccacagaggugugcuugaaggaccccaugucuguggcggacagccuguacaaccuccagcucgugcaggauuucugugccucucgccuuccucguggcugcccccugucccuugaggacuugcuguacgucccaccgccacucaagguaaggccauccuggggccuccugggccgaggcgggcaucuggggccaggggucccgucugcugacccggccucccaccuccaggucaacuugguggugaugcuggccgaguuguucauguguuuugaggugcucaagcccgacuuugugcaagugaaggacuugcccgauggucacggugaggcccugggggccugggggccgggucgggggcgggugggagagccaaacccccgccugacccucuucucuguacugcagcugccuccccccggggcacugaggccuccccaccucagaacaacagcggcaguagguacgcuccccacacugggcgagucucuggcauuguggguguggggcuccaugucugccuugcugagcacugggacgcagcugggugaugcuguugucuccccccggggagaggcggaggaggagguggggguccugaggcugaaguacgucucuccguacaguucuccugucuucaccuuccgccacccgcuucugucaucugguggcccccaguccccacuccgaggauccacaggugaggaggggguagguggcuucugucacgggggacccccccacucacagacugccccagugggccucauguugucuccucgugagccuuccaauagccucuccaucagaucccccuugggcaucccaaagugacccccagaauggccuccccaguggccccacaguaccccguagugacaguaaauggccccggguaucuguuucuggaaaccucuggucucacuagaccacauaaugagccaucagugacucacccaaugaccuugcagagguuguccccagaugcuggcugaccccacucaggguucccaggguccccauagugaccacucaucgccucccccaggcucccugaagucuuccccguccaugucccauauggaggcccugggcaaggccuggaaccggcagcucaggugaguagaccucacaggccaggguaggggguggagcaggcuagggcggguuggggccgaggcuggucccaggggcugaccccucccuccggccgcccagccguccccucucccaggcugugucauucagcacccccuuuggccuggacagcgacguggaugucgucaugggagacccugugcuccuccgcucugugagcucggacagccugggccccccgcgucccgcgccggccaggacccccacccagccacccccggagccuggugaccugcccaccaucgaggaagcucugcagaucauccacagugccgagccccggcuccucccagauggggcggccgacggcagcuucuaccuccacuccccugaggggcccuccaagccaucccuggccucccccuaccugcccgaggggaccuccaaaccacuguccgacaggcccaccaaagcaccaguguacaugccacaccccgagacccccucgaaaccaucucccugucuggugggggaggcaucgaaaccgccagccccauccgagggguccccgaaggcgguggcuucguccccagcagccaccaacuccgaggugaaaaugaccagcuuugcagaacgcaagaaacagcuggugaaggcagaggcugaggccggagcggggucccccacguccacuccggccccgccggaggcccugagcucggagaugagugagcucagcgcccggcuggaggagaaacgcagagccaucgaggcucagaagcgacggauugaggccauauucgccaagcaccgccagcggcugggcaaaagcgccuuccugcaggugcagccgcgggaagccucuggggaggcggaagcagaggcggaggaggccgauuccgguccagucccugguggggagcggcccgcaggcgagggccagggugagccaaccucacggcccaaggcagugaccuucucgccagaccugggcccggugccccacgaggggcugggggaauacaaucgagcggucagcaagcugagugccgccuugagcucgcugcagcgggacaugcagaggcucacggaccagcagcagcggcuccuggccccgcccgaggcccccggauccgccccaccaccugcugcgugggucaucccuggccccacgacggggcccaaagcugcaucccccagccccgcccggcgagucccggccacccggcgcagcccugggcccgggcccagccagucaccccgcagcccgaaacacacgcggccagcggagcugcggcuggcacccuugaccagggugcuuacgccaccccacgacguagacagccucccccaccugcgcaaguucucgccgagccaggugcccgugcagacgcgcucuuccauccuccuggcggaggagacgccccccgaggagccagccgcccggccgggccucaucgagaucccgcugggcagccuggcagaucccgccgccgaggacgagggagacgggagccccgcuggugcugaggauuccuuggaggaggaggcgucuucggagggggagccccggguggggcugggguucuucuacaaggugaguccccgagcagguggcuggaggguccugggccuggggcgggggcgggugggggcggggggagguggacaaacccacuauuggaugaauagggcuuuacugaaggaugggugggcgggugggggauagauggggagccagguaugaauggacagaacaggugugaguggcuggguaaggccuccaugggugggagaggggggaaagggacauuugcacgguggggggcagguauguggggugacaggggccucagaugggauuugacccugucuguuggguaaggacuuccacaaggggcugugggggugcaguggggugagagguccucccccuguggcuuaaugagugaggcccucggguauguuugggggugagggguuuccagugggggcugacccagucaugucccucccaaacaagguauggguggccggacaagggggauagauagauguggggagggguggagaaacagggaggagucauggauagacagauggaugaauggcugguugcaugggugggugggugauggacagauagacggacaggaccaggaucuucagcgcaccuccuugcucauccucuccuucacccccucgcccccagcacgcuccuaccaccccuuuccuggcccugcccuguguccacugucucuccauucccauggcuuucccagccggggacaccuaggguuaccugacuggccucugcugccugccuccaucccgggccauuuugcacugaguggucggggauuuugacugcuccccuuacccuugcuuuuagaaugaaaguccuccccaggguggccgggcgcaguggcucaugccuguaaucccagcacuuugggaggccaaggcaggcggaucaugaggucaggagaucgagaccauccuggcuaacauggugaaacuccgucucuacuaaaaauacaaaaaauuagcuggcgugguggcgggcgcauguagucccagcuacucaggaggcugaggcaggagaauggcgugaacccaggagguggagcuugcagugggccuagaucgugccacugcacuccagccugggcaacagagcgagacuccaucucaaaaaaaaaaaaaaaaaaaaaaaagugagcacagcccaaagcccuggggaggacuuccuuuucauuuuuuuuuuuuguuuuguuuucuuuuguuuuuuguuuuuugagacagagucucgcucuguggcccaggcuggagugcaguggcaugaucucgguucacugcaaccuccaccuccuggguuuaagugauucucuugucucacccuccugaguagcugggacuacaagagcaugccaccacgcccagcugauuuuugcauuuuuaguagagacaggguuucuccaggcuggucucgaaccccugaccucaagugauccaccugccuuggccucccaaacugcugggauuacaggugugagccaccgcgucuggccuguacucacuucugacuuaguccugcgccacuguccucagcucugugucccagccacacuggcccccuuguacuuccgugccccccaguagguuugcuccagccucagggccucggcacuagcuguccccucugccuggaacgcucugcucuguacgcccaccuaguuaaauccugaucauucuacaggguacuuccucugggaagccuuccugggugucuccaggccaggccgggguccucccgcaguguagagugucugugcccaacacgagcuuuugcuggcacucacugcugucugcugcuuuugucuuccccguuggguuaagcagugugugugugagcggcacccaguguaucccaucccuguugugucccaguacuuaguguggggcugugcauacaguaggcaccaacuaagugcauuuagaacaaugaugaaaacaaaagcacagguggguggcgggcaggcuggguggagggaagaugggccuccagccauguugggggaggggguggcuggcuggacucggcgucuguccccaggaugaagacaagccugaggacgagauggcccaaaagcgggccagccugcuggagcggcagcagcggcgagcagaggaggcgcggcggcgcaagcaguggcaggagguggagaaggaacagcggagggaggaggccgcgaggugaggccgggccugcccgggacgcccgcuccuuggccugucugccaccgcggaccccgugagcgguucugaugccgauucccugugaucugcaggcuggcccaagaggaggccccgggcccagccccgcuuguguccgcagucccgauggcgacuccagccccugcugcccgggcuccagccgaggaggaggugggcccccggaagggggacuucacgcggcaggaguacgagcgccgggcccagcugaagcugauggacgaccucgauaaggugcugcggccccgggcugcgggguccggggguccaggucggggcgggcggagggccacccggccucgcucggguugcugugacgacucagcccuggcacgaagcccagcccgcggccugcugggugaggacccuugggggacggggccugcccagugcccuuuccggggcucacugggugaggcccccauggguaaggggggagggggagggagauguaagcaggggugccgggagggggcggguauguggggugacagggggccucaggugggguuggacacugucucuuggguaaagacuuccauagggggccgggcgcgguggcucacgccuguaaucccagcacuuugggaggcugaggcgggcggaucaccugaggucaggaguuugagaccagccuggccaacauggugaaagcccaucucuauuaaaaauacaaaaauuagccgggcauauggcaugccuguagucccagcuacuugggagacugaggcaggagaaucgcuugagccugggagguggagguugcggugagccaagauugcaccacuguacuccagccugggcaacagagcgagacuccgucucagaaauaagacaaaaaaaaaaaaaaaagacuuccauagggauguggggugcagugggaugaggggucuuucuucuguggcuucauggauaggaaccuuugggaguauguuuggggugaggcguugccaguaggggcugacccagugcugcuccccacuugccugcugggcaaagcauccucccucauagagggguccccccauaggggugcugcagagggccgaggggucuugggcaggacugacuccuccuguguuccccccacagccugcuggaccggguguuguggagggcaggggcuucuggugggcacugaccugcaaucucuguccccaggcucucggcugagcaaaaucuauucccaguccacccugucacuguccacuguggccaacgaggcccacaauaaccucggggugaagaggcccacgucucggugaguuuagcccgcacaggcgggguucguaugccggguggcuucccagagccugggaggugugugggcaucugggugaaccuagagggcgguauggcucgaguuuauggauacgccaugaagagauggagggacgcgugugggcacgugugcauggggcauagucuguaccuggcagacaggacucaagcaugugccucagugcacuugagugccagguguuccugugggaggaggacagcacggggcacugcauggacuugggagggugugcaguguauaccgccuccucugcaguguguguggcccgccuuuuuuuuuuuuuuuuuuuuuuuuguuuuuuugagagggagucuugcugugucgcccaggcuggagugcaguggcgcaaucuuggcucacggcaaccuccgcccccugggugcaagugauucucgugccucagccuccugaguagcugggguuacccgugccuguagagacgguguuucaccauguuggccaggcuggccucgaacucccgaccucaagugaucugcccgcuuuggccucccgaagugcugggauuacaggcaugagccacgaugcccagccguggcccuuauuuuccuuggccccucugcacauagggaagcuucccaucucugaccccaccuccaucccauccugaccccaccuccaucccauccuucucccacugcagggcucccuccccgucaggucucauguccccaagccgccugccuggaagccgcgaacgggacugggaaaauggcagcaaugccuccuccccagcgucagugcccgaguacacagguaagcaggggcucugggugaugugaggagcaacaggcacccuccuccacagccccugcucauuccugcugccccccacccccucccacugccucacccucuagguccacggcuguacaaagaacccagcgccaaguccaacaaguucaucauccacaaugcccuaucacacugcugccuggcgggcaaggugaacgaaccgcagaagaaucgcauucuggaggugagcccgcccacacgugggaguugggggcugguggguggguggguggccugacuuggccagcugaccauuuccagcacuccugcccaggaaauugagaaaagcaaggccaaccacuuccugauccucuuucgcgacucgagcugccaguuccgggcgcucuacacgcugucgggggagacagaggagcugucgcggcuggcaggguaugggccccggaccgucacgcccgccaugguggaaggcaucuacaaguacaacucggaccgcaagcgcuucacccagauccccgccaagaccauguccaugagcgucgaugccuucaccauccagggacaccucuggcagggcaagaaacccaccacucccaagaagggcggcggcacccccaaauagccccacccgggcgguccacgggccgggcccugugugcugcggccgccauccccuggaggacagucagucgguauuccuggguccugucuguccccaaccgugucuggguggggcuggagucuccacccucugacuuugaguccaguccugcugugggggcugagcugggagguucagggacucagggcucagcucaguccccuugucuguccucccccacuucuugaauaaaauaauuuaaagagaaguugaaccuugucccccccuccgaggcuggc

SEQ ID NO: 15510 - RNA, 22800 nt, Homo sapiens
gccagccucggagggggggacaagguucaacuucucuuuaaauuauuuuauucaagaagugggggaggacagacaaggggacugagcugagcccugagucccugaaccucccagcucagcccccacagcaggacuggacucaaagucagaggguggagacuccagccccacccagacacgguuggggacagacaggacccaggaauaccgacugacuguccuccaggggauggcggccgcagcacacagggcccggcccguggaccgcccggguggggcuauuugggggugccgccgcccuucuugggagugguggguuucuugcccugccagaggugucccuggauggugaaggcaucgacgcucauggacauggucuuggcggggaucugggugaagcgcuugcgguccgaguuguacuuguagaugccuuccaccauggcgggcgugacgguccggggcccauacccugccagccgcgacagcuccucugucucccccgacagcguguagagcgcccggaacuggcagcucgagucgcgaaagaggaucaggaagugguuggccuugcuuuucucaauuuccugggcaggagugcuggaaauggucagcuggccaagucaggccacccacccacccaccagcccccaacucccacgugugggcgggcucaccuccagaaugcgauucuucugcgguucguucaccuugcccgccaggcagcagugugauagggcauuguggaugaugaacuuguuggacuuggcgcuggguucuuuguacagccguggaccuagagggugaggcagugggaggggguggggggcagcaggaaugagcaggggcuguggaggagggugccuguugcuccucacaucacccagagccccugcuuaccuguguacucgggcacugacgcuggggaggaggcauugcugccauuuucccagucccguucgcggcuuccaggcaggcggcuuggggacaugagaccugacggggagggagcccugcagugggagaaggaugggauggagguggggucaggaugggauggagguggggucagagaugggaagcuucccuaugugcagaggggccaaggaaaauaagggccacggcugggcaucguggcucaugccuguaaucccagcacuucgggaggccaaagcgggcagaucacuugaggucgggaguucgaggccagccuggccaacauggugaaacaccgucucuacaggcacggguaaccccagcuacucaggaggcugaggcacgagaaucacuugcacccagggggcggagguugccgugagccaagauugcgccacugcacuccagccugggcgacacagcaagacucccucucaaaaaaacaaaaaaaaaaaaaaaaaaaaaaaaggcgggccacacacacugcagaggaggcgguauacacugcacacccucccaaguccaugcagugccccgugcuguccuccucccacaggaacaccuggcacucaagugcacugaggcacaugcuugaguccugucugccagguacagacuaugccccaugcacacgugcccacacgcgucccuccaucucuucauggcguauccauaaacucgagccauaccgcccucuagguucacccagaugcccacacaccucccaggcucugggaagccacccggcauacgaaccccgccugugcgggcuaaacucaccgagacgugggccucuucaccccgagguuauugugggccucguuggccacaguggacagugacaggguggacugggaauagauuuugcucagccgagagccuggggacagagauugcaggucagugcccaccagaagccccugcccuccacaacacccgguccagcaggcuguggggggaacacaggaggagucaguccugcccaagaccccucggcccucugcagcaccccuauggggggaccccucuaugagggaggaugcuuugcccagcaggcaaguggggagcagcacugggucagccccuacuggcaacgccucaccccaaacauacucccaaagguuccuauccaugaagccacagaagaaagaccccucaucccacugcaccccacaucccuauggaagucuuuuuuuuuuuuuuuugucuuauuucugagacggagucucgcucuguugcccaggcuggaguacaguggugcaaucuuggcucaccgcaaccuccaccucccaggcucaagcgauucuccugccucagucucccaaguagcugggacuacaggcaugccauaugcccggcuaauuuuuguauuuuuaauagagaugggcuuucaccauguuggccaggcuggucucaaacuccugaccucaggugauccgcccgccucagccucccaaagugcugggauuacaggcgugagccaccgcgcccggcccccuauggaagucuuuacccaagagacaguguccaaccccaccugaggcccccugucaccccacauacccgcccccucccggcaccccugcuuacaucucccucccccuccccccuuacccaugggggccucacccagugagccccggaaagggcacugggcaggccccgucccccaaggguccucacccagcaggccgcgggcugggcuucgugccagggcugagucgucacagcaacccgagcgaggccggguggcccuccgcccgccccgaccuggacccccggaccccgcagcccggggccgcagcaccuuaucgaggucguccaucagcuucagcugggcccggcgcucguacuccugccgcgugaagucccccuuccgggggcccaccuccuccucggcuggagcccgggcagcaggggcuggagucgccaucgggacugcggacacaagcggggcugggcccggggccuccucuugggccagccugcagaucacagggaaucggcaucagaaccgcucacgggguccgcgguggcagacaggccaaggagcgggcgucccgggcaggcccggccucaccucgcggccuccucccuccgcuguuccuucuccaccuccugccacugcuugcgccgccgcgccuccucugcucgccgcugcugccgcuccagcaggcuggcccgcuuuugggccaucucguccucaggcuugucuucauccuggggacagacgccgaguccagccagccacccccucccccaacauggcuggaggcccaucuucccuccacccagccugcccgccacccaccugugcuuuuguuuucaucauuguucuaaaugcacuuaguuggugccuacuguaugcacagccccacacuaaguacugggacacaacagggaugggauacacugggugccgcucacacacacacugcuuaacccaacggggaagacaaaagcagcagacagcagugagugccagcaaaagcucguguugggcacagacacucuacacugcgggaggaccccggccuggccuggagacacccaggaaggcuucccagaggaaguacccuguagaaugaucaggauuuaacuaggugggcguacagagcagagcguuccaggcagaggggacagcuagugccgaggcccugaggcuggagcaaaccuacuggggggcacggaaguacaagggggccaguguggcugggacacagagcugaggacaguggcgcaggacuaagucagaagugaguacaggccagacgcgguggcucacaccuguaaucccagcaguuugggaggccaaggcagguggaucacuugaggucagggguucgagaccagccuggagaaacccugucucuacuaaaaaugcaaaaaucagcugggcgugguggcaugcucuuguagucccagcuacucaggagggugagacaagagaaucacuuaaacccaggagguggagguugcagugaaccgagaucaugccacugcacuccagccugggccacagagcgagacucugucucaaaaaacaaaaaacaaaagaaaacaaaacaaaaaaaaaaaaugaaaaggaaguccuccccagggcuuugggcugugcucacuuuuuuuuuuuuuuuuuuuuuuuugagauggagucucgcucuguugcccaggcuggagugcaguggcacgaucuaggcccacugcaagcuccaccuccuggguucacgccauucuccugccucagccuccugaguagcugggacuacaugcgcccgccaccacgccagcuaauuuuuuguauuuuuaguagagacggaguuucaccauguuagccaggauggucucgaucuccugaccucaugauccgccugccuuggccucccaaagugcugggauuacaggcaugagccacugcgcccggccacccuggggaggacuuucauucuaaaagcaaggguaaggggagcagucaaaauccccgaccacucagugcaaaauggcccgggauggaggcaggcagcagaggccagucagguaacccuagguguccccggcugggaaagccaugggaauggagagacaguggacacagggcagggccaggaaaggggugguaggagcgugcugggggcgagggggugaaggagaggaugagcaaggaggugcgcugaagauccugguccuguccgucuaucuguccaucacccacccacccaugcaaccagccauucauccaucugucuauccaugacuccucccuguuucuccaccccuccccacaucuaucuaucccccuuguccggccacccauaccuuguuugggagggacaugacugggucagcccccacuggaaaccccucacccccaaacauacccgagggccucacucauuaagccacagggggaggaccucucaccccacugcacccccacagccccuuguggaaguccuuacccaacagacagggucaaaucccaucugaggccccugucaccccacauaccugccccccaccgugcaaaugucccuuuccccccucucccacccauggaggccuuacccagccacucacaccuguucuguccauucauaccuggcuccccaucuaucccccacccgcccacccauccuucaguaaagcccuauucauccaauaguggguuuguccaccuccccccgcccccacccgcccccgccccaggcccaggacccuccagccaccugcucggggacucaccuuguagaagaaccccagccccacccggggcucccccuccgaagacgccuccuccuccaaggaauccucagcaccagcggggcucccgucucccucguccucggcggcgggaucugccaggcugcccagcgggaucucgaugaggcccggccgggcggcuggcuccucggggggcgucuccuccgccaggaggauggaagagcgcgucugcacgggcaccuggcucggcgagaacuugcgcaggugggggaggcugucuacgucgugggguggcguaagcacccuggucaagggugccagccgcagcuccgcuggccgcguguguuucgggcugcggggugacuggcugggcccgggcccagggcugcgccggguggccgggacucgccgggcggggcugggggaugcagcuuugggccccgucguggggccagggaugacccacgcagcaggugguggggcggauccgggggccucgggcggggccaggagccgcugcugcugguccgugagccucugcaugucccgcugcagcgagcucaaggcggcacucagcuugcugaccgcucgauuguauucccccagccccucguggggcaccgggcccaggucuggcgagaaggucacugccuugggccgugagguuggcucacccuggcccucgccugcgggccgcuccccaccagggacuggaccggaaucggccuccuccgccucugcuuccgccuccccagaggcuucccgcggcugcaccugcaggaaggcgcuuuugcccagccgcuggcggugcuuggcgaauauggccucaauccgucgcuucugagccucgauggcucugcguuucuccuccagccgggcgcugagcucacucaucuccgagcucagggccuccggcggggccggaguggacgugggggaccccgcuccggccucagccucugccuucaccagcuguuucuugcguucugcaaagcuggucauuuucaccucggaguugguggcugcuggggacgaagccaccgccuucggggaccccucggauggggcuggcgguuucgaugccucccccaccagacagggagaugguuucgagggggucucgggguguggcauguacacuggugcuuuggugggccugucggacagugguuuggagguccccucgggcagguagggggaggccagggauggcuuggagggccccucaggggaguggagguagaagcugccgucggccgccccaucugggaggagccggggcucggcacuguggaugaucugcagagcuuccucgauggugggcaggucaccaggcuccggggguggcuggguggggguccuggccggcgcgggacgcggggggcccaggcuguccgagcucacagagcggaggagcacagggucucccaugacgacauccacgucgcuguccaggccaaagggggugcugaaugacacagccugggagaggggacggcugggcggccggagggaggggucagccccugggaccagccucggccccaacccgcccuagccugcuccacccccuacccuggccugugaggucuacucaccugagcugccgguuccaggccuugcccagggccuccauaugggacauggacggggaagacuucagggagccugggggaggcgaugaguggucacuauggggacccugggaacccugaguggggucagccagcaucuggggacaaccucugcaaggucauugggugagucacugauggcucauuauguggucuagugagaccagagguuuccagaaacagauacccggggccauuuacugucacuacgggguacuguggggccacuggggaggccauucugggggucacuuugggaugcccaagggggaucugauggagaggcuauuggaaggcucacgaggagacaacaugaggcccacuggggcagucugugagugggggggucccccgugacagaagccaccuacccccuccucaccuguggauccucggaguggggacugggggccaccagaugacagaagcggguggcggaaggugaagacaggagaacuguacggagagacguacuucagccucaggacccccaccuccuccuccgccucuccccggggggagacaacagcaucacccagcugcgucccagugcucagcaaggcagacauggagccccacacccacaaugccagagacucgcccaguguggggagcguaccuacugccgcuguuguucugagguggggaggccucagugccccggggggaggcagcugcaguacagagaagagggucaggcggggguuuggcucucccacccgcccccgacccggcccccaggcccccagggccucaccgugaccaucgggcaaguccuucacuugcacaaagucgggcuugagcaccucaaaacacaugaacaacucggccagcaucaccaccaaguugaccuggaggugggaggccgggucagcagacgggaccccuggccccagaugcccgccucggcccaggaggccccaggauggccuuaccuugaguggcggugggacguacagcaaguccucaagggacagggggcagccacgaggaaggcgagaggcacagaaauccugcacgagcuggagguuguacaggcuguccgccacagacaugggguccuucaagcacaccucuguggggacaggaggaguggguccccaacucuaugaggaggaggauggggccccagggaagccagggaccagcagucccccacacacggaagaccuccuaugagcccagcuucugccaggugcccuucgagaggugaauucuuuuuuuuuuuuuuuugagauggagucucgcucugucacccaggcuguagugcaguggcgcaaucccagcucacugcaaccucugccucccggguucaagugauucucccaccucagccuccugaguagcugggauuacaggagugugccacaacaccaggcuaauuuuuugugguuuuaguagagaugggguuucaccguguuagccaggauggucucgaucuccugacuucaugauccggccgccucagccacccaaagugcugggauuacaggcgugagccacuguacccggccgaggugaauuauaugauagaccguccuuaggccggggguccuuaacccccggggcguggccugucaggaacugaaccguacagcaggugagcugcagugaguguauuuacagccgcuccccgucacuugcaggaccacccgaaccccgcuuccgucagaucagcggcggcauucgauucuuacaggagcgcgaacccuauugugaaccuggcgugugagggaucuagguugcacccuccuuaugaaaaucgaaugccugaugaucugucacugucucucaucacccccagcugggaccgucuaguugcaggaacaagcucagggcucccacugguuccccaugaugaugaguuguagaauuauuucauucuauguuacaacguauuagauauaaaguacauaauaaagauuaacgugcuugaauuaucccaagaccaccucccugccuccaucuguggaaaaauugucuuccacaaaaccggucccuggagccaaaaaguuggugacuauugccuuaggccuuugcaucuuucuagaacacucucccccaagaccucagcucaaaaagcuuuuccgggccaggugugguggcucacaccuguaaucuuagcacuuggggaggcugaggugggaggauguuugagcccagggauucaagaccagcuugggcaacauagcaagaccccaucucuauuuuauacuuuuuuuuuuuuuuuuuugagauggagucucgcucuguugcccaggcuagagugcaauggcauggucuugacucacugcaaccuccacuuccuggguucaagcgauucuccugccucagccuccuguguagcugggauuacaggcgcccgccaccgcacccggcuaauuucuguauuuuuaguagagacgguuucaccauccuggccaggcuggucuugaacucgugaccucgugauccacccgccucggccucccaaacugcugggauuacaggcgugagccaccacacccagcccuauaauuuuuuuuuuaauaaaaaagaaaaaagaguuuuuuuaaaaaaagcuuuuucugaccacccauugccuuuaggacuacccaguaugcaaaaaguacuucugggccgggugcagugguucacacuugcaaucccagcacuuagggaggccaagguaggcagaucacuugaggucaggaauucgacaccagccuggccaacacggugaaacccgucucuacuaaaaauacaaaaauuagccaggcgugguggcguguggcuguagucccagcuacucaggaggcugaggcaggagaauggcuugaaccugggagguggagguugcagugagccgagaucaugccauuacacuccagccugggcaacagagcaagacucccgucucaaaaaaaaaaaaaaaaaaguacuuuuggauaaacuuaguaucuuucucucccagcuagagccgucugugaaguggggagugugucucuauucuggcuggauccccagugccuaaaacaaggucuggcacacaguccacacuccauacguuucaucugcugcaggaaugaacuccuggaagcacagagagguuuauauacuugugugaggucacaaagcucauuggggaagagagagacacaaacucaggccugccaguuccggaagcugcccucaugaccacugcaucguugcuggucucgcggaccuggggauggagggucuaggggcugggacuuaggaugcccagcuccccggcacaagaucuguuccacauccauuuacucacccucaagucgaagcagcuggggacaauagcaguggaugguggcggccagcgcggccccacuggccagguccuggaggcuggucaccgucgggaagcagggggcacgucgcgccaccacacgguccuugcgguaucggaucugcagaugggagccaggucaggugaguggccaggcuggcccccagggucagcggucaugcaggcugggcagggaggccugggguuuccgccaugagggggcgggaagcugggggucccagagacagaguuggggggccagccuggagcaggggaggggcagcagcaagaggcagaggagaugucuucgagcagccaggccagcagcgggggcuggggacagggacuccugggaccccggggcgggggauacauuaccaugggggguuugcuccccgacuccuucaaacagaaggcaauugcgugcuggggggagaggagcagccaucagcaagggggaggggugcugaccugcugggcccccaagcccaccuugggggggaggggguagcccugacccugguccugagccccggccguccagcucccugacugcucuggccggcuucgcgaaccccagcuccucccagccccaagggaccccacagaguaggaacccccucuuaugcggggaauccuccucccacaaaagacccaggcccccagcuuggggagaggaugcagaggaagcggguaggcaggaagggaaccucccaacccaggccccagggugggggaaggagugagcaaagguggggacgccagccagcccaaaaccucccccacuuccuccuuguuuaucuacuaugggaguaauuuauaugaagcacagagagguuuagauacuucugcaaggucacacagcucauucagggaagagagaaauuucaacuuccagcuucagggaugggccuccuccuccuuuucaaagcugggauuuuucucuagggaagcugggggucucaguuaggaaaguuauucuaucuucuucugcauuggagggucuuccccuuggccagagggugcccugccugcuagggucaggauccacguuugugaugggcugcagguccccccuucagaaauuuauguggucuccccaccucggcuaagggggacagguucagggggucccacccucuucauuaaugggaacggggagggcuugcccuucugaauaacgggaggggaaguucguccccacccaucaguucgcugggggaggggucugcccucucaguuaauggccgagauucuacccuucucuugguucacagagggguucucccugucucccaggacugggguccaaccuccuuugcucacagcuuggggagguaugagagggcgcgcagacaggcaggcagaaacagacauacagacagacagagcuacaagcagggcaggcagacggggcggacagacagccccacuuacaggaaccagcuuccaguaccagcgcguagggcacugaggccagagaggcagagaggagggcagcggguaccggcacaggggacgggcagggcacagagagauugagagaggggggaagaaagagagagugugucaccucuagcccccuccccacuucaggaguguccaggaagcacagcccugcccucccagaucuccggucccccauccuucugacgguucuaugcccuggccucaccgagggcugcgccggggccgccccgucugcaggggcugcuggagaggcucgcugggccgcuuccugcucggucuucuccugcagccgccggacggucuggagggcagggagggggucaguggucuggccacuggacgaugcugguccccgaacccaccccaggcccaaccccaccuaccguguccacccagaaaagcagcuugugcuccaagcuggucagggccaagggaccuggcagggucuuuguccacucgaaggcaaaggcagccaugagggcaucaaugacagcuaggugggcucccugugggggcaagcgcuagagggugagaccugagagcugcaggaggcgcaccucggcccccaagggccugggaaaaggaagaaccugcagaugggagggacuugacgggggggguggggcuugagggggcggggccagugguucauggguggggccuuaagggaaggaacaagaaauggggucccggaaaagccacgcacgaugggugggacuuugaggucagaugcuaggcguuaggauagggugggcuguguacacaaauccucaagggccagaguagcgccuuuuuggggagcuggguuugaugggaggggccaggcuugaugggaagagcuugaggggaggagccagggcuggggggaagagcuaggcuuaaugaacagagcuugaggggaggagccuggacuggugggaggagcuagguuugauggacagagcuuaagggacagagccaagacugaugauaggaggagcuagguuugauggacauagcuuaagggaaggagccaagacugauaggagcuaggcuuaauggauagcgcuugaggggaggagccagaccucgugggaggaacuaggcuuaauagcgcuugaggggaggagccaggccuggugggaggaaccugggggaggagccaagccugaugggaggagcuaggcuuaaucgacaaagcuugaaaggagccaagacugauagagggaacuugggaggagccaggacuggcgggaggagcuugaggggaggagcugagcaugguaggcguggucuaacaggcaguggcggggccuaccaugagaaugggcuggugccucaggucggccucgcgcaccgggcgcucgggcaaagcaggcacugugccccuccgcgccagcagggccagcagugcagagggguugggggguguuucaagcuguggcagugccuggcgccaggcucugcaguagagcucggcugagagcagcagccgugucaccgggggcuucacaugcuccugcgcguacuggucgguauagaagggcucccacagcuccgggggcacgugcucugugggggcauagaggggaaacacgggggucagggucaccagauacaacacacacacacacacacacacacacacaccacauggcccggauuaagagugugucuggaccagggaggauggcauugggaaaggagaaaggggaucugggcugagagugcagaugugcaggaguuugcuggaggaaggggugauggcguuguaggcagaggggccugcagaugcaaagcccagcaggugggagagaacacggugccucagggagcugaugggcacuuagaguggaaaggaggggaggcuacccccaauaccaggccagcuggacuggcucuuguaggucccaggaaagacaauaacaucggcaauccuaagagccuuccugcucuugccaauguagacucacugagccuuacaucaacgcuaggaggcagccagggcccaauuggcaacccccauguuacagaggaggaaacugaggcacagagaaggaaagucccuugccccaggccaaauaacucuucaacaccaggacugggguuagacccagcaaacuggacgcccucucuuagcuugcaggcagggggggaugaguggggggcacacaggcgagcaggggaggugggcacaccacaggcacaucgagggaguugagugauguaaaccuggugauugaagggaggaggcaagggacagagagggagguagccaggaccuugcugggucugagggggaagagggaagagagggguaaugacugagcuugggugcaggaggaaugggaggugaaggggugaaauugaaugugaggggcuuugaggacauccuugaggcagauuaugugaaaggcuggggcuuagagagauggugaggucacaucauagagacagccugaggucccuaaauaggacaaugggaagaggcgugaggaagccccagguggacagugggcugggggcagaaauccacguaggaccaagaguggagaggagaaggccaggaaggcuuggcaggggucggggaagaggugacugaaaucaacagcagggaaucuguccagcucuuguucuaaucugcacagcuuuugcgguuuuuuggagauaagagucucucugucgcccaggcuggagggcaguggugcaaucuuggcucacugcaaccucugccucccgggcucgaaugauucuccugccucagacucccaaguagcugggauuacaggugcgaugcugccauacccggcuaauuuuuguauguuguagaaacaggguuaucaccauuuuggccaggcuggucuugaacuccugaccucaagcgaucugcucaccuuggccucccaaagugcugggauuacaggcgugagccaccacgcccagccugcacagccuucucuguuuguuugaguuuuugcuggagugcaguggcacgaucauggcucacugcaaccugaacucugggcucaagggauccucccugccucagccuccugaguagcugggaccgcaggcacgugccaccacacccagccaauuuuuaaauuuuuuuauaaagauggaagccucaccauguugcucaggcugguuucgaauuuccuggccucaagugauccaccugccuuggcuucccaaagugcugggauuauagggguaagccacugugcccagacuuguuuuguauauugggguucuguguguguguuugaaagaacggggugggggccgggugcagugacucaugccuguaaucccagcacuuugggaaaacaagguaggcagaucuuuuaaggucaggaguucaagaccagccuugucaacauggugaaaccccaucucuacuaaaaauacaaaaaugagcugggcaugguggcacacgccuauaaucccagcuacucgggaagccgaggccggagaaucgcuuaaaucugggaggcagagguugcagccagcugagauugcgccacugcacuccagccugggugauagagcaagccucugucuuaaaaaaaaaaaaaagaaagaaagaaaaaaaaagaaaagaaagaacaggguaagggguucuagugcuucagaacauauuugaacgggacuucuccaccugugaggacccaggcacucuuggcugccuucugucccucccuguccuggcuccuuucccaccuucuaaaaccacacuggaccgucccacuuaacgcgccacccgcauguagacuuggaccuucuuuuugccccucucaucuuggcuccuugaaagaagagguauuucaggcucacuuccucccugcccucccagccccccuccaccucucccucaauuucccugagcucgaugcugcccucauggcuuccggucuccccaaggccagcagggaccuccaaagcauaucugugggcccguaucucgccugggcucugugcccagugccuccuucuuccagaaaccuuccucccacaggcgucuccuuguaaauggacaugccccacccccaccccaggccacccuaccccgugacggcuuccagggccaccugaagacugcaacagcggcugccacgggccccacugcacccugggcaucucccacaauucucaacaucucacccacaccuccccuccucccugcccccaaggcagugagaaaucacccucccucccuuucuuuacgcccucaccccacauuuaaugcguccuuggcuuucaacuuccugauaucucccaaauccaaacccuccucucuaccuccccagccccggccuugggcacgucuugcucccaccagcaaaaucacacguguuucuuuccuacaggacuuuucagggccuuuaagaugaaaaacaagaaacaaaaaacaccaaaaccuuaagcuagggcuacacugacauuuaucagacacuuauuauacaccgauguucuuccaccuugguucauugguacuuggggcuggaaaauucuuuguauucaggggaugcuguccuguccuguacacugugagauguuuagcaaaaucucuggucuguauuuacuagacgucaguaguacauuccucccaaguaaugacaaccacaaauguccccagacacugccaaaugucaauuaagugucaaaaucaucaccaguugagaaccacugccuuauacuauaaacuuauucuauuuuucuuuccuuuuuuuuuugagacaaucuugcucugucacccaggcuggagugcaguggugccaucucggcucacugcgaccucugcuucccaaguucaagcuauucuccugcuucagccucccaaguagcugggacuacaggcgugcaccaccaugcccggcuacuuuuuguauuuuuaguagagaugggguuucaccacguugaccaggcuggucucaaacccugaccucaagcaacccacccaccuuagccucccaaagugcugggauuacaggcaugagccaccacaccuggccccacuuucuuuuuauuuuauuuauucauuuauuuuauuuuauuuuauuuuauuuuauuuuauuuuauuuuagagauggggucucacuauguugcucaggcuggucuugaacuccugaguucaagggacccucccaccucagccuccugaguagcugggacuacaggcaugugcuaccacaccuggcuaaaauguuuacugagcauuauuuacagcagaacacugcugucugauagaaauacaaugugcccagacuggccaacauggugaaaccccaccucuacuaaaaauacaaaaauuagcugggcgugguggcgcaugucuguaaucccagcuacucaggaggcugaggcacgagaaucacuugaacccaggagacggaggcuguggugagccgagauugugccccggcacuccagccugggccacagagcaagaugcugucucaaaaagaaaaaaaaaagaaauauaaugcguauaaugugagcccaaugagccgucaaguuuccuagaagccacauuacauauguagaaacaauaagaauuuaguaauauauuucauugacccaagacauaucccacucuuauuuuaacauguaaucaacauaaaaauauuauucauaagauauuuuacacugguuuuuguuguuuguuuuuggaccaagucuuuggaacccugaguauauuuuacauuuacagcacaucuugguucugaucaaccacauuucaagugacucaguagccacaucuggcugguggccaccauauugaauagcacaggucuacaacauagcuaggauggauggauggauggauggauaaauggaugaaugggugggugaauggauggauggauggauaaauggaugaauggguggguggauggauggauggauggauaaauggaugaauggguggguggauggauggauggaugaauggguagguggauggacagauagauggauggguagauggguggguggguggauggguggauaaguggauggguggguggguggaagggugggaggauggguggguggguggauggauggguggauggaaggguggguggauggguggguggauggaugaguggguggguggauggaugaguggaugaguggguggguggauggauaaguggguggguggauggaugaguggaugaguggguggguugguggauggaugaguggguggguguguggguggauggaugggggguggguggguggauggauggauggguagacgaguggguggguggauggguggauagguggaugggugggacggugggaggguggguggauggaugaggggguggguggguggguggauggauggaugggcggguggauggaugagucggcgggugcauggaugagugggcggguggacggauggguggauggguggguggguggaugaguggguggguggguggaugaguuggugggugggugcgagggugggagaguggguggguggguggauggaugaguggguggguggauggguggauggaugaguggguggguggguggguggaaggauagauggguggguggguggauggacggacggauggguagauggguggguggguggaugggugggaggguggguggguggaugggugggaggguggguggguggauggcugggugggaguguggguagguggauggauggguggguggauggauggaugggcggguggauggaugagugggcggguggauggaugagugggcggguggauggaugagugggcggguggauggauggguggauggguggguggguggaugaguggguggguggguagguggaugaguugguggguggguggauggauggauggguggauggguggguggauggauggguggauagguggaugggugggugggagaguguguggguggguagguggguggguggauggguggguggguggguggauggaugggcggguggauggaugggcggguggaugaguggguggauggaugagugcgugguuggauggaugagugggguggguggauggaugaguguguggguggaugagugcguggguggauggaugagugggguggguggauggaugagugggguggguggguggguggauggaugagugggguggguggauggaugagugcggugaguagguggguggguggauggauggauggauggauggauggauggaugaaugaauggguggguggaaggauggaugaguggguggauggauggguggauggaugagugcguggguggauggaugagugggguggguggguggguggguggauggaugagugcaguggguagguggguggauggauggauggaugaaugaauggguggauggauggguggauggauggaugaguggguggauggauggguggauggaugagugcguggguggauggaugagugggguggguggauggaugagugggguggguggguggauggaugagugcaguggguagguggguggguggauggauggaugaaugaauggguggguggauggauggaugaguggguagauggauggguggauggauggauggaaggcugauugagacaggaucucacucuguugcccaggcuggagugcaguggcgugaucauagcugacuguacccuggaacuccugggcucaggcaauccuccugccucagccuccugaguagcugggacuacaagcccaugccaccacacccaaccauuuauuuauaccaugaccuucccugcauccagucauuuaauccuuacgacacuuauuauuauaccccuuguacagaugagaaaaccaaggccuggagagcugagauaacuuguccaggauaaaaauguccaacaugaacuugaguuucccucacacaucacacaucuguucugaaggcauaaagaacugcaugggguguuuuccaaauguguuuaacauggaacccuuuguuuuuugagacagagucucucucuuucacccaggcuggagugcaguggugcaaucucggcucacugcaaccuccgccucacagguucaacaauucuccugccucagccucccaaguagcugggacuacagacgugugccaucauucccggcuaauuuuuggauuuuuaguagagacggggauucaucguguuggccaggcuuggaacccuuucuuaucuaaucuccaagcuuguguucugcuuuuauuucugcacagccuucucacaccugugccuuggaguugccagaacuaucccuuccucugagccaucacuacucccacggggccacugcauaccugaucuugucaguucccaacacuguccguggcuccccaguacccuuggauccauaaccaggggccugaagggccuuccucagucugaccagccucccuuaucucccaccgccaccccggggaccugcaucuuauucucugagaacucccugcugguccacacuccgagccuuugcccacugcccacacaucucuucuccgugucaaacuuccaugcauccuuccagacucaaaucuuuccaccugugggaucucuucccucccuggaagauuucaagaauuucuuuccccaggccccgcuggccagcuucccuaugaucugguuuccugcccaucccccucugccccauauccauccccugccgucuccucuacacccugagcgcccagcccagcaccugauagguaucauaccgucaagaguccccagagcucaugaaucuuguagaacucugcucccauuuccuucagcccuucuccucuuuuuaggggaguggaacagggaacagauugaacuugacccucacgguagaggcagccacugccgugugucacacagcagagggagcugggucaacaagaacagaacugggugagucagggcacugggagcucaccaacaccccucaucagaaguuugcuuugcugucuucaaaaugggauaauuucuacucugauuccuggccaggggauaauggauaacguuaauauuauucaucaaaauauaccaccgccaaucacaccagcagcgagcaaccguuucgcauguaucacgcgccccgugccacgcgaagaauucuguggucacuacagcuuuuacgccucccagcaaccuugcaaagagguaacggggggucuccaucacuggagcagugcccuacacauagcaagugccccugccccacaaacauucgcaaaacagauaagucugugaaugaacgccuucuuuuauagaaggggaaacagaagcucagauaauugggauaauucgcauucuggugcagcuggacuucacauucaauucugacacuccacguugaguucucuacagccugguaaccuuggaagugaggagcuggggcuguccuggcuguccaaugcccaaucucuuucuuccucaagcaaauaucugcagggagguagaccccagagugggaaaugcaugcauggaacgacgcagacagagacugucugggagaaagagggacaggcuggggcggaaccaggagacggacagcugucacugagacccacacccagaacagguugaucugggaaggccagggagaggggggaugggcugugccaacaccagugggcagaaccagugggagaaaaggauguacccccacagcuccccgcuggaaagcccagaccuuaauuaaccccugucuucucuggccaggcccugacuccuagcucuggccugggguugugaagcugcccaaagccgagacugaguguuuccagggccucuaaucccggggacccgggauuacggcauccuccccauuaggguggcucgggcucucaggcaagcgggccugggggagggagugaaggaucugcucuaaugggagaaggccccgcagccgggaggagcggggggcccaccccaggcgaucuuguacuacccauuucccuucagcugggcucgccaaccuccccaguaaaauggggccauaagucgcagcugccaggcgcuggagggggcuauggaggcgaaaggggguucccagagcuccccggucgccgcccgcagcgcggccagggccgacgcgggguguguguuggggccugggggucgugcggugguggagaccggagcgcucgagaccccccagcgaggucggggucugggucuccaggguguguggcgggggaagagaccgagaggagauccucgcaggggcgugauguguguaaaagagaagaaggcgugcaagggaaggccuugggggugcgggaggcgggaacgagagguccgcacggggagaccccacccggcccgcagaccccgcccggcucaccuggaggcuuggacgccggggacccccgcgcggagcugggccgcgggccccacccccaccgcgcucccgcagccggcggggcaaaguccaccgcccgggccgagcaggaagcucggaggccccggcgcggcaggggcccgagcccggggacccccggcggccggcgcuauuguucccacggcccccugccuucccggcccggcgccccgcccccccccagcaccugccgcgcccggcccgccgcccccgaccccggucccccgagccccgguaccugcgcccccgaacgcggcccgcagcacccacgccaggcuggccgccgccuuggcccgcgagaaaucguacugguccagcgacuugaucucgggcacuagaaagguccuccgcagcggcccgggcccggggggcgccgccuccaccauggcggcgccggggcugcgggcgccggguccgcgcucggacugggcugggcugggcugcgccgcgcucgcgccccagccgggcccgcugcugcuaccgccgcugccgccgccgccgccgccgccgcugcugagccaggugcggccgcuugcgcuggcgacgcugcgucgggcccgccccggggaggagcccaggugcgccccgcccccgaacccggacccggacccuggcgcgccccugcgccccgcccgggccccucacugcagugugcacggagcagcaggggcggggcggaggggggcggccuggacugcggcgaugguggagggagcuugcggaggacugaguguguaugugugcgcgcgcgcgugugugagugugugcgcgcgcgccuagcuuacuggaaaggauuagggacccucugugugugccagccccagugucuacccuuaggcguaggagcuccugc

SEQ ID NO: 15511 - RNA, 11998 nt, Homo sapiens
gccaaguccaacaaguucaucauccacaaugcccuaucacacugcugccuggcgggcaaggugaacgaaccgcagaagaaucgcauucuggaggugagcccgcccacacgugggaguugggggcugguggguggguggguggccugacuuggccagcugaccauuuccagcacuccugcccaggaaauugagaaaagcaaggccaaccacuuccugauccucuuucgcgacucgagcugccaguuccgggcgcucuacacgcugucgggggagacagaggagcugucgcggcuggcaggguaugggccccggaccgucacgcccgccaugguggaaggcaucuacaaguacaacucggaccgcaagcgcuucacccagauccccgccaagaccauguccaugagcgucgaugccuucaccauccagggacaccucuggcagggcaagaaacccaccacucccaagaagggcggcggcacccccaaauagccccacccgggcgguccacgggccgggcccugugugcugcggccgccauccccuggaggacagucagucgguauuccuggguccugucuguccccaaccgugucuggguggggcuggagucuccacccucugacuuugaguccaguccugcugugggggcugagcugggagguucagggacucagggcucagcucaguccccuugucuguccucccccacuucuugaauaaaauaauuuaaagagaaguugaaccuugucccccccuccgaggcuggccggggucccacacucccuggcuguguuuuuagucuccuguucuuucucaaaccaacuccugucuucaacccccauaauccccuaaugcagcuucagccagggcacucccagcccccagccagggcuguuucgaagcugccucugaacugaucucucaggcucgaggugucccacuggcccuuccuguggccuuggccacccccgcuugcuggauucuccuggucuguguggcuguuguuacuggcccuaaccagcguuuggcauggggccaacuucuaacuugaucuugucuccccuggccagccugguguuuccaggccuggcaucuaccucugggccagugauuccagguuucucugagaucuguguuugacaauccaguugcccccugccauugccugggugucucucucagaugcaaggccugcccugcaacccaggcuggcacuggcuucccagcugccgcccaguucuacacagcucagcccuccccuccugucucacucgcuucucuccagcccugucaccucccugcaaaguccaagccaauggccugggccuccccauguccccagcugccuccugcccacacagcagccugugugacccguucgaagcacaaaucugauuauaucccuugauacuuaaaaccccuuaauagccuacagcccgcuaauggcuucccaggcuuaggacuaaggaccacgcccugguccugggccgugcacaaggucuggcgccuggcccccguccaggcacagaaacgcguuacuaaucaguucccagagcugggccagagccugccugacuccaagacuugagggcaagggccagucccuaguggggaacagacagugggugccaccccagggaggcggcagcugccuggggccacagaagggcucugagaggcaggggcuggcgagaccugggcagccaggggcuggauugcccuucccaggcuacagaggcucaaggaaguuuccgggcaggacccacuccaaggccccaggcagcggagggacuggccucucgaguccagaacuggcucugcggggugaggccgggcaguaucuggccuggggcccagccgccccaccucccacagcagccaaucccggcccagggccaggcacuccugagcuguacucccucgggcaccugggcagcaggaaggaggcucagaccaugauguacaaacguagcuguauuggggaggggguggggaggggggaugggggagggacgggucagucuuccuucaggcucccaaacacugcggcuggcacgcucugcugcuccagccgaaccucuguggggaaggcgggagccagucacccuccuggcguuggccugucccccgaggcccacccugguaaugccaccguccccgccccagccgggcccucaccguugggcuccagguccaucucguccucguccucguccucgcccagcuggaucuccucgggguugaccugcugugccagcucugccagcuccucccgggaggcgucacuccuagggacgggccaugcugccucaguuccccaccccgggcccccuugggaccugucccaguccugucccguccaaggauccgcccucaccucacgaacaggaucuugcucugggcgcgcaagggcuggucacgcuccgccucagccgccagcugcucugcccgcuguuccagcagcuucaugucguccaugccacucugcccaggggccaggucagacacuagggggugggagcagggggucagcgccacgggggccccucccacacaucggacguugcacuaucccagucccccaggugauggcccagcccucaaggagauugccaucaggauccgaggcucccagacccggaaagcccaggucaggccgggcugagaugcccuggaucaggaacucagccagcugggacggcucaccggugcccguggcacugcccgagaccuugagcaucugcgaggccaugaaguugaccugcguguuguacguggccugcacgcugcgccggauacgcagcauuuccuugaugguguccucauugccaugccggaccucaaaguccuuccacgucugccagaacgcgccggucgucugcguggggggcagggcaggggugggugugugugcccgugagcuggcugacuccgccgcagcccccaacccugauacccgucccuccccacagcccuacccgggggucacagaucugggagcagaagcuguagauggcccgggcgcggucaaucuccccgagcuugcacuccaugucugcaaaccgcaggcacaucucacgcgcgugcucguccgacagcaccuggacaccgggguuggggaggccgggagugaggccgggguagcucgggggcucccaacacaccauggccaucccugugcuuccagaaggcuccuccucagccccucccaccugccuggaccccuuccgucugcucagggaccucuggccccggcccagccccccacgguggguaccucaauggccuucugguagaugccgcgggugugggugaccccauagaucucggccgcccgcuugauguagauguugaacaugucauacugcugggcgggcuccacggcccugguggcacgcucguacacggccauggcaugccgggccaggccccacuccuccuccagcugugcguacagcagguacaaggcugggcgggguaggcggggagaggggagcacggucagccggggccagucagaaacccagcccgcccgccaccccccccaugcccucugcccgccucacucuuggcauauuuuggggggcagccguccagagccuguucaaacaggucccgugcccgcuccagcuugcggcccccauagcgggcaaugaauuuggucagguaggugcuccagaugucggacacguugggccacuugaacagcgagaugccgcgcucguacgccuguuaccagagggagagucacaugugagagucugcagauagagaccaccaggcacccgggauguccuuggguggcgucuguagggagccugccaggaacucccuuggggcccuucccuguccacgccucccugucccuaauggcaguugugggggucuguccucugcacugucucccucugugagaaccccaagaacaggggugcaaugggaccugcuaagcacagucuggccccauaggaggugacaugaugggugaagguggguggcuccccagcuccgcugacgcuggcugccuguccccagggagaaggccgcacccccugacagaggggcaggcaguagcacgcguaugcauguacgaccuccccauuuguguaucuguauaaugcccacacgauccauagaaacacacacucaaacaugacugcuccggccgcgggacauggccuucccacggacacgcaacccacccccuggaccccacaacccgucuccugagcagcggggcagggagagcccgcacacacuggcaccaacacccuccccaugagucaugggugcacguggaaguaggauucugugccugcuauggaaugaacugugccccccucaaaacauucauaugcucaaaucuuaacccccaguaccucagaaaguagauucguuugaagaugagaucacuaaguuaaacugaggucguuaggggccaccuaauccauuaugacugauguccuuuauaagaagaggaaauuucaaaagugacacacacaaagagaaggccacacaaagacauagggagaaggcggcugucuguaagcuaaggagagaggccucaggaggaaccagcccugcccaugccucgauccuggacuuccagccuccaggacggggagaagcuaaaucuuuguuguuuaagucacccagucuguauacugugucacacaagccccagcagauucguaaguugcugaggaccccuggggaggggacacugccaucaggggccucuggguccacccuagccccucaccuugaagcucuccucgaaguacuugugcuccuccaggaacauggcauaguugaugacgaucugggguguugcgauacgcagguccaggaugcggucguacacggccuugguggacugcagggguggggaugggaaagguuggagcugguucuggagcugaguccggggccccgucccuccccagccacaggcagcucaccuggaaggugccgaggcucuccuccaggucggcgagcauggaccagaccuucagugacuuguacacgcgguucugcacgggcucugaaccaucaaaguacucggcccggcgggcaggcagcgccguggccuucugcaggggcagacaguggccggggaggcgcucaggggcugucccuggcccuugcccuacaaccugcagcccccaccccacagccugggccuguucucacucgcagcagccgcaaggccucaucguaguucucgugucggagcuccagcucuccgcacugacaccacacgcuugccaggucauccaccugcuugaaguucaccuugguggccuucuccaggaugacacgggccugccggggcgggcagaggcgaggcugagacccugcccaccuggacagcucccaccaucaagggucagaaaggugaccaugcucacaaacauacaggcacaaacacacaggcacacacacaggcacacacaugcgugcacauaugcaugcacccaaaugcacaugcacacacacgugcacacauccaugcacaaauauguacacacacauacaugcacacauauacaagcacacacacaugcaugaacacacaggcacacgcaacagggugcucacaucguccagcuguccguuguccucauaaaacuuggcaaacgccacccacagaguguggggcuugccuguggccuugaagggguccaccgucugcacagccucuguguagguguugaugaucuggggacaggagggaggaggucauauaggacucaggacccugcagaugacggucggggcagagcuguggcucugagggguggggccuggagggugcuguggccccugucgggagaggccagaaacgaacuauggcccuugacaauggucaggaccaagagagagcuguggcccuaaggggcggggccaggagagagcugugacccuccaaggggcggggccacgagggagcuguggcccuccaagggguggggccaggagggacuguggcucugaggggcggggcucgggcaggaggagaaccccaagaacagggguggaauuggaccuacuaagcaaagucaggccccuagaaggugacauuaugggugaagguggguggcuccccaguucugcaggaaacuggcccucagggguaggacuggggcaggcuucauguaccucccgggggcggcccuggugcagggcgacacgcuugugccacucgugcacgugguguggguuuuggcgcagcaagacgcuguugaggagcaggggccgccggcugaugagcugcucgaagcgggccaggcgcagcuccagguccacaucaucugggagccgcgaacauguuugucaggggcggagacccaggaugcagguccccggaugccaccgccuccacuccccacccucacuccgcuccagcccccagccaagugcucugggcccuagacacucagcucggguguccaccugagccccacccccagccccagguacuguggauacccccuccuacccccacuguuccccuagcccuccugcccugccaggcucuggcccaggccugagaaguguccccauuccuggcuccuucaagacccccacacccccugcauccacucagccuccuucccugcuggcccccagcugagccucccagggcugccucaccugagaugugucccgccccuaccgcuaauguccacucagcucucuccccaccagccggggcccccagaggcucacccuccuccucgcgccccagcuccgaggcggucuccaucuuugcagcgaucaugcucuccucgaacugggcguagcugucaaacaccugugugaagucccgcacggucaucacuguccggauggccuccucguacacgucccgagccuguggggacccagggaaggggaggugagaggaaaguggcgcaggggacaggcagcagcacucuuagcaccagccucaauguggaaccccugggggccuucuggguagugacgcauccagcaccucuggguagugaccccaggacagagccuccguggagccuucucacccccgcccugcccugcacugccaggguggucuugggagcuucaggaccuccucaguaaacugggugacugcccuuugcacacagugaccucagggcucgacugagacacaugugugaagcacuuggcacccaauagguggccaaaaaccccccagcgccuauggguccacccugcagggacccucgccucagcucauccuccgaggccucagaauuugcuccaaagcgucccucucgcuugccugacccucuuccccagcccgccuguccuccaccuggcucgcccaccccagcucagguccccucucucuacccagcccugacgggucuugcccugcugccuccgacagccuuggccuacacgugccccuggaaggggcgcugcgaagcgcauaccgcccacaccccacuggcggcucccccagccaggagcauggccagcccguuuggcuuucgaggcucccaaccuaucuucccuggguuccugagccuccccgcucucggcucuggcccccucugcacccaccugcccccaggccauccccugagcuugccacuccacugccugccaagagccacagucagcuaaccccugagggaguggcccucacaccacguaccuccucagugcugugccugcgucacugagcugauuggugacaggcaguaacugucacccugauuuuacaaaugaagacaccccaccuuaguggggccaaggccgcagagccagagggugaacccugaacgcaaauguggcugacuccaaggcugacgugccugcgggcaggagugcucccccacccucagcaggauaguaaucgugugcagggauaugcaugucugucaaaaauggcacuuuuuuuuuuuuuuuuuuuuuuugagauggagucucgcucugccacccaggcuggacuuccguggcgcgaucgcagcucacggcaaccuccaccucccaaguucaagcgauucuccugccucagccucccgaguagcugggauuacaggcgcgcaccaccaugucugacuaauuuuuguauuuuuaguagugaugggguuucaccauguuggccaggcuggucuugaacugcugaccucaagugauccuaccgccucggccucccaaagugcugggaugacaggugugagccaccacacccagccauaaauggcauguuuucugccugugcaugugucaacauguguccccgagugucggagggagaccccgccccgaacccagagccccgugugccagcaugcaccuucucgaaauggccgcugcggauguaguagucggcgagagaacaccagagcuugcccagcuggucggugaagcgggugaggcccccgcggaugauggcguccacauugagggacuguaccuuguccggauucugggagaugaggucgcacagcucgugccacagcugcagggcauggggcagugggggagagucucaggcucagucauggaggggguggcccucccacccaguugccggcucccggcaggcccaccugguaguuggacuugccggccuuagacacgaaacgcucgucguucaccacgguggccaggcgcugggcggccucauccagccggucacuugacuugagguacucaauguacuccucugcacucucaggacucagcuggggaccgagccaccccucaggcagucagugggguggcagggcuacgcccaccucccgauucaguggcuucggggcguccccccccacccauuuaugagugucuugggcaaaagcaagcccugucaaaccagccucagccccacugguccagcccgguuccuacuggucuagccuuggccccacuggguuaggcucaacccccuguggguccugccuuggcuccacugguccagccucaguccugacuagaccagcuguggacuuuuuggguuagccuugacccgcaagggcacagccuugacugcggugguccagucucagccccaaugguccagccuugguccuuuuggguuagaauugacccccaacccacaauggguccagccuuggcuccacuaguccagccucaguccugacuggucuagccuuggccccuuugggucagccuugaucccauggguccagccuugacuauaguguccagccugggccccacggguccagccucaguccugacugguccagcuuagaauccaaacgucauaaaacagauacuuuaaguuugagcaaaccaugccccacucccgcccggcuggugcuuccacucuccacccugccugcuucuccccaccccuauuccuggcccucuucauggcugugguuuuacucuaguucaugccaucagcucauaugcaucugucuuccuacuuagacuaaaagcuccgugcaggcagggagugucuuagucacacuguccucagcacccaucgcuaugccuaaugugaaaccagugugaacaaacuauuuggaaaauaaagacaugaaucacggacaacaacaaaacacaugcaucuccaggagccucuucccacaucccgucugcugggugacauccuacgcggagcuagugucacagugaggccguuucuggaaacuaaccuggggaaccagcgcaccugcuaggcucaccuugaggaagcgccgauagccucgcacagcugucucaggcagugggugugagcgcaggaagcgcagauacaggggccaaauucgagagugcugcgugaugggcagugcccggagggcacggucgaaggugcggcgggugugugugacgcgccccugguccaugaggaacuggcaguaaucuagccacagacgaggcaucuggggguguggggagaggcggcuggggcuaagccacggacuccauggccuggccacagacacucgauguccuguggcugagccacaccuggggccaccacauaaaugcggcgggacccagaaacccccagcuccaggacugaguccagcccaacuucccaugcaaagaagcaacaggaauccaagcccccaucccuaacaugcugagcccagccccuguccccgccccacccaccaccauggacugagcuccacuucccgauucauccccucgccgagccccaaaccuugugcaugaacacaaaggcccucucaugacaguuguugacaucuucauaggcagggucggucacacagcgaugcuucaccugugcccgacgcgccuucagguaucgguaccagaguuuguagcuggggaauaggaggggacagaugcugaucggucagcuuuauggacacccccagaaccauuugcccugccccaguuggcaaaugugggaagaaggggugugggaggggugacaugucucagcaaugacagggacagacugggacaucagagaaggugugcugacccaucaagggauguacaggucagugaugaaacacgaagcaaucacccgggacccgggacccacuuggcaguuuuguuauaacuggaccagguggggugggggcuggugggcagggcagcuggagccauucccaccugcagggcagcagcuugagugcccgcucguauagcugauugagccugggcuucggggcgcccuguuugaacucgauguagcgaagccagcauuugacagagaauugguuccgcaugauuuccuccucauaggggagguccucuuccuccugccagggccagggaaugggaagaagagaggccuacccucagagccugugugcagcaccaucccacugcuggggcucagguccaaacuccggacuuuuaccuagaucccaccacccaccaaggaagucaggucaccagaugcccaggcaccaaaccagaugcccgacaccaagacaguggcccagaccuuuaccccucagaauucaacuacccaaaaucgaacccaaaucaucagacuucucagucauuagggcucugggccaggaaugaguccgcaucaccacucgcuuucugccccagauggucagacuccuuagauaccaaggcccuggcccagaugccaguccuggacaccagaccccacuucuucaaaacgugccucuucccagacaccaggccuuuggccccucagacucccacugucaccaucugacccaucuccaccccaggcccagaugaccagaucuuuaccccagccaccagggcucucagguccagauuccaagccacuagccccgcccccaggaucccacuagccagcgucuagcucaacucugccccagaaauuaaaagcuaggccuuuaucucacaggaggaguuauacaccagaagccaagccuuuaacucugcacaccaagaaucuggugaagaugucacgccucuacuccagagaguaaguauuucacuggccaucgccugacaagcuccacaucaccaggguucuucuagccuggccaccaccccagaaacugucaugcugcaguccaggccuagagaccgcuauccagaaaaccaagccuucaucccagaaaccagaacccuggccucguaagcaagccuuuacuucagacaccgaucuucaccucucaagguucaguuaugcgaucuuccuccucucccauucccugcacgcccccauuuccgccccugguucgggaggcuagacgcuucccuucgacagugguuuucuacucagacccgaagauacaacaccauauuuuuacuccuggacaguucggugcggacaugacgauccggucucuggcccauuaggguucccagaccuuggccuggcaguuucggccuaaaucuccuugccgacccagccucgauccccugcggcguccaggucccaaugccccaacgcaggccacccccggcuccucuguggacucacgaagacaagguccggccgcucgggccgcgagagucgcgccaucaccaccauuuuucuggaugcccagguacaggagagagucgcgcgcuu

SEQ ID NO: 15512 - RNA, 11998 nt, Homo sapiens
aagcgcgcgacucucuccuguaccugggcauccagaaaaaugguggugauggcgcgacucucgcggcccgagcggccggaccuugucuucgugaguccacagaggagccggggguggccugcguuggggcauugggaccuggacgccgcaggggaucgaggcugggucggcaaggagauuuaggccgaaacugccaggccaaggucugggaacccuaaugggccagagaccggaucgucauguccgcaccgaacuguccaggaguaaaaauaugguguuguaucuucgggucugaguagaaaaccacugucgaagggaagcgucuagccucccgaaccaggggcggaaaugggggcgugcagggaaugggagaggaggaagaucgcauaacugaaccuugagaggugaagaucggugucugaaguaaaggcuugcuuacgaggccaggguucugguuucugggaugaaggcuugguuuucuggauagcggucucuaggccuggacugcagcaugacaguuucuggggugguggccaggcuagaagaacccuggugauguggagcuugucaggcgauggccagugaaauacuuacucucuggaguagaggcgugacaucuucaccagauucuuggugugcagaguuaaaggcuuggcuucugguguauaacuccuccugugagauaaaggccuagcuuuuaauuucuggggcagaguugagcuagacgcuggcuagugggauccugggggcggggcuaguggcuuggaaucuggaccugagagcccugguggcugggguaaagaucuggucaucugggccugggguggagaugggucagauggugacagugggagucugaggggccaaaggccuggugucugggaagaggcacguuuugaagaaguggggucugguguccaggacuggcaucugggccagggccuugguaucuaaggagucugaccaucuggggcagaaagcgaguggugaugcggacucauuccuggcccagagcccuaaugacugagaagucugaugauuuggguucgauuuuggguaguugaauucugagggguaaaggucugggccacugucuuggugucgggcaucugguuuggugccugggcaucuggugaccugacuuccuugguggguggugggaucuagguaaaaguccggaguuuggaccugagccccagcagugggauggugcugcacacaggcucugaggguaggccucucuucuucccauucccuggcccuggcaggaggaagaggaccuccccuaugaggaggaaaucaugcggaaccaauucucugucaaaugcuggcuucgcuacaucgaguucaaacagggcgccccgaagcccaggcucaaucagcuauacgagcgggcacucaagcugcugcccugcaggugggaauggcuccagcugcccugcccaccagcccccaccccaccugguccaguuauaacaaaacugccaagugggucccgggucccgggugauugcuucguguuucaucacugaccuguacaucccuugaugggucagcacaccuucucugaugucccagucugucccugucauugcugagacaugucaccccucccacaccccuucuucccacauuugccaacuggggcagggcaaaugguucuggggguguccauaaagcugaccgaucagcaucuguccccuccuauuccccagcuacaaacucugguaccgauaccugaaggcgcgucgggcacaggugaagcaucgcugugugaccgacccugccuaugaagaugucaacaacugucaugagagggccuuuguguucaugcacaagguuuggggcucggcgaggggaugaaucgggaaguggagcucaguccauggugguggguggggcggggacaggggcugggcucagcauguuagggaugggggcuuggauuccuguugcuucuuugcaugggaaguugggcuggacucaguccuggagcuggggguuucugggucccgccgcauuuaugugguggccccagguguggcucagccacaggacaucgagugucuguggccaggccauggaguccguggcuuagccccagccgccucuccccacacccccagaugccucgucuguggcuagauuacugccaguuccucauggaccaggggcgcgucacacacacccgccgcaccuucgaccgugcccuccgggcacugcccaucacgcagcacucucgaauuuggccccuguaucugcgcuuccugcgcucacacccacugccugagacagcugugcgaggcuaucggcgcuuccucaaggugagccuagcaggugcgcugguuccccagguuaguuuccagaaacggccucacugugacacuagcuccgcguaggaugucacccagcagacgggaugugggaagaggcuccuggagaugcauguguuuuguuguuguccgugauucaugucuuuauuuuccaaauaguuuguucacacugguuucacauuaggcauagcgaugggugcugaggacagugugacuaagacacucccugccugcacggagcuuuuagucuaaguaggaagacagaugcauaugagcugauggcaugaacuagaguaaaaccacagccaugaagagggccaggaauagggguggggagaagcaggcaggguggagaguggaagcaccagccgggcgggaguggggcaugguuugcucaaacuuaaaguaucuguuuuaugacguuuggauucuaagcuggaccagucaggacugaggcuggacccguggggcccaggcuggacacuauagucaaggcuggacccaugggaucaaggcugacccaaaggggccaaggcuagaccagucaggacugaggcuggacuaguggagccaaggcuggacccauuguggguugggggucaauucuaacccaaaaggaccaaggcuggaccauuggggcugagacuggaccaccgcagucaaggcugugcccuugcgggucaaggcuaacccaaaaaguccacagcuggucuagucaggacugaggcuggaccaguggagccaaggcaggacccacaggggguugagccuaacccaguggggccaaggcuagaccaguaggaaccgggcuggaccaguggggcugaggcugguuugacagggcuugcuuuugcccaagacacucauaaauggguggggggggacgccccgaagccacugaaucgggaggugggcguagcccugccaccccacugacugccugagggguggcucgguccccagcugaguccugagagugcagaggaguacauugaguaccucaagucaagugaccggcuggaugaggccgcccagcgccuggccaccguggugaacgacgagcguuucgugucuaaggccggcaaguccaacuaccaggugggccugccgggagccggcaacugggugggagggccacccccuccaugacugagccugagacucucccccacugccccaugcccugcagcuguggcacgagcugugcgaccucaucucccagaauccggacaagguacagucccucaauguggacgccaucauccgcgggggccucacccgcuucaccgaccagcugggcaagcucugguguucucucgccgacuacuacauccgcagcggccauuucgagaaggugcaugcuggcacacggggcucuggguucggggcggggucucccuccgacacucggggacacauguugacacaugcacaggcagaaaacaugccauuuauggcugggugugguggcucacaccugucaucccagcacuuugggaggccgaggcgguaggaucacuugaggucagcaguucaagaccagccuggccaacauggugaaaccccaucacuacuaaaaauacaaaaauuagucagacaugguggugcgcgccuguaaucccagcuacucgggaggcugaggcaggagaaucgcuugaacuugggagguggagguugccgugagcugcgaucgcgccacggaaguccagccuggguggcagagcgagacuccaucucaaaaaaaaaaaaaaaaaaaaaaagugccauuuuugacagacaugcauaucccugcacacgauuacuauccugcugagggugggggagcacuccugcccgcaggcacgucagccuuggagucagccacauuugcguucaggguucacccucuggcucugcggccuuggccccacuaagguggggugucuucauuuguaaaaucagggugacaguuacugccugucaccaaucagcucagugacgcaggcacagcacugaggagguacguggugugagggccacucccucagggguuagcugacuguggcucuuggcaggcaguggaguggcaagcucaggggauggccugggggcaggugggugcagagggggccagagccgagagcggggaggcucaggaacccagggaagauagguugggagccucgaaagccaaacgggcuggccaugcuccuggcugggggagccgccaguggggugugggcgguaugcgcuucgcagcgccccuuccaggggcacguguaggccaaggcugucggaggcagcagggcaagacccgucagggcuggguagagagaggggaccugagcuggggugggcgagccagguggaggacaggcgggcuggggaagagggucaggcaagcgagagggacgcuuuggagcaaauucugaggccucggaggaugagcugaggcgagggucccugcaggguggacccauaggcgcugggggguuuuuggccaccuauugggugccaagugcuucacacaugugucucagucgagcccugaggucacugugugcaaagggcagucacccaguuuacugaggagguccugaagcucccaagaccacccuggcagugcagggcagggcgggggugagaaggcuccacggaggcucuguccuggggucacuacccagaggugcuggaugcgucacuacccagaaggcccccagggguuccacauugaggcuggugcuaagagugcugcugccuguccccugcgccacuuuccucucaccuccccuucccuggguccccacaggcucgggacguguacgaggaggccauccggacagugaugaccgugcgggacuucacacagguguuugacagcuacgcccaguucgaggagagcaugaucgcugcaaagauggagaccgccucggagcuggggcgcgaggaggagggugagccucugggggccccggcugguggggagagagcugaguggacauuagcgguaggggcgggacacaucucaggugaggcagcccugggaggcucagcugggggccagcagggaaggaggcugaguggaugcagggggugugggggucuugaaggagccaggaauggggacacuucucaggccugggccagagccuggcagggcaggagggcuaggggaacaguggggguaggaggggguauccacaguaccuggggcuggggguggggcucagguggacacccgagcugagugucuagggcccagagcacuuggcugggggcuggagcggagugaggguggggaguggaggcgguggcauccggggaccugcauccugggucuccgccccugacaaacauguucgcggcucccagaugauguggaccuggagcugcgccuggcccgcuucgagcagcucaucagccggcggccccugcuccucaacagcgucuugcugcgccaaaacccacaccacgugcacgaguggcacaagcgugucgcccugcaccagggccgcccccgggagguacaugaagccugccccaguccuaccccugagggccaguuuccugcagaacuggggagccacccaccuucacccauaaugucaccuucuaggggccugacuuugcuuaguagguccaauuccaccccuguucuugggguucuccuccugcccgagccccgccccucagagccacagucccuccuggccccaccccuuggagggccacagcucccucguggccccgccccuuggagggucacagcucucuccuggccccgccccuuagggccacagcucucucuugguccugaccauugucaagggccauaguucguuucuggccucucccgacaggggccacagcacccuccaggccccaccccucagagccacagcucugccccgaccgucaucugcaggguccugaguccuauaugaccuccucccuccuguccccagaucaucaacaccuacacagaggcugugcagacgguggaccccuucaaggccacaggcaagccccacacucuguggguggcguuugccaaguuuuaugaggacaacggacagcuggacgaugugagcacccuguugcgugugccuguguguucaugcaugugugugugcuuguauaugugugcauguauguguguguacauauuugugcauggaugugugcacgugugugugcaugugcauuugggugcaugcauaugugcacgcaugugugugccugugugugugccuguguguuugugccuguauguuugugagcauggucaccuuucugacccuugauggugggagcuguccaggugggcagggucucagccucgccucugcccgccccggcaggcccgugucauccuggagaaggccaccaaggugaacuucaagcagguggaugaccuggcaagcguguggugucagugcggagagcuggagcuccgacacgagaacuacgaugaggccuugcggcugcugcgagugagaacaggcccaggcuguggggugggggcugcagguuguagggcaagggccagggacagccccugagcgccuccccggccacugucugccccugcagaaggccacggcgcugccugcccgccgggccgaguacuuugaugguucagagcccgugcagaaccgcguguacaagucacugaaggucugguccaugcucgccgaccuggaggagagccucggcaccuuccaggugagcugccuguggcuggggagggacggggccccggacucagcuccagaaccagcuccaaccuuucccauccccaccccugcaguccaccaaggccguguacgaccgcauccuggaccugcguaucgcaacaccccagaucgucaucaacuaugccauguuccuggaggagcacaaguacuucgaggagagcuucaaggugaggggcuaggguggacccagaggccccugauggcaguguccccuccccagggguccucagcaacuuacgaaucugcuggggcuugugugacacaguauacagacugggugacuuaaacaacaaagauuuagcuucuccccguccuggaggcuggaaguccaggaucgaggcaugggcagggcugguuccuccugaggccucucuccuuagcuuacagacagccgccuucucccuaugucuuuguguggccuucucuuugugugugucacuuuugaaauuuccucuucuuauaaaggacaucagucauaauggauuagguggccccuaacgaccucaguuuaacuuagugaucucaucuucaaacgaaucuacuuucugagguacuggggguuaagauuugagcauaugaauguuuugaggggggcacaguucauuccauagcaggcacagaauccuacuuccacgugcacccaugacucauggggaggguguuggugccagugugugcgggcucucccugccccgcugcucaggagacggguugugggguccaggggguggguugcguguccgugggaaggccaugucccgcggccggagcagucauguuugaguguguguuucuauggaucgugugggcauuauacagauacacaaauggggaggucguacaugcauacgcgugcuacugccugccccucugucagggggugcggccuucucccuggggacaggcagccagcgucagcggagcuggggagccacccaccuucacccaucaugucaccuccuauggggccagacugugcuuagcaggucccauugcaccccuguucuugggguucucacagagggagacagugcagaggacagacccccacaacugccauuagggacagggaggcguggacagggaagggccccaagggaguuccuggcaggcucccuacagacgccacccaaggacaucccgggugccugguggucucuaucugcagacucucacaugugacucucccucugguaacaggcguacgagcgcggcaucucgcuguucaaguggcccaacguguccgacaucuggagcaccuaccugaccaaauucauugcccgcuaugggggccgcaagcuggagcgggcacgggaccuguuugaacaggcucuggacggcugccccccaaaauaugccaagagugaggcgggcagagggcaugggggggguggcgggcgggcuggguuucugacuggccccggcugaccgugcuccccucuccccgccuaccccgcccagccuuguaccugcuguacgcacagcuggaggaggaguggggccuggcccggcaugccauggccguguacgagcgugccaccagggccguggagcccgcccagcaguaugacauguucaacaucuacaucaagcgggcggccgagaucuauggggucacccacacccgcggcaucuaccagaaggccauugagguacccaccguggggggcugggccggggccagaggucccugagcagacggaagggguccaggcaggugggaggggcugaggaggagccuucuggaagcacagggauggccaugguguguugggagcccccgagcuaccccggccucacucccggccuccccaaccccgguguccaggugcugucggacgagcacgcgcgugagaugugccugcgguuugcagacauggagugcaagcucggggagauugaccgcgcccgggccaucuacagcuucugcucccagaucugugacccccggguagggcuguggggagggacggguaucaggguugggggcugcggcggagucagccagcucacgggcacacacacccaccccugcccugccccccacgcagacgaccggcgcguucuggcagacguggaaggacuuugagguccggcauggcaaugaggacaccaucaaggaaaugcugcguauccggcgcagcgugcaggccacguacaacacgcaggucaacuucauggccucgcagaugcucaaggucucgggcagugccacgggcaccggugagccgucccagcuggcugaguuccugauccagggcaucucagcccggccugaccugggcuuuccgggucugggagccucggauccugauggcaaucuccuugagggcugggccaucaccugggggacugggauagugcaacguccgaugugugggaggggcccccguggcgcugacccccugcucccacccccuagugucugaccuggccccugggcagaguggcauggacgacaugaagcugcuggaacagcgggcagagcagcuggcggcugaggcggagcgugaccagcccuugcgcgcccagagcaagauccuguucgugaggugagggcggauccuuggacgggacaggacugggacaggucccaagggggcccgggguggggaacugaggcagcauggcccgucccuaggagugacgccucccgggaggagcuggcagagcuggcacagcaggucaaccccgaggagauccagcugggcgaggacgaggacgaggacgagauggaccuggagcccaacggugagggcccggcuggggcggggacgguggcauuaccagggugggccucgggggacaggccaacgccaggagggugacuggcucccgccuuccccacagagguucggcuggagcagcagagcgugccagccgcaguguuugggagccugaaggaagacugacccgucccucccccauccccccuccccacccccuccccaauacagcuacguuuguacaucauggucugagccuccuuccugcugcccaggugcccgagggaguacagcucaggagugccuggcccugggccgggauuggcugcugugggagguggggcggcugggccccaggccagauacugcccggccucaccccgcagagccaguucuggacucgagaggccagucccuccgcugccuggggccuuggaguggguccugcccggaaacuuccuugagccucuguagccugggaagggcaauccagccccuggcugcccaggucucgccagccccugccucucagagcccuucuguggccccaggcagcugccgccucccugggguggcacccacugucuguuccccacuagggacuggcccuugcccucaagucuuggagucaggcaggcucuggcccagcucugggaacugauuaguaacgcguuucugugccuggacgggggccaggcgccagaccuugugcacggcccaggaccagggcgugguccuuaguccuaagccugggaagccauuagcgggcuguaggcuauuaagggguuuuaaguaucaagggauauaaucagauuugugcuucgaacgggucacacaggcugcugugugggcaggaggcagcuggggacauggggaggcccaggccauuggcuuggacuuugcagggaggugacagggcuggagagaagcgagugagacaggaggggagggcugagcuguguagaacugggcggcagcugggaagccagugccagccuggguugcagggcaggccuugcaucugagagagacacccaggcaauggcagggggcaacuggauugucaaacacagaucucagagaaaccuggaaucacuggcccagagguagaugccaggccuggaaacaccaggcuggccaggggagacaagaucaaguuagaaguuggccccaugccaaacgcugguuagggccaguaacaacagccacacagaccaggagaauccagcaagcggggguggccaaggccacaggaagggccagugggacaccucgagccugagagaucaguucagaggcagcuucgaaacagcccuggcugggggcugggagugcccuggcugaagcugcauuaggggauuauggggguugaagacaggaguugguuugagaaagaacaggagacuaaaaacacagccagggagugugggaccccggccagccucggagggggggacaagguucaacuucucuuuaaauuauuuuauucaagaagugggggaggacagacaaggggacugagcugagcccugagucccugaaccucccagcucagcccccacagcaggacuggacucaaagucagaggguggagacuccagccccacccagacacgguuggggacagacaggacccaggaauaccgacugacuguccuccaggggauggcggccgcagcacacagggcccggcccguggaccgcccggguggggcuauuugggggugccgccgcccuucuugggagugguggguuucuugcccugccagaggugucccuggauggugaaggcaucgacgcucauggacauggucuuggcggggaucugggugaagcgcuugcgguccgaguuguacuuguagaugccuuccaccauggcgggcgugacgguccggggcccauacccugccagccgcgacagcuccucugucucccccgacagcguguagagcgcccggaacuggcagcucgagucgcgaaagaggaucaggaagugguuggccuugcuuuucucaauuuccugggcaggagugcuggaaauggucagcuggccaagucaggccacccacccacccaccagcccccaacucccacgugugggcgggcucaccuccagaaugcgauucuucugcgguucguucaccuugcccgccaggcagcagugugauagggcauuguggaugaugaacuuguuggacuuggc

SEQ ID NO: 15513 - RNA, 2778 nt, Homo sapiens
gguguggggcagcagucugcuggggacuaaugucugccucccauaagccgacccugcccugauguggggcucuggaggccuuuggcucgugucccauuugugacuuuuccuuacagagggagcuguggccaccugagaagguaagugaucucuucuuccugccagagggauggaggaggcuggauucuuguauccgggauggguuuuagaugaaaauuuuaggccaggcgcaguggcucaugcuuguaaucccagggcaugggaggcugagguggguagaucacuugaggucaggaguucaaaaccagccuggccaacauggcgaaaccccaugucuacagaaauacaaaacuuagccaggcaugguggcaggcgccuauaauuccagcugcuugggaggcugagggagaagaaucacuugaacccaggagguggagguugcagugagcccaagaucacgccacugcacuccagccugggcaauagagugagacuuugucucaaaaagaaacauuuuacucucagccaugaguaaggaaccgagagcagaggaguagaugguuuccuuauugccuucuccuggaagagugaagcggaucccacgcggaccccuuuguaauuggcagggggcuuccagugaagacacugaacccugaagccguggucuggggcaggguggugggagaggugggcggggggggguggucccggcucugaggugugugccccuccccccuuccugucccacccgcuucuccaccccuagcuucaagagauagaggaauucaaagagagguuacggaagcggcgggaggagaagcuccuucgcgacgcccagcagaacuccugaggccuccaagugggaguccuagccccuccccugaugaaauauacauauacucaguuccuuguuauucauuuaaguguuuuauucuuuuaucaguuuuugggggccgagugagacccaggaugccucaggcccucagggggcuugugucgggggcugggggcugcuguuccgacggaagccgagagcggucggguccugaggggugagcagggguuggggacugagggucccagcucguuucugugcuccguccuguggaugaagaggggucagccagggggagggcucaagggcagugccggccacagguggcgaacaauggagagagggugcagguagccaccgugucccaccucauugugagcacuggucuauguuuacccucaauaucugccauuuaggguggcauuugagugugagguggcaggucuuggggcccucgcugggaucuugaucagaacccaagcuucguguaugugugaagucaacagaugugaguauacagauguauauauccuaugugugagcuuacgugacuuccucccugggauacuuuccuaggaagggguccuauuuucucccuuuggccuccccagaaccuucagacuugggggcaggagccacaaguuccagccaugggucuuacacuagcauggccccuguauaaccuugggccccucuagccacugccugggccuugguccucccaucugaagucagggcagcggauggacagagauggggcaggcccuguucccuccuggcugggguggagggcaggaucggagagcacugccuggcggguuucuccucgacaucgccagaacaucaccuaccuuggaccccacgggcuggaagccgggcaggcugcugacugucacacguuggucauccaugcggcggcccuggguacuggccagcauguccaugaggcuguccaucucggggguggggucgcucucugcguggacguucacagacuugggaggacacagccggagugggggcccccaacccuaccccuucacccccacacagaugcuucagggugcacaaccaccucccacaucccgugcccccaggcccuccagaugaccacuugcccugcacucccaccccguucacgccccauggacagcacccccgugcccaugcucacggcucuugguggucuggcccggcccggcuugcagugaacagcgcugucccuccauccggucgcccugcacguggcucagcagauugaagaagcccuccuggucuggggagcccgccuggggacagacucgcucagucugguuggcccuucagcuugggggccccuccccaaacuuccuagccagcuugcucacacccugaccccggggccugccguccccacuuccucagcucucaccaugguccccgccgauccucucugcagagcuguucugaaugagacaugagucuccuucccaaucccggcccccgccccaggggcccuggccagcagugccacuucacgugguaccgcuucaagggacaggcuccgaugcgugucccgccguccuagauuggggccugaugaguguggccugggagcugggacacgaaucagggaaacauggcccaggagcuacccccaggucccagcaucucccaucaauagggguccacacggagagcccugcccucugcccuggggccuggcacucagacccccaagcccaccagccccuuucuacagccacaacugggucaggggguccuaggagacucacucguuaauuaggugcccuacaaacuagucuugucaaucaugggcucugagaccuugagcuggggguggggugggggcagggcccucucaccucggcacaggggccugagccuuccuccgucuucuccuccugauccaucaugucccuggacuccagucacuuuucugc

SEQ ID NO: 15514 - RNA, 4660 nt, Homo sapiens
cuucauuacgacaccuuccuggugauucgcuacgucaagaggcauuugacggugagaguccuuguccuggaccagaugguggugugggcugugucgcucuugcucccauggccugacccugauuuaucucucuuuuuauucuagauaaugauggauauugauggcaagcaugaguggagggacugcauugaagugcccggaguccgccugccccgcggcuacuacuucggcaccuccuccaucacuggggaucucucagguacugccacgcgcacucuugguuugcccugacugaggccucuucucaauacccacacuucauugaggccucucacaggggagagccagaggagcggugcucuggaaggaggugccucaagacugcuucuccuucugcauucuuauauccacauuccuuaaaaacccacgccaggcuuuccuaguacaguugucacuagaagaugguuggugcuaauagaaagcaguguuugucccuucauuaagcuggcucuucuagccuguaucgugaguuccuugcuuucugauuucugcugucaggcuccucuccuuccaaccacuaauguuccccguuccccuuccuuaacaaagcuuuuccuugacuuugccgucccucuucugaccccagacucuccuuuugcugagacuuuugaauguguuguguguacagauccuuuuguuuccuagcuguccaccuccuuaacaugcugacucagaccugugcucuaucuugcuaguacacuaacaccauucucaugaaaggucauucuguuuccuugccauauucaguacucuauucucguucucacccuuuguccuccucagcucauuuaacccauuacccugaaacucuugccuucuugacuuaugugacauuaacagcaccugguucuuuuacuuuuccaucuccucuuguuucuuuuucuacuuaugccugauucguagcuucucguuuauacacuuacucucuuugcuugaaccccaaucauaacaucuuuugggaagagaaaaggaacugaacuucuguuucuuuugauuaauauaauuuguucuggauaaagcuaguuuggaauagaaguuucuuguggcaaaauagaaaggcagauacccaucugaaaaagccgacagcuagugagcuccagccauuguagcuaaaaggaaaugucagcucagugaggcuaaaucuuccaguuuuucaagagcaguuggaauucuggauuuuuuuuuauauauauauauggagucucgcucugucgccaggcuggggugcaguggcgccaugucagcucacugcaaccuccaccuccuguauucaagcgauucuccugccucagccucccaaguagcugggacuacaggcgcgccaccacgcccagcuaauuuuuguauuuuuaguagaaacgggguuucaccauguuggccaggauggucuccaucucgaccuugugauccgcccgccuuggccuccgaaagugcugggauuacaggcaugagccacugagcccagccuggauaaucuggauuuuuaaaaugcaaucugcugaucuuuaaaacucuggcaucugauuuuuuuaaaaucaacuuuacugaggugugcuuuccauacaacagaagaauacaguuugaagaguuuugacaaauauuuacaccuauguagucaccaucacaauuaagauaugaauguuuccaucaccugccaaaagccuuauuaucccccuuugcaguauuccuccccuucuuggauuccaggcaaccauugaucugcuuucugucaugcagagagauuaguuuuggcaauuagguucuaaguaccgagcaggccagaccugugggaaaaauuuagucucggcagggggauaggaggcauaggcuggagaucuuugcuauauaaucucauuauaugacuacacauuuuccuuugagcuuacagguuucuggguuaaccuccugacguacuuuuuaauggaaaguccccaacugucagaaauggcaggggagaauaauuuuuuguuuagucuaaguuuuuugcccuaggucuuuagugagaauacccaaguuaguaagucuguguucucugcccauaggguaucccuaaaugcaaguuguuucuuucuuuugaggucuuucuuguugccauccucuuacuuguuguauaguagguuguugaaaacugcugagaaaguuaggauguuucccagccguuccaggcuuuaaugcccugcauugcaugaggagcauugcccuggccuuuuauccugucccaugguuuaaacugagcucugacaguuaacauuuuuccaacagaagaugaauccaguuuuucacuaccugggaaucugcuaaagauucuagcaguccaagcagcuguggaugcucuccuuauaaaugaccagaaauccaggccccagucaguaaccaaccuaguagcaaugagcaccccuagcacucagauuuguggucucuaaauaccaauucccccuaaaaggaacugcagcuuccuugagaaauggcugaugcaggguuugagguaggaaaucuauaaguuggaacuucccagaaaagcaaggaaguuauaaaaaacuucuggguuuauguaaagagacgcaggagccaaacugaauaggcuccuacuugacaaagacaggugaguugagcaucaauaagaaucuaacuucaggccaggcgcgguggcucacgccuguaaugccagcacuuugggaggccacggcagguggaucaccugagguugggaguucgagaccagccugaccaacauggagaaaccccaucucuacuaaaaaaaaaauacaaaaaauuagccgggcgugguggugcaugccuguaaucccagcuacuugggaggcugaggcaggggaauugcuugaaccugggaggcagagguugcagugagccgagaucgugccauugcacuccagccugggcaacaagagcaaaacucugucucaaaaaaaaaaaaaaaaaaaaaaagucuaacuucagugcauugcaacacaucagauaugguuaaauguaggaguuuauaaugauacuuuaaagagagaaaucuagucccuaauugcuugaucuucucucugguaauuauuagggagauuaagagucacaaguacaagaagccacagagaaacaggcauagucuagaagggcaguguaucccaugcccauagcugugcccugcccauggcccauuaaacagcggccaugagaccuuuuccuguuguacgugugugugugugcacguguguggucuucaccagcggggaagcugcaguccuacuuugucuguucuuacugugcuggaagguuuaacauaugggauuuaauugugguuuuaucuccaaauuuuuuaauuauacagaugcgucuugacauacaauggcguuaugucccaauaaacucauuguagguuguagauauuguaaguugaaaaugcauucaauacaccuacccuacugaacaucauagcuuagccuagucuaccuuaaaugugcuuagaacauuuacauuagccuacaguugggcaaaaucaucuaacacaaagccuauucuguaacaaaguguugaaugucugauguaacguauggaauacaguacacgaugcaguacugguuguuuacccuugugauuguguggcucacugggagcuacagcucacugcugcugcccagccucaguacagaguguuguacuacacaucgcuagccugggaaaagaucaaaacucaaauuuugaaguaugguuucugcuaagcgcagauuacuuucacaccaucauaaaguuggaaaauuguaagucgaaccauuuuaagucagcgaucuucuauacagguaaugcaugcuuguugauaaaaacuuaaauacagaagauauagaauaugccuuguuccccauccuuauuuuuaguugcaaaauggagagguuucaauuauuuuuucaaggucacugcugguuagcuguggaucagaggcuugaacuaagauacugacuucaagaaacauaccucuuuuucaaguggcacaagucauccuucuuccauuuuucuucagauaaucaugaugucauuuccuugaaguuguuugaacugacaguggagagaaccccagaagaggaaaagcuccaucgagauguguucuugcccucaguggacaauaugaagcugccugagagugagcacaggggcccgcgggaaauggucccauaguuggggaggagcuugcagugcuguacccauagcucacagggcggucucugcucuguguucuucuucugaaggguagggagcacuuucaucugccuuuccccuucaaguuacagaugagcagcaggagggccgcuuuguuucucaguuggaaagagggggucuaagcucuggcuucccagaaguaggugucagaaacugggggccggacagccuauaguuugauccuucccuauugggugggcucccuguuuucugacuugcuucucucuugcuuccucagugacagcuccacugccgccccugaguggccuggcccucuuccucaucgucuuuuucucccugguguuuucuguauuugccauagucauugguaucauacucuacaacaaauggcaggaacagagccgaaagcgcuucuacugag

SEQ ID NO: 15515 - RNA, 735 nt, Homo sapiens
aacgccccgguggagaagcugaggucaacaucagauuugaaauauuuaaaguggauacaaaacuauuucagcaaugcagacaauuaaguguguuguugugggcgauggugcuguuaguaaaacaugucuccugauauccuacacaacaaacaaauuuccaucggaauauguaccgacuguuuuugacaacuaugcagucacaguuaugauugguggagaaccauauacucuuggacuuuuugauacugcagggcaagaggauuaugacagauuacgaccgcugaguuauccacaaacagauguauuucuagucuguuuuucaguggucucuccaucuucauuugaaaaugugaaagaaaagugggugccugagauaacucaccacuguccaaagacuccuuuuuugcuuguugggacucaaauugaucucagagaugaccccucuacuauugagaaaccugccaagaacaaacagaagccuaucacuccagagacugcugaaaagcuggcccgugaccugaaggcugucaaguauguggaguguucugcacuuacaaagaaaggccuaaagaauguauuugacgaagcaauauuggcugcccuggagccuccagaaccgaaaaagagccgcaggugugugcugcuaugaacaucucuccagagcccuuucugcacagcuggugucggcaucauacuaaaagcaauguuuaaaucaaacuaaagauuaaaaauuaa

SEQ ID NO: 15516 - RNA, 2137 nt, Homo sapiens
aaaugggcuugggcggcuccucggcagguggcggugguggccguagcgguuccuccuggcccuguuaaugucggggccaggccgggggaggauggcgcccuagaacccggccuugcugggguaggggcgggaggggacgggguggggaccggccaugucggaggugacccggagucugcugcagcgcuggggcgccaguuuuaggagaggcgccgacuucgacucuuggggccagcugguggaggcgauagacgaguaucagauauuagcaagacaucuacaaaaggaggcccaagcucaacacaauaauucugaauucacagaagaacaaaagaaaaccauaggcaaaauugcaacaugcuuggaauugcgaagugcagcuuuacaguccacacagucucaagaagaauuuaaacuggaggaccugaagaagcuagaaccaauccuaaagaauauucuuacauauaauaaagaauucccauuugauguucagccugucccauuaagaagaauuuuggcaccuggugaagaagagaauuuggaauuugaagaagaugaagaagaggguggugcuggagcagggucuccugauucuuuuccugcuagaguucccgguacuuuauuaccaagguugccaucggaaccaggaaugacauuacucacuaucagaauugcgaaaauugguuugaaagaugcugggcagugcaucgaucccuauauuacaguuaguguaaaggaucugaauggcauagacuuaacuccugugcaagauacuccuguggcuucaagaaaagaagauacauauguucauuuuaauguggacauugagcuccagaagcauguugaaaaauuaaccaaaggugcagcuaucuucuuugaauucaaacccuacaagccuaaaaaaagguuuaccagcaccaaguguuuugcuuucauggagauggaugaaauuaaaccugggccaauuguaauagaacuauacaagaaacccacugacuuuaaaagaaagaaauugcaauuauugaccaagaaaccacuuuaucuucaucuacaucaaacuuugcacaaggaaugauccugacaugaugaaccuggaacuucugugaauuuuaccacucaguagaaaccaucauagcucuguguagcauauucacccuucaacaggcaggaagcaagccguacccagaccaguaggccggacggaguccaaugcaaagcuguaccacagaauucagaguccagcacaucacugacguauaggacuccuugggauacagguuuauuguagauuuugaaacauguuuuuacuuuucuauuaauugugcaauuaauagucuauuuucuaauuuaccacuacuccuacccugcuuccuggaacaauacuguuguggguaggaugugcucaucuucagacuuaauacagcaauaagaaugugcuagaguuuacacaucuguucacuuuugcuccaauaugcucuuuugacuuaaugucaagcuuuggguugauguggguaggguagugucaaacugcuuugagaggaaugggaccaguucugcugccuaagaaggucugucuggauguuuauaggcagcaccucugaaguggccuaaauucacccugaucugauaguuuuccugcuuagaaagugugccuuggccagaucaguaucccacaugggaguguucccuagguuguagcugugauuguuuccagaugaccagauuguuuuucugaaaaugagcauauuuuuagucaugucgauuagcuguucuucuacaucacauuguuacucuuucugaugaugauucuaggguuaacauuggaaccaucucaaaauaauuacaaaguuuuagauggguuuacaaugucuucuaaacaauguaaucuaaaaauaauugagucagaugcuaacgagauacugcaggcauaagugcuguuuuucugacaacugauugugaaaccuuaaaaccugcauaccucuucuuacagugaggaguaugcaaaaucuggaaagauauucuauuuuuuuuauauagguagauaggaucgccauuuauuuccuauuuagauauacugacauucauccauaugaaaauaugcaggucauuagcuuacuauaauuuacuuuugacuuaa

SEQ ID NO: 15517 - RNA, 2137 nt, Homo sapiens
uuaagucaaaaguaaauuauaguaagcuaaugaccugcauauuuucauauggaugaaugucaguauaucuaaauaggaaauaaauggcgauccuaucuaccuauauaaaaaaaauagaauaucuuuccagauuuugcauacuccucacuguaagaagagguaugcagguuuuaagguuucacaaucaguugucagaaaaacagcacuuaugccugcaguaucucguuagcaucugacucaauuauuuuuagauuacauuguuuagaagacauuguaaacccaucuaaaacuuuguaauuauuuugagaugguuccaauguuaacccuagaaucaucaucagaaagaguaacaaugugauguagaagaacagcuaaucgacaugacuaaaaauaugcucauuuucagaaaaacaaucuggucaucuggaaacaaucacagcuacaaccuagggaacacucccaugugggauacugaucuggccaaggcacacuuucuaagcaggaaaacuaucagaucagggugaauuuaggccacuucagaggugcugccuauaaacauccagacagaccuucuuaggcagcagaacuggucccauuccucucaaagcaguuugacacuacccuacccacaucaacccaaagcuugacauuaagucaaaagagcauauuggagcaaaagugaacagauguguaaacucuagcacauucuuauugcuguauuaagucugaagaugagcacauccuacccacaacaguauuguuccaggaagcaggguaggaguagugguaaauuagaaaauagacuauuaauugcacaauuaauagaaaaguaaaaacauguuucaaaaucuacaauaaaccuguaucccaaggaguccuauacgucagugaugugcuggacucugaauucugugguacagcuuugcauuggacuccguccggccuacuggucuggguacggcuugcuuccugccuguugaagggugaauaugcuacacagagcuaugaugguuucuacugagugguaaaauucacagaaguuccagguucaucaugucaggaucauuccuugugcaaaguuugauguagaugaagauaaagugguuucuuggucaauaauugcaauuucuuucuuuuaaagucaguggguuucuuguauaguucuauuacaauuggcccagguuuaauuucauccaucuccaugaaagcaaaacacuuggugcugguaaaccuuuuuuuaggcuuguaggguuugaauucaaagaagauagcugcaccuuugguuaauuuuucaacaugcuucuggagcucaauguccacauuaaaaugaacauauguaucuucuuuucuugaagccacaggaguaucuugcacaggaguuaagucuaugccauucagauccuuuacacuaacuguaauauagggaucgaugcacugcccagcaucuuucaaaccaauuuucgcaauucugauagugaguaaugucauuccugguuccgauggcaaccuugguaauaaaguaccgggaacucuagcaggaaaagaaucaggagacccugcuccagcaccacccucuucuucaucuucuucaaauuccaaauucucuucuucaccaggugccaaaauucuucuuaaugggacaggcugaacaucaaaugggaauucuuuauuauauguaagaauauucuuuaggauugguucuagcuucuucagguccuccaguuuaaauucuucuugagacuguguggacuguaaagcugcacuucgcaauuccaagcauguugcaauuuugccuaugguuuucuuuuguucuucugugaauucagaauuauuguguugagcuugggccuccuuuuguagaugucuugcuaauaucugauacucgucuaucgccuccaccagcuggccccaagagucgaagucggcgccucuccuaaaacuggcgccccagcgcugcagcagacuccgggucaccuccgacauggccgguccccaccccguccccucccgccccuaccccagcaaggccggguucuagggcgccauccucccccggccuggccccgacauuaacagggccaggaggaaccgcuacggccaccaccgccaccugccgaggagccgcccaagcccauuu

SEQ ID NO: 15518 - RNA, 6075 nt, Homo sapiens
ccccuucucucccagaagaggaaaaccgcacuuuauccagagcuccaaccgguucgagcacagccgccagcaaggccuuaucuggccuggccccccgcgccgcucagccugcuggaggcccccagccccaguccucucugugacagcgaaggugugcaagucccagugucccaguuuuauugcaaacucaggcugugcggggugggcaauacacugcacacggggcgggacucggggaaacggggcguguccuaggccaaaggggcggagcucgaggggcgggccuaggucaaagcuguggguaggucccgagccuccgaggccaaaggcucaggcucuagggagcuaagacuaauccacccagcggggcuccagggcaguggaggcggggucuaaaacaaacggcguacccggaggggcggauccuaaggcaggggugggguguagcaggcggggcuguggucuggcucaguggaaggucuccaccuccaccacgguccagucacccugcggggaggccacgucguccggagagaagcuggugaccgaggugaugcuggcacgggacucguccaggggagacaguaguucggcccagcggccgaguucggcgucgcugagugcagcccgggcgcccccugugacgccaccacccuccgcaccuccugggcccccgccgcugccgcccgcggcacccucggcagccgccagcagcagcguccggcucagcaggugcugcacgacgcucgccugcagcgcccccaguggcagcucgcccaggcgcgccugcuucgggcuccgcgaggacgccccggccccggccccagccgccgccuucccaccgcucgugccgggacugggccccggauccagugcgccaggggcgggggucgccgacucgggcccuucagucucguagauggugcacagaccgucagcagagcccgguccgguagcgggaggccacggcaggggcgcaccugcggggagagacgccaggugggccgugggggugauaagccccgccccugccucaaggucccgccuccuugucuaagcuccgccccggacccagcugucccgccccugagcugcgaagccucgccuccgaccccgcccacagccaggccgggucuggggugccccuuaccuggggcuccgcggaaagccagcggcggagcggggccucgacuccaggcagccggguggcaagcggcgagcucugcgucggggggcggggaggcugcggcaccgcccucgggcccgcugucguagccacgcagcuccucuggcgugcucguggcgcugcugcuguggccggccaggucugggccgcucagcgugcuggacgggcugcgcgagggcggcggcggcgggccgggggccaacgccagggucagccgugggcccgagacggagguauccggacccggggucggggggcggcguggggccugcagggugggugaggcagggggagagggagggaccugcagaaggggcgcugccagaacagguggggccuguggaggaggcguggccaaaggagacauugggagugaggcagagggugagaaaggggccugcccagggaaugaggcaggcggagagggaagggccugcagaggagguguggccagagcagguggggccuguggagggggcuuagccaaaggagacauugggagugaggcagggggagagggcgggaccugcagaggaggagcggcaagaaggggugggacccguggagggggcguggccgaaggagacauugggggagaggcagggggagagggugggaccugcagaggaggcgcagcgagaggggguggggccuguggagggggcguggcugaaggagacauugggggagaggcagggggagagggugggaccugcagaggaggugcggcuagagaggguggggccugugaagggggcguggccgaaggagacacugggggugaggcagggggagagaaaggggccugcacugggggugagggagggggagagaaaggggccugcagaaggugcacugccagagcauuuggggccuguggagaggguguggccaaaggagacagagggggugaggcagggggagagggaggggccugcagaggaggcaaggccagggcagguggggccuguggagggggcguggccaaaggagacagagggggagagggcaggcccugcaaagggggugaggccagagcagguggggccuguggaggaggcguggcuauggaagagggcgucuccggagggggcguggucaauggcgaagguggugcuugcagagggcauggggcuggacaagguggagucuccagaugggguguggucaggggagcagaagcugucugcagaggaggcggggcuagagaagguagguucuccagaggggguguggucaggggagcagaagcugucugcagaggaggcggggcuagagaagguagguucuccagaggggguguggucagggaagcaggaggugucugcagagaggguggggcuagggaagauugggucuccagagggggcaugaucagggaagagagaggugccugaggagagugggaggccagagaagauagcgccugcagaggguguauggucaggggugagcuuaggggugagacagcaggagagagagaagucugcagagggggugaggcaggaagggaaagaggggccugcagagggggugaaucagggggaguagaggccggccgagaaggugagaucaaagaagcuuggguuugccuaggggacauugucaggaaagaauguguggccugcagagugggugagcccaaagaaguuguggccugcagagaggacaaagccagaggagagggaggugccugcagagacggugaggucagagaaugugggaccuguauugggggaauggucuggagagagggcggggccugcauagggggcguagucauagaagguggggccuguggguggggcggagccugcagaggcggugaggccaaaagagagggagaaacuagaggaggauccugcagagagacuguggucaaaggagagggagaggccugcagaggcaauguggccagaagaggagaguccugcagaggaagaguggccagaguguggggcguggccuggagagagggcggagacggggaaggacuggccugcggagggggcguggucagagcagaaaggccuggcugagggagugcggccaggggaaaagccgaauuccccagagauguugccggagaaacagggccuuguagaggagacauggcugacagaggagguguggccaagggagagaggagagucggaagagagggcaacgcuggauuagcuuggguggggggcauacucugcagaggggaugaaacugauggagagacugaagccacaaaagcggcuguggccagggaagagacgccugcuucuggaaaggacauaaucagcuguguggguggaacuugcgaggggggcguggcugguggagaggggagggucugcagagaagguggagcagagggagaaggaggggcuagaggaaggggcguggccaacugacagguaaggcucgacgaguggggcguggccggcagggugggcggggccugacuuuggagagcggcuggcggagggggcguuaccgguggagagggagggagcguggcuggcaggggaguggcugcauugucgggaggcgguacgggucuugccuugguacccgauggagaggguguggccaaaggagaggaagaaagcgguccuagugcuggggcugcguccuuccuugggggugugaccugagggggucgcagagccugcaguccuuucggcuugggcugcgagggaugcgcaggagcccuggguguuccgcgggcugagggcccagaacgggcuggggaggagagagggguggcgcuggagcucagggagcgcgaggccggccucuggagacccccaccggcgcugggccgccuccuggcagccgggcuuggcucggugguacugugcuccgaggcgcugcucacugauuuccgggggcccucugucgggggccguggccgggcacucggagcuggccgggggagccccaccucggugcccgcagcccgggaccgacgggccauggccggggacgggguuccugggguaggcccggaagugucuggagaaaaaguagaaggccaagggucaccgauaccucugaggcggcuccccuugcugcccaggaaccccacucuucuccaggucacguaccucuccgugccccagcgcugagggcacuccuuuugggagccucuguagcuuuuccucuggccacaguuuccuccgcugagauccggagucccuucuggccaagagggccuggccuggagacagaaggggccacgcucaggccuaggucuuuguuuggcuucccaagucucuauuuucccaucugugaaaugggcaugugcccucucugaggaccaauaauggcuuucacccaauuugugcccagugaccugcaagugcucccgcgccccaacucguguaaaauaaaagguuccagacucugugacgcuaacccuggcuuaggagacugggggagagggagcagguuaccugguggucccgcuggcacgcccugggcuagaaacagggccugggcugguguucuuggcaggaggagcucucuccccucucccagaggcugggggccuggaggcugcggggagaaggccgagucacaggugccccggagagguggcaguggaggugagacuggacagguauuggaagggggagggaagaugggggcggagcugaggaaggaggcugggguaccagguuucgggaacuugucccagcacuccgcguuggucccgcucggggagcagacucgggaauaguggccccgccgaugccccccgcucgcucugccagaggcuuucgccccacugcucccgcagcucccagaacucggagggcugcgggaguuacugggggagggggucgaggagagccugggggccugggggucagaaguccaggagcgcgagcagccggcguccgcgcggcggccccugccuucgccuugucucucuuguuguccaucuugcaccugaagagacaaaccgguccgcaucccagguucuggacagcuacgccgccuccagagaccuggacccugcuaccucacugcccuuucgcagcaucgccacccauggacacucaaaccucggccucggcuuccauccgcucggcucccacgcaccuacacccacucgccagccccacugcuccucgcuguccccaagucccaccccccaccgcuuuucccuaaagcgaagaggcccugcccgccccagcccaccgccucccccgccucggcuccaauucaggaccgaucuccacgccccugccccuugccccuucagggacucagaccgccagccucgagagcgggggacugccacgggcucaggaugucgcaucccuccagacccggagcgcacgcccgggucuccccgccagcccccaucggccuccccuggccuccccgagggaugccugcaccugccgggaggcagagcggccccgcugcccgcgaacgggcuccgggagacaaagagccgcgucccgggcccgaccccucccccagccgggccuggcccgcgcccagccucuccaccugcucgcgucgcgcucaccuccgccuccggccuccggccgcuccucacagagucgccugggguggggcccgggccggagcgacgcgguggccgccagcggcgaggaggcgaggggagggggcugcgggcugcggcgccgggggagccgagccggucccgccccucggccgcgggcgggagagccgggggcgcgcgcucgauccggacccgggagcgcggccggcggaagcgcgccgagggggaugggggagaagcgcgcuuuggagagaaggguggcuucucugcgguccgggggaagccuguuuccccagcugcgccugaggaacccagauagucaacgguugggacugggggagcaaaucccugggguccu

SEQ ID NO: 15519 - RNA, 6075 nt, Homo sapiens
aggaccccagggauuugcucccccagucccaaccguugacuaucuggguuccucaggcgcagcuggggaaacaggcuucccccggaccgcagagaagccacccuucucuccaaagcgcgcuucucccccaucccccucggcgcgcuuccgccggccgcgcucccggguccggaucgagcgcgcgcccccggcucucccgcccgcggccgaggggcgggaccggcucggcucccccggcgccgcagcccgcagcccccuccccucgccuccucgccgcuggcggccaccgcgucgcuccggcccgggccccaccccaggcgacucugugaggagcggccggaggccggaggcggaggugagcgcgacgcgagcagguggagaggcugggcgcgggccaggcccggcugggggaggggucgggcccgggacgcggcucuuugucucccggagcccguucgcgggcagcggggccgcucugccucccggcaggugcaggcaucccucggggaggccaggggaggccgaugggggcuggcggggagacccgggcgugcgcuccgggucuggagggaugcgacauccugagcccguggcagucccccgcucucgaggcuggcggucugagucccugaaggggcaaggggcaggggcguggagaucgguccugaauuggagccgaggcgggggaggcggugggcuggggcgggcagggccucuucgcuuuagggaaaagcgguggggggugggacuuggggacagcgaggagcaguggggcuggcgaguggguguaggugcgugggagccgagcggauggaagccgaggccgagguuugaguguccauggguggcgaugcugcgaaagggcagugagguagcaggguccaggucucuggaggcggcguagcuguccagaaccugggaugcggaccgguuugucucuucaggugcaagauggacaacaagagagacaaggcgaaggcaggggccgccgcgcggacgccggcugcucgcgcuccuggacuucugacccccaggcccccaggcucuccucgacccccucccccaguaacucccgcagcccuccgaguucugggagcugcgggagcaguggggcgaaagccucuggcagagcgagcggggggcaucggcggggccacuauucccgagucugcuccccgagcgggaccaacgcggagugcugggacaaguucccgaaaccugguaccccagccuccuuccucagcuccgcccccaucuucccucccccuuccaauaccuguccagucucaccuccacugccaccucuccggggcaccugugacucggccuucuccccgcagccuccaggcccccagccucugggagaggggagagagcuccuccugccaagaacaccagcccaggcccuguuucuagcccagggcgugccagcgggaccaccagguaaccugcucccucucccccagucuccuaagccaggguuagcgucacagagucuggaaccuuuuauuuuacacgaguuggggcgcgggagcacuugcaggucacugggcacaaauugggugaaagccauuauugguccucagagagggcacaugcccauuucacagaugggaaaauagagacuugggaagccaaacaaagaccuaggccugagcguggccccuucugucuccaggccaggcccucuuggccagaagggacuccggaucucagcggaggaaacuguggccagaggaaaagcuacagaggcucccaaaaggagugcccucagcgcuggggcacggagagguacgugaccuggagaagagugggguuccugggcagcaaggggagccgccucagagguaucggugacccuuggccuucuacuuuuucuccagacacuuccgggccuaccccaggaaccccguccccggccauggcccgucggucccgggcugcgggcaccgagguggggcucccccggccagcuccgagugcccggccacggcccccgacagagggcccccggaaaucagugagcagcgccucggagcacaguaccaccgagccaagcccggcugccaggaggcggcccagcgccggugggggucuccagaggccggccucgcgcucccugagcuccagcgccaccccucucuccuccccagcccguucugggcccucagcccgcggaacacccagggcuccugcgcaucccucgcagcccaagccgaaaggacugcaggcucugcgacccccucaggucacacccccaaggaaggacgcagccccagcacuaggaccgcuuucuuccucuccuuuggccacacccucuccaucggguaccaaggcaagacccguaccgccucccgacaaugcagccacuccccugccagccacgcucccucccucuccaccgguaacgcccccuccgccagccgcucuccaaagucaggccccgcccacccugccggccacgccccacucgucgagccuuaccugucaguuggccacgccccuuccucuagccccuccuucucccucugcuccaccuucucugcagacccuccccucuccaccagccacgccccccucgcaaguuccacccacacagcugauuauguccuuuccagaagcaggcgucucuucccuggccacagccgcuuuuguggcuucagucucuccaucaguuucauccccucugcagaguaugccccccacccaagcuaauccagcguugcccucucuuccgacucuccucucucccuuggccacaccuccucugucagccaugucuccucuacaaggcccuguuucuccggcaacaucucuggggaauucggcuuuuccccuggccgcacucccucagccaggccuuucugcucugaccacgcccccuccgcaggccaguccuuccccgucuccgcccucucuccaggccacgccccacacucuggccacucuuccucugcaggacucuccucuucuggccacauugccucugcaggccucucccucuccuuugaccacagucucucugcaggauccuccucuaguuucucccucucuuuuggccucaccgccucugcaggcuccgccccacccacaggccccaccuucuaugacuacgcccccuaugcaggccccgcccucucuccagaccauucccccaauacaggucccacauucucugaccucaccgucucugcaggcaccucccucuccucuggcuuuguccucucugcaggccacaacuucuuugggcucacccacucugcaggccacacauucuuuccugacaauguccccuaggcaaacccaagcuucuuugaucucaccuucucggccggccucuacucccccugauucacccccucugcaggccccucuuucccuuccugccucacccccucugcagacuucucucucuccugcugucucaccccuaagcucaccccugaccauacacccucugcaggcgcuaucuucucuggccucccacucuccucaggcaccucucucuucccugaucaugcccccucuggagacccaaucuucccuagccccacccucucugcagacaccuccugcuucccugaccacacccccucuggagaaccuaccuucucuagccccgccuccucugcagacagcuucugcuccccugaccacacccccucuggagaaccuaccuucucuagccccgccuccucugcagacagcuucugcuccccugaccacaccccaucuggagacuccaccuuguccagccccaugcccucugcaagcaccaccuucgccauugaccacgcccccuccggagacgcccucuuccauagccacgccuccuccacaggccccaccugcucuggccucacccccuuugcagggccugcccucucccccucugucuccuuuggccacgcccccuccacaggccccaccugcccuggccuugccuccucugcaggccccucccucucccccugccucacccccucugucuccuuuggccacacccucuccacaggccccaaaugcucuggcagugcaccuucugcaggccccuuucucucccccucccucacccccagugcaggccccuuucucucccccugccucacccccagugucuccuucggccacgcccccuucacaggccccacccucucuagccgcaccuccucugcaggucccacccucucccccugccucucccccaaugucuccuucagccacgcccccuccacaggccccacccccucucgcugcgccuccucugcaggucccacccucucccccugccucucccccaaugucuccuucggccacgcccccuccacgggucccaccccuucuugccgcuccuccucugcaggucccgcccucucccccugccucacucccaaugucuccuuuggcuaagcccccuccacaggccccaccugcucuggccacaccuccucugcaggcccuucccucuccgccugccucauucccugggcaggccccuuucucacccucugccucacucccaaugucuccuuuggccacgccuccuccacaggccccaccuguucuggcagcgccccuucugcaggucccucccucucccccugccucacccacccugcaggccccacgccgccccccgaccccggguccggauaccuccgucucgggcccacggcugacccuggcguuggcccccggcccgccgccgccgcccucgcgcagcccguccagcacgcugagcggcccagaccuggccggccacagcagcagcgccacgagcacgccagaggagcugcguggcuacgacagcgggcccgagggcggugccgcagccuccccgccccccgacgcagagcucgccgcuugccacccggcugccuggagucgaggccccgcuccgccgcuggcuuuccgcggagccccagguaaggggcaccccagacccggccuggcugugggcggggucggaggcgaggcuucgcagcucaggggcgggacagcuggguccggggcggagcuuagacaaggaggcgggaccuugaggcaggggcggggcuuaucacccccacggcccaccuggcgucucuccccgcaggugcgccccugccguggccucccgcuaccggaccgggcucugcugacggucugugcaccaucuacgagacugaagggcccgagucggcgacccccgccccuggcgcacuggauccggggcccagucccggcacgagcggugggaaggcggcggcuggggccggggccggggcguccucgcggagcccgaagcaggcgcgccugggcgagcugccacugggggcgcugcaggcgagcgucgugcagcaccugcugagccggacgcugcugcuggcggcugccgagggugccgcgggcggcagcggcgggggcccaggaggugcggagggugguggcgucacagggggcgcccgggcugcacucagcgacgccgaacucggccgcugggccgaacuacugucuccccuggacgagucccgugccagcaucaccucggucaccagcuucucuccggacgacguggccuccccgcagggugacuggaccgugguggagguggagaccuuccacugagccagaccacagccccgccugcuacaccccaccccugccuuaggauccgccccuccggguacgccguuuguuuuagaccccgccuccacugcccuggagccccgcuggguggauuagucuuagcucccuagagccugagccuuuggccucggaggcucgggaccuacccacagcuuugaccuaggcccgccccucgagcuccgccccuuuggccuaggacacgccccguuuccccgagucccgccccgugugcaguguauugcccaccccgcacagccugaguuugcaauaaaacugggacacugggacuugcacaccuucgcugucacagagaggacuggggcugggggccuccagcaggcugagcggcgcggggggccaggccagauaaggccuugcuggcggcugugcucgaaccgguuggagcucuggauaaagugcgguuuuccucuucugggagagaagggg

SEQ ID NO: 15520 - RNA, 13801 nt, Homo sapiens
caggagugcacauaagagaucaaaacuagaacuugcauaauuaguauuauuuauuaagcacccagagaacagucaagaccaaagucccugcuuguccuuggaaaaaugucaccucuauagcagguguccuaacccugcaguccacccaccuuaggaaguccuugaauagcucucugggggaaaucuaucagcugccugaagagcuuuguguguauuuguacaccagcauuuuccugaggaaggaggugccuggcuucaucaguuucucaaagggucuaggaccucaaaagggaucagaaucuagauauuuggauacccuauuuuuuuuuuuuuuggcagagguggggucucgcuauguuacccaggcugaucucgaacuccugagcucaaccauccuccugcauuggccucucaaacagcugggauuauagucaugagccacagcgcccggcccugauaccuuuacgucagcauuucccaacauacugucucagggccacuuaccugcaccagaacuaccuggaauauuuaggaacagacuccuggcccccaaccaaaccuccugagucaguguuucaggggaggggacugggauauuuuguuuugcaccgacucccuaggugauuuugaugcuuagccaaaugagaaccauuguucggagcuaacauauaacacagcaaacaacugugucuguguccucuccuugggagagaacuccagaaguaaguugcuuuguugcauggggagggggaguguuggaaaucccacugggaugugucguuucccccauauguggcacuaauugagcuggaauauccagggagaggcagcaguucuagggaugggagcaaggccagccagccugccagagacacaggugugguuuuggucggagaaugccaugacugaguuaaucccuccauaccagguuccaccccagcuccacaacauccugucugucuccccagacaaaccagcccagauccuccugggccccagaaagaugacacagcugcccccgccccccccaucuccuggccuggacccacuuggcuuccuaucuuggaagacaaugguugagauuccagggcagaagcauuuuuaaggcucuaccuaaaacggccccaccccagcuucauuccuccuccaucuugucccgcacuucugccggcagacccugguaaagcgugucuuccaccaggagccccgccuucuugagccccccacaguugccaaguucuucuggcagcgccucuaagcgguugccuuugagcuccaggcggcugagggcucugagggcacccacguggggcgagagcuggcucagcugguugucgcccagaagcaacguccgcagcuugcggcagaagaagagcucuucgggcagggccuccagggcauuguaggagagggccaggugcuguagguucugcaggaggcccaccucggguggcagggaguguagcccauugugggacacauccagcagacggaggccugagcacaggccgagcugggagggcagggucuccagcuuguuguagcugagguagagcugcuccaggcuccugagcuuccgcacgugcucagggacguaggcgaucugguugugccacagccugagcgugaccagcuuccggcagugcuggaagcugaggauuuccucgauggagcgcaggugguuguccuugaggucaaguuccugcagcgcacccaggcugaacacugcaugggggaugcgcuccagcccgcaggccaccagcuccagcucccgcaaugccgccagcuucuugaggcuguucagggcaaccagacgggccccaucguugugcaggcugagccucugcagguggccagcaacgucggucacacuggcuggcaccuucccggcguugcuccggagggacaacaccuugagcugcuucagcucccggaggcucuccaggguggcugcccgagcuagcuccugggggaaaagccccuccaggugcagcuccuccaagccccgcagcccaaacacccaaagcggcaccucgcggagcuccucgcauuugacgcgcaucaccuucagguggucccgcaggaagaccugcaaggagaaggguagccuggcgggcgaguggagcaagcugagcuccugcaagugcaccagcugugacagccccggggggaaggugauaucgcagauggccuccagccugagugacuccaccucacugagcucaaagacggugucgggcagacccggcagcaugcagagggccagcuccagccggcccgcggcauugcgcugcagcuucugucgaagcuucucgggcguccacucgugguugagauugagcugcuuuagacggcuuucgcugaccucggacaggaagacggcgaagcgcuuggaguagagggagucguacugaucgaugaggugcagcaugaaggcgaagucauucuugacgucaggaaugucccccaugccagucuccucccgcacggaacggaaggaguacuccuugaggggccgguggaagagccaguagagcguguagaugcagguaaguccguagaugcacacaaaggagauguaacagaaggccagcuuggagaagaggugggccuuggugugguugcagcagaagcuggcguagcccgugaccucugacgucuccacccuacaggccaccaggaaacugaucuucuccacauagaccagguuguagaccaggauggccaggaacuuacacacuuucagcaccgucugucggauguacaugguguacaggaugucgcccucuuccacgugcaugcggaacuucuucaccuucucaaacagggcuuuggcuugcucacccuccuucuuguccaacagggugacaacuggaggcucggucaccaccuucuccgguuccgccagcacuuucuccuucucacccuccccugccuuccccggcccggucccugccauggccacuaugguggccgcagcccguucgguggcugcugggcccuucugguucuccccggauaccucggauagggcccuggugguccauggagagucgaaacacuugcccaggauggagaugaaguguucaaucuuggagcuggugccagggaacuugaaccagaaacuggugcagaccaugaagaugagugugugaaugaccacgagguaagggaaguacuuggcauaccagugcagggccgucucauaacacagcugguuaauaaagcuguauugcugcagguccaaauuguucuuaaggccuuuaaccuccugcagggccccaaucugcucagggaucccccgaggcagcaauugcuggcacggggccucugauaaguucuccuggagcucaugauuggguagacagaugaucuuguccugugucaccugaggagcaaaagagaaugagggcuguaauccuagcacuuugggaggccaaggcgaguggaucacuuuaggucaggaguucgagaccagccuggccaacguggugaaacccugucucuacuaaaaauacaaaauuagccgggcaugguggugggcaccuguaaucccagcuacucgggaggcugaggcaggagaaucgcuugaacccggaagauggagguugcagugagccgagaucgcgccauuguacuccagccugggugacagagugagccucugucucaaaaauaaauuaauuuaaaaaagagagaaaaugagggggauggggaaaaagcaggcugaaggugggagaccccccgcaccccccaucucugacuguugccagccagcugugauuuuggaagaguuuugcuaaaccucuaagcacuguuuuuuuuuuuuuugguuuuuuuuuuugagacaagagucucgcucugucaggcugugugcaguggugcaaucuuggcucauugcaaccuuccccuccugguucaagcaauucuccugccucagccugcugaguagccggggcuacaagcacgcacuaccacgccuagcuaauuuuuguauuuuuaguagagaugggguuucaccauguuggccaggcugcucucgaacuccuggccucaagugauccccugccucagcuucccaaagugcugggauuacaggaaugagccaccacaacugacaaagcacuggucuuugucugagaaaaggagcuggguugaaucguguccccacaaaagauguugaagucccaacuccgaauccuuagaaugugguauuauuugagcugggucaggcggcuccuguuugguaauagggucuuugcagagguagucaagacaaagccaguagggugggcccaguaugacugcgccuuagagaaaggggaaacauagacacagagacagacacaaagacagaagaugacgugaggauacagggagaggcugggugcgguggcucaggcuuguaaucccagugauuugggaggcagugggagggggggccaagcgggggugguagaggaggauugcuugaggccaggaguacaagguuacagugagcuauuauugcgccacugcacuccagccuaggugacagagcuugcuuaaaaaaaaaaaaaaaaaacugucucgaccaggcgcaguggcucaugccuguaaucccagcacuuugggagacagaggcaggcugauccugaucacgaggucaggaguucaagaccagccuggccaacauacugaaaccacgucucuacuaaaaauacaaaaaaauauuagccgggcgugguggcacacgccuguaaucccagcuacuugggaggcuaagccaggagaauuguuggaacccgggaggcggagguugcagugagccgagaucgcaccacugcaugccagccugggcgacagagggagacucugucuaaaaaaaaaagaaaaagaaaaagaaaaauacugggagaaugucaucuacaagccaaggaacucuuggagcugcaaaaaucuaggagggaagcuuggaagauucucccucacugacaacugacgccuugaucucagacuucuggccuccagaaccagacccagaagaggaaacauuucugguuauuuaagccacucaaucccugcuacuuuguuacaacagaaguaacaaacucauauagcaacugcaguccuuuccagauucuagggauaaaacugagcauugugaaaauauggggcuggacacaguggcucacaccuguaaucccagcacuuugggaggccgaggugggaggauggcuugaggcccggaguccgagacaagccugggcaacauagcaagaccccugugucaacaagaaauuuaaaaauuagcuggacgugguggugugugccuguaaucccagcuacucuggaggcugaggcgggaagaucacuugaguccaggaguucaaggcugcagugagcugugaucaugccacugcacuccaaccuggaugacagaaugagaccguguuucuuuauuuuaauuuucaauuauuuuauuuuauuuuuuuuaagauggagucucguucugucacccaggcuggagugcaguggcaugaucucggcucacugcaaccuccaccucccagguucaagcaauuuuccugccucagccuuccaaguagcugggauuacagguguccaccaccaugccuggcuaauauuugugucuuuaguaaggacggguuuucaccguguuggccaggcuggucucaaacuucuggccuuaagugauacucccaccuuggccucccaaagugcugggauuacaggugugagccaccaugcccggccccugucucuuuuuagccaaaaagaaaaaaaaaaaaaagaaaaaaaaagaaagggucaggugcagugccucaggccuguaaucccaacacuuugggaggcccaggcaggcaggucacuugaggucaggaguucgagaccagccuggcuaacauggugaaaccccaucucuacuaaaaaacuaccaaaauuagccaggcgugguggugggcgccuguaaucccagcuacucaggaggcugaggcaggagaaccgcuuguacccgggaggcagauguugcagggagcugagaucaugccacuguacucuagccugggugacagagugagacuccgucucaaaaaagaaaaaaagauauggaauggcauagcaauguggggacuccggugcuccuggcuauggagguaaggaagauaaggggucuggauuggccuuugaguggggcucugucuucaguuuccucucuuucuugggugaugagaaggcuucccgacuuccccagacaccugccccgccccucuggucacacccccuugccaggggagggccucaccuggagggugcagccaaagaccccaaucaugagcauggccacggugagguacucggccagcacgucccaccaggguuugagcaccuugaacgcaggcugcuguuccgugaacugcuugaacucggccacugggaucaugcugccugugggacgggacgagacgggggguguagagagagacccucaggaugggaggcucugcaggggguccuccgaggagccggacacaggcaggccugugacccucccugcccaaacuuguccaaaccaccaaagugugugcccccacuucccucuuagccuggccuuagucacccuccaugcagacgucaccaccugcccagaaccaagcggccacuguuccccucugggcaccccugcaccugaucugacuugucugaccucgaagagcacaugagggauaguccacagggccgccgcccuccagccuccucggguggcccccuccccaaaacgaggcaucccucucccaccccugacaccaaggccugaaaacaucugccucgaugcucccugacugcagacacucagcgucugggccagccccggcucccaccgccaccaggccugaaagcguuccaaggcucaggacuuccggggcguaggccccuccacccccuccaggggcacucugggcaccaccuccaaccucuaaccggaaaagccggcuggagccuggcucugguuacuagggccccaggggcagggacugccaagcugaaggcuagucagcccuggggguaggaggugaccaggacaccugaguuucuaaaggggcuacagcccagaaucacaggcagaaaccagagaccugggcucugagagggggcaaugggguguccggauguccgaggaggaaggaggauuugcaaauggaaaguugucaggugacaucugcgaccaggcuagggcugugcugucaggcuccuggccggcccacucugucuguucccagggucuccuuuuagaccaagcuaucacuauuacagauacagacaggccagccacaaaucacacuggggcguggggcaugagcugagaugucacucucccaggcagguaccuacuuccccagaggcuggagguggaacaaggaagguggggaaccuuagaccagcccacuucugccaacauccaaguucccccacuccugggagccuccuguccuuguccagauagauaaucuguaacuggggcugggcgcgguggcucaugccuguaaucccagcacuaugggaagcugaggcagguggaucacuugagguuaggaguucgagaccagugaggccaacauggugaaacccagagucuacuaaaaauacacaaaaaauuaaccagguguggugacacacaccuguaauccuagcuacucuggaggcugaggugggagggucuugauccggggaggcagagguggcagugaagugagaccgugccacugcacuccagccugggugacagagugagacuccaucucaaacaaacaaaacaaaagacaaagauaaucuguaacgggacaggaguugggccaagaaggagggcaucugcccaucagggaguuaucucuggcuccccauccaucuccccaggaagaaucuagggaaacccugguccccugacccacgacucagccaaugguucugacaugucugagccucccuuuucaguuugugucccccccauauuuuggggugacuccuggguuaaaacaagguaggauacaggcuccacccaccaagcuaaaggccaagcagucccgaaagaccacauccuuuuacccccucagaggcccccacuucagucuggggaaucagauaggcaggcaaggguguggguacagccugcccacacggggacucaccaugcaaguguaaaaugucauagguugggccaggcgcaguggcucacgucuguaaucccagcacuuugggaggccaaggcaggcggaucacaaggucaggaguucgaaaccagccuggccagcauggugaaaccccgucucuucuaaaaauacaaaaauuagccgggcaugguggcaugaaccuguagucccagcuaggcaggagaaucgcuugaacccgggaagcggagguuguggugagcugagaucgugccacugcaaucuagccugggagacggagcgagacucugucucgggaaaaaaaaaaaaaaaagucauggguucccugacucaggcagugacucacccagacccagauccaugcaagggggugcccagagcacaggguccuucgcaccauggccuggcccucaugcucauucacacucccugcccuaagcaaaaagccaaguauacuuugggaggccgaggugggcagaucacuugagguuaggaguucgagaccagccuggccaacauggugaaacuccgucucuauuaaaaauacaaaaauuagccaggugcgguggcucacgccuguaaucccagcacuuugggaggccgaggcaggcaaaucacaaggucaggaguuagggaccagccuggccaacgugaugaaaccccgucucuacuaaaaauacaaaaaauuagcugggcgugguggcaggugccuguaaucccagcuacuagggaggcugaggcaggaggaucgcuugaaccugggaggcagagguugcagugagcugagauugcgccacugcacucuagcccagacaauagugcaagacucugucucaaaacuaaaacaaaauaaaaauaaaaauacaaaacagccagucaugguggagggugccuguagucccgguuacucgggaggcugaggcacgaaaaccccuugaacccgggaggcggagguugcagucagccaagauugcacuacugcauuccagccugggcgacagagcaagacccugucucuaaaaaagagaagagaagagaaaagaaacccgacuacaaauaucccagucugccugggucaccaguauguaaucugguagaaacauaccaggauagcucaacuguccccaggggaagaauauguacauugcacccaccaaaauggacgcuuggggucauuuugggucaugcauauuugugcacgaggguauaaaguccaaguacacacacugagcuucggagggacccagcaccagggacccucacguccuguuuugguuccggccauccauugaguccuccaaggauccugcagggacacugcucaguugcuuuaccuaagaaugcugaccccaggcugggugcaguggcucaggccuguaauuccagcacuuugggaggcugaggcaggaggauugcuugagcccaggaguuugagcagccaggacaacauagucagaccccauuucuacaaaaaaaucuaaaaauuugggccgggugcgguggcucacgccuguaaucccagcacuuugggaggccgagguggguggaucacgaggucaggagauugagaccauccuggcuaaugcggcgaaaccccgucucuacuaaaaauacaaaaaauuagccgggcauaguggcagacgccuguagucccagcuacuugggaggcugaggcaggagaauggcgugaaccugggaggcagagccugcagugagccaagauugcacaacuguacuccagccugggcgacagagcgagacuccgucucaaaaaaaaaaaaaaaaucuaaaaucuugccaggugugguggugcaugccuguagucccagcuacuuggaagacugaggugggaggauugcuugaacccaggaguuagaggcugcagugagccaugaaccagccugggcaagacccuaucucaaacacagcaagcaaaacacuacugacuggggccgggcgcgguggcucucgccuguaaucccagcacuuugggaggccaagguaggcggauaauuugaggucaggaguuccagaccagccuggccaacauggugaaaccucgucucuacuaaaaauacaaaaacaauuagccaggcauggugguggaugccuguaaucccagcuacucaggagagugaggcaggagaauugcuuaaacucgggagacagaagcugcagugagccaagaucucgccacugcacuccagccugggcgacagagcgagacuccgucucaaaaaaacaaaacaaaacaaaaacuccugacucuggaggcugcagaagaaaucacacaacacacacacacacacacaaacacacacacacacacacacacccgagcagggaccaacuuccuguccuugccacccugguguaagcuccaccaauagccaucccaggugcacaaucgcagacaagaaggcagcaacacucaggggaccggggggcagccacaggggcuaucauuaucugucuccaugacucaaacuugauccucacaaaccugccauuaaauuuccacagacauaaaauaggcccccacuuugucugagcagggcuggugggaagguccaggaacaggggcucgaagaauuggggcagagccagggaaaauaaaacgaugggacguauacgcucagcuuucuccaccagacacugaaugccucauuuuaucccaacccaggcagcguggaugucggagacuuugcuuuccagacucaggggagagaaauaacuugcucaagcuucuacaguuccaagcggcauucgaagccugacccauccaaccuccagguccugccuguaggauugcaacugcucuguucccucuugggagacagccucuaauuaaaaugcagcaucuugccaggcacgguggcucacgccuguaaucccaacacuuugggaggccaagguaggcagaucauuugaggucaggaguuugagaccaggcuagcccaacaugguaaaaccccaugucuacuaaaaauacaaaauuagcuggagugguggugggcaccuauaaucccagcuaauggggaagcugaagcaggagaaucucuuuuuuuuuugagacagagucucacucugucgcccaggcuggagugcaguggugugaucucggcucacugcaagcuccgccucccggguucacaccauucuccugcuucagccucccgaguagcugggacuacaggcgcccgccaccucgcccggcuaauuuuuuguaauuuuaguagagacgggguuucacuguauuagccaggauggucucaaucuccugaucucaugaucugccugccucggccucccaaagagcugggauuacaggcgugcgccaccgugcccggcugaagcaggagaaucucuugaacccaggagguggaaguugcagugagccgugauugcgccacugcaauccagccugggcaacagagcaagacucuaucucaaaaaacaaacaacaacaaaaaaaccacagcaucuuugccaaaagcaccuaagagcgguguugcauuguggcaggccaggcuggaaggcuuuccagccugagaccauguggcucccaccagcccuggcuccauccacccaugccucaccccuccucccucccagguccuccucaagccacuugccuccaaaaaauguggugaugaguuccugcugggggaagggugggagagugagacccuccacacccacagcccaugcuaagaggcagggaagaagcaagaaacauccagcaguuuucagcccuaagagggguuuuguagaaaacaaggcccaaccuuuuuuuuuuuuuagacauagaguccugacggacacaguggaucacgccuguaaucccagcacuuugagagguugaggcagguggaucacgaggucaagagaucaagaccauccuggccaacaugaugaaaccccaucucuaaaaauacaaagauuagcuggguauggugccacaugcuuguagucccagcuacucaggaggcugaggcaggagaaucgcuugaaccugggagguggagguugccgugagccaagaucgugccacugcgcuccggccuggcaacagagcaagacucuaucuugaaaaaaaaaaaaagagagagagagagagauagagucuugcucugucacccaggcuggaguucaguggcacgaucauagcucauaguagucucgaacuccugggcucaagugauccuccugccucagccuccccaguagcugggaccacaggugcgugcuaccaugcccagccaacuuuuagauuuuuuguagagauggagucucgcuauguugcccaggcuggucuugaacuucugaguccaagcaauccucccaccucagccucccaaagugcugggauuacaggugugagccacugugccuggccucaaucuuuuuuuuuuuuugagauggagugucgcucuguugcccaggcuggagugcaguggcccaaucucaacucacugcaaccuccaccucuuggguccgagcaguacucaagccucagccuccccaguagcugggacuacagggacacgccacuaauuuuuguauuuuuaguagagaugggguuucaccguguuagccaggcuggucucaaacaccugaccucaggugaccugcccaccucggccucccaaagugcugggauuauagacguaaggcacgguguccggcugagccucaaccauuuaugcaagggagaaacugagggucuagggugggggaggguggcaucuuuguagcccguccugggucaggccccaggccugcggauucccagccgagugguuuuccaagccgccucugccagcagacuugaagaucugggacauguguaaguucaagagcaccagaggucaggcuugguugaacccaccccaagugguagguucuggagcucugagagucucccggggaugaguugucaaugucuucccagaugccaaggggaggggaaagugguugagacccccaaagucaaguuuaucuucagccuguuuaucuucacucugagacuuggccgcgucugccuggcucccaggacgggcaccucgugggccagguuucccuuugcaccggccggcacccccaccccagcuccuggugugucgggacggccugccccggccacagggccggcgcaccuggagcggcucugccccuuguccagacccggggacucccagcccgacccccacccugccaccucgugggguguccagaggcaaagagccaccuacucaccguuccgggagggacgcugggcccaacuccugggucucugggagcggagcugccgcgacucccgcagaguucccgggcgggccgcgagggugagucagggcaggcggggacaggagacccggagccgccccgccccgcccccggacgacucggccccgccucgccgcaggcgcgcccaggucgacccuacuccaggcgccgcgcgaucagcaggguugggggaagacagccgucuuaggcugcuuugcccuggugggcucggggcuggcgggagaugcaggggucuuagaacuuugcaacuuugcagucuggcuggacccuggcagcuggggaaacugagggagcuggggacg

SEQ ID NO: 15521 - RNA, 2952 nt, Homo sapiens
cugaccucggcggcccccguagcuccgcccaucggagaagcgaccuuacagcgccugccucuuucugagcggcaugaagccaccucccaggcggcgagcggccccggcgcgcuaucugggcgaggugaccggucccgcgaccuggagcgcucgcgagaagcggcagcuagugcgacuccugcaggcgcggcagggccagccggagccggacgccaccgagcuggcccgggagcugcggggccggagcgaggcugaggugagaugcgguucucgggaccggagccaggcuggaggcggggcugggguggggcggagagugggcggggcugcggcaggagccagcggggcggggccaggaauguaagcgagcgggggcguggcguggggcugaguggcggggcguuagugggugagccugggcggggugaggggcggggcguggacgggaagagaagaccuaggggcggggcgagcuugggagcuagacgugggcggggcauaagugaagcggaggggcggggcgaugccgggggcggggcgugcgugccgcugagguuuggagagugggugggugaguuugaggggcaggacgagccugggggcggggcgugggcggguuaauagcaagacuuaagggcggggccguuuugggaguaaggcgugggaggggcgugggcgggaugagggcaagcuuuaaaggcggggcgagccucgggguaaugcgugggugaggcgagggcuaaacgggcggaaugaacugggaguaagaugcugccgaguccgggcgaaaagcaacgcaugcuguuggacaggauacgagcuugaagugagagggaauagagaagaggggacgaagaagggaguugaacgggguaguagucagcauaggguugggcccuggcugcgugaaggagccggaacuggccugggccuuacaacuuccuuagguagcuggucacgcucugggugggguaggggccuuggcagucacugggacuccuaacaccgggccagcaggagacuaaggcgcaguagcggggcccagagcauacaagggauugggcuuuggcuucucugcugcagcccugagcucauagaagccucauuccgccgccucuuuccuuucuagauccgggucuuccuccagcagcucaagggccgcguagcccgggaggccauucagaaagugcauccggguggccuucagggaccaaggcgccgggaggcacagcccccagcccccauagaggugaggcagaugaacagggugaggcuguccagggcaggucccugguggguaggugggaguugcgggggauaaccugauuaggggauccccaggaggagcagggcuuggggggccauugcaggcugaucccugggcugacccuguaccucuggcuucacucaggucuggacggaucuggcugagaagauaacagggccacuggaagaagcccuggcaguggcuuucucgcagguaccgccauucccccaggcaggucagggugucccagaggacagggucacaugggccaaaucaugugaaccuggguccugggcccuuuugccagcucuguggacuccgucagucacuggacaccucgagccucagugucccuggcucugaggccaucucuugucugaggagcaucuuaggguggcagggaggaugggggaauguguagacggugagaagacuucccagcuccucuuccucccugauuguucugccugccaggugcucaccaucgcggccacggaaccggucacccuccugcacuccaagccccccaagcccacgcaggcccguggaaagccuuugcuccugagcgccccuggaggacaggaagaccccgccccugaaauaccuagcucugccccugcugcaccuagcuccgcacccaggacuccugacccugccccugagaaaccuucugagucgucggcuggucccuccacugaagaagacuuugcuguggacuuugagaagaucuacaaguacuuguccucugucucccgaaguggccgcagccccgagcucucagcagcuggugagaagggugagggagggggcaggagcagagggaucaagggucccuggcagcaggcagggguguccccuuaccccucuccuccauccaucacuagaguccgcugugguccucgaccugcucaugucacuuccagaggagcugccacuccugcccugcacagcccugguugagcauaugacggagacguaccuacgccugacagccccccagcccauucccgcuggagggagccuggggccugcagcagaaggggauggggcuggcuccaaggcaccagaggagacccccccagccaccgagaaggccgagcacagcgaacugaaaucgccuuggcaagcagcugggaucuguccccugaacccguuccuggugccccuggagcuucugggucgggcagccaccccugccaggugaggggcauggcgggcaggaggccacaccaggccccccgcccugccccucgguucugcucggcuggcccuggcucuuucugaggaucccgucaugggggaagguccuugagaugaugcucagcuguggggcgggccucuaagaugccccauacuuugggggucucagaaauggaacccccguuguacagggguuggguggggguugcaggacuccacucacaagccuccugaugucaaggacaggcggacagggcuggccucccccaguccccaagccccacugugccuuguugucugcuggggggccauagcuggcacugcccaccguaaaggcccucgcacauuuucccccuuccuguacaccucggggccagcauccucaccuucuucaacugaccagucgugguuacucccugcugccagguccuuccccuucccggggguauucugugaccaugaauaaaguuaucauucucuuucuc

SEQ ID NO: 15522 - RNA, 14311 nt, Homo sapiens
aaaaagagccagcuggcacugccaaccaauuccuauaguagucuuagaaauccuaauccuguagaauuuccucuuguagucaauaagcaccaccaucuucaggaguauuucaguguauuguuaucuacgccaagcaagccuggugaugcagcuaccugaguucucuugguuaugggugaauguuaucuucauucauaacuucccagcuuucauguagguggggauagagccacguugagucaacccuucaaaccuuuuauagguauaauugagaaaaacccagucuuuggauuuguaguccgguucugugguauuuggcacuagaaagagaaaaaauaaaggaauuucauuagugaaaugccaucaucuucaaagacuuuuaauaggguuaguuacauuacagauugucuuaccugguuguaaaauaucagauucagggaagucaucaaaauuugaaguaucaucaaugcuuuugauuucuauagggauugcugcuggccuuucccuauaaaaagguauuaaguaugcaugguaacuuuucuugaacucucaauuuccaacaaauaauucuacuuguaaauucugcauacuauucuacagauacuagaaaauccaaggaaauuuauuguggauuugagauuaguuaaagggaguucaaaauaguugaguauaauuuuuuauuaaaauguuuucauuuacuuagaauuuuaaauauuuuuuuaauuuuugggguuaugugguagguauauauauuuauaggguccaugagagguuuuaauacuggcaugaaauggguaauaagcacaucgugcagaaugggguguccauucccucaagcauuuauccuuugaguuacaauccaauuacauucuaaguuauuuuaaaauguacaauuauuauugacuauagucacccucuugugcuaucaaguaauaggucuuauucauucuauuuuuuuuguauccauuaagcaucuccaccuacuugccauuuuuauaucucuguacccaaggcuuucucauccuauuuuuuuaaguggaaaaaugagcuaaugaaaaguaaaagaagagguuuuauuuaaaagauuguauaauuguauaaaguauuugagauauuaugaggacaggauccuucuuaauugauuuaggaauagaauucuacuaguagacaauccauaaauuaaaagucauuugggaaaauaaggggcacauaggugaagggacuauauauuugugaugaaaucugcaugcaaaaacuucugucauacaaauuuuaagagaaucaaagauacucaguuaaaaagaaaccagucaugaaaaugccuucuuaucaugcuaaaaaguuuagcuauacaaaugguuaaaagaagcuaucaguuuuuauugcuucuguuuuuucaacaaauauuuauuggauuuauuaggugcuaaguuuaccaaauuauuuaaaaccauauauauuuuuuaccagaauuauuccaacucauuuauacuuaguauacuacuuuaauaaaccuaguuuagaggaaagaacccuggaggccugagagcuaaccuuccuuguuauuaacuagcaguaugaccuuaggcagccaaaucccugcuccaugacuguucccucauuauaaaaccaaaagaacuggcagucucuaagcauccuucccacuguaaaagggaggguauucuaguucuauucaauuaaguuauguguguauaguauuauacagcauagugguuaagaguuaggccuccaccaggagaauggcgugaacccgggagguggagcuugcagugagccgagaucacgccacugcacuccagccugggcgacagagugagacuccaucucaaaaaaaaaaaaaaaaaaauuacuagcugcagcacuauagucacauuacuuaacuucucugugccuuaguuuccucacuuguaagacagggauaauaacaguuccuauuuuauagagcuuauaugaggauaagaugagaaacgcaaguaaaguacuuaaaacagugcuggacacaauaaaugauuuuuaaaaauuagcuauuauuacaacaggcagagugggcuaggcgccuguaaucccagcacuuugggaggccgaggcagguggaucgcuugagcucaggaguucaagaccagccugggcaauugggcaacauggugaaaccccaucucuacaaaaaaaaaaaaaaaaaaaaaaucaacaaaauuagcugggugugguggcacaugccuauaguuccagcuacuugcggggaugagguggggggaucauuugaggccuggaggucgaggcugcggugagccaugaucaugccacagcacuccagccugggcgacagagugagacccugucucaaaaaaauaaguaauaauaauaggcagagugccuagcacacagcagguucaccagugaagagcuguaccaaggaaaugacacauaagcuaucuuggaagaugcaaaggagccagcuaggcaggguagggguagaggcagcagggagagggcauuucagucaggauggauagcaaauagcaaaacuuagaggugggaagaggaguaggagaggccauccaagacgcaacuccugcagaugaggcaaucgccauauccugcaguccuaagaaagcagugaaggcuucuuaacuguauuccaagugcaaaaggccacaggaaaguggcauggccagauuuaugcuucuaaacuguugcuguguggagaacagaucagaacuaccaaugguaguuuggccauaaacugaaaaaagccaaugcucacaauuaacaacuguaagcaaauucuuaaaaguuacuuguauuauuuaaugcccaaccaccguuuaaagagggacuguaccuuauuauaaauuaauuaaggagacaguaugugguauauuacagcaaggacaaaaaugaggggucacugugugaaauguaaauacauguuucaugugcuaacagccuucacugugaauaugaauauaagaauuuaaacagcuucccaauguucuucccugaaaguggauguuagccuaaaaugagucaucaagcuguagccacaauagucccacucacuuacauaauccagaaaacacugcacuuaaugacauuauauguuacuuuuguauuuaaucuagcagaaucagagguaaauuaauugccaacucuagaaauuuguuuuuacucagaccuuucccauucaaagccuaggaacauaccuuaugugcucccagucgacaccuucaaaaaagggaugaccuuuuauuucuucuacuccacuauuuccaauucuguuuucagaaucaauacaaaaucuacaacauggaaacagagaaauuaucauacacaaguuacaucuaaaguauucuagcugcauuacuucaaauauuucuuuuuuaaagaaauauaauguuuuucuuuuauugauguuaacuauguuuauuguaggaaauguggaagaaaauaaaaaucaucuguaagcgcacuguuuagagauaacuacuguaaauaugcuaaucuuuuacaauauuaaaaauacuguguugcuaccauaguuacuauguuaggucugcuuuuuuucacuugauauacugagaaaauuugccaaagucauuaaauauuuuucaauaaauuuuuuuuucguuuguuugugagacggagucucgcucugucacacaggcuggagugcaguggcgugaucucagcucacugcaagcuccaccucccggguucaugucauucuccugccucagccucccaaguagcugggacuacaggcgcccgccaccucgcccggcuaauuuuuuguauuuuuaguagagacgggguuucaccauguuagccaggaugguuuugauuuccugaccuugugaucugcccaacucggccucccagaguguugggauuccaggcaugagcugcugugcccagccaauaaauuuguuuucuaaaauuuacauauagagguauuauagacagucuacuauugagccaguccacuacuguugaacauuuaaauaguuuucaauuuucacuauuaaauaccaugaaaaucauaguguaccuaaaucuuuauacguaucugauuaucugcauaagcgaaaucccuagaaguagaacuucugggucaaaggucauacauaguuuagggauuuuaaaaaaauaauaugcugccaacuggcuauucccacaaguugucccaauuuauauuccuuccagccauucacagcaguaccaaaacacuucauauuaguugaggaacacauggaauuuuuugcuuagaagauuuuacauauauacuuuucaugacaggaaucugcuauuaacauuuuccuuuuucucuuuaauggaaucaggucauugcauucuaacagaagugaccuuuugcuuuuauauauaucaguaacagaagcaauacaagacuuccucccucuuuuuaauuccuacguuuuuuucugcauacuuccuuuuaagaguuuacauuuuuaaaaacaccuuuauugaucucuuugacuguauacaucagugguauccccucuucccccacaaaagugaaaugagucuuuuagguucuuaggaaguuuuaagacacuaugaacuccucuaggaauuuaaccacuaaccugagaauuaaguccuuggcuuucucagauauagguaccucuggaggaaauaccagaguuucuuuccaguucaucacuuuucuguacguuucuugagguguuucagagcagaaagguggauauccuauguaucaaauaaaucaaaaauguuucaucagcuuugugagcagugaaguuuauacccaccaaacaugugcgacaagaaaccaaacaacccugagugcucuauuuaacagucaaaaaugccaccauucaucaauuuacaaucacguugcuaauaaagucaauaaaauaaaggauugaaagcacugccuccccuuuuaccugaaaagcuauguagauaaccacuuuuauacgugggaguuuggguuaaauacccaccuuccugaaacaggauccguggggagcucacugguauugaucaguauguauuuaacauugggggaacaucagaauuaagcuuaaaagacuucaaauauuuuagucaaugauaucuguaauauguucaaacaauggcacucaaggaaauguauauauuuuguacauaaaugaaugauaaaacauaccuauuagcauuucauacauaaucacucccaaagaccaccagucacacaauuuguuguaaccagucugcaugaauacuucuggagcaauguaaucuggugucccaacuguggaauaugccuacaaaggagcaacucgucaaaccagcauucuuaacauuuaaaaaauaucuaucugaggauggcuuacuacuggaaaaagcaauauauagaggaguuaaauuuucacuuguauuuauuuugcauguuuaucaugugcaaggcuuagugguagguagugagucagauaauauguuauagacuacuauuuuucagucuauuuacuuuccugagggaaugcugaauuaguuuuccuuucaucacuuaguugaacaaauauuuauagaguguccauaugugccaggcauuuuauaagaauauaucauuucugcccccacaagaagcucaguuaaguuauuuauauauauagccuucagucuauuucaaaaagaaugaaaaaguugaaccuagaagaccuggcuuccccacucacuacuaauguguucuugggcaaauuauucaauuucucugaggcucagcuucugcuuacauaaaacuagaauaauaauaccugcccuaauagaguugauaugaagaugaaacaauaaacggcauguguuuuguaaacuacaaacuacaaaaauaagcaugagguauuuucauuauaaauguaauuccaggguacugcuuauccuuuaggaagcuaugcaguuuuuaauucuuaauucauauaaaaucuuacaaaaaugauuucuacaaggcaguaauucucaaccagggguaguacucuuggggccauggcaaaauguaggaccacagauuuugucaucucagugacauaacuggcauuuacagggcaggggauccaggugcuaaagaaauuuccugccccaaacacugaguccucucuacuucucccuugggaaacacucgaucuaaggcuuggcaacuacuggccaugagaauaauaaaacacacaccugaguaaucacccaugaauauuuuguaaauagggggguacagaauucccccaccauaauuuugagcaguauucaguuuuuccccuuuaaaaauagggaauauugcaauuauucucaauugcaaaaccugaucuaaaauggacacauuuuaaaaguagaacaaaguuuuucuccuuaauguguaacucaauacauuuaaaaauacugaaauguuuuacaaguuuuugcaguuacuuagguuaaugagauaauaagcucaauaaugcaaaggucauuuuauuugguuuuagaggguauuagccuauuauuuuucagucuguuuacuuuccugagggaaugcugaauuaguuuuccuuucaucauuugguugaacaaguauuuauagaguguccguaugugccaggcauuuuauaagaaaugagaaaaagaaaauccuaaggcacauucuuaaccuguagacuguugauggaccauguuaacaggacaaagggaaagaggagaaaggggaagcaauucuucuauuugcucaguuauagaaaggaaauaguaugggguuaaaaauaauguaauucuauauuaaaggaguaauuaaauuuaucuguggcaaagccagcuuuuucaaauuuuaucuguuuuauuguaacacuguuuacaucccaaacuuccuguuuacuuugucuauaaagaaguuuuuagaaacucacaaccaccuuacuugcugauugauauuuguuguaucaggauuuguaacacaguuaugaaaaauggaaaaauggaaaucacaaggcauucauuacaauugcauucaccucagugaguuuuauuuaaagugcuaauuacuaguaaacagcuuacuuguagguaugcucaguaaacuacucuaaaguuacaaaguaaaaaccaacacuuugcuuuacaggcaaggaaacuuaacagagaaacuaagaaaacugugugaucccagagcaagcgcuaccauuguuaugaaguaaauacuaauuauuauaaagauaaaaauaaucaaguuaaaaccagguaagauuuuagaaccaaggcauaaaauucucuuaaaaacugguugacucaccaguugucuccuguucuucuuccaaguuucugcuuuccucuuugaguucauguucugaaaugcuaauuucaacaauauggaauuguaaucacgagggaaaaaugcucuccacaaaaagaaaauacauauacaucuaaaacacaguggauuaaggaguggggaaagggaaagaaccuucuguucucuacaguaucuuaaccaggggaaagaagaaaaacaacaaccaaacuuacagaagucacuugguggguugugugugagauuucuauaaaauucaguccugugagcuuucuuuaaucccguacauaaaccaaaaucagauaauuuuacaugacccuaaaaaaaaauccaguaaaauuagaucauauuaacuuugaaaacaaaaagccuuguuauaaacuccucuauuaaauggcaauuauaauaaaaauucuuagcuugggauuuauacacguaaaauguaaaauuuuaaguaucugaugaugauuuuuaaaaguagaaaauggagggagauaaaaagagagccauauucccuguugucauuuaauucccaaguccucuccuaguaccuuaucauauaauguuguuuagcaauauucuaaauugcaguugcugauuuccauucacaaaaucagcccuacugcucuaaaaaauaaucaacagccuaguaauucaccaguuuauucacaugccuuggcauccaauaaaagguugucuggcuuaauaucccgauggaugaaacccaacugguggaucgcaucuauugccagaacagucucugaaauguagaacuguguuuccucuucugucaaggugucuuucuucauuagcaaugucaucaugucaccuaaauaaaggauagucaaauauauuauuauugaaaaugccucaaagguggaauaccuuguaaaagcuuuccugcuuuuuuuacuuuuuuuuuuuuuuuuuuggagacagagucucacucuguugccuggguuggagugcaguggugugaucauggcucacugcaaccuccgccuccuggguucaaacaguuuucaugccucagccacccaaguagcugagauuacaggugugcaccaccacacccagcuaauuuuuguauuuuuaguagagaugggguuuugccauguuggccaggcuggucucaaacuccugguuucaagcuaucugccugccuuggccucccaaaguacugggauuacaggcaugagccaccaugcccagcuagcuuuccugaguuugcauuuuaugaucuacccaguauauuucuaaccacaucuugggacaaauaaaagugcuauugcauagcagaaguuucaugacuuuuaaugguuuuaaggcagagaccaugugaaaucaaaucacaaaagagcugauaaugaaguaauaucuaccacucaacuucuagaauuaacugcugaggaaaaugucaaacugcaaaaaaaucagaauaagugcaccuggaaacgaaauauauucuuuuagaguuuagugggacauuaucccacuaaaaaaggcaccugcagacauucuuuuauuuucaaggaauuuuaaaaguuuuaacaguuuuaacuguuguaaacacuggugcacuuacaacacagaauugacaacugauuacauuuuuuucauauauuuuuugaggcuuuaaaaaaaauagggagccaggggcagugguucacgccuguauucccaacacucugggaggcugagguggguggaucacuugaggucaggaguuugagaccagccugaccaacauggugaaaccccgucucuacuaaauacaaaaaaaauuagcugggcaugguggugggcaccuguaaucccagcuacucaggaggcugagacaggagaaucgcuugaacccgggaggcagagguuguagugagccaagaucacaccacugcacuccagccuaggcaacagagcgagacuucaucucaaaaaauaaaaauuaaaacaaaacaaaacaaaacccagaauucuuugcccuccauugccauucuuuuccccuugcccucuuugcugagcaaugauuaaaccucuuuccuuuauaaauuacacagucucagguauuuuuuuuuuuuuuuuuugagacguagucucgcuguuuucgcccaggccggacugcaguggcgcuaucucggcucacugcaagcuccgccucccggguucacaccauucuccugccucagccucccaaguagcugggacuacaggcgcccgccacugcgcccagcuaauuuuuuuuauuuuuaguagagacgggguuucaccuuguuagccaggauggucuugaucuccugaccucgugauccauccgccucggccucccaaagugcugggauuacaggcgugagccacugcgcccauccagucucagguauuuuuuguaacaacauaaaauaaacuaacacaacuuauaacaaccuaauuauauacagugaacccagaacgguaauauuuaaaaugugcuaacuuuauaauuccuucaaaacaaucuguuuugugguaaaaaugagcaucaauaugguaguaaauauuuuuaaacugugacuauguaaagccucagagcaaagaauauaaaaguaaaccucaccaauaaaauuauuguugcauauaaagaugugcuuguaucagucugucauugauacaauguuugcuuuuaccuccagggagaaauuccaugauuagauaaagauuccucuuauccugaaaacuguaaaacaucuucaccacccaggcaccaucugcuucuaccaaaauaucucuuucugcucggauaugggccaccuagaugaauauauuuuugaaaaaaauaauuguaaauacaucacacauuuguuaaacucaucucuuacacuuauccauccauaacaguuaaugaaggaaagauggaguuucagaagauuugauacauguaugaauguucguauucucaucaaauauggagaaccucaagaaauaguuuauuuuagcuuauaucuuuaggucugaaaaggugaggucaacagguauauuacgugaagcugaggccucugagguagagcaagaaucagucuaacaacuuuuuaaccagaaucucuacccagccuaggauccuggcuuugucacauaaauuuagggcacuagugugauuuuuaaaguuaaaaguaguaagcagggccgggcacaguggcucacgccuguaaucccagcacuuugggaggccagggcagguggaucacgaggucaggagauugagaccauccuggcuaaaacggugaaaccccgucucuacuaaacauacaaaaaauuagccaggcaugguggcacacaccaguagucccggcuacucaggaggcugaggcaggagaaucgcuugaacccgggaggcggagguugcagugagccgagauugcgucacugcacuccagcuuggugacagaacgagacuccaucucaaaaaaaaaaagaguaagcaaugcccuguaaauugguacagcaaaccuaagcuuggcuaaaaauagcaaacuauuuuuaauuguuaaacaaaggucccagcuugaucauuauuugguguuuuuuaaagaaauaguaacaauuauaguaacuuuauguuauauuauuguuauaauauaaaaccucuaccauaucuauaaauguuagcuaaagcaaauuuguguaacuuuuggggauuuugccacugauuucucggacacauaauuacuagagauacuaucaugugaaaauguuauagacuggaaaauuuuauaaacuggauaauuuaugggguugguauaacuggucaguuugcagaugcuuuugcauuaauauauuuauacacuuuuuccaaagauuaauaagauuugauuuaugcuuuugcuauuuucauugugcaacguuaaaaacucugguccaaagcacaugagaacauacauuuguaaaccuuucuaugauaauaaaauaugaucugcuuaaagugucauauuuggaauuacuccuagugcaguaaauauucugagaucaaagcguaagaguugaggaguaagaacuugucuucuggcaugaaaauacuuuauaauuucuauggaucuguuucauuaagugaaaagugguagcaagagugccuaccuauuaccuuucaugaagcaauuuaaggugguaaggaaaagcccuaaacuuugguguugcaucugguguguaaggaaaacaacuacaacauaaacauggcuugauuauuuuuaaaugguuuaaagccaaauuacaggaucccuuuccaaaacaggauccaaagguuggaaaguaugaccuauaguaaucugguagaacaacagugaggagaucaguugguauuuaauuuugugggggugguuugcauuaaaauaaaugugauaaaaguuaaaauauugauguauuagaauugaguagaaaaaagcuuucuaaaacaaaauccagugguaacaaaugcaaauuaauuuauacagggguaaaaaacaaccccaaaaugcaaaggcaacuagacguuaggcuacggagagauuuccgccccccaccuccccacaggaaagagcagugguccagaggcuccuuaacuucccacaaaauauuguagaccaagggcuguccaguacagauguaacacaagucauguauguaauuuuuaaauuuucuagaagccacauacagaaugaaauuauuuuuaauaauacaguuuauguaaccuaauauauccgaauauuaucaccuuaguauguaaucaauauaaaaaucauugaaauauuuuauuuauuuauuuauuuauuuuugcaccaagccuuauuugcuggauaucccaauuugugcccaguagccacauguggcuggcugguaucuacacuacagcuggaacuaacugcuuccuucuguccuuccuauuauacccuaguaggacuaaucccauuauggcuaaguuagauuccuguugcccucccugucucugaggcuaugcaucuuuacccacguccuuauugccaucauuaucuuucuuuuuucuuccuuuuuguggagaauggggucuugcuauauucccaucauuaucuauaguucucuaauccaacucaguaucucaaccuuccuugccuuccacaccucuucccucuggggaaucauagccugucaucaacaaaauccccuauaacccugucuccugaugguuccuauuaccuucuuaaccuaacugaaacuagggugaaaaaucacccagcuaugccaauggguuucacuuuaaauucaugacugcaaaucucaaugagccuucaacugcauuuccuuagcaggucugcuuucccgcaccugaaaaugaccauuucacaauuucucuccuuaaauauucaaaaagccaucccuccuuuacucgaagccaccccuuguaacugcauuaaggcacaggaaacaugcagagagcccagaauauuuacaagguuacagauuuuagaaauauguaaaaucagcaaauuuccaggagacuaguuuugauuaucugauaugugacagggauucugggagcugagaacuguccuuuauuuucauuguagucagaaaaggagguauuucagaagguauguacugaauguucaugcaucuacaaaauucauagaguaaagcuuuaaucuccaaugaggcuguauuuggagauggacccuuagggaauuaauuaagguuaauuaaugaggucauaaggguggaauuaauguccuuauaagaagagacaccagagaguucucacaggaguguguguccccgcacacaccaaggaaaggccaugugaaaacuuagugagaagguggccaucugcaagccaggaagagaggccucaccagaaaccaaaaccugcccaaacuuucauuuuugacuuguagccuccagaacuaugagaaaauaaguuucuguuguuuaagcuaaccagccuguuguguucuguuauggaagucuaagcagacauacauagauuauaaauuuagaagaaaccuuaaaagaacugagaaacacuaaaacaggcuaccaaaaaauuaauagcuuauguaguaagauguguaaacugcuucuuaaaaauucuaauauaaacacucuuaacacugcgucaguggaugcuccuuuauauuacauguguuaaagaacucauaccugcucuuuuucaagcauaucagacuuucucaauaucuucauugcauagauauggccuguaucuuucuucuggaccaaccgcaccuaaaagauaaaaaacauauauuauaaaacagucacuacuauuuguucaggaaagaaaaguaacuucccuuaaagaaagcaggaauuugccaguguugguauuucaggaauuuuauauauauauaucuauauauuuuuauaucuauauauuuuuauauauguuauauauauauuuauauauauuuuauauauauuaauauauauuuauauauauuuauauauuuacauuuauauauauuuauauuuauauauauuuuuuuauauauacauacaaacacauauauauauuuuuuugagagagcguuucacucauguugcccaggcuggagugcaauggugggaucucagcucacugcaacuucugccuccugggcucaagcgauucuccugccucagccucccaaguagcugggauuacaggugcccaccaccacgcccagcuaauuuuuguauuuuuauagagacgggguuucacuggccaggcuggucucgaacuccugaccucaggcgauccacccgccucggccucccaaaguauugggauuacaggcgugagccaccgcacccagccaggaauuauauuuuaacacauauuuuaaauuaucuuaagauauauauuugcagcaguagugacuuuuaaaaagaagcacaccucuccaaaagcuccucuuccuauaacuuucagagacucaaagucauccaagccaagucugguccuuuugagccguaagaacucuguuucuuugcgagcguguugugaucgacguaacuuuuucu

SEQ ID NO: 15523 - RNA, 603 nt, Homo sapiens
cuuucggccggaaccgccaucuuccaguaauucgccaaaaugacgaacacaaagggaaagaggagaggcacccgauauauguucucuaggccuuuuagaaaacauggaguuguuccuuuggccacauauaugcgaaucuauaagaaaggugauauuguagacaucaagggaauggguacuguucaaaaaggaaugccccacaaguguuaccauggcaaaacuggaagagucuacaauguuacccagcaugcuguuggcauuguuguaaacaaacaaguuaagggcaagauucuugccaagagaauuaaugugcguauugagcacauuaagcacucuaagagccgagauagcuuccugaaacgugugaaggaaaaugaucagaaaaagaaagaagccaaagagaaagguaccuggguucaacuaaagcgccagccuacuccacccagagaagcacacuuugugagaaccaaugggaaggagccugagcugcuggaaccuauucccuaugaauucauggcauaauagguguuaaaaaaaaaaaauaaaggaccucugggcuacaaaaaauaaauaaauaaauaaauaaauaaauaaauaaauaaa

SEQ ID NO: 15524 - RNA, 1022 nt, Homo sapiens
gcaguucagguuaggaggcugaguuuguuuacauugcuuacagauuuagcugcugcuuuacccagcuccagcuccaagauggggaaauccuucaccaacuucaugugcaagaaggauuuucaucuugccuccaaauccaauaucaaaaaaguauggauggcagaacagaaaauaucauaugauaagaagaaacaagaauaauuaaugcagcaauaucauaaauaacaagaaccauaugauaacagauuguuuaugggagaugaacguguaaauaauggccuuaauuucauguaugaagccccaccaggagcuaaaagagaaaacaaagagaaagaagaaacagaaagagagacugaauacaaaugugaauggcagaaaggagccccaugagaaaaauaugucaaagaugacaugaacaucagagagcagcccugugguauugagguuugaaauguguggugcauuaaaugucaccaguggggucaugucaacacagaucaagaacguccuuugcuuggucuuucuggaaucaaugcaaguuugguucccacugauggcucaggaccaucgaugcaccccuuggagcuaauagcgaagaugagaaacaguggguuugcacugaaccgaaauguacuggggagaaccugaccacaaaugauccaucaaaggaguauguugcaagugagggugaagaauauccagaaguugaauguuuaaagucacuagcagcuaaacaaaaacagaaauuuucaggaaauuagaucgacuggagaagaaaaagaaaagaaaagaaaaagauagaaaaaagaaaaaguuucagaagagcagaaguaaacacaaaaaucauaaauccucuuccuccuccuccucccccuccuccucuuucucuacugagacuuuagaaagcaguagugagagugagagugacaauaaagaaaaaaaauaggaagaaaagaaagaaaagcaaguguucagggcauaacaacagugauucugaagugaaggaccauucuaagaagaga

SEQ ID NO: 15525 - RNA, 7129 nt, Homo sapiens
cccucagcaccuuguccugucucuccuagugggugggaggacgcuacucgcuguggucggccaucggacucuccauugcccugcacgugggugaguguguuucugugucuugcagccccugugggagacaguguugcagucuaaggucgggguagggggcuugugucccugaacaucaugcuguccucacaggcugcuggccucucugcagcuggcugggauauuuauuucauguccagaaggaaggucuggguuuuuuugcgugugcaaguuggcccccgucuuugccccucacaacugcaguccuguuucucuccuauccuaggcagagucagaucccugcacucagggccaccucucacuggaggggcuuugucuagguccgaguccucccaugucguaucuucuggcucuccaugcagccuuccuucguugcagaaggagcugugcccacugcccacaggacgcaggguguggccacuucuguugacucugcuuuugugucacagguuuugacaacuucgagcagcugcucucgggggcucacuggauggugagugcugaggcugguucucugccaagugcuggccagaggcgcguguguugguccuggucccccgcuuucucccccacuguccugucccuccccuccccgugcagcugcucagcucccacucauccugcuccuguuucaggaccagcacuuccgcacgacgccccuggagaagaacgcccccgucuugcuggcccugcuggguaucugguacaucaacugcuuugggugugagacacacgccaugcugcccuaugaccaguaccugcaccgcuuugcugcguacuuccagcagguaccagcugccaagccaggccuuggagucagcaagauuuguggggggucugggaggucuaggaaccuggguuucagcuccuccaggagcucuuugccccauugcccuugggccuggccaagguccaucugugcuccuugucucaggaugaaucuuuguaacugagguugguuccauuugagugucaucugaguuugaucaccaugggaggggcaugacuggugaucauggugcccuggcuagggagguccuggcuugacucaggggauguuucucagcuggggucacuucuuucuugcacaucacuaugcaugccuaccauagugucugaggacguaggaucuagcccugguaugaggcccuaggucuguuaguaucuggggaggaaggaucugguacagguaugaggaccugggucuguccaugucugaggaggugggauuuggccauaggguggggcugcaagcuggaaucccuuauagccugcacugccuuuaucccuccagaaaagcaaguguguaucuagucugugguggccucuuuggacuacauggcccucuucucccuugggaucuccagagccccccgagaggcuuagcaggcccucuccuagucacauuaugucccagaaagcuuuuccacaccugucccugcuuuuuuuuuuuugaacagauucucacucuguuucccaggcaggagugcaguggcgcgaucucggcucauugcaaccuccgcuuccugaguucaagcaauuccugugccucagccucccgaguagcugggauugcaggcaugcaccaccuugccuggcuaauuuuuguauuuuuaguggaaacgggguuucacuauguugcccaggcugguuucgaacuccuggccucaagcgauccaccugccuuggccucccaaagugcugggauuacaggcaugagccaccaugcccaacccuauccuugcuuuuguuuaguacaaagccagucccuguccagcagcucuugaguugcucugggcagguacagaaggcuucaccaacaccuggaagcaaauccugugacugaaggagaggccaagguuccccaaaucccagcugccuuggugaggguugccaugaccagggcccagguggguacccaaagccuagcauuuaguuguggugacagcccucaaaggcuguacucuuagccaggcaugguggcugaugccugcaaucccagcaccuugggaggcagaggcuggggggaauugcuugagcccaggaguucaagaccagccugggcaacguagugaggcccggucucuacaaaaaaaacccacaaaaacuaacaguagccaggcaugguggugcggcaccuauagucccagcuacuugggaggcugaggcaagaggcuugcuugagcccaagaggucgaggcuucagugagcaaugauucuaccacuguacuccagccugagugacagagugagacucugucucuuugggaaaaaaagaagcugugcacucuggaccccagccugcucucccuuaagaaaugagcugauuuugugaccgauuuugucuuuagggagguccuugccugaccuccagacccaccuuuuccugggcaugaguccuuccugcacaguggcuuaagcaggaaagguugggaggcuguguccucacugguguggggaggaaggggaucgugccuguggacacgugugcagguccaccucacggugucagggcagggugggucugccuggagcaucugggcaggacuuuggcauggugcaggaaggagcaggauuugcguacagugugugaaggaucaagacuugcaggaagaggguuggguuuuuuuucuuucuuuuccuuucuuuuccuuuuuuuuuuuuuuucuuuuuuuuugaguuggaguuuugcucuuguugcccagucuggagugcaguggcaugaucucggcucaccacaaccuccgccucccggguucaagcgauucuccugccucagccucccaagcagcugggauuacaggcaugcgccaucacaccuggcuaauuuuguauuuuuaguagagacaggguuucuccauguuaaucaggcuggucucaaacuuccaaccucaggugauccgccugccuuggccucccaaagugcuggaauuacaggcuugagccacugcgcucagccucuuucuuucuuuuuaaauguucuuucauuuugccaagaacuggguuucuguuccuuuuccagggcgacauggaguccaaugggaaauacaucaccaaaucuggaacccguguggaccaccagacaggccccauuguguggggggagccagggaccaauggccagcaugcuuuuuaccagcucauccaccaagguaggccccuguggccugggaagggugauguugggggagggaaaggaucuuccagaagagauaucucacuuaggucagugcccuccucuaggccauauggcuagcucccaugggcuggggucaugugggugaccacagugcccuucacaggcaccaagaugauacccugugacuuccucaucccgguccagacccagcaccccauacggaagggucugcaucacaagguaagagcccccaucuggccccaucuggggggucuggcucacauugcacccagaccucugaaaaccuggugcauugguuggcaaucacguuaguuuucuauuccugccguaacaaaugauaacaaacauggaggcuuaaaacaacacucuucuuuugugggguggggaggggggacagagucuugcucugucgcccaggcuggagugcaguggcacgaucuuggcucacugcaaccuuccccucccggccucaagugauucuuaugccucagccucccaaguagcugggacuacuggcacucaccaccauggccagcuaauuuuuguaguuuugguaaaggggggguuucacuauguuggccaggcuggucuugaacucaugaccucaaguaaucuaccugccucggccucccuaagugcugggauuauaggcaugagccaccuuccugggcuaucugaagaguuucugaagcucaaauauccagcaggcccugaugugucucugcuuagagucuugcaggcugaaaucaaggugucaucaggacuguguuucuuucuggagaccuuaggggaaaagccuuugaccugcuugucaggugguuggcagaauucauuucucuaugguuguggaacugaaguccagcuuccuugcugugggcugaaggucguucucagauucucagaggucaccugcauccucuagcuugugggccucuucacugcagaaccagcaauggcagguuaaauccuucucugaagcuuugauucugucuugccacuucuguugcaucucucugacuuguuuaccuuccucuucuacauuuugcuuuuguucccuaagugacagugucaugcuguguugucuaggcuggacuuacaguggcaugaucacaguucacuguauucucaacgucccaggcucaagcagucuuccugccucggccccucaaauagcugagacuuacaggcacuaacaggcacuuacaggcacuuacaggcacuaacagccuggcuaacuguuaaacuuuuuguagaggccagauuucacuauguugccuaggcuggucuccaacuccugggcucaagugauucuccugccucggccucccaaaguuuugggauuacaggcaugagcuaccgugccuggcccucuuuuacuuuuaagggccagugugauuagauuggggcuacuagauaauccaggaaaaucuccccuuuuguuuauuuuauuuauuuauuuuauuuuagagauagcaugucacucuguugcugaggcuggagugcacuggcccaaucauagcucacuacagccuugaacuccugggcucaagcaauccuuuuaucucagccuccugaguagcugggaccacagauguacaacaugccuggcuaaguuuuuuuuuuuuuuuaaagagacagagucuugcucuguugcccaggcuggggugcaguggcacaaucaggcucucugcagccucacccuccugggcucaagcaauccuccuaccucagccuccugaguagcugggaacaggcacacgccaccacacccagcugauuuuuuuauuuuuauuuuuuguagagauggagucucaguauguugcccaagcugcccucgaacuccuucagagaauuuacugugcuuugucucaggugugcagagcagcacaggguuacgguagcacaaucuugggagucagugagcuggauugaauucugauuguuccugucuauaguucugugauccagcacuguggacuuguggaacccaaggcucuacuagaacagggcgaugaugccuuuccuccuuaggaucuuaguauuauuuuuuuuucgagacaccguuucacuuuguugccccggcuggagugcaguagugugaccuugacucacugcaaccucagccuccuggguucaagugauucucgugcuuaagccuccggaguagcuggaauuacaguugcacaccaccacgcccagcuaccuucuuaggaucuuaaaagauagauguugguaaaauugugagcaggaccccuagcaagugguguguaguucuuuuuuuuuuuuugagauggagucuaggucugucgcccaggcuggagugcaguggcgugaucuuggcucacugcacccucugccucccagguucaggugauucuccugccucagccuccugccugaugacaggcaugcgccaccaugcccagcuaaauuuuuuuuugguauuuuuaguagagacggguuucaccauguuggucaggcuggucucgagcuccugaccucgugguccauccgccucggccucccaaagugucgggauuacaggcgugagccaccgcgccuggccacugguguguaguucuuaaagagcaguuaucacuguucccugccuuguggugucaucggaugugucccccucgcuccaacugagcuguacagcgagugacccaggcugggacugaccccugcugagaaguaccaggcggucuugucccucugccugaagcccagacagugcucucaagcauaacugaugucucgcucaucagauccuccuggccaacuucuuggcccagacagaggcccugaugaggggaaaaucgacggaggaggcccgaaaggagcuccaggcugcgggcaagaguccagaggaccuugagaggcugcugccacauaaggucagcacuucugcauuuggcuuuggggugcaugcuggaguuggaggugugaagcuauggcaccaggcaggggcuuggggcgugccuggcuuguccuacagaaugggagggccuguccucacagaccugcacgucucagccucuggggcagggugugcuucccuucaagggguuuagggaucaggacucucuuggagacauuccuugguguuuucugcaggucuuugaaggaaaucgcccaaccaacucuauuguguucaccaagcucacaccauucaugcuuggagccuuggucggugagugaguaggggaaagguccuggcuugggguagguuggaaugggcuuguggagcccugaugugcccugucugucacuucugcagccauguaugagcacaagaucuucguucagggcaucaucugggacaucaacagcuuugaccagugggggugaguugcucacuuaggggagggccgggaauaccuuugugucggcucagggauuucaguagcaacguuagagccuuccucauaccacucuucccuucccuucccuucuuggcagaguggagcugggaaagcagcuggcuaagaaaauagagccugagcuugauggcagugcucaagugaccucucacgacgcuucuaccaaugggcucaucaacuucaucaagcagcagcgcgaggccagaguccaauaaacucgugcucaucugcagccuccucugugacuccccuuucucuucucgucccuccuccccggagccggcacugcauguuccuggacaccacccagagcacccucugguugugggcuuggaccacgagcccuuagcagggaaggcuggucucccccagccuaacccccagccccuccaugucuaugcucccucuguguuagaauuggcugaaguguuuuugugcagcugacuuuucugacccauguucacguuguucacaucccauguagaaaaauaaagaugccacggaggagguuguaggcucagccucu

SEQ ID NO: 15526 - RNA, 7129 nt, Homo sapiens
agaggcugagccuacaaccuccuccguggcaucuuuauuuuucuacaugggaugugaacaacgugaacaugggucagaaaagucagcugcacaaaaacacuucagccaauucuaacacagagggagcauagacauggaggggcuggggguuaggcugggggagaccagccuucccugcuaagggcucgugguccaagcccacaaccagagggugcucugggugguguccaggaacaugcagugccggcuccggggaggagggacgagaagagaaaggggagucacagaggaggcugcagaugagcacgaguuuauuggacucuggccucgcgcugcugcuugaugaaguugaugagcccauugguagaagcgucgugagaggucacuugagcacugccaucaagcucaggcucuauuuucuuagccagcugcuuucccagcuccacucugccaagaagggaagggaagggaagagugguaugaggaaggcucuaacguugcuacugaaaucccugagccgacacaaagguauucccggcccuccccuaagugagcaacucacccccacuggucaaagcuguugaugucccagaugaugcccugaacgaagaucuugugcucauacauggcugcagaagugacagacagggcacaucagggcuccacaagcccauuccaaccuaccccaagccaggaccuuuccccuacucacucaccgaccaaggcuccaagcaugaauggugugagcuuggugaacacaauagaguugguugggcgauuuccuucaaagaccugcagaaaacaccaaggaaugucuccaagagaguccugaucccuaaaccccuugaagggaagcacacccugccccagaggcugagacgugcaggucugugaggacaggcccucccauucuguaggacaagccaggcacgccccaagccccugccuggugccauagcuucacaccuccaacuccagcaugcaccccaaagccaaaugcagaagugcugaccuuauguggcagcagccucucaagguccucuggacucuugcccgcagccuggagcuccuuucgggccuccuccgucgauuuuccccucaucagggccucugucugggccaagaaguuggccaggaggaucugaugagcgagacaucaguuaugcuugagagcacugucugggcuucaggcagagggacaagaccgccugguacuucucagcaggggucagucccagccugggucacucgcuguacagcucaguuggagcgagggggacacauccgaugacaccacaaggcagggaacagugauaacugcucuuuaagaacuacacaccaguggccaggcgcgguggcucacgccuguaaucccgacacuuugggaggccgaggcggauggaccacgaggucaggagcucgagaccagccugaccaacauggugaaacccgucucuacuaaaaauaccaaaaaaaaauuuagcugggcaugguggcgcaugccugucaucaggcaggaggcugaggcaggagaaucaccugaaccugggaggcagagggugcagugagccaagaucacgccacugcacuccagccugggcgacagaccuagacuccaucucaaaaaaaaaaaaagaacuacacaccacuugcuagggguccugcucacaauuuuaccaacaucuaucuuuuaagauccuaagaagguagcugggcgugguggugugcaacuguaauuccagcuacuccggaggcuuaagcacgagaaucacuugaacccaggaggcugagguugcagugagucaaggucacacuacugcacuccagccggggcaacaaagugaaacggugucucgaaaaaaaaauaauacuaagauccuaaggaggaaaggcaucaucgcccuguucuaguagagccuuggguuccacaaguccacagugcuggaucacagaacuauagacaggaacaaucagaauucaauccagcucacugacucccaagauugugcuaccguaacccugugcugcucugcacaccugagacaaagcacaguaaauucucugaaggaguucgagggcagcuugggcaacauacugagacuccaucucuacaaaaaauaaaaauaaaaaaaucagcugggugugguggcgugugccuguucccagcuacucaggaggcugagguaggaggauugcuugagcccaggagggugaggcugcagagagccugauugugccacugcaccccagccugggcaacagagcaagacucugucucuuuaaaaaaaaaaaaaaacuuagccaggcauguuguacaucuguggucccagcuacucaggaggcugagauaaaaggauugcuugagcccaggaguucaaggcuguagugagcuaugauugggccagugcacuccagccucagcaacagagugacaugcuaucucuaaaauaaaauaaauaaauaaaauaaacaaaaggggagauuuuccuggauuaucuaguagccccaaucuaaucacacuggcccuuaaaaguaaaagagggccaggcacgguagcucaugccuguaaucccaaaacuuugggaggccgaggcaggagaaucacuugagcccaggaguuggagaccagccuaggcaacauagugaaaucuggccucuacaaaaaguuuaacaguuagccaggcuguuagugccuguaagugccuguaagugccuguuagugccuguaagucucagcuauuugaggggccgaggcaggaagacugcuugagccugggacguugagaauacagugaacugugaucaugccacuguaaguccagccuagacaacacagcaugacacugucacuuagggaacaaaagcaaaauguagaagaggaagguaaacaagucagagagaugcaacagaaguggcaagacagaaucaaagcuucagagaaggauuuaaccugccauugcugguucugcagugaagaggcccacaagcuagaggaugcaggugaccucugagaaucugagaacgaccuucagcccacagcaaggaagcuggacuucaguuccacaaccauagagaaaugaauucugccaaccaccugacaagcaggucaaaggcuuuuccccuaaggucuccagaaagaaacacaguccugaugacaccuugauuucagccugcaagacucuaagcagagacacaucagggccugcuggauauuugagcuucagaaacucuucagauagcccaggaagguggcucaugccuauaaucccagcacuuagggaggccgaggcagguagauuacuugaggucaugaguucaagaccagccuggccaacauagugaaacccccccuuuaccaaaacuacaaaaauuagcuggccaugguggugagugccaguagucccagcuacuugggaggcugaggcauaagaaucacuugaggccgggaggggaagguugcagugagccaagaucgugccacugcacuccagccugggcgacagagcaagacucuguccccccuccccaccccacaaaagaagaguguuguuuuaagccuccauguuuguuaucauuuguuacggcaggaauagaaaacuaacgugauugccaaccaaugcaccagguuuucagaggucugggugcaaugugagccagaccccccagauggggccagaugggggcucuuaccuugugaugcagacccuuccguauggggugcugggucuggaccgggaugaggaagucacaggguaucaucuuggugccugugaagggcacuguggucacccacaugaccccagcccaugggagcuagccauauggccuagaggagggcacugaccuaagugagauaucucuucuggaagauccuuucccucccccaacaucacccuucccaggccacaggggccuaccuugguggaugagcugguaaaaagcaugcuggccauuggucccuggcuccccccacacaauggggccugucuggugguccacacggguuccagauuuggugauguauuucccauuggacuccaugucgcccuggaaaaggaacagaaacccaguucuuggcaaaaugaaagaacauuuaaaaagaaagaaagaggcugagcgcaguggcucaagccuguaauuccagcacuuugggaggccaaggcaggcggaucaccugagguuggaaguuugagaccagccugauuaacauggagaaacccugucucuacuaaaaauacaaaauuagccaggugugauggcgcaugccuguaaucccagcugcuugggaggcugaggcaggagaaucgcuugaacccgggaggcggagguuguggugagccgagaucaugccacugcacuccagacugggcaacaagagcaaaacuccaacucaaaaaaaaagaaaaaaaaaaaaaaaggaaaagaaaggaaaagaaagaaaaaaaacccaacccucuuccugcaagucuugauccuucacacacuguacgcaaauccugcuccuuccugcaccaugccaaaguccugcccagaugcuccaggcagacccacccugcccugacaccgugagguggaccugcacacguguccacaggcacgauccccuuccuccccacaccagugaggacacagccucccaaccuuuccugcuuaagccacugugcaggaaggacucaugcccaggaaaaggugggucuggaggucaggcaaggaccucccuaaagacaaaaucggucacaaaaucagcucauuucuuaagggagagcaggcugggguccagagugcacagcuucuuuuuuucccaaagagacagagucucacucugucacucaggcuggaguacagugguagaaucauugcucacugaagccucgaccucuugggcucaagcaagccucuugccucagccucccaaguagcugggacuauaggugccgcaccaccaugccuggcuacuguuaguuuuuguggguuuuuuuuguagagaccgggccucacuacguugcccaggcuggucuugaacuccugggcucaagcaauuccccccagccucugccucccaaggugcugggauugcaggcaucagccaccaugccuggcuaagaguacagccuuugagggcugucaccacaacuaaaugcuaggcuuuggguacccaccugggcccuggucauggcaacccucaccaaggcagcugggauuuggggaaccuuggccucuccuucagucacaggauuugcuuccagguguuggugaagccuucuguaccugcccagagcaacucaagagcugcuggacagggacuggcuuuguacuaaacaaaagcaaggauaggguugggcaugguggcucaugccuguaaucccagcacuuugggaggccaaggcagguggaucgcuugaggccaggaguucgaaaccagccugggcaacauagugaaaccccguuuccacuaaaaauacaaaaauuagccaggcaagguggugcaugccugcaaucccagcuacucgggaggcugaggcacaggaauugcuugaacucaggaagcggagguugcaaugagccgagaucgcgccacugcacuccugccugggaaacagagugagaaucuguucaaaaaaaaaaaagcagggacagguguggaaaagcuuucugggacauaaugugacuaggagagggccugcuaagccucucggggggcucuggagaucccaagggagaagagggccauguaguccaaagaggccaccacagacuagauacacacuugcuuuucuggagggauaaaggcagugcaggcuauaagggauuccagcuugcagccccacccuauggccaaaucccaccuccucagacauggacagacccagguccucauaccuguaccagauccuuccuccccagauacuaacagaccuagggccucauaccagggcuagauccuacguccucagacacuaugguaggcaugcauagugaugugcaagaaagaagugaccccagcugagaaacauccccugagucaagccaggaccucccuagccagggcaccaugaucaccagucaugccccucccauggugaucaaacucagaugacacucaaauggaaccaaccucaguuacaaagauucauccugagacaaggagcacagauggaccuuggccaggcccaagggcaauggggcaaagagcuccuggaggagcugaaacccagguuccuagaccucccagaccccccacaaaucuugcugacuccaaggccuggcuuggcagcugguaccugcuggaaguacgcagcaaagcggugcagguacuggucauagggcagcauggcgugugucucacacccaaagcaguugauguaccagauacccagcagggccagcaagacgggggcguucuucuccaggggcgucgugcggaagugcugguccugaaacaggagcaggaugagugggagcugagcagcugcacggggaggggagggacaggacagugggggagaaagcgggggaccaggaccaacacacgcgccucuggccagcacuuggcagagaaccagccucagcacucaccauccagugagcccccgagagcagcugcucgaaguugucaaaaccugugacacaaaagcagagucaacagaaguggccacacccugcguccugugggcagugggcacagcuccuucugcaacgaaggaaggcugcauggagagccagaagauacgacaugggaggacucggaccuagacaaagccccuccagugagagguggcccugagugcagggaucugacucugccuaggauaggagagaaacaggacugcaguugugaggggcaaagacgggggccaacuugcacacgcaaaaaaacccagaccuuccuucuggacaugaaauaaauaucccagccagcugcagagaggccagcagccugugaggacagcaugauguucagggacacaagcccccuaccccgaccuuagacugcaacacugucucccacaggggcugcaagacacagaaacacacucacccacgugcagggcaauggagaguccgauggccgaccacagcgaguagcguccucccacccacuaggagagacaggacaaggugcugaggg

SEQ ID NO: 15527 - RNA, 16002 nt, Homo sapiens
cacuggcagcggcuucugcgcaugcucggaagagcgggcaggguucccacuccgggagcggagacggagaacagguuaugugggagccggcgggggcauuugccggcgacacccgagcgggggccggaaguggggccacagcucgcagcaggagcuccgggcuagaccguggcgccggcagcggccccugggcuggaggaggaugaugaggagcgacggaagcgacgcggggguacgcugcugcgcggcgcccgguuucgugcccgcggccgacugcgcagccuguccgcgagucugaguaagugcggcucggggaccccgagcccgcggggcccgagcgccgguccgcuccuucuaggagggucgcggggagccgccggcuccuccaggcgggcgcgaaacccucccgggaggcuguggggggagccccggggcuagugcggcuuccccugggggucgugcgggggccgagcgccggggguuguggaggaccagcccggggugcagcccugccggccgccccgacuccgcucaccacucaccaggggaagcaaacugaagccaaauaccuguuuuggaaacuaaggugcgcgcauugccagaggcucgccgggugucguuuuguaauuggaaccuaaaacguaucuuaguguucuaugucaauuguauuuccaguaauguguacaaaccuaagaucccuaaaauccaacccuccgcucccccacccucccacacagacaugaaaaguaaaauagaauaauuccagcuacuagguuggagagagggagagccccgaucuaaucacgacaguaacagguuuagaccugugaauaucaugacaggaaguucugggguuauucaggaaacaucaaaaaagcaccccauacaaucgaagucaauuuugcuguagauuuuagucaacauuuaaguaaaaugaauuacuaguauuacuacccaagguaucgaaaccaaaaaaaaguccguccccauuuaacaacucuuauuuauguuuacuaugugauaguaacuggauagaaagagaugaguauauuggcuuuguguguugauauuggauuuuucacugaucucuuuugacgggaggggguucguggaucaauacuuauuuguaugcaugcuuagggaaaucacucgucuuugacuaaaauaucaaauuuuauuuuacuguguaagauuucuugauugccgauuuaguguuaaugucaugauauccuaccuaagacaucagcugcucaauuaaauaaucguuaauagaggcccacuaugcaucaggcacugcugcguacagaaaauguagaguugaauaggacgaggucucugucaucgaggaacucacagccuguguaagcagguuaauuacgcuguaauaguaacuucugccacguaaguuugcacaaacuacagaauguggaauggguggcaggagggaauagggguccaaggaaagcuuucuagaggaucuacuaccugaguuugguuuuaacagagaaagagugcauugcucugauuacuuccuguguucagauacgguaccucuagggaaucauauccauuauuugaucuaggacuaauagggcuucuaguuguccuuacuuucacauacucugcuauaguacauaauuaaguaauuuaaauuuugucucauagaaguagcugcacuuaacacacuauuacauuuuaucucaacaguaguucaauuuaaucuuucauccuccuuuuacauacgaggaaauauauauuuagagaggcuaagugaguuggcaaaagcuaccuaucucuuaacagaccaugacucaaaacacugucuccuuuccauugcaccacacugccucccacugacaguuaacuuggaaugauuaaagcaagccagguaccuacagguagcccuuggcacacugcccucuucuugggcacaucaaagaccucuuggcauguggauaagaggguuuacuaaccaaauugcccugggcuaacaauauaacuuagugauaggugcaggaaacuguuggaucuaacauuuucccaugaucucuucucauaacuuaucucaggggaaucuauuucuguuucucuguuuaauguauuacccagauucugaaaucuuucuaauccuuguuuaguugccccaggaaagucuuaagaccuuuaaauagccuuuuuucguguggacuuaaaagaugcucuaguucuucuaaguaagauauuuuuccucaaaugacagauuuuguaauacauuauuauauuuuauguuucuguuucacauggugugaacuccuacaacaguauauucugcugaaaucccuugcaaagauguaguauuuccaguacagggacuacaugcauuuaugagcuagccugagaaucuagauacuucuaguaaggcuucuaguuguacuuacuuucacauacucaauguuauauaacacugguuuuauacaaaacaaauauucuaaguuucauccaucuaguuuauagguaaaguuuuagaacauugcccauuuauaaauuggaaacuuugugaauuucauuaucagucuaacaucacuacaguuuuaggcuaguggauuuguuuuaaacauuucagauauuuauaaucucagaacaaauugugguuggcuuccauaguaacaauaaucucucauuuuacuucugccagaguugacucuauuugccaagauuuucaagcaugaaaaagcuacuaaguagcugccugguauaauuuuugagcuaucugcucauacagauuuaaauccuaguuaaagaugcugucugaaccauccaguuauuauccagcaucuccauaggcaguuacuguucauuugucccauaggacuauuaauacacacuuuuucauuauugauggcauguggguaaccauuagggaaauagauaauucauucuguggugucuccaacaccuugauagcagcuauuuguguuuccauuucagcugugcagcuggcaugguuucuuaacuucccaaugcuuaacagaagaggagagagauugauauaagaauacugaaucugaguuccacauuacuucacaugugauuggaagcugugauucacccagaguaauuaaugagcccauggggugugggguccucauucucugcugggauguggaugucggcauugacacacgaacucccuuuccacuuuuuacagucuucacuugaaccugcacauuuuuuuuaaauguaugaacaguuuuuauuuuuaaacaagcuguucccaaaauuaucaaucuaggauggacuuaaagaucuuuaaagaaauaauagugccuuuaugacuuaggacuuuuuaauuguauuugaaauuguuuagccuuuugccaaauuguuuuucggaaauucauuguaauucacuauggguaaugcacuuuuuuguauuuuuaaaagaccauuugcugguggcagaauccguaacucgauauacaauaugcaaaacaauguacacuuuuuuuuuuuuuugagacauagucucacugugucacccagguuggagugcaguggcacgaucucagcucccugcaaccucgacuccuggguucaagugauucucaugccucagucucccuaguagcugggauuacaggcacgcgccaccaugcccggcuaauuuuuuguaauuuuuaguagagacgguguuuuaccauguugcccggacuagucucaaacuccugagcucaggcaauccaccugucuuggcuuccuaaagcgcuaggauuacacgcaugagccaccaugccuggcccaauguacacuuuuuaauuaaaaauaauuagaauaacuagaauuuaauuuguagggcaguucugaccuucauuaaaauacaauuuuuauuguaaaauguuaucuaugauacaauagauuugucuaauuuauucuccuacuaaccuuacggcaauaauuacaauguauuuacuccuauacuuuugaguuucaguucuugauauauauaaguuuuuauuuauuuuuaguuuuuggagaaaauauuacuggguaaaaaccuuaaauauauuuauauauguuauaaugcagaaaggauuuaaaaaaauguaauauaucuuucuuaauuugaagaaggcaagucucuggggcauaaggcaauacaguuauaugguuaaauaguauggaaccgugguucucaagcuuuuuggucucagaccguuuacauuuuagaaauguaaagaucccaaagauuuuuuuguauguauguggauuauauagauauuuauuguguuagaaauuaaaacuggaaguuuauaaaguguauaaauuaaaauuggaaaacuggaaguuuauaaaguguauaaauuaaaauuggaaaacuggaaguuuuaauucauuuaaaaauagcaguaguaaguucauuacauacucacauaaauaaaauuuuauauaaaacaauuguaauuacaaaaaauagaggugugggauuauauuuuuguaauuaucuuuaaugucugccucauagaagacaggcagauuauuaggcucuuaaagugaaacaugaagaaagucaggcucacacaaauuuguaguuguaaagggaagaguauuguaguagagaauuguggguacucguugguacgacuccaucacccaacaggaggcacuuccuuaaaggucaguuauauugugccaucugaaaccuacaucagagaaauuguugucucuuguuacaucaaaaucuguugguuuguagugaauuuuuuacucacguuugcuugauuuugugacaccauucauuggucauuuggaauauauugguuuauggaguuaugcagauuuuuccaaauggugacauguuuaauauuaauagauuaccacagugccaucaaaaaggucccuuaagugucuaggagcuauuggcaaccucauucauuuucuaguaaauaucugccaaaccucuaagucugaacaaccauaguuugucaguugucuuuuuaaauaaaaauguuguuaccugaacaaagcagcuaguucagcucacaauucaaauguauuucaauacauagcacaaaaugcuuuaugugcacuuccaguguugucacacauuugucacacaauguguuaaaaagauguguacuuguuaguugagauaaaauaauuuuuacugcuucuucuuugacauucuuaaguaaaacuggauuauucccucauuuaccgugagcucauggugauaaagaauacagugacuccaacacgugaggccacuaccuugauucuuacaaaggcaccagcaauuuuacccaucauugcuuaugcaucauuagugcaagugucaaacagugaaaaaaguaaaugauauuuuaguauuauuaugagcauaauacugaucuuguggaccccauuagagggucuuggggacccucagguuucugaccaccuuuugagaaccacuggcauagaaagaucucagauuuaauagagcccucaaaguucauccaguuuaacagcucuaaauuccucuaugcuauccuugccaaguauuuauuuagauuaugcugaauacuugcaguuucugugaauaaucgugcuaaaugaauaaaaauaagugucacagacagcuguuugauggaaaguaauagagauucuuaauccuggaguuauguuuuguccugcuuuuaaaacauugcauaaguuuccacuugguuucucuaaguaaucaaccuugaugaaauccagagacuacuaaaauuauguugugaaggaaagauacagcuaagguuuugauuuuccuuugcuauauguaaugacaauugucaucuuucuuugauuuuucuuugucugcucuauaauuaaaugaacuuacguuagguauguaguuauuuauauccauaucugucucccgaguaccucaagaguugcuugaacguuacugaguagaucacaagcuacuugagagcaaggacuguauaguauacuaggaugcauuggaaucugaugaccaucucuuacggaagaggcugggaaaucaacuguaggccugcuucagugguccacgcuggguuucacagcuccccugggagccugcagugauauucugaggacucauaccauucguagugggcaugacuucaauauugaucucuuuuucuaaagcaucaguuuauaaaauaguuauuuaaaugaaauauuuuuccuuaaaaauggaaccauucgugauccuauaugaacacaggagaugauuaguagacaucagagaagcauggccaucacucaugcccuuagcugacuuaccauccagcuaacacuguuagccagcaagguggucugagagcuuuacaguucuagacggcucuuauuuuuagucucaaauuguuuauuguauacccgucauggacuuaaauuuagagacaguaaguagggagcacuagaggugacuacaaccagccaauuaggaccauaaauccucaagaugagcaccauauauuaaauugcaucagaugaucaaacuacuuauguaguauagcaggaugucacuaauacugcaaaaccauucuuguaaaaggaaaacaaucauaucuaauuuauacaguacaugauaauaaagauuaguuaugcuuucaguagauuauuuuuugagacacacucacuaauaucaaugugacaccucaaaccacuucauuuagaaagcacaaaaguuguuucuaagguugauuuuuuuuucauucaaauacaagacugguacagguuauaauaaacuguaauacuuaaaucuuagcuacauauccuggguuuuuaaaaaauguauuuguuuacacaucaugcuuuuuuuguguauaauuagcauaaagucugcaaaacguugggaagggagcaggauguguuuaguuuuggauaaguuugaaauaucagugaagcaucagguacgugaggaacagguaaauugagauuguagaugaagaguagacuuguagauugggaauaauucauacacaggugugauaauuggagccaugaaaaggaaugaaaucacugagggaaagaacauaguauccuaaaugaguggagaagaccuuggaaaaugccugcuuuucgggguauagggcagagagaaacagcaauuugaguguagaggagaagccaauagcagaugacacuuugggggucugguguugcaguguggauugagaaaaauccacuagauuuauuuuaaagugaaguuuacauuguaugagagaucauuaugagaagucagucagcaaguucucagauaguaaaugguuaaggaguuacuggcggugguuaaaaccacagauugguggguuuuagaaaugucugacauguaauaccagaucugauaacauagcaaacagaaaauugagaaaugggacugucagguauucauuuaagauguagacauaagguuaaaaauacauacaauaaugauguaaaagaagacuggaagaugagaaguuauugauuaucuacauuucuauauucuacauggaacaggucuaauuggcucuccuacucagcagcccuucuaguugguauaaguuugaguguauuaaaugcauccuuuuuccugauuuuuaugaugccaagauguuaucagcaaauggauuucacaugcagaagaacccaacaaauaauacaucuccucugaagacacguuuuauagguguuuuaccacaugggacauacuugauugcuucacucauucuucaugacuaguagcaguggucuuggggucaauuggacauugauacucacaagacccaguauaccauaguggaccguacugugcaucagccuuucugcuuuuuugaaaacccaacaugucaguguuagguauauuguuccagaugauagcucaggucuaguggaaaaugacacaagggugggagugagcaccacccuggcuuagcugcuucaugcuccacaggaaacagugucuuuuugugacagcaugugaguauagcauccaggacuaagcaaaugacaagccaauuacaggucguauucaauucagaaaagccccuguuuauacuucccacugggcauguuuagcccugcucacuguccucucaguccagauguagcucaucaguaggagccauuuuuacuacacuguugcuuagaaacacagcugauaucccaccuuuaucagguuuccagggaaacagugcaggaagguuaaggagaggucauuuuuuaucugaagagggagaaagguuuuguuaaccguuuacucacacuaauuuauugacaaaaucaauagaaaacauaaugcuggcuguaggauccaugcagucgacuuuauuagaggcaguguuuguuucuauugacugucauaacaucuggguaugaaguuguuuuuacaucucagcagauggugcaugguaauuaugcuuugcugauacuuucagcaaauucaguaaauuaaaaauccuuccugauauuguucacuuguccugguuccuuuaagaucaccuuugagauggaaauauauaucauacagacuagggaacagagauuauuagcaagugggguuagguaaaaauaaggcaauccgugaguggaguucuuacucuaaaccagcaauauaagaauauguuaaggagaaaacacacccauacccacgcacuccgccaccccagagcaauuuuuauuaaccuguucuuaaaaaugacuuccauuugauauuacucaagaugaauggacuuuuauuccgacuuccauagugcaacaacugauugugagauuaugauuguuuaucacaaaacaguuuaguuaaugugacuuuucaggaauguuuuguggaaaacgguaaguuuaucccuuauuauuccuagccaguaauagacccaaacaaauacgcccauuuuucugauguuguuuuaaacauauaugcccacugcucagaauacuuuuuuuaaaauaaauugaauaauucguauauguaauuagauuauuuuaaaaauguuuuagucguaaguauauauaaagugcuguacuagauauuagagaugcaauagugaaaaagagauauacaauuccuagucuuauaaauuuuaauucaguauuugcuaaaauuagauguuagaggcuacuaaaacgaaaauaacuuuucaaaguucauuaguugaaaauuuaacuauguaaauugauauaaauguaaauauaagauucaaauuuuaaaauaugccuuauucguguauuuggagcuauuuuaucugguuuuauauaauuuuuuaaguaagaacuaauuugagcagaacacaguaagaaaguaguagagccagaaauaccagucacaaaagcaaauaaaguuaacaugucuguaacauuuaugaaugaucucauuauuaaucuuacuugauacuaaugaccagccucauagguaagcauuuuaaaaacucauucuacugaaaaggcaauugagacuggaaauaagugauaaauaguuauucagggaggaugugauacuguaauaaaacuugcuaccacuggguggcaguguugauuucugggaaaucagaaaaauguugguuuaugcucaaaaagguucaguucauuugaauaauaauucaaauguaaaagucuauguuuagugaaauaauagaaaaaaaucaaauuuguuaaaucauccaacucauuauuuguauaaucaaucuauaaccucuuuauagcaguuuggucagugggaaagaaggaaauguaguauuuuuaaaaguucaguaaauaagcauaaguagacgaauaguacauaagaaaauuuguaacauaucucaauucuuuugccuuuuuaagacaacauguauaaaccuuuugauaacaaaaaauucucuuuuaauaguuuuuacuuucuuuauaucaguuaacauauuuuaguaaucuuuuuaagaauuguucuccagugagucauuuuacuuuauuuaucucuguuucucagaggauuucuguguauuuguuucacacugaacccucaaguauuuauugccuuaucaauacauuuuagcaaucuauugaccccaggacgugaaacuucauuaaagaguauauaaaagauacugccgaucucaugacacuagcaauaugauauuuauuuuuaauuacauaugaaagauaaaucauuaauaauuuucuuaaaacuaauacaauauuagaaucuaguguuuaagcaaauuauuuaaguuuaguauuaaaacuucgagguagaggggggauacuuuuauucuuucuuucccuaguuguuuuuuuuuguuuuauuuuguuuugcccaacuccuuacccuaguuucuuuaguuuuugcuaccguaugugaaaaaaauugacaaaguauauuagauuggucuugcuauguuggaauuucugaacugccuuuucaguacaguuugcccuggacauacguaaccuaacagcagauguaccacaaucucuagaaucaugcuuguuugccucccagcucuucuacauugagaagcagaugauagccagucuacuuaugccccugagcuucuguuuucucauuaaaaaaaaaaaaugacacuaucgcaucaacuuuuuuugggucaaauccgugagaacacguauaugaagaauaagcacuuguuaaaaaugaguuaauuugaagaauauuaguguuuccuaaauaugacaguggagggauaugguagaaaggaaacuguugagaacagaaaggacaagggaaauuauagcagcuacuuuuguggauggacuguaccuauuaccauauuuaacaauuacauguggccuaguaccauaguuuauuauauuguggauuuuuaaaagaauagauagacguugaauuauugauauucucccucucucucucuaggauacuuacagagagcuacaauggaaaaguccuggaugcuguggaacuuuguugaaagauggcuaauagccuuggcuucauggucuugggcucucugccguauuucucuuuuaccuuuaauagugacuuuucaucuguauggaggcauuaucuuacuuuuguuaauauucauaucaauagcagguauucuguauaaauuccaggauguauugcuuuauuuuccagaacagccauccucuucacgucuuuauguucccaugcccacuggcauuccacaugaaaacauuuucaucagaaccaaagauggaauacgucugaaucuuauuuugauacgauacacuggagacaauucacccuauuccccaacuauaauuuauuuucaugggaaugcaggcaacauaggucacagguugccaaaugcauuacuuauguugguuaaccucaaaguuaaccuuuugcugguugauuaucgaggauauggaaaaagugaaggagaagcaagugaagaaggacucuacuuagauucugaagcuguguuagacuacgugaugacuagaccugaccuugauaaaacaaaaauuuuucuuuuuggccguuccuuggguggagcaguggcuauucauuuggcuucugaaaauucacauaggauuucagccauuaugguggagaacacauuuuuaagcauaccacauauggccagcacuuuauuuucauucuuuccgaugcguuaccuuccuuuauggugcuacaaaaauaaauuuuuguccuacagaaaaaucucucaguguagaaugccuucacuuuucaucucuggacucucagaucaauuaauuccaccaguaaugaugaaacaacuuuaugaacucuccccaucucggacuaagagauuagccauuuuuccagaugggacucacaaugacacauggcagugccaaggcuauuucacugcacuugaacaguucaucaaagaagucguaaagagccauucuccugaagaaauggcaaaaacuucaucuaauguaacaauuauauaauguuucccuuuuugauuauugcauuguauuuuaauuugugcagaaugauaaagaauguuccuuuuagaaguguguuaugucuguaccugucugaagagugacauuaaacuuugaaaggacuucacugcuccuuuacgauauuccaaauaguuuuuuacauuggaaaaacuaauucuugggauucuuucauacauuuucaucaaaacuuucagugugauuauguauucauaucuucaguuuaauaugucaguauaauagauauuguucaaaaguuucuuguugcuaaagugguguaaucuguuacacagaugaauagcuagauguggaaagagauauguaaacaagaaaccuuuggguauuguuucuuaaguaaauauugggacaaucaugguaagcaaacuuaguucuguaacugcauuuuucaccuuaaaaguuaaaugaaaugcaugaugguauuuuauuccuugaauuaugcaaugcaacauuuuacauguaaauagcacuggucauauacugauguauaugguuaucuggguuauaucuauuuuuauguaaacucuauuuuguuuuuggcaagaagugaaauugagacuuaugugcagguugccauugaauuuugcucuggugaaugcugagauccagcuuuuucuuacaaauaaaugggacccuguuuuccaauacaaauguaccguguuuuuguuagguacagucuggaucauggcauguagaaauagaaauuuagaauuuuacugcagcuuugaugugcauauuugaacuuuuuaacauuuguaacuuugguggcaaagagaauuuuagcuucuaucgauuuuguaagucuucagcugaaccacuaauagcagucauagugaagauuagcacuacuuagaauuaaauuaggaagucuuuuaucauugcaggauuguacauacuacuuuauaaaaauucucaccuuugauuuuaaaucccaguaccuaguuauaucuaaccuaucaaaggcaagauaucauuuauuggacuucuugaaaauaaaaguuacaaaauccaacaacaacaacaacaaaacaauguucuugguuuuaauguuccaguugcugugaaauagaacuccuacaaucaaaagacaguuuuaggaagucuuauuuauugauuuuaaaaguuuuacauguaggagugugggaaugaaggaauucuggagcuuuuugacacaaaaccuauuaccacauuuagcaguuaaauggcuauaggugggaaguaggauuuagauguauagaaaaguaagaaaaucuuacuuagaaaaaagccccuugaaacuugcaggauuuacuuaauaaaaauacacgcuaugagucauaauugugccaaguuguuucaugcaguccucaaaaauuagauguaauugagcuuuguguaauauuaugucagcuuuaacauauaauauuuugaauauuuuagcuauauuuaguggcuuucugcaagcaacuagaacagagaaguaaugggucaauaaucuugaccuuaauuuaaaacuuucaauggagauagggcuagaaauacuuuugccaaauagcauucuuauucacuuuaugccgguauuuagaaaaaauaaauuauagcaaguaugauuucuaagaauguuuuucuauaaauuacuaauuguaaaaagucuugcuuuuuaaaacaaguugguaaugcauaucauggaaggcauauuuuguauguauaaauucaccacaauuaaagauuauucuugucaguccuugcuauguagaaugacuauucuaaauauuaauguauuaaaaagaaaauacaacaaaauguauauuuagacacgagcuuacauggcauaccuuauauuuguaucauucuuuaaaguuuacaaaaaaaaaccuuauguuuuuauguaaucagucauuacacuagggagaaauuuaucagcuuuaguucuaaauaugcucaugagguauaaaagcuauuucuucaucaguauuuugcuuuuaugcugcuuuuucuuuuugauacuccagguuuauaaacuaucuuuuaaaauuuuaagccaggacuucaaaaauuguagaguacuuguuuggcguucccuaccuucauucucuuaggguuaaggagccuuucuuucugcagcuaagggcagaggcugugccuagggcuauaccaccacuagcaucuguauuugagacuguuuccuuagauggguaagagguggaaaacaaacuuaguaucagggguccaugaagcccauggcaucauuuuugaaaauauuucuaguuuuguagccaaagcaauugguuuuaguaaaaugagacuucuucaggagucacuccuuuacuguggacccauugcuuagugggaauggaaguauauguaucuaucuuguguauuaacuucugacuuauuuauacaagagcagcuauaggaguuuacaaaagaacuuuaaguuauuaaguuacuauaaauuuggggauccuagagugaucuuaaauauggcaagauacagcucauuuagaauaaaaucucacauccauuauuuuaaagggaaugauuggggggaaaaacuggugaaaaagaaauauaaaaaggacccuaaaaagaauucugcaaaauaagagaagaaauaauuugugacagguaauagaauacuaguaggauagaaacaacuagaaaggaaagugugacacaguuuuuaaauuuagauguagaaaauaaugaauuaaugagauuggugaaaggaaaucaugcaaaacauuugaaugcaaagcauuucuaacaaaaagugacuggagcacuugccauugcaacaacccuguuuuugcaauuagguuuuugacuguuaaaauggauauuuucauaaaaaugguguucugaauuuugcuacagggcugcuuaaauuuaugauuaccuguagacacuugauauuuacauagauuacagcuuugguaauaugucacuggaguaauuacgcuguaauaccuguugagaauucauaccaucugaugcuuauauauuaauuucuuauguuuguaaguuuggcuuugugggaauagguguggagaaauuaaagagugaaggccauauuucauuuuuuauaaauuaucuuucaagcucagauagcuuaagagcaguuuauauuaaggagacccuuuucuccuugaggauagggauagguaagguaaacuuguaaaaaggaugucacagaagucacuuuuuaauuaagucaugauugagauacugaacucuuccacucauucuucuuucccauuuuccuauuauguuugauaauuauauguauuuuuaaaaacugugagaggaaaaauuagucauaacccuuuuggguuauccacuuaaauuuagguauuuucauauuacucagguaaagauggaaaugacagagcacagacauuuauuuuuuaaauugauaggguagaaaaugaaauguacuucuguuuauucuuaauacuauauauauauauacacacauaguuuuagcaaauuggaaauaauauauucauuuguauggcaagauaaaugcagucaucuuaauacuagucuauacauuuuugccaaauggcgcaaauauaccuccauuuauauuuuguaucuuaaaauguaguuuaaaaauaggaccauguaugagacacuuuuuuacaaaaagugccguauauacauauguaacaggugaguguguguuuaacauaauuuauaauuauuucugucaguacagcguauauggaaaauucaaguuguuuuuaacauauucaaguauguucaguauaaaauaaguuaaucccauuucauaauguaaaucauauuuuuguuauuugccauauuuuauuugaagugauaaaauuuuauaacucaaauuugaaugucauaguacauugugugcuaaccauggcaagcaaacauuuacauuuguuuuuuacaauaaauuucuuuuaaaauauacuuucuauuuuucuguacugacauaugcaauaaauugguacauuaaaaauuugauuaaugucuucagauaguuuguauucagucuuuuuuuaaaaauuguuaaucuagaauuuuaugguaggacauuaaaauuucuucaaugguuacguaaaauuccugaauuugcacugaaau

SEQ ID NO: 15528 - RNA, 4567 nt, Homo sapiens
gugcgcgauguguuacucacugugcggcggggaccgcgacgagcccgggucgccguuggcagcagcagcagcaacaccagcagcagcagcagccccggcggcggcgcggaccccgagcgcccgggcgcaccccggcuucccggagcgcgacgcggcggcagcagccccggugcggccgcgcgcgccuuaggcucggccccgcggcucggggaccccgacucccggcccagcgagcgcgucccccggcgccgcccgagagcccgaggaggcagcggccgcaggcagccggggaggggggcggccaccgcccgcgccgggcauccucaggagccccagagcgcggagggcgcggcgccgccgagcggugcuggcccccgcgggccuccccggaccuuccccaccgccugggcccgagggacgcgugaucgggcgggcggccgggcgcaagggugggagggagccgcccccgcccgcgcccccuccgccccucgccccaaccccugggcgccgggcccgggccgcgcggccugaagcgcccgcgauggcgagcccgccgcggcacgggccgcccgggccggcgagcggagacggccccaaccucaacaacaacaacaacaacaacaaccacagcgugcgcaagugcggcuaccugcgcaagcagaagcauggccacaagcgcuucuucgugcugcgcggacccggcgcgggcggcgacgaggcgacggcgggcggggggucggcgccgcaaccgccgcggcucgaguacuacgagagcgagaaaaaguggcggagcaaggcaggcgcgccgaaacgggugaucgcucucgacugcugccugaacaucaacaagcgcgccgacgccaagcacaaguaccugaucgcccucuacaccaaggacgaguacuucgccguggccgccgagaacgagcaggagcaggagggcugguaccgcgcgcucaccgaccuggucagcgagggccgcgcggccgccggagacgcgccccccgccgccgcgcccgccgcguccugcagcgccucccugcccggcgcccugggcggcucugccggcgccgccggggccgaggacagcuacgggcugguggcucccgccacggccgccuaccgugagguguggcaggugaaccugaagcccaagggucugggccagagcaagaaccugacggggguguaccgucugugccugucugcgcgcaccaucggcuucgugaagcucaacugcgagcagccgucggugacgcugcagcucaugaacauccgccgcugcggccacucggacagcuucuucuucaucgaggugggccgcucggccgucacaggccccggcgagcuguggaugcaggcggacgacucggugguggcgcagaacauccacgagaccauccuggaggccaugaaggcgcucaaggagcucuucgaguuccggccgcgcaguaagagccaaucgucggggucgucggccacgcaccccaucagcguccccggcgcgcgccgccaccaccaccuggucaaccugccccccagccagacgggccuggugcgccgcucgcgcaccgacagccuggccgccaccccgccggcggccaagugcagcucgugccgggugcgcaccgccagcgagggcgacggcggcgcggcggcgggagcggcggccgcgggcgccaggccggugucgguggcugggagcccccugagccccgggccggugcgcgcgccccugagccgcucgcacacccugagcggcggcugcggcggccgcgggagcaagguggcgcugcugccggcagggggcgcgcugcaacacagccgcuccauguccaugcccguggcgcacucgccgcccgccgccaccagccccggcucccugucguccagcagcggccacggcucgggcuccuacccgccgccgcccggcccgcacccgccucugccgcauccgcugcaccacggccccggccagcggcccuccagcggcagcgccuccgccucgggcucccccagcgaccccggcuucaugucccuggacgaguacggcuccagcccaggcgaccugcgcgccuucugcagccaccgaagcaacacgcccgaguccaucgcggagacgcccccggcccgagacggcggcggcggcggugaguucuacggguacaugaccauggacaggccccugagccacuguggccgcuccuaccgccgggucucgggggacgcggcccaggaccuggaccgagggcugcgcaagaggaccuacucccugaccacgccagcccggcagcggccggugccccagcccuccucugccucgcuggaugaauacacccugaugcgggccaccuucucgggcagcgcgggccgccucugcccguccugccccgcguccucucccaagguggccuaccaccccuacccagaggacuacggagacaucgagaucggcucccacaggagcuccagcagcaaccugggggcagacgacggcuacaugcccaugacgcccggcgcggcccucgcgggcagugggagcggcagcugcaggagcgacgacuacaugcccaugagccccgccagcguguccgcccccaagcagaucuugcagcccagggccgccgccgccgccgccgccgccgugccuucugcggggccugcggggccagcacccaccucugcggcgggcaggacauucccggcgagcgggggcggcuacaaggccagcucgcccgccgagagcucccccgaggacaguggguacaugcgcauguggugcgguuccaagcuguccauggagcaugcagauggcaagcugcugcccaacggggacuaccucaacgugucccccagcgacgcggucaccacgggcaccccgcccgacuucuucuccgcagcccugcaccccggcggggagccgcucaggggcguucccggcugcugcuacagcuccuugccccgcuccuacaaggcccccuacaccuguggcggggacagcgaccaguacgugcucaugagcucccccguggggcgcauccuggaggaggagcgucuggagccucaggccacgccagggcccagccaggcggccagcgccuucggggccggccccacgcagcccccucacccuguagugccuucgcccgugcggccuagcggcggccgcccggagggcuucuugggccagcgcggccgggcggugaggcccacgcgccugucccuggaggggcugcccagccugcccagcaugcacgaguacccacugccaccggagcccaagagccccggcgaguacaucaacaucgacuuuggcgagcccggggcccgccugucgccgcccgcgccuccccugcuggcgucggcggccucguccuccucgcucuuguccgccagcagcccggccucgucgcugggcucaggcaccccgggcaccagcagcgacagccggcagcggucuccgcucuccgacuacaugaaccucgacuucagcucccccaagucuccuaagccgggcgccccgagcggccaccccgugggcuccuuggacggccuccugucccccgaggccuccuccccguauccgccguugcccccgcguccguccgcguccccgucgucgucucugcagccgccgccaccgccgccggccccgggggagcuguaccgccugccccccgccucggccguugccaccgcccagggcccgggcgccgccucaucguuguccucggacaccggggacaauggugacuacaccgagauggcuuuugguguggccgccaccccgccgcaaccuaucgcggcccccccgaagccagaagcugcccgcguggccagcccgacgucgggcgugaagaggcugagccucauggagcaggugucgggagucgaggccuuccugcaggccagccagcccccggacccccaccgcggcgccaaggucauccgcgcagacccgcaggggggccgccgccgccacaguuccgagaccuucuccuccaccacgacggucacccccguguccccguccuucgcccacaaccccaagcgccacaacucggccuccguggaaaaugucucucucaggaaaagcagcgagggcggcgugggugucggcccuggagggggcgacgagccgcccaccuccccacgacaguugcagccggcgcccccuuuggcaccgcagggccggccguggaccccgggucagcccgggggcuuggucgguuguccugggagcgguggaucgcccaugcgcagagagaccucugccggcuuccagaauggucucaacuacaucgccaucgacgugagggaggagcccgggcugccaccccagccgcagccgccgccgccgccgcuuccucagccgggagacaagagcuccuggggccggacccgaagccucgggggucucaucagcgcugugggcgucggcagcaccggcggcgggugcggggggccgggucccggugcccugcccccugccaacaccuacgccagcauugacuucuugucccaccacuugaaggaggccaccaucgugaaaggugaggaggcccuu

SEQ ID NO: 15529 - RNA, 509 nt, Homo sapiens
cugcacugcagagggcuggcucggacaucuguggauuucagucaacagaggagagauuggaaggagcauguuucuuucagaguagauaguggauucacugaauccccccgccacuaguaaaucucuucuaguaagccauuugcauccuuuuuuguugguuuuuaauccuugcggaguucucagcgaugcuacgagcaaugugcuugcacuuaaggugauggacuguaaaugccugaaaaaggaagaagcaguugucaaagcaaauuaauuauuaauguuuauaguuuuccugucuuaaggguuuucagaaucucaguuguucaguguuugaagcuguaaugucuccaacuguaauuacucagugaaugggaggcagugugauugucacccacaagcauccccaccaggaauggaugagucgugacccuuuggagaggcaaguggagcuuuuaccuugagagccauucguccugccagggucaggcagugggaggaggcaggaaaagggc

SEQ ID NO: 15530 - RNA, 20088 nt, Homo sapiens
uuacuuucuuggcaauguugacauuugaccuugauucagagcuccuugacaggagcucuggcaugcccuggugguaguccaaaaacaggucucagagaagcugugugucugagaccagcauuucugugugaugcauuccucucaguaaaacaccccuggucuuugagcaccaagagucuaagucucuguauguuuugauccugagaugagcuucuaaagccaacggggaggugcuaaaccuuagagucuaagcaauggggcacagcauuucccacuuaacaugucauuggaccagaaaguccugaaaugucccaggacuuuacauuuccagauuuuuaugucuuccuguuaguugacacaucgaagcucagcaugaagggaccuucccaggcauguacuugaagcugcugcuuuugcaucaagucugccucuacuucccucucguagagaggcugccccuuugucccugucucugagcaagcagguuuccacgguuacugaacuuagugguuuccacgacuucucaggacuuacagguuccuucucagcucuucccuuuagggagguccgaaagcuaaauuuuagaaacagcaaaugacacaaaagccuucguuuugagcagaaaagguggcaguuuuccagcuuucauccgauaguagggcacaauuuucuaaguacuuucuagcuuucugcagacaagacucacgaaauaaauacugauugcuaauugcucugacgaaaagaccgcuggauugagagcaaggagaacugcauuuucguucugucuuggacacaacuaacccuggccuuaguuucuucauaugcaauauggagaauuuggccaugugaauuuuaaggaaucacacagcucuuuaagccugcaauggggcaggacccuugaaucccucagcccagagacagucugaaaaagacaaaacccuucccuccaggcuguauuucuaggucucgugucuagcaaacagaugguggcagauguauaaggccaauuucagucacuguuguuuaacugaaccuuuuaauucaucugcauuugggugaauaaaauagaaaauugcacacaccacacauacacacacacacagacagacacacacacaaguccauggaaaaucaaaugacucauucagcccuauucccccuucugauccacguucaugcaaaugucccaguauaacuagguguaauuauugacaccauuuauagucauuuaucagcauuguuaacacucuguucauuuugugacuugaauguaauuauucacuguugacguuuaauuuuuuuuuaaacaaagcauuaucccaccaucaaggguucccuucauugagagggucuuagucagaacacugugcuguuuuaauguguuucuggugcagucccaaggcugagcugaaucagccuggcuugggaggcauccuguccuugggaggguccucuggaggucacuucagcggcaguggaugcugacagccuuggaccuuggacaucugagccaagagggcagaccaaaaagacaaguuucccgcaggaggcccauguggacauucagccuuaaguucauuaaagcaugcauuauuugucuuaguuacucaacucacuaagugcauuucuuauacuaaagauuauuaguagcuucaaacuguugcauuccagaaggaguagcucuuggauuucaccagcauuuuuucugaagcauuuauugugcuuguggaaauacguaugcauuguugaaagauuggaaaacacucaaaugcccaaagaagaaaaguugccuguaaccccagccccuccaggagagccacuguuagagcuuugccuuccuauuuuccccuucuacaagacagacaguuaaauaacucguguuggaucuauuuuuuaaacaauauuuuaggggcaggucucgcuauguugcccaggccguagagcaguggcccacaggcaggccgagcauagcucccugcagccuugaacuccuggccucaggcaguccugccucagccuccccaguagccaggacuacaggccuguguccugcucuaauuuuuuuuuugagacggaguuucacucuuguugcccaggcuggagugcauugacacaaucucggcucacugcaaccuccgccucccagguucaagugauucuccugccucagccucccgaguagcugggauuacaggcaugugccaccacacccagcuaauuuuuuguauuuuuaguagagacagcguuucuccauguuggucaggcuggacuugaacuccugaccucaggugauccacccgccucggccucccaaagugcugggauuauagacaugagccaccgcccccagccauccugcucuauuuuugaauugaauguuuuaauacugagacaggcuuauaaaaccaacggggagguacuaaaccucagagucuaagcaaugggcacaauguuuucuacuuaauauguaauuggaccagaaagacugagugaggauguugaguguagguaacggggcagugcauggagggcggccucugcccugcaccccggcugugcugagugucucugcuccacuuccaggugugcugugugugaggcgccugccauggugauggccgugcacagccagaccauucagaucccaccgugccccagcgggugguccucgcuguggaucggcuacucuuuugugaugguaagugucuggggagacgccauauuucccgggaagagccccacucacgccccauagucgccucugucuggugccuccacaccuuggaguucucugcaucucgcugcuuaagccccuccuucuuccuccaaccauccccuuccaaagcaugccucaaagccuggccugcccugccuggugacagcaggggucuccagcaccagccagaacccuccccugcucacagccaagguagcugggaugagcaucuuccuggaaaugcaggcccaggccucugcuucccuguggcugcuccacucaggugcucuacgggucuguuccagcaccagcaauaugaacagcuucucuauacaaccagcuucuccauacaaccagcuucccuauaugagcagcuucuucauaugaccagcuucuccauaugacuagcuucucuguaugaccagcuuguucauaugaccaguuucucuauaugaccagcuuccaucuuugagcagcuucucuauaugaccagcuucuccauaugacuagcuucucuguaugaccagcuucuccauaugacuagcuucucuguaugaccagcuucuccauaugacuagcuucucuguaugaccagcuucucucuaugagcagcuucuguauaugaccgguuucucuauaugagcagcuucuccaugugaccaacuucucuauaugaccagccucuuuacauggaguggaggccucuuucagggaaaggaggaagagagccuccacguggggaguacacauucuacuacaacaugcacgagcuugaaagcagaagcuugaguuagggagagaacacccgagggcuggccguggccuccacgaaggcccuccuggggcagugccgccugggacccuucccagagggcaaggacugcucuccuagccccagggcuucccuuucccacaaaagccaacugaaacagaaaacaaggccccuguuugauacacucauuguagcuuauuuuauucuauuaccccaguuggcaguauugauugaauauauacaagccgugaacuuguaagaucagaguuaucccggaauuugccaauucccaguaaaugacccuacacauacaucugcaccaucauuggaaguccuagucccaucuucacacugucaggaaugggcaaguuguacauuugacccacagaugaacauuauuuauuaucugauugacaggcuucauagcuauuuucuucuguaaauuauuccaauuguagaaaaaauuggcgggaaagcauuuuuuuaauguuugagugaggacgcugaggguagauaacaagguaacucacggaugguguggcgucugcccugcgccccagccguguggagggucucuguuccaccuuccagacgugcugugugcgaggcgcccaccauugccauuuccuucuacugguuuuuucuugugcuuuucuacacauuuuuccaaguguagaaaaaguuggcaggaaagcaauuuuuaaaauguucgugcacguguacaaguuugauuguaugauuugcuggguugauuguacugcagcuacacucuucauguugcaaccaccagauuaacagguuguugcaauaauucgaagugcugcauuguaacuacuuuaucgagagagccagaaagguugaaaaugcuguauagagaaaucaggacacuaacaaugauguaagcuugccauguucauuaaaagguagauuggauucgccacuccauaaucauaagaaauacugaguggaaucucugugugucagagaaagcccacaguugcauugaggacccacaggaaagcuguugucaccaccaacccuuguccgggugucaaaaggccugaaacagugauugcccauaauuugucuaaaucaggagcaaacgaaaauagugacguucuagagaacagugucuuccagcaccuccucugaguucucaggacgguggcucugaucuggaggucuggagaccccguccuugccucugcuccgccuugaagcuaugugauccuggucagauccgagaauguccucagcugggaaucaguggaguuagccuuguccucaaaggucccuugugucuccaaaauucuagaguucacauuuccuauaucugaaauaauagucacggggcucuguuguaaugucuuagucaaguuuguaugucauucauuuuaaggucuugauuucugaguacaggaagguccuacuuaaaccugcuagaccaaaaugcaauuugauauaguaguagcuauuuuuuucucuuucucuuguuuuucucucuuuuuaaagaaaaaaaauugaaugauuauucuuuaccuuauuauaagauaaauagcaucuaauauagcaaauacaggaaugcauuuguaaagucugauuccacaucaguuguuuacaacauuauuugaacauuuuggcuauugucucaugacccauguuagaauggguuggaguguuucaaaucuaauacacagugagcucuucuuuaaacucuaaugaagcugggcuggucaccuauuugggaagcagccauuagacgaucccuggggccaugcugagcaccauggggccccagccaugcaggcacuggcuugcgggccagcccgauaauuugggcacagaguguguccuguggugaccacaugaggcugcaguguguggcuuuccagagggaacacccuggcgccuuccugggaaggaucgaucucuuuccugguguuuggggagggaaccucugacucacggcucgcaucuguucugcagcacaccagcgcuggugcagaaggcucuggccaagcccuggcgucccccggcuccugccuggaggaguuuagaagugcgccauucaucgagugucacggccgugggaccugcaauuacuacgcaaacgcuuacagcuuuuggcucgccaccauagagaggagcgagauguucaaguaagugggagcacugcuuuuuugcaggcugcuggccccuuugugacuuuauuuuuuaaucauccgcgauccguaacaccuuccaaugcaaagucucaaagaugguuagcaaugaauauuugaugcuguucgacaugggcagaugaccgagacgauuuucaaaggcagaccuucagucacagguuuaauuuuuucauuuaccgaagaaccaugaaagaaaaaggucauuuuccauuuuuucuaggugaguguacuaaaauguaauuaaagcaacugaaaucuccaaacagagcauguuugaaauacaguauauuuaacaaucccggggagaagaagugagcagcguucauuuucaugccauucauaacacugaucguaauguacacuuuguguaaguucugagugacuucacaagguauuuuuuuagaccugugcaaauaaaaauuaauuucagcacaaauucagcugaaacugagagggaagacccuuccuuccuuuuccauuaccaaaaucucaccuuuaaaaugacuggcccaaguggcuacuaaccuugcuggaguugacugggagccgggccgguccccgaaggccaggaacgcauaaugaacccucuaucccgagccccagcugcagccccgcuggagccaaugcaggaggcugacggagcuggcacagcugcuuacuguucauuuccaaaacaagcgcuucucaccccuggagaugagccuuuccaucuucaccuuuuuggagagaauuauauggaacccugcuaugauccugucucuuuccagcuuagauaguaagaggcagaacaacauacacgcuucucuaauucguuacucauccaaaaagugccgcgugccuaacuggugguuuauuggagccuuucaaggaacuggaaacuugacauccaugcugcagauagaguuuaaccauucacuaccaaaaugagcgcacuuuguucaugccucagcccuugcgguguccucuuauaagguugauagguaaugauggguuuuuuuuuuuuaaccagcagccugauacaauaaacuaaaauguuuucccaaagcaaauuagguaagaucccauuaauuuaaauaauaaacuugaggguacuagaauuugcaccaaaaguuaauaaaauaagcagccucaauuuuaggaugaggcacucucauaaauggcuauuuuaauuuaguuuaauuaauuuauuuauuuuaauagaauuuucucaguaacaauuuuaguucagauuuuaccuuuucaacaaucaaaauaauguagaguuucuaagcuugagaaacacuugggacauugaaugucuuucccucuuuuuggucucaaagcagaccaucugcauagaaauccuucaaaaguuauaaaaguauuucgaggucuagggaauuacuccagauuuauuacucaucacaucauuccacaaauauuuaaugaauacuuacuguguguguaaaguguugcagagaagaauaauaucuucuucuuacccuggaggaguuuaugaucuaguggaggagaauggaaaaaaagugaaauuguaguacgaggaggcaggguggcacagaggggaauggccaaggcuucggagccagacugauguggcgggacuucagcugugcccuauggggcugugggcacuggggcaggugccagggccugggugugcagcugguaaccugcaguguucugugugcgugggaccgugugugcacugcacccagcaccugccugcucacugggugguaccagguugaggccugaugccaggggcugggcugaucccuuagagauuuccgagcagggcaggagugccauguuucugacgugcugugagaugauggccaauggucugucucugugucguguuuuaggaagccuacgccguccaccuugaaggcaggggagcugcgcacgcacgucagccgcugccaagucuguaugagaagaacauaaugaagccugacucagcuaaugucacaacauggugcuacuucuucuucuuuuuguuaacagcaacgaacccuagaaauauauccuguguaccucacuguccaauaugaaaaccguaaagugccuuauaggaauuugcguaacuaacacacccugcuucauugaccucuacuugcugaaggagaaaaagacagcgauaagcuuucaauaguggcauaccaaauggcacuuuugaugaaauaaaauaucaauauuuucugcaauccaaugcacugaugugugaagugagaacuccaucagaaaaccaaagggugcuaggaggugugggugccuuccauacuguuugcccauuuucauucuuguauuauaauuaauuuucuacccccagagauaaauguuuguuuauaucacugucuagcuguuucaaaauuuaggucccuuggucuguacaaauaauagcaauguaaaaaugguuuuuugaaccuccaaauggaauuacagacucaguagccauaucuuccaaccccccaguauaaauuucugucuuucugcuaugugugguacuuugcagcugcuuuugcagaaaucacaauuuuccuguggaauaaagaugguccaaaaauagucaaaaauuaaauauauauauauauuaguaauuuauauagaugucagcaauuaggcagaucaagguuuaguuuaacuuccacuguuaaaauaaagcuuacauaguuuucuuccuuugaaagacugugcuguccuuuaacauagguuuuuaaagacuaggauauugaaugugaaacauccguuuucauuguucacuucuaaaccaaaaauuauguguugccaaaaccaaacccagguucaugaauauggugucuauuauagugaaacauguacuuugagcuuauuguuuuuauucuguauuaaauauuuucaggguuuuaaacacuaaucacaaacugaaugacuugacuucaaaagcaacaaccuuaaaggccgucauuucauuaguauuccucauucugcauccuggcuugaaaaacagcucuguugaaucacaguaucaguauuuucacacguaagcacauucgggccauuuccgugguuucucaugagcuguguucacagaccucagcagggcaucgcauggaccgcaggagggcagauucggaccacuaggccugaaaugacauuucacuaaaagucuccaaaacauuucuaagacuacuaaggccuuuuauguaauuucuuuaaauguguauuucuuaagaauucaaauuuguaauaaaacuauuuguauaaaaauuaagcuuuuauuaauuuguugcuaguauugccacagacgcauuaaaagaaacuuacugcacaagcugcuaauaaauuuguaagcuuugcauaccuuagauuauuuuuauuuugcacuucuuccaaaugagagucacagacugggggugauuuauagugacuacaacaaggaaaaaaagauugguguucuccaucucuuccucuuucgucgccuccucacucccuccuuugcauccuucccucuguccccccagagagcugucaucuaucucuccauccuuccauucauucacucuacaaaugccacuucccaggcauugguuaaguagaagauaaacagcgaugaauagcacacauauauagccauuaagugugaauccacuggggguuagagcugagauuuuaguuauauuaggaguggaguagagggcuggauuccaaguauuacuugauauaggaaaaaaaaauagauggcugauuucuuuucccuaaugacuuaagcuucagucugagcuggaucagaauauaguccacggagaaugagugaguuacugaauacucagaaaaaagcucucaauacgaugaugcucucaguuaacucacccaccagagccauugugaagacgaaggacagaaugugaacacgcagcacagugcuccaggcaggccaugcggcagggacccgauucgccaccuuuucaccacuuuugacaaaaccauugaaaagcguucuuuugcucuccuuaguauauagaaggguagagaagaaaauuaaaaucauuagacuuaguuucuacugaaguuacugagagguauuaagagccacuucagagcauuucguacauguacauauauuuuguguacaaaauuuuguacacauauauacauauauauguauaaaguucauuuaucauguuuauuauauacaauuuaguaucccuaggaaaguacaaagaagauaauauaacacuguggaucccaacauucaaaucccaugcaucuuauaccaguuauucugaaagcaguuuuuauguuuuuuaaauuaacuuacaguaaaacugacuuauuuggauguacauuucuaugaauugugaacuuauaaauagguucacauacccauaaccaaaucagcacgcagaacaguuucaucaccuaaaaaccuucaaaccuguacuauguauaacacgcccaggcacccuaaccuggucuucaaccauggaacucucccccaucauagaucaucuauucaggaauggaauaauagacuugaaacugucuucuuucacucagcauaauguauuugacauuccuccaagucguuauguguaucaauaguucguuccuuuuuauugcugagcgggauggcauuuuauagacauaccacccuucacuuaucuauucaccuguugaaggauauuugguuguuucuggguuuuggugguuauaaauaggaauaaacauucacauucagguuugcaugugaauguaagucuucauuacuucauuacuuuaggauaaaugcccaguacuaagacagcugugccauaggggaaguguguguuuaauguucuaaggagcugccaaaccaucuuccaggauggcugcaccaugcugccuuccaccagcaaccaaugggagccccaguggcuccacauccccuccaguauuugacuuugccagcaauuguucugugugugcguggucuucucacaaguauguaguggcauuaacuaugguuaauuugcauuucucuaaugguuaaugauguugaacaguuuuuggcugccuguauaucuuguauauccuuuuuuuaaaguguuuguuaagccuuugcucagucuuuuuaaaaccuuuauuuuauuuuauuuuauuuuuagauggggucuuacucuguugcccaggcuggacugcaguggccuaaucucggcuggcuguuaaccuccaccuccugggcucaagugguccucccaccucagccuucugaguagcugggacugcaggugugugccacucacccagcuaauuuuuuuuguauuuuuguaaagacuggguuucaccauguugucuaggcuggccucaaacuccuagacucaggugaucugcccaccucggccucccaaagugcugggauuacaggcgugagccaucguauccagccccuuugcucagguuuucaguuggguugcucguuuucauacugcugcauucugaaaguuuuucgcauauucugguuacaaguccauuuuuggauaagugauuugcaaauucauccacuuaaugaugucuuucacagagcuaaacuuuuuugcuuuuuaaaauuucagcuuuuauuuuagauacagugguguauaugcaggauuguuaugcagguguauaguaccagguggcgagcgugguacccaguagguagcuuuucaacccaggccccguccucccuccccgcucuaguauucugcaguguugauuguucccauguuuauguccaugaauagagcuaaacuuuuuaauuuugaugauauccaauuuaucaauuuuuguuuucuuccauuggacaugcuuuugcuauuaugguuaagaaccuguugauauacccucgcucacgaauauuuucucuugcauuuucuucucaaaguuuuaugguuuuacuuacuacauuucgauuuguaaucauuuuuuaauugaugaaauucacauaacguaaaauucaccauguuaaggugaacaauucaguggcauguaguacauucacaaugcugugccaccgccugcgucuaguucuaagccaccugcuucuaguacuaaaccagcuucaucuagcacuaaaccaccugaaucuagcacuaaaccaccuacaucuaguuguaaaccagcugcaucuagcucuaaaccaccugcaucuaguucuaaaucagaugcaucuaguacuaaaccgucugcauguaguucuaaaucagcugcaccuacuucuaaaccaccugcaucuaguucuaaaucagcugcaccuacuucuaaaccaccugcaccuacuucuaaacuaccuucaucuaguucuaaaccagcugcaucuaguauuaaaccaccugcaucuaguucuaaaccauccgcauucaguucuaaaucaguugcaucucauacuaaaccaccuccaucuaguacuaaaccaccugcaucuaguacuaaaccacuuguaucuaguacuaaaccacuuguaucuaguacuaaaccacuuguaucuaguacuaaaccacuugugucuaguuccaaaacuaguucuaucacaccaaagccccaugcccauucagaagucacaccccauucccucccuaccccuccgucccugauaaacaccugucugcuuucugccucuauacauuugccuacuuuggauauuucauacagugcaugacuuucgugugugcuuucuuucacuuagcaugaccuucucaagguuauccacauuguggcaugccaguacuucgaucacuuuuauggcuguauaacuuccgucauguaaauaugcuacauuuucuguaucgacucacccauucaugaacauguggacuaucuugauguuuggcuacugugaauaguguugcugugcacaugcauuuguuugagcuccuguuuucuuuucuuuuucuuuuucuuucuuucuuuuuuuuuuuuuuuuuuuuuuuuuuugagaaacagucuugcuguguugcccaggcuggagugcagugaguggugugaucucagcucacugcaagcucugccuucuggguucaggccauucuccugccucagccucccaaguagcugggacuacaggugcccgccaccaugcccggcuaauuuuucguauuuuuaguagagacgggguuucaccauguuagccaggauggucucgaucuccugaccucgugauccacccaccucaauucuuuaggguauccaccuaggaauggaauugcugagucuguguuuaacuuuuugaggaacugccaaacucuuuuccacagaggcugaacuguuuuacacucccaccaacagugcugugggcuccaauuccucuauguccuuguccacacuuacgauuuuccaauuuuugauuauaaccaucuuaguggguaugaaggggucacgguuugguuugcauuuuccuaauuguucaugaugcugugcaucuuuucaaugugcuucuuggccauuuauauauugaguagacauuugaaauguuuacucaauuucuuuuccauuuuaaauuagguuguuugucuuuuuguuauuuauuuacuuuugagacagguucucacucuuucacccaggcuggagugcaauggcacaaucauggcucacugcagccucaaccucccagguuccagugauccucccaccucaaccuccugaauagcuaggacuguagggaugcgccaccacacucagcuaauuucucuaauuuuuuuuagagauggggucucacuaugcugccaggaauggucucaaacuccugggcuuaagcgauccuccugccugggccucccaaacuauugggauuacaguugugcaccaccgugccugacccgucuuuuuguuguuuacuuguaaacauuccucauauauucugaauaguagacccuuaucagauauaugauuugcaaauauauuuucuauuaugaagauugucuuuuuacuuuuuuaauaauguacguuagugcacaaagguuuuuaauguugaugaaguacaauuuaucuauuuuucauauguugcucaugccuuuagugucauaucuaagaauccauugccagauccaaggucaugaauauuuacuccuauguuuuccucugucuauuucuuccuuuucuuauuucagcccuccuacacacacaccucuuuuucuuuuucuugccucuuuguacucuccagaauuuuaaguacaauguuaaauaggaguggugaauaugggcauucuucccuugugcuugaucugaagaaaaaagcauuuagucuuucaucauuaaauaugauguuaacuauaggguuuaaaaaaaaaaccagauaccuuuaucccuguaaguaucaugaguggauaucaaauguuguugaaugccuuuucugcaucaacggcaaucccauaugcaauccccuaugauaugauuauauggccuuucuucuucagcuuguugaaacaguggauaauagugauugauaaucaaagaucagaccaguuuuauauuucugggauaaagcccacuuggucaugauauguuauucuuuuuauauauugagcauuugauuugcuaguacuuacuagaguuccuugugucuguguuagugaggaaaauugcuuuuaacuuuauuuucuuauauuaccuuuggcuuuucuaucaaauaaugccauuugcaaaaaaaaagaaaaaugagccaggaaauguucccaucucuucuguuuucuggaagacauuauguagaguuguuuuuuuguuuguuuguuuuguuuuuuagauauuuaauagaauuugucaauaaaaccguuugguccugcaaauuuccuuucuugguagguuuugaacuauaaauuuaaguuacaaauaguuauaggacuauucaggauaucuauuucaucuuggaugaguuagauaacuuuuucuuucaaggauuaguucauaguaaguugucaaauuuguguguguagaguuauuccuaguauucuauuaucuccaugucugugaagccuguagcagcauuuauuauuucuuuccugauauugaacauuuucaucuuccaucuuuuucuuugucaaauucuuuagaaguuugucaauauuauugaucuuuucagagaaccagcuuuuggauuuauugauuuuuuucuauuuuuucugccuucaauuucaucaauuuuuucucuuaucuuuauuauuuccuuucauguucuuauuuuguguuuauuuugcucuucuuuuucuaguuucuuaagguguaagcauacaugauuaauuugagacuuuuuucuuuuuaagcauaagcauuugaugcuauauauuucccucuaagcacugauuuaccugcaucccaugaauuguguuauguuguauuuucauuuacauucaauucaacauaaguuuuaauuucuuugauacuuccuaugauccauggcuuauuuggaaguauguagcuuaguuuccaaauguuuguagauuuuucuguuauauuucuguuuuugauaucugguuuaauuucauuaugaacacagcacauacuacauaugcuuucaauaauugugcauuuguuaaaguuucuuuuauucuuucuuggugaguguuccauguacaauugaaaagaauauguauucuauuaguguuggauagauuguuauauaaauguaguuuaugauccacuugguugaugguauuguucaguucuuuuauaucccugugauuuucugucuauaguucugucauuuaucgagagaugaauguugaaguuuccaguguguuuuauggauuucuaaauuucuucuuucaauuggaacaguuugcuuuuucuauuuuuaaguuccauuauuaggggugcacaccguuaguauuguucugacuucuuggugagucaacucuuuuaccauuauacuaccugccuuuuuaugucugggaauuaguuuuugcuccaaaucuacuuugucugauauuaauauagccacuccaucuuucuuuugauuggcauuugcuugauaagucuucucuauuuuguuauuuguauccuauccauauucuuauauuugaagcaagguucuuucugacagcauauaguugggucauauuuuucaaaucuguucuggcaucuuuguauuuuaauuaguguguuuagacugggcuuguguuuaaagcaauuauugguauguuuggauuuaagucuagcuuuuuauuauugauuuucuauaugcuacuguugauuuucucuuuuucugccuuuuuuguuauuuacacauuuucuaguuugcuauuuuagcuuacuuguguuguuuccuacauugauauauuuuuaaaacccaagagaagaaaaguguuucauauuuacccagcuauuuccaauuuauauuuuacuuucuuuauucuugauauuucaaaguaucuuuuaauaucauuuuucuuauguuuaaauaacuucccuuaacaauucuuuuagagaaauguauacucuuuuaguuuuucuucacuugaaaaaugucuuuauuucaccuguucuggguauuuuuuucuucauuugaaaaaugucuuuauuucaccuguacuggguauuuuuuuccacuggacauagaauucuaauaguucuucgccuucaacaauuuaaaucuguuguuuacuuucuuuccuucuggccucuauuuagugucugauaauaaacccugaaucauucaaaucgguguuccccucuaaguaaugugcugucucuggcuacuuuuaggauuucucauucugucuaauuuuccgacaucuaauuaugacaugucuguguguggauuggguucuuuagcuuugugagucuguagauguaugccuuucucuuauggaaaaauguugguguuugggggucuuugcaggccaaugacugggucagguuccaggcugcaagcuucaauucaccuucuauagguagaacuguuuuugcgguacuauucagaucuguccugcaugcgugcccaccaacggccugucugggugugggcagugugggcaguuuucaguuugguagcuguuuagagucagauccaugcacgcgcacaucaaagaugaguccaggaguccaugaacaauuuuacuggaucuccuucccucauuccaccgucccacugaacuccccauuacuuuucagagccuaacauuccucuuguugacuccuuguuucuaaaauugugucuuuacuuacucugcacauaauuucuguggcugcagccauaucugggcuaaacagcaggagaacuggagaaaaaauaugguaaaauuguccugcuuugguggcacaucuaaaucugguuuucuuccccagucugucugcuaccguucacugacagaguccucuaauagcugcuccaugcacucagcaggagagacaggcugggguggccugcuaaacuuuaccugggacuggcaccagccacaauacagaguacuuguuuugaugguuuuaaguaugauggugauaaauggaagagaaugaaacgguucaacuuuggucauuuaaaaaaucuuuucacucucuuuucuaaagcuugaacauaccauagucuaccaauuuaguuaaccaucauucaugggcuuuucgauuuuaauggcuguaugcuggcucuuuccaugcacuuuuucacucuagcuuacuggacuuuaaauuacaugcauuagcuuguacucauuagggguaccaucgcuuuuacaccagaauucuuaaagccuaagacucagugcacccauccuguaucugaacccaagagucauuuugucguccucaugaaacuagacaaaucugaguucagaugcugacucugccacuuacaaacuugugaccuuggguaagauauaaaaccucucagagaucugcacaaauuaggucauuuuuacuuguaauucuuccaaaucagaaucauagacugagaaggauuuacaaaaaaagagaaaaccuguuuggcuguaucacuuaucauccuuuuacucauucucugcuuccuuccaucuguuccuuccaucuacucauccauccauccauccauccaucauccauccaccauccauccauccauacauacauucaucuguucauccauccaucuauucauccaucuguucauccauccauccauccacugauccaucucuucaucauucauauucugcgugcuuauuauuucccaaguacuagguuagguacaggauaaauggaaaucgauaaugucguccuuaagaaguguugugcaaaaaaaaaaaaauaauaauuguggaagaaaccuguaauuugucagguuaaggaauuaaaaaggaguuaugcaauagauagggugagguugaggguuggauuacaaauggaauaaagguugcccacaucugaguguugccuggaagauuaaaugagaaauaugcaagacgaagugcacacggcaucucuuccuucauccaggccccgagugagguccagggaugcaaugucacggcauagccccugccucaggagacuuuauaccaauguggauuguuucugcauucuccuuuacacgugugucuaaaucauucugaggauaauuuuguggucaacuucauuucuaccugaaugacaaauucccuauauucaauucccaugaugcaaaaauagcauuuaguuuuauugggccuaagaugaucucucugcaauauuaaaagguguccccuagaguaauuuuuaaguaucugagguuuuguuaagaucauucuuuucauaauucauaucuucuuuaaccuuuguuauuccagauuuaagagauguuuucaagucguguucucagaagcuucugauccuuauccuucugaucauuugaguuauaccugucugacucuacuaugucucccugcugcuuugauaaaagacaauuucacauacuguggaggucaucagucaaucuaauguuuauuaaucauccccucauuucacauggcuuucucuggaccccuugggaggagacaagguaauaaauccuauccuccaucccagguucaugaucauuuggauagacaagguauauauagagaaaauauuuaauaauuagaguccugaaggagggacuuugcagugaacuucaacaucucaagccuccuucuucucccacuuccaaaccacccugaaucacgcgggagaagugaaaauaucuuuuaaagacaucaagagaaaaauauuucacaagccuguucgauaacuuucugaaaacacucauuguucagggugcugcuuaaaugaucuuucugcuucugccgguggcaaggccccuccagcucugaaagcaugcagaggacagcccauuguucccuuaacgccugagcaucaaucaccuggucacccaacacucagccagcucugcgcagaauguuucuaagugauuuugacugcaagacuuuucgccauuggguccacgugggaaccucucccucuggcucuccuuacaccuccacauggguggacacauggccccggccucuggagggauggagagggagggugcuucuggagagaggagaucugauggggcuggggucucuccaacccugcacguggcacccugugaacucacagccuuucauaccagcuccuucccugguccuuagcccuuucgucagugcgguuuagggcaauggucaccugaacguuuguuuugacagucacaaauucccagaaacagggaaacggaacucgcuagcgacguuguguggaugaguuugcuuuaggcuggaacaagccuugccuuuggguaacgggcuuccgggugcgcccuggccggcugugugcgcgcggaaggcggucaccugggcccccugggcgcgcgcgccgcccgcccgcccgccugccccgcgcgcaccugcaggaggcucuggcgcgcucccucccucccuggcugcgcugcgaagggcgcgggagagggggauucuagcagcgcugaaucacuuucccacagccucugcguggggagcgcuuccucugaugcacgcccuauuuguacuuccugagugcgcguggacugcgggcccugcucgccgcagacuugcccgaaauagcagcgcgcgggcucggcuccccgcgccgcccgcagcaucugccucccccucccgccucgugggcaaccgggcgcggcugagucacggugacacugagucacucgccagcgucaggaaaugccuuuuuuagacuuccaguuugaaauggagcagcaggugacuuuuuaaauucgguuuuguguuuuaucuucaauuucccugggggcaguucuugcugguuucacauuuccccacgacuugcugcuuggggcaaguuccgcaccaaauguaccuaggcggagcuccgccuuaagggauauucauuuuuccgauguaaaugaggaaauucugcagacugguuuugaagcagucuucgcuagacacuccaugcaacaguguguauuuguacguggguggacg

SEQ ID NO: 15531 - RNA, 158273 nt, Homo sapiens
cuuugaggcgccgcccgcgcaccgccgggggggagggggcagcgccaacaaauuggggagcucggcccgccgcgcucaggucuccgcuuggagccgccgcacccgggacggugcguagcgcuggaaguccggccuuccgagagcuagcuguccgccgcggcccccgcacgccgggcagccgucccucgccgccucgggcgcgccaccauggggccccggcucagcgucuggcugcugcugcugcccgccgcccuucugcuccacgaggagcacagccgggccgcugcgaaggugaguucccggccagcuccgcucccggcgucccgccccgagcuugggcgccccgagaggccccuuuguccgcgccuggacccguccgccugccccucgggggucgcgcguggcacggccaggugcauucucugggccgggguucguugggggucccuguaggcuacgaucgcgcauugguggaccgagccuccuuuguuaugguauggguacuggagaguuaaggaauuccuccggggaagggaggagaaacagcccgcgcuguggcggggugagggugccugggagccggcgggauuugaacccgcgucgcggguaugcucggcagcugggcgccuucacccgucccgggugcgcgagggaguugggggcuggagggccgggagcgcccaccccgcgcugcucagagacccacacugggagcuccgagcuccuagccccugggagcagcuuugggcguauuucuccuugucuggagacccugguggcugaggcugaaaagcucugggcccuuugccuggaaacagcuguaucugagcuuucccacgacugcugccuaaggcgcgcuccaaggcagaaguggggcucuucuggacgcccggcuugaagaagccaccauccucaacucguugccuucuauuaauauauauuuuaaaaaauuauaaccacauucauauuugagcaugaaaccaaagugaaacuccaugucauuguuccaugcacaaauuguuuuucuaguuuucauuuccuuugguuaugugcuugcccagaaaggaucugggagaucgguuugcaggagguuugcaggagucgaggcuuccagccguggacaagccuggacugacuguuguuuccuuuuuuccuuccccuccgagagaauaaagacuucagcuguugcucagugucacagccaugcagucccacaggccggaagguguggcuucugaacagauuuugcaguuucucccucaaaugcuuaaaaaugauuuuugcuacuuaccagauuuuccauacuuauucuuuuacuguucuuaaucuuguucuuuguuuuccucuuuaaaaaaaaauuuuacuucucuccuggaagaaugauacucacuaaauccacuuaacuguauagaaauuguuaacuguuacaugccagagagaacuggugauauacacacacgucuccuaauugagagcuuaucucccuggaggcagcuucuccacuggguauugaaaggacuaaugauuacaucagcaauuaacuucagauuguaccucccagcccagucuccccaaacuucauagccaguuauuuaaacacucuuugguaaugaugacaaaauacuuuccaaagaacaggcuugagagcacuuuauuuuggucuagaaauauugaccaaaagauugaacgcuuccaaggugagauggugaagccugaugaugguaagguaaaucagagaaaguucuucauugggaaauaggagcuguuugcauuucgauuuucugauggauaauguuagcaaagcaaagaaagcuaacuguaagagcuggcuuuccaaacauccaggacuguagaaagaaagaaccacucaguuacgcaaauccuguucucacccgggaaaucaaacgcauuaauguugaguuggagaugauuuuacuucccuuuaaucauuuccuaaagcucaauuacauucccggccacugucuuugcagugucccuugaggugccauggacuguuuuuaagagaugcagccugugggcacuucugaucacagcugaccucacagauauuaucauuacucuguauuuucccuggcuuaauuagagaaaagugcuuaaugugcagaugauguauggguauacaagaaaaucacuuaaaaacugaaucugccuaauuuuaaaauuugucucacuuuucaugccaucaauaacauuuuggcuuaccuccuuccaaaaucagcuguuagauguaccauaacacugaaauagcuucaauacugauccaagcaaaacauaauuuaaaagcacauuuugaaugauaagaugcuguggauuugaucagauccucauucagaagccaguggaagugacuguuggcuuaccucuccuuugcacugucugaaucacacuucaccugcauuuguacauccagacaucaccugcugugugccaggcaugaauugcccuuauuguuuuuucuucaugaaaggcuguuuaauuuuguauuugcuguaucugcuauggucauauuguuuacguacucauggguggauuuucuaaaccauugauuuuaucccacgcugaaccuaccacucuacuccccgcuccucccuuccuccacuuuucuucagcaagaaaggaggaauagcuugcaggcuccagacaaacacgugccagcaguguucugauugugagcacccucuacucuuagucacucaguugcacugggcggaaugaacccuuccugcagcagcuuucacacuccccucuagcugguucugugugaugcuucuuaacagauuauuucucaggauuagaaacgugaacuuuccccucaguguggugaugcuuguccagcaauacugucaucuccugaccauuagucaccaccucugggacugaaugaccuagaguucaaacuaagugagauuucauucccauauaaguauggaccauguucuacuggaaauguaguuuagaagagaaggcugguuucugaaucagucccaacaagagcagcaucgcccaggaucucaggagugauauuggugaagcuauuccuuauaucugcaagcucuuuauauuaauagauggaauuggacuagggugaagggacauaacuuuaagaccaaccagaagacacaauguucauguacucugacuagauucacagaauuaucaaugcuauauauuauuaauagucacguguacacaggaugagugugcuuuaggcaccagaggaccuuacauuuuauaccugcuuuuaagcagaugauuuggggguacucaucaaacucuauaccucaguuucccuggcaggucugucccuuccucacacggacccguuugugccuuccuucauuccacacacacaucgggaacaccuccuuccugccaugaccuugccaggugcuggccaugcggcagggacucacccccacucucuguccucaggaaggucaggugagaaauauuggaaaagaaacagacgaauccaagucaggcugguaaaugucacaaucaggggaaucgaagggcuauaggaacacugaauccagcuuuggggaacucagaggaaacuucugggaggggcuuccgccucugaaauaugagggagaaauaggaacuauacaccagcaugucauuuccaugugcacugugaugguguacuauacacagaagacauggucauucugccugucugcucucaagucuaagggucuuugcacugaaagaugaccuucaaguuugcuccuuugagauaccaaaaugucauuguuucugugauuaacaaucuugguggcugaacuuugcucucagagggguggaaagaauuggaagggcaggguuuaggagaccaguguuaaaaaagagcucccagcuccaacugaggccccaguaugugguccugucccuuuucucggagguggcagguaggcaggcaggggauguuuggaaaguugcggcauggaugacugauucuagucaggagugccuuuaggaacugacccagaaaaccuacccuuacuugggccaggccaugagggaauucacaaaacccuacauuauucauuaacaaggcuguuggcaaauuucugagaacuggcaaggauggucauaacaaguucaguuauuuaguuaagagcugguaaagauuuugcagacaaauggaacccaccagugaugaucuaagacaaaccuuuguagacaguggaagaacaucaagaaguggcuaaaugacaacagugguuuugaugaauucuaugauauuuguuauaauaauuguuccccaaauugaagaaggauuaaccucauuaaaaugucucacaaggagguuugguauuuugaguucuugggcuagagucagcucaagcaacaauagaaugccuaaaauaauguuagagcauuguucuuccugcuauuauuaagcaaccaugaaaaaaugucaacuauagaacaauacaaaagacauauuccuaccauucuuaugcauacaaugaaaagggaugucaaccagagcauguuuuaauggugaauuucuucugagucuuuugacacuguaggaaugacuuuggggugaagacuuugauagucugguacacagugagcugguuccagccucguuucccuccauuguucuccugguccuaacucugggacaugggucccuccuagcgcucuuuccgugucucugcuucugucuucuuccucuucccaugccccucagugugggugagcugcaggggcagcucugcgugguucucuuuguucuuugcacucucuaacuuccacugggggucugcuccaugaugcaccauuacucccugaaggggacuccagaacuccuucuugaacuccaguucaacgucuucacauuuccacgcgacgccuccccuuggcugucuugcuuugaucucaaacugagcaaauauguucaggacugaacucauuuuuuaccuggacugacaacccuucccgacucugccauuuugguccuggugcccucugauguuucuggguacagagcccagagacuaugaggcuuuagccuuuccucuucuuuauccucugcaucugcucagucacaaagucuccuacuucuuucuggaugcuucccagaggugcccgcagcuuucccuucccacggcugggacucccuuccagcucucuuugccuugugccaggaucaccacugaacccucauggcccugccccuccucccagcucucgugcucuccagcccauuccucaggcugugagaggcuaauugcccucaauucccuaaguuauggucauagacuugcugguucaggaucugccauggccaccuacuaucucacugggguucccccucuuuuuggcuuggcugugcauucccuuugugguacggaucugucaaauuuuucuggccucguuccuugcuacuccucgacauacggcuuugguaacuguaaggaaggauaaucucugcauuccacagaagcuguuucaucuucuccugcuccccggccugcaguguccucucgucuucccucggcuagcacgcauuccacugaagcuccugaaacaguucgcagccugccccuuuuccacgugauccccucucgagucagagugguaaugugaaauauuguugacuaucuggauuuuaaaaaauccagccuaaauugcaauucuugcucugccauucaguagcauuguaaucucuuugagcuuggagucucuaauacauacagugaggguagucgccaugucuagggagagcaugugcacaugaaguaagcacucgagcggugcugguugugguugcugccacauggcuuggaguuacauugucauuugugucuugguuccaacacuugccaggacauaacuucuuuuuaaagcaucccaccauguuugggagagugcccgacacagaggaggaaaucaggaauuaauuacuuguaauugguuccaauuuucuagcugccauucucuugggagcccccuccccacccccggaguguccuagagggagcugccugcuggcuuacacuguccaccccugugguauuacuagugaacacaaagaugaaucugggcaaacgaagguguuuccccuuaauuuggaauuuggaguagauauuccaccacagacuaaacaugacuuggaaauauguacacugcugaacacuuuauguaaauaguuuauuccgugguuuaguaauuuucucuguggaagcuuugcuggauuugguuuuuaaucugcauacuauaaaaacauuucauuuuaucugaguuuuaaagcucacuugaucuuuaagguacaagacaaaugccaaguguccaaaucagauauuaaagcaaucuuuuccaggccacuugggcuuuuguguuucuguuguuguaccucuuaccugauaaaggagagcuauucaaccuccucaucuucuguugcuuuuagaaucaguacauuguucaguuguaaaauuaccauuguuuaguaauacauacacauacacaucuuaguguacuguggccacugauuccagcaaggaccacagccagagauacuggccgugagcuggaagcauccaguuugaugucaguugcucuauuuucauuucaccaaauacaccaacaauuggggaagccauuuguguauucacucauagagagugcagcuaacuuaaauaaacauugcucaauucagcagaagaucuggaggcacacuauuccuguauuggacacaauuaaaauuguuuaaagauuuuauuaaguuucugcuuuagaaaacaaggauauuccuuugugaagaacaaaacccaguguguuccagcuguaauucaauguuuugaaagcuauuuccacaaacuuuucccagcagccacacucaucccuagagaugauccacauucagaagaaaaugacagaugaugcacguucagaggagaauacuaugugucuucauugcacaaagauaaaccuugccuaauccucacauucagcacauggggcauuuuugaagguacuaggucaguauuuguucucuguuucagcguuguacagauaaacucaaugauaaccauuuugguauuguuuccuucauauuuauuaaauaaacaauauuaauaucuaaucuaauugguggaagauuuggcuauuacaucucuaauaaugcuuuauuuauauguauauuacuauguaauauaaaacaaucaaaauuuauuuucagauccgcaguucccuugugugcaaguaaugccugauuucugagcacaguggcauuuauuuucauaucauccaagagcaccagcuuugaaaugucauuuuaaaauauaagcaacucuuuuuuaucauuagcuugaauuuuugaguugcauuuuagaguuuuuuaaagaaugcaaugccauuuuaauguuacagaauuaauacugaguugugugugacguauuugcuaccaccagacuaaggacccuacgauuagucuggcaaaagaaaagucuguuucucaaagaagcuggcauuaacgggucagacgugcacacgacuuuuuggaaaggcgauggcaacgucucaacuacauccagagaggagacaguccagggacacacugguugugcaccagucacaggcccugcagggaaaugugugggcccuggucuuccucauguguaugauggggaugagggcaguugcuuuccuuagggagcaaauguaaggauuaagugaguuaaugucugugaagcauuuauaccgagcuugcuuugugccaggcacuacucuguuaaauuaaagacaaauucagaagcauaaacagcaaaguaaugacaucaagaccccuuggggcuggaagggcccacacaaggaucuccuucagccguuguccaacaugagcucacagcagcaucagcuggagggcuccacgaaacagcuccagagcuucuguuuuuggaggugugggguaugccgagaaucugcauuucuagcaggugagggugcggcuacugacagcccgacuucuuucacugaggccgccgcuugagcagccuuaggugcaggccugcagugucgggacguuaguuugcacucacuuugaggcugaaccccugcguguaacauggcccuccccguucucuuugucuucuuuuuccguugauuucugcuccugcccgcaaucccgguuccagcuguguggugcaguuuggaaggucagaugggcgggggaggaagguuccagaaacaugcauguggcgugucaggaaguggaggcuccugaguggaucuggagagggcugggcugaugguaaaugagcacagcggugccuggagcagacucugcccuccguggcuuucuccccucuucgggagccuggcgugggugucucagaacugaucugcuuucagucugaguuuugccauccucugcggcgagccugcgagcuugcacacuugggcaggaugcgcucagcgcccuagcucagaggccgacccagggcagagccagucagcgggcgcugggacgcaggacucugaacauggguccucugccucccucccaccuccuccaggcccggccacucggcuuccuggugaggaauucuuaacgaccgccaaauccgguuucuagagauaaaagacgguugaagguuagugguuuaaaauaacuccuaaauuuugguccggaaauggccuauacaaugaagauaaacuuaccaaagcaggaaaaugggucagugaugggggaaaauaccauccacggaaugguuaguucagccucagcauccgauuuauuucggacacauacacaaacccgguccagaaucaauaauauuaacuggaaaaggggaugacacgguuuuuauuacguaggauauguagugggcgaucuucuugaaagauuucucauuccuagcuuaucuuuaacaaacauguuuuucauguaaacauuaugcuagcgccagaugcuuuuuaucaauuguuaaagccugucuagucugacuaaauagccauugggcgccuccauaauaauuagauuuuguuuucccaaauacuugaaaauaauaagauuguauuucuucaggaauuuaggcuuuuaaaacuuuuuuuaaaaaauucuauaauucauacuucuuuauuauuucauguugaucauagauauuuucucuuuuuuccauggagguuaucaucaauuaauauauuaugauauauggauuuuuuuuucucuugacuagaucauuuauuuaaaacauaaauaacuuuggguauuguccuaggcgagaagccaauuuguaaccaaaggcccauuucucucucucuuuuuuuuuuuuacaucagcgaaaguaaaacaagaguaagaauucacaugaaaacaaaguaggaaguaauaguuugauagcucaguaucuugcuuuuggccuuuaaaauuuguucaguaaguguguguucagcgcuuacucugaauuaggaaauaugcaggugguuggaauuguucuuauacuuugcauucggacaugugccugaguuaaagugagaauaauuuugguaaugguaugauagauguuacguugaaaauuuagcacuugcacuguucucuucuggcuccaaaucuuuucauuuaaguucugagacugcaaaaggcaucaguuucagacucuggagucagaugagauggauuugaauuccugaugacaguuuuagugauggauuuuaauaauaaaauuaauaaaaauaaauuuauuugcccaaacagcaacuagcuguuugacuuugggcaaccuucuuaacuucuuugugccucaguuuccccaucuauccaugagggauaauaacguauuccuuuauuguguugugaaggucgcagacacgauacugguaaaugagugacugccauaucauaagauuucaugcugugaaguagaucuuuggucuuccucuuguuuccuggcauacaauuccugaaauucuuggaauccgaagugauaagugucuuuguauguuaaugaguugacugguggcuggcccccccaccccgcagcuucagaguuaggcuggucccugggaaagaccaaggcaggcuaaaggauggauucagccccacucacaaccucuggggagaggggccguguaggagguugaguuaauuaccaauagccaaugauuuaaucaaucaugcccuuauauaaggaggcuuccaugaaaucccaaaaagacgggcuugaggagcuucaggauggcugaagauguggagcuguuccuagaagguggcaugcccugguagggcuggaagcccugccccuuccccuacaccuugcucugugccucucuuccauguucuggguauucaucuguauccuuuguaauacaguagccuuuauaauaaaucaguaaacauaaggguuucccugaguucugugagccuuccuagcagguuaaucaaaccccaggagggguucauggaaauuccaauuuauaaccaauggacagaagaauaggugacaauuuauuccuggcaauggggucugaaguggggcaaucuugugggacugagccuucaucugugggagcugaugcugucuucagauagauggaaucagaauugaguggaauuaaaggaagccuagcuggucuccccugaagaaaugauugcuugcuugguauguggggaaaccucccacacagccggugucagaagcuuguugugagagcagaggaaaaacuguugugccucuuuguaucuucagaugagcauucauaaaauguuagcuuuuacuauugauuucgugauuauacuaucgauauucguauguacuuaaaacuaugaaguaucuuucuuuuacuacgacuuuauuucuuauaagagaucagcuucuuggauaauuuacaaaauauugggauuauaaugauauucaaacaaucgaauacaucuugagugcauaauucuugagggcacaauucuaucccuaauguauuccaagauggagcccuuggcuuugagguauaacaauuaugagaugaacaaaagcaaauugaaacaaggcacguugccgugguuucgcguaggugguggcagaaucuccguagcuucacuucucaugagauccaucauagccacucagagaggagacugucauagauuucuuccuguaagcgauuuaugggaagguccuaguuuaauagggcagagugcaaaaugggaaucacuuuugagaacuuucucuggucucuuaaucaagugggagaggcgcagggcugaaguuagccagcacugcacaucugaguuuuggcuugagcacaguggagacagcugcccacagcagcucacuccccgcuagaaagcgcaccugucuccccggagagcuggagcugacuuuggagggguugcaucucuggcugccucagccugacauuuuccaugguagaaaaugucucuggggcuccagagguggggcuuccagccauguaaauauuugcauguaaauauuuuagaauucagcauagguugaggucagaaagccauuuaccgugaggcugggugcgguggcucaugccuguaaucccagcacuuuaagaggacgaggcggguggaucaccugaggucaggaguucgagaccagccugaccaauguggugaaaccuugucucuacuaaaaauacaaaaauuggcuaggcgugguggcgggcgccuguaaucccagcuacuugggaggcugaggcaggagaaucgcuugaaugggggagguggagguugcaaugagcugagauagugccauugcacuucagccugggcaacaagagcaacacuuugucaaaaaaaaaaaaaaaaaaaaaaggaagugaacuacaagaauauuuugucguuggcuguuguuuaaugggacauucaaaagcuuuaauugaauucaaaaaggaguuauuuaagauuuggacuuaaaaucagcccauuccuuuauugugucucuguacaaacuccgucucaaaaaaaaaaaaaaaaaagaaagaaagaaaaccauguagugugagagccuaagagaaaaaucugaacaugcuggcagauugaggauguuuauccauuaaagagucuaaaagugggaucuucacauacaacuucauaaagucuucugagcucuguacaugucuuaaggaaaugagucugauuuguacauuuuuacauuaaaaugauuauuucuaggacauuauggcuuuuguauauuaagugugcucaaugaacagaacuguaaucuaacuucacaaaauuagauuuuaaauacauauaaacauauguacacauauacacuacauaaguagaccaugugugcauuuccuauaaaaugaaugauauucauucauucauguaagaaauauuuauuguacacccacuaugugccaggcacuauucuagacuuggagacaaacagaaaagaauugcugcccucagcauuuauuuaugggaugaauacagagaagcaaacaauuucugccuuuuaucaugcugaacuagaaauuauuuaaaaggauaucccucucugcuauuuuagggaugguucaaccucccaaauucaacuuuguuaaaauaguuguaaggaagagacuggaguccuuuauaggaaauugugucuacuuugugucucagaaguacauucaugagacuaacagacauugaguuguuccaauuuuuggaaauuuugaaauaucucuccaguaggaaauggguuugcagagcucuucucucuucccugggaauuaaguacagcuagccaugggaaauaccacuuggguuuagaguggaugaaaccaucagauguggaaauaccagauggaggaaugggagggaggcuguggacagcaaauguguuucuccagugugcaagauuucuuggcacuuugaugaggauguugugugucacaacuguaaugaugcaagaauauuguccuuugucuuaaaauuguguugcucuuuggccaugucagccggacccugugugaaggggcuggaggcaggcagagaaaagagaugcucuuguaaucaucagggacacaccucagaccucuaguuccacaggacccgaguggucgugcuaccaucucugcacaauggcaacccucagggacagacugucacaauguauggcagcaccaagaaauugggggcucgucuccuccagcucagcgccuacucaaaccuggaggaguucuggucacaaugagcacuugagccuuuucugagagucaaaauuaaaaucugguuccaaggaccaaggcuuaccagguuuccugggcaaaagaaaccuaauuugugaguuagggauaaaugaaucagaaacaugaaaacuauugcugugagaacacucagaggcuuaaacaaggaaacgcaggucaaaguucuuggcaaaauauguuggcgaauuguccuggacaauuggcagugcaugucccacauuauccugcaacagugacacgcuguuaauaagggaaaggguauaaugugaaaagcucugaugaagugugcuagguuacagagccuuuuugguggaaaauaauucuagaaaugguccuuaauuugauuccuuaauuggcaauugucuucuuaaagugucagagugaggaagaucagcugguguuuccaguauguucaaacagcauguucgaaagugcaggccugaguuuggguugcuguaucugagccuaucugccaucucugagcagagucaauugccaucucaagucagaugauuggcaguaacuucuagaagauaaugucaaauuuuuaauacaacuuuuucuaguucuauaugaugugcacuugugccauuugagaaacuguagcauuaacuugaaagcuauaguuggcaaagcgaaguaauuagguugaguuucuuaucauucauagccuucuagguagacgcagcagccgcuaccucuacaacauuuuacugacucuucccugggucagagcaaugccacaggugcgagcccccagcuuuggcagccugcagacguccagaaacacuucucuaggugccacaguccuacacaccuuuggucauguuugccuaagcuuugggacuuugcuaauuugcaugggagggcuaaaccuccagcccccaacgguggcacuggggaguagacuaaguguuccugcacggugaccuugaauggaauccagcauuuaucacuaguugaaagagagugacugcacuuuuagggggugcucuggguaaguuguguaggugggaauugagauuuuuuaaaaauaacagccaauuuauuuucccacaauucuagaaucuacuuaugaauuugaggcgugauaucuuuggcuguuaagugacacagauuaccuggcaguugccuuuguaugcuagugagaacccuggacauauccuguuucuccugacccuuuacauagagauaauugacuugaugacccauugaucccaucugccuaccugccagucaucauccuuugaguuccugucccucccuacauguugagggagggaccuggugggagaugauuagauuaugggggcaguuucccccaugcuguucucaugauagugagugaguucucaugagauuugaugguuuuaaaaauugugcuuucuccuucgcucucucuccugcuaccauguaagacaugccuugccuccccuuugccuuccaccaugauuguaaguuuccugaggucuuccagcuauguagaacugucaguuaauuaaaucuccuuacuuuauaaauuacccagucucaaggaguaucuuuauagcaguuauagcagugugagaauggacuaacaaaaauaaccaccuccagauuggaaauauaugaaaaguugagagucaagaaacuauaguccagucuagaccacagcauggccucuuuuggggggcccgugaaccccuugagaugauaugcaaauuuuuaugaaucugugcacaagugcauuuuuaagaagacaaugccuggaacuuuuaucacauucucagagauguaugccacagacugcuggucuagagggccuugguagcagauuuuuauaguaagaacugucaaaaagauuuuccagggaagaagacccugaauuuggcaguagauaagaauagagcuaaauuugacaaugcuuccaaagcuuuggcucucagcggcaggcaggaugcaggcacuucugaggguggugggaaaaucggucggaaagacaguuuuggcgaauguuaaucuuauuguuuguaucaaauguuuggcaugaaucucucgaaagacaugugugcagaccccaucuucucagcugcauuuugguuucuuucuccaugccccuccagggauggcacaguaucugagcaucgccauguagaaucuaugcucaguaagugugucucuugauugacuaauugguugucaaggucaugcuagaaaauggaaauuugaaggugaaucuagauugguucaucugcagaugguggaacuggcgauuaugaucccucuaggaacccagcucagagcucuugaagagggagacaagaaguaaauaacccacuaaagaagccgggucuggucacaggagagguguuucugugaacacuuuuaugaaaaggugcgauguacuugggggcagucagggcucugcacaauuagugaaggccauugcauuuucagcacuugacauggggugggugauaaggaaacugacaagucuagucccugccacguggccagccucgcagggcugagaaggcgaugggagagggcugacuuguggucugauuugcccaggccagcgagguccaugcugugaccugggugaaauuacuaauggcgcucccgugcaccccuagcacaucccgacauggaagaugaguucuguggacagccagcugugaggagauggcaugguuaaagcucccucgccauugccuccuaguugcagaaaaauauggcagauucuugguugcugagaaaugcugaagaaaugaaaagacaagaucaagaguuuagaugaauuuagugcaaaacgugaagaugaucaaagagacaaguggguggcuaaugugaugccaggcuacuuggcaucgguguacuuuuucuagacaccagguccucgacacaccuuaaggucaggaggggaagccccaguguucucggacaggugaggugggagcugcaaguguccugaggagaggggcgggcaggacacucacgucugugcacgugauucaggucaggacagccccccacccgcccugugagcaccucugugcugguccaagugcaaagaggcccaccccugggggacgugcaaucgcccuuggcuucugccacugcacggcgaccccccugccgaguuucacuggccacugaaggcaaagagaguagcagagugcccagcgucaccggcaggauagacccaaaagugacacccacguuuuaaaaagugggcugguccaaaugcagugauauugacagaucauugaucacaaccaguuauagauuucuuuguuccuuuuccaguccccacuugcucucgugcacccaagcuucacuugcuaagcuuuaaaauguaaaacaaaauaaaaacuaaaauaaaagugggguggagagugggucugguggagguguggacagggaugaugagcuggaggugacuccagggugagugcccagagauuuuggucaccuggggugguugaugaguaguuugcgagugaagcuagaguccaaagggaaggaaggaucgaggaagccggaggagccuguggaaggaaugcuauggguuuguaaccuuuuaagggaaucuugaguguaguguaagcaugguggucauuagauguacugauuaagaggguaaaucauaaaagaaauuaugacuuggacauaaaauuuaaacagugcaaggacauguuaaugauaaaacgaaugcugcacagauuguguucccucuggggagucuggaaaucaaaaucccagaagccgccugccgagcgcuuguuagcuugcaacgcgcucacgugugucuguguagcuuaguguguucgcacuuguugucuaaccaggaaaaugaacuuuaaaaggccuucaacuaggcuuuaauuaagaggaaaagaugacaaaaccuacacagcagcaugucaaaauuaccgaacaugaaacaggacucuucuguuuagaauagcaccgagucaccuuuggaaggagugacgccccugcgagggugcugugccccccggcagcauccuuucagccaacccuucccuucacgccccuuuucagaagcagacccucuauuuuuacuucccaggggccuuaaaacccaccugcuuguccuccaugaggaugugggugaagcgcugacccucauuccgucucugggaucuguccacugggggcagaacauguuucuguuggaagacagaggaagaagcggugguccgugccagccaccuugaggagcagccugggauccggagcaucucauguuccauuucuucuugaguuuuccaugcaucaggaaccugagauguugguauuuagcccugaagguggcuguggguauucucuaugcgcuuuuggacuuuaacccaaaauacagauagcguaauuugcaguguaacgucuaacauguugaacucuuuacauauucugugaaggacgaaccugcaagggcaccgacuuggaguaucucauccguugucuugggugaggaaacacugacaacugaccaagaaaucggugaacucaaggccugcaaagagcuuccugagaagguagacaggaauaguaacagggcugccuggagcagugggggaugggcagggggucagggugggugcgcagggccuuguccccucacaggaacgaguugauugcaaggugaugaggagccagagaugcuggagaagagggaagcuguucuuuugccuugggaagggucuccucuuggucgcggcaguggauggcaccccggccuggaucgugcuagagcuggaacucaucacuccagcccucuaccuccaggcuuaggugcggggccauucagacccuguucuuugagaucaaaauccccucuuccauccaggagaacuuaggaauccagcacucgccaaaaugaggagaucuggaauggaagccauugcucuccccagauacucacugaccuuaguccacucuguccucuccucuccacugaagggcuaggccugugacacgcaucuuuuuuuuuugagauggggucuuguucuguagcccaggcuggagugcaguggcacgaucuuggcucacugcaaccuccgccuccugggucccaguucaagcaauucuccugccuccaccuccugaguagcugggauuacaggcgugcgccaccacacccagcuaauuuuuguauuuuuaguagagauaggguuucaccauguuggccaggcuggucuggaacuccugaccucgugaucugcccaccucagccucccaaagugcugggauuacaggcgugagccaccgcgccuggccugacacccaucauuuacagguagcucccgaggcuugaggcauuucaacaaccuguccaggguuuuacacaaggacaugggagggauaagaauggaaaaucagucuguuaugcucaaauugucaggguuaaucaguguucauuauuucauuucaaaugacauacauuuuugugauuuuugauuuuugucugugcaaagaaaauacauauacuaaauaaaaauagauauagugaagugggaacaauucugucaguugcucuacccugugguuagauaauccuuaaaauagacauuuugguugcaagagacaaaauuaugcugaucuccugagccauggauuuuucuauaguggcaauaggagucucucuuuucacauuuugcuauuuuaccagcaagaucaaagcugaguuucaaggcucauaguagcagcgauucaaggcugcgcucaggcuuaauuauuauuauuauuauuauuauuuuuuuuuuuuuugagagggaguuucgcucuuguuucaggcuggagugcaauggcacgaucucggcucacugcaaccucugccucccguguucaaguuauucuccugccuuagccucccgaguaacugggauuacaggugucugccaccacuccuggguaauuuuuuuuuuuuuuguauuuuuaguagaguugggguuucaccauguuggucaggcugguuucaaacuccugaccucgugauccaccugccucagccucccaaagugcugagauuacaggcgugagccaccgcgcccagaccacucaggcuucuugaauucaccaauuucuuggucuguugucagcguuuccucaccaaagacaauugaugagauacucccuauugguggcauugccaccacuugaacggcucucuucugagucugaaaauaguuugugcuuccugugcugcagguauuguagcgccugcauuagccccugaaaggaaacguuucucuuggaaacaccaguguugggcucucaugugcuuccuccuuguauauagauuggaagugugugugauuuucaacuucauguccuugagccccagacagccgcccaggcaaggccaucccacuguacggcgcucaaggacgugccggcuucuuucugggucucacagcagggugagcauucugcucaagugacagcucaugaugcccggccuucugaccuuuagagaagaguucauccgauacaaugagagccccaaauguaaacucacuucauuucauuccauguuccaauggaaaaaccgagucuuggcugugguggugcuucuuguuuagagaggaaccgggaacuucacaaagauaagauauuaauaggacuggauccuuugugggcacgaaguaggggaguauuuagauuugcagcugugugcagccauuuagacuagauaucugaguggcuggccucgggcuuuaggguggggacggcaggcugucuggcuugccccugagaugucaugcggccuaaaggaauucuguuacuauuguugaauggcugaauaagagcaaaugagggcguuccuucccucugacacauaguggggaaaagugcgucucugcauguccagugcccuguggcuuggccuugcagcccucaugucuacaccuggggugcccggggccucuccugccucuuccuagguggguggccucugugugaagaaagacaagacaaacagcaucucugugggccauucuccacccucagccucagguuuuccaaaugccacuccugaauuuucuggaguuuugugucguuuccaaacuuguuucgaagaagagcuuugaacuaauguagcagaaugcaaaguggaauucuucccagaaacgaauucuguuuaacucuuuggguuuaguggaggugucaaguagcuugggacacagucagaagcacacacuguuuaucguguggacuugggaaaagugagcauuugggaucuucugcuggucuugccugaguccaggcauccauguaaugcaagcugccucucugcgaggccagcagggcugcagagccggggcucaugguuuguucaccuuugggaucugggaauacagcuucagccaaucucagugccccacgaaguaacccaccgccuuucuggcacuccggggugccuaggauuucucugucccuauaggcggcuccucuguaucccagcugguggucuuacugccucagccccauuuuccugggaacuguuccuccucuuccaggaauggauuucuuggcaugauacuucugccucucucccccacacaaucugaaugccacacaaggcucuggacccugaggcuccugucugggccugaccggacagcgggccccuccaggcauggccaucucucccuuuagccugcucagcccuccuacucugccugcagccacccucaggagcuucgaguguucagcacccucaugugaauaaaccagaugguuauuggccugggugugaucccaagcccccauuuccccuccagugucaaguggcugagucccacuggcuucaguguacccugaaucugcagcugcagccuuugagccaaugcuguccuuggucguucuuggucuugucaguauugccccuccauggcaguuucuccuuagggcauucccguauccaguccuuucccuccuuccaggccucuccagacucauagcucacucauaucagggagccgauguugcaccuuugcccucugcacuaugagaaucuggggcaaaaauuaaacggggucccauuuccagagggucuaaccaaggcuuuggacaggggauguggucaucgaguaguagcucugagucaguuuucccagagaaaagguaccaauacauccagauaguuuauagagauauaaggauuuauuauaaggucuugacucacacaugaccaugggggcugagaggucccacagugugcugucuacaagcuguggaacugggaaagcgaugguauggccugaaguccugagaacugggagcaccaggggcaggagaaggaaaaugucagggagcgcuaauacaaccuccuucugcuuuuugguuuuguucaggcucucaauggcuugagugagaccagccuacucuggggaggaugguucugcuuuacucagugcaccaguucaaauguucaucucaugcagaaacaccucacagacccacccagaaauaccguuucaccagauaucugggcaucccauggcccaggcaaggugacacauaaaacuaacaaucacaguagcuuagcucaagugcugauuuauuaugagugguaguauuuccacugcagaagacagacgcuuacuaagggcugcuguuccuaaauguguaagguacaaaggcagagccaaaacucuguauucacggauucacggagacagucccagugagugaggcccacagggugaggaaauaugcgugggauuccgcagcacacguaagagcccauccuauuucuucaccauuguagauucacguuuuuggaaugugcauuuccaauggaaaaucgaugcuuccuggcuucaacauuuuaauaaaaauacuucuggcuagugcccuagucuuucauuuugaaaauaacucauguuagaaaauugaucuauugguuacauuuuaaacaugaaaagauccaaacacugcucagaguguucuuucccugaaagccucagcccagacugacggccauccccugugcugcugagggcaugugccucgcuacagaaagggccauugccuuguaauggaauuauucugacauagccuuuagaccacaccaucagcuuucccaagggcagggacggugucaucucuaggcuuaucuuccuggccacagcacauugucuggcacuugucacuguucauuucucuuggagaugaaauaggcagaaaguauuagcuacagucaaggguugcaucuucuuuucagauguucaggagaugguaaucuccaucagcauuugccuuacuguucugauuaggugaauacuaagcccauucgagccucucuuuuucauaucaugaggauggagccauguuucugcucauuaaaaaggccuuuuacaaaaagaagacagcuauggggaauauauuuugcuugcucuaucuguguuaggaaguuaguauucauuaaucaugugcuacuucuccauguguuuugcacaaaaaucggugaaaaaugauggcuuucuacuucuacauucuugaagcgugugcauuagauuuuucuauuucuuaagggacugaaggcuaauauuaggauaucauguugacuucucaagacguuaaaaccaaaagaccucugcagcuuccaaaucaugcuuacugauuucgggauuaugccuccagcccccaaaaucaacaccuauaauuuaaaagcugugggggucacauuagucagauguuagagagaugcuuguggcuuguggguucccagauuccagaauuugggcuuuccucccagcuuagcucugcuugugacagauguuuaaguuagagagacacuaagaaaacuuccaggaggagaggggugaaauuuagcagccucuuuuuagaugauucuaccugggggagcacauccugucugggugugaaauugagagcuguguguuuccaccugcaccacagcauccaggugcacgcucugugggaucccugcccguugguggccugaccuacagacccuuugcugaaggacccuuugcugaaggcuccuggccuguggccaucaccggacagacccuuugcugaaggcuccuggccuguggccaccacugucauacagcgcuguuccuugggcuggagggagagcuuuugccaccucaucucccauccugucgacaugugacagcuuugccagcccagccacagugacuaaagucuucagggucaugaaaaauaaccccccaaaugccacccacugcugcuguccaagcucaccccaccagcauaaggccuggcuuaguauggugggaccugggcauggugagccccagaugagcucacagauggcaggcagucuuugagggaaacuuugaugugcaugugugggugugugcaugagugugagagcaugcacaugccugugugcaugugccugagugugcauuguguucauaugugugccuguaugugagggaguguaugcaugugucugcauaugcagaugucuguauacacagaaaggugugugcaggugcacaugugcgugugugugcgugagagugugcgugugccuauggggcgcccagacaccuuggcccuucccuuuguauucuugcuguucuuagugaguuuacaucauggcuugggcacggcucacauucucaucucccuacauuagugacaucaacacauuucacauuuggcuuauuagccacuucuauucaaugucaaaaagcaaauguaugauuuaaaaacuagcugcugacauaaaauuuucuagucuacauuauucuuuauuuucuugaaccucucuuuuccugaaaucucugauucgaugacucgucuuuucugaacauauuauauuauuugaugacagagagaaucaaguaauuacucuucagucucugucuuuccuaugaagaacugaacauccuucaaacugggaacacuaaauaaaacaugguaaggagagaacugaaucacaggcaaggcaaagagagagaaagauaccaugcaauugcuuaaaacuaacugaagccuuuaugcuuggaggugaggccccagggccucaggggcaccuggaagcgacugggaucacuggcucauuuugauuuugaaauguggagacaugcaggaagauuggagagggcaauguuccgauggccacgaaagaacaaaauugaauuccagaaaucacauaucagugaacuuagcauggacaauuauauuuccaaauugauuuuuuuugacagaaagcuugugaauacuuaaauaaagaguucaugaucccuggaagccaacacaggugccccaaaacaggucaggagaaucaguaggcacagcagggaugccauucagggacauauacuucaggguacagacccugugcuuggagaagccaugucccaggguaggacacacaguuaugugagagcacuucaucucaaugaccuuggcagggccucaaaauucuccccaauucagagcuccugcagccauccuugacugguaggaauugacacuugaguugaaaccagcuugccauugcuaaucuaaaggaugugcauuggaagugaggacagggugacuugcguggaugcagccaugccagggaagguacaguagggaugaagauggcauugaggagacacaaugaacagcuuagaaugcacagcaugaguaggaaagugauaauaccuaagagucaccaccagcuucccuugaugugccaguacucuacaugagucccccacagucugcgcaaugacagugugagguggguugucuuacucccauuuuauugaugagaaaacaaaaggucaaggacuuuucuccacuaguauucaaacucaggucugucugaauccaaguuuacaauauugacauugauaugccaccucuccagcauugguagggaauucugacaaggggagagaggucaaauuguaaaaguuuuauacacuagaaacuggugaguaauuggugauuugugaccaagggucuuugcuggggagaauccucuuaaguaagacuagguggauaaugguaagcaggcccuaaggugaggcgaggacacgcagccaggaaaacugaagggagcuguuguguuucaggcauaaacugauggagaucugagcagggaagguggccaggggaaugcgaaagaaacuguagaugucagggccuuuugcagaaaacauccacagaacugugugccgacucucugaagggcagagaaacagauggguugaguaaguuuacuaaaaugugagaggggaauugauguuccugccagauugguaaacggccauaccauuagaagaagagucccuuauuuugugaaaauucauuggcugagagguacuaauuauuucagauaguggagguaaaguggguaagacuuuacucuuugaucaagggucuacccaaaucuugacuagucuucuuaauuacuuaauuuauagauuuuugaugaaauugaguuucugugugagcccccauaguggaaaucuaagcuuccuacuguuuuuuuuaaacauuuucucucuauauugcagcagguaaccacuuccucuucucuuucccuucacugcaguuugugaaugaucuggcuguuuuuggcuuauggcacaucuggguucuccuuugguccuucucaagaauuaauuacuguucauaaaguauuuugaaauaaugucagaaaauguccuucaaggagcacagaguacuuuuuggaacauuaaaaaauucucaguauuucugcuucucacguuuuguuuugggaaauaagaauucuggcuguaggagauggcggggggagguuagucuucccagagucgugucaucacagaacaguguugcuccuuacagcuguuaucccaagagaagaaaacgggagagagugccggccacguuuuguggcuuacacaagccaguugauggugucaaagauguuguugaguucucuggccaaaggauguucuguuuucugaaaaaguuuagagcugcagaauuguuuuuaugcucgaguggcuaaaaaaaugggacacaugguuggggugaggagaaaagccauauuuuacugauccaaaggaauuggaucacuccugaagcaaacaaaguauaauacggcgaucuaaguagauaguugcauauauugaacacaaaggcagagcauuagaguaagaaaccuucagccagaucucggauguauuucauaacauguguucguugaaagaauauaagaaaggcucuaggucuugaaaaaagaaagaaaauucuccuucacauuuauauucauguauuacuagcaagauuacaaguucucagaauagcaccaagaugaaagaggcuuaccagaauuauugaaaaggggauuuuucgaggccacuuauaaaaccaacacaccaaauuugguguugcagauguaggcgugggauuguccucugucuucagagguguaauacguaaagcccaugccaugcggcgcugcuaagccaaagcaaaccaugauuugugagcaagaacuugaagauucuauauaauucauuuuuugaauacuuucucuuguaauacaagcauagaauuguuuucguuuucaauggcauaauggugacuuugugauguauucaugagaauuaugaaguuuggaaugugacuuuuauuuuaagauuuugagggaacuccuaaaggcauuucacuuuugaccuuuaucugaaacuuguggcugacuauugcuggguaauaggcaccaagugugcauuuuuguugugucugaaaaucuggaugugcuguucggcacagauggagcaaacacgcagcaaacuaaggaccgucaguggcuucccauuggcucauugaacaaguuaacaccacugcaguauuuuaguuauuuuaaaaacuaacuuuaaagaaucccaaguucuuuauacguggcaaacuucaucauuugguaauggauuuagaaauaaaaguaagcuccaaauuaaaagaaaauugccaauagaaacagaaaauauucauaaggaaggguaagacaggaaaggaauaucaggaagggagaaucaaagugaauucaguaaugugcagacacuggaguucacaggaccuaaagcaggugcaacguggacgcucucuggaggugucuggcagacccaggagaagacaguggccacaguaaggagggcagccagcccucucgaugcaggcccacgggagacaggccagcacugcagaagggacucacugaauaguagugccaagaaagucaguguugagaaugaaagaaaauacugugaaaugggcacugguuagaaaguugaacaacaacagcaaaacuuaaaauaugaagucuuggggagggaaaaacuaccugaagcaaauccuguuaaacacuucuguguggcugguuucugaugcuaggagguuuuccccugcaagaaaagacacaaguaauaagaauuuggcauauuuugguuuccuccuauaaucuauaugugugugugguccuccagccccccaaaagaauagauugaaugugucuaacacagguucaggauauggggaacugagcaaaaaaauacauuauaugguuugcacauucaaggagcuuacaaucuuccuggaaacacuagucauugaaaugauaucacaaugaaaccaaccugagcauuauguacaugagcucagagaaggagcccguauuguggggaggagcaguacugggaagcaucacugagaagggccucagguguggaacuggacuccagaaaaccucaccuuccauggggagcgaugauuauugauauguaugugucauaagaagcaaaaauagaucagaugugcagggagacauagcuggaaaaggaaagggcgcuccaguguauaugauaaagauugguuagguaagugccccccaaaagugcaugcaaagccaaguagguagaaacauaaaaaacaguaggacauugagagcaccuguggccgacucgaaacacuucauauggaauuggaagaccccgggcaaagcacugaguuggguuccgcagaggagccaaccgugacagugggcagaugagaugaaguugggccugaggguuucaucauaguccuagauuaagggaagauauuuuacaggaaaaaacaugauuuguaguuugagaaaaaugaaaaggaggugugggacgccucugagcugcugaaacaucuaagguagcauauauguacccagcaaucccacccaacauucccacagucuaggcagauggagaaggugauccugucaagaggcguggcugggagaagaguggccauaguuugcaaguccaaagaauacauagaaaauaaaagaggaggaaaugcccaugaagaaaucaguuaugaaaucaaucaggagcauauuuguuaagcauuuacuauguguggaaaauggguauccuuggggaggaaagccuuuuuaaaaaggcugugaagucacuacauaguacuuugcagauguguguguauauauguguauauauauauaaugauuagaagaaugaaugaauggaugaaugaaugagcacacccaaaagaaaugucuaggaagugcuuucauaaccucucuagugaguccagaguauuguaugaaaugcaaugcuuucaaauugugggaaaauacgcagguauuuccagaauccaggucacaaagaccaaagaagaaugauaaggcuaggaaggcagaauacauaagauagugcaaagggaauaaaaaugucagaugggcucauaaaaauucugugaauacauuguggaaaaagcuaggugcaaaauagcauuggaaaggaggagaagaaaauauaaaacuccugucaauguaggcagugucuccuugaaacucacuucaccuuuuaugagauuaucauuuauacccaucugccacaauucuaaguggcucuauugaaacuuacuaaguucuuccgaguuauugggagaaaauauuauucuaaauacguuaacguauguacuucucagugaagggggcuggaaauaagaaacuagaguuccauuugggaucauuuugaaaggggagaaaaggcugggguaaauaggaaagaauuuuuuagaaacuuucaucaaaggcaauaaugcuagcauggguuacuuaauaauuauaaaagaugauaugggaauuaagggaaaugaagccaaguggagauugggaaaucugaagaaaaugaaauugcuuguuugaagugagugaccuuuaacuuacucaacuugcaagacgugggucaaaagauagagggaggggaggacaaaauauguccaagggucagcucugcaaaggauggccugagucacccagagugaaucugaaaugccugguuccaagagauuuccauuuuauuuauguuuacagauuuagggguuaugagugcaauuguguuacacggacauacugugugguggugaggucuggcugguggaugcccaucacccgaacagcaguuccgagagauuugagagcagagugcagacccugggaagcuggaggugggucccacacacagcugaggaagaaaagggccuuguugccaguacucuggcuacgaaguuaucauaguaccuuugcaggagggauuauuauauuaauuagcuuaaaaaccuugauaaaaagauguucugaaaagaugacucauccuaucacagguuucaggcaaagacaaauuggggaaaauaaagaauggcuuagacagaacaugucagcagccaguuuuuaaaugacauguuugccaugugauauuucacagaaauggcuacacagaaaugaaauguguuaacauugaugauacagaaauauccaauaaaaauagcuuaagagagugcuuuuaugcccuggaauauaacuacagaggaccguauugauaaauuauaugguaagauuuauugggaugcaaauuucaaucauuuaagcucgauuaacguacuauacauugguuaucuaaacuggaguucaaaaacccagaugucuacugaggucaggcagauaacugggagcagccagcuuugugagaaaacgcacaucccugcaaaaggaucccagugggucccugcuuuuaaaggucugggaaggaaucagaagccuggggccucaauuuuaaaauauucauucaaaaacuucuagaauauggugcaggccaaacaggguacaucuguggcccgaaucuggccugcgggucaccaguuugcaaucucuguuccaaaguuaaggcacccgguaucuuuauacugcagaguuuugaacuguguuguauggauuacguagcagucguggaauuaaaacuggucacaacagcaggagagcagguucaaggccagcauuuguucugaguggcugguguggaguaccacacugaaaguagggguuuuugaauguuauuuugccuacagucagaacauuuacauacuuaauggagugcauagaaauugauacugagaaauuaauuauugccuguaauauuuggauuuaguuuguaguaaauauccuacaaaaauuuggaacccucccaugcaaccuguauaaaaacgcuccggguguagaggagccucagcagaggagauggauuuggcgguacaacgagaaucagucuugaaggccaggacgcauuccccaggggccuaacaggaggcucaugaacaucugcagugauuuauugaaccagugcuggaaggaaaaugacaaaauauuugagucaacaauaaaacaauuaugcagauguuuuacgaagcucuguuccacuguuucgcaaucuggggugguacacaugcagguuuuuauuuuuuaauugacuugauuuuuagagcaaguuuagguucacagcaaaauuguacagaagguaccaagaguucccacguaccucuucucgggcacacgcauggccucucccaugaucucuacaucccgcaccagagugggucauuggcuacagugcgugaaccugcaccgacacgucacuaucccccguccauaguucaugcugggguucacucucggugcuguacuuuguaugcauuuggacaaauagauaaugacaucuauccaucauuauaguauaacauagaguuguuuuacugcccacaaaauuccuccauccucugccuauucaucccuacccccuuaccucugaccccuggcaaacuauggauccucuugcugucuccguaguuuugcauuuuccagacucucuuauaguugucuuauaguuggaaucguaugguauguagacuuuucagauugguuucauucccuuaguaauaugcauuugagguuccuccaugucuguucacgucuugauagcucauuuauuuuuagugugaauauuccauugucuggaugucccacagguuguuuguuuguucaccuagugaaagacguggugguugcccccgagcguuggcaguuaugaauaaagcugcuguaaacauccaugugcaggguuucguguggacauaaguuuucagcucauuuggguaaauagcaaggagcaugauugcuggauugugugguguguuugguuuuaucagaaacugccaaacugccuucccgaguggcugcaccaucuuguauccccacccgcaaugacugagaauuuuuguuguuccacacccucaccggcacuuaguauugucacuguucuggguuucagccacuuuaauagguguguacugguaucucauugauuaaauuugcauuuuccccauaaccuauguggaacgcauuugcauaugguuauuuucaaccuguuuaucuucuuuagugaagugucuguuaaggucuuuggcccauuuuuuaauuggguuguuugucuuuuuauuguugaguuuaagaugucuuuguauauuuuggauaacaguccucuaucaaucaaauauaucuuuugcaaauauuuucuguggcuuguauuuccauucucuugaaugucuuucccagagcagaacauuuugauguuaaugaaguccagcuuguuaauucuuucuuucauggaucaugccuuugguacuguguuuaaaauguuuggucaucuuccuuggggaaugagcggaaggugacggcugcgagcaaggauuuuuggaagagagagaaugcauauuuugcuuuugccuuugaggugcugcaacauuuaaguagaaagucccucagugcugccaucuguugcuguggccacagcuucccuccuagggccuggcguuggcacaaucacugcuuuauggacaucaguucucuguucuacaugacagggagguucaauuaguacaucccuaagcucuugcuaccuauacaauguuaugaucucaugagcggauacuguggcuaucagugcacagccaggccacucuugguuucuuuuccugacacuccucccauugcauuucugucuaacaacggugacgagguuggagagagcuccagggguggugugccugccgcauccuuucacauauauuguauaucauuucaacucagcaggauagaugaugcugaccccaccugaccaggaggaauugagagguguagggaguuagugacuugcucaaagacacaccaaaggcaaggaaugcggccagauccaaguucagaccagccucccgagggcugugugcuuugauuugaucaccuguuucucuuugaauuauacgugcaucagaucagaacaucuaauaacacucaugggaaagggggcuuccuaaagguggaguuacugcagguauccugaugccugcuuuccaaccugccuugaauuuucauugacuuaaaguugagcuacauacgacguauuagagaagaaaaccauggacuucuaucccauuauaauaauuagcugaugauauugucauuauucauaccacugcugucuccucauuagguauuguguucauugggaacagggccuuaauauuugccccuguuuaccccuaguacuuagcacauuuuaucuuuuauaggcauuuaauaaauauuuaucaaaaauaagcaaaugcacaauacaguaguaacgcuguauuuuuaaauaaaaauucauuuuuaauuugaugaggcccuagaucuuuuuggucugucuucugaagucaggauuuuugaaauguagugagaaaggaagggaaaugggaucauuuagugcuuuaaacugcaguguaagcacucagugugucucaguuguaaugcucuuuuggcagaugcgcgucugcaacccugaacaaguuucagccucacuugacugauuaguugcccucauuuaaaagaggagccacaucugugcagcacugauggacacuggggucagucugaaugacccuucuaaccucagaauuagagggugaguuuuccagacuuuauacccauucccuggugccuaugcuuuugaaagaagaaagaagaaaaauucuagguguuuaguucuuuauuauucaguugccauaaacaauuuaaaccccuuuuuuccaaccagacaguuaacuguaggaucugaguuuggaaacagacucuguccuaggaucuguguguuuaggagcgagcucggcugucugaagacuucuucccugacuaggugagauauauagagacgacacugcuggauggaguugucacaaguggaaugaggugauuuagguaaaaaagcuucugcaaaaugcuguggaugguggucuaagaugcacucagccacuaacagagccuuuuugacacagguaggucauuccacugauucucaagacgaacccauaauagaccuuuagguccuucaaaauauacaucccgcguuagcagggaccuucuccacuuuucuccauuucgguacccacaacagugaccgacaguuacaaggguuaaauggacauugcugaauucaugugagugauuugccaggcccauaaugccccaaaggcccaguagguaguuggaucugaaagcacuugcucucugagacaugaucaggcagccauuuacugucuaaaaacucucugaaaauuuuaaccaugcuuauuuaaauuuuaccacacaugugcacacacaccccauuuauuucccuggaaggaaggagaagguggaggagaacguucccuuugcuuuaggauucccuuugggcauaucuggcacagaggagcgaugccugggguccagcaucccuuaucaguuuccaugggcaccuuauugauggugacaggugaagggucggacguucugacaucagccacaucauacuuccauaguagaggugacauuccaauguggcuuccuuuuuaccugcucaggguguagcgaaaagcaacuucugccuugucucacuguugacaucuuaccuuacuguuggcaagaaaaggauuaggcaaauaggaagugacuaguguuagguacuggccuucccggcuuucuucuucuuuucauuuguagcgaagugucaccauuguggaacauccaugugugcaaugcugagaagaguucccccccuuuucuuuuagaggggacuuaugauggaggauggaagaaaugagaauucagagagacaagcaugggccaccugccacgcccacaggugaucugcgcuacaugcaugugcucagaaggguuuagggguugcucuguggguugagguguuucuuagaaagaagugugcaauuucgagaguguuuccacuucaauuuugaguccacuauauacugugagaugcagaaaaggcagagucagcauuugccuucuucauguguucacguaucuacggucuaugugaaauuacagaauuauuacuuucucugucuauggaaaaauguguguagguauacuucauuuuuucugaguuacugaaaaagaaaaagaggucugacuuuuaguucaaagccauuuuucaccuaugugcuguacauuacaguucuuaaaacaguaaaacuuuaaaggauauuucuggcggagaaacuuuuuuuguuuuaaagaggcuaugaccagaaauuucuggccuaauuuauguacuccacuuugauauugaguauugacaaauauuaccugaucuuaccccuugaauaugucaauucuuuggguaguguaccuguaaaacuggcuuugaagaccacaaauacgaugagcuauuuaggauucauuuuucaaguaguuaauaaaauucuuaaauuuugaaauaacuucagacuuagaaaaaaguuccaaaguauucccguauaucuuucauccaaauuccccaaauguuaaugucuuacaaaaccacagaacaaugaugaaaaugaggaaaauaaaauuaagauaauacucugaucugaucuacugaccuuuuuggaauuuugcccuuugucccaucggugucuuucucugaucucggcuccagcccaggauuccauauugcauuuagcugucacaucgcccuggucaccucuaaucuaaacacauccucagucuuucuguguguaugugggucagggcgggggcuggcaggggugaccuuggcgaguccuggccaguuauuuuauagaaagugcuucaaccuggguuaucugauguuucaugacuaaauccaggucauguguucuugacagaaauagcacagaacugacguugucuccuccuugggaggugugugaugccaguuuccccaaugccugaugaugggacucugaggguuggcucagguggugccuaccaggucucuccaugaaguuacuguuuuucuuuggcuccuaauauguaucuuguggaaagggccuuugacacaguaugaauaucuugcuucuccucuuacuuugcaccguaacgugacuaucccugaggauucuugccugaaacagcucuugcugcaacguucagugguuggcgccgcugucuccaucccgucucauuuguuaguugggauucugcagaagggaagagcuuucccuuugcucccauuugcuuacauguauucaguuauuuacuuagaucagaaugggcuugaugauugguuuuauucuaugaauuguaauccauuuccaucauuguuuuucaaaucaucuccaauuuguucuuugggagcuccuuccagcuggcgcaugugucuuugugacacgugcugucauuuuaugaacaugucguugcuuuccuggaaucagaaguuccaggcucacuuuguucucucccugccccaccccugaaaucagccuuucucuuaagacuucuggacccuucuauggaaaaacaaaaaucuaaguuaggggggcuaggcaugcccauugcuacuguggugucuuugcuucuagaccuaacuaaggcuauauucuccggugacgcaguaaauggucgcuguuagagaaauggacaucuccacuaagggcacaguuucggccagugcccccagccauggcacguguguggugaugguggagaggcuguguggagugguggaaacacuggccugggaggucagagaccucguucccaucugccccacccuaagccucagcaccuuccaguguacaaaggggccaugaaacgacccuacaaugauuaacccuacaaugguuguugugagaacaagugagauaauacaauacaagccuaaaacagcaagagaaacuagaaacugauagcucuuccuuuuaucuccuuuucuuacccauuugcaucagaaccuuggguccuuuauggcaaauuacuugcuucuaccauuguuuugaucauuugaauaauucuccucuuaauuagauguagauuuagauucuccuuccuuguagucugauuagaaaacuuuaagaggaagguugcacuguuaugcacuaaaaacaauauuuaucaaggaaaucguuaaugugccccuacuggguaugguaggaugaacacaggucaguuucagguagaugaacuuuccuguuauuucucugaagaaggucgcagccuucacagcagcuucacagucuugccaggugaucugcagugacaucuggcugaugcagaccaaguauuucaaacucaaaccaacaagcagcuguuuguguuggaguggagugcggggugaaggcugggggugcguggagaagaacgcucuaguccguuaccagaucugguuucauucuggcaucucccuaaaucaggucacagccauuucggcagguauguguuucuggucucgcagugccagccuccugcugacauuucacccuguaugugaggcuucagaccccuucacccagcugaggaggcuaacacguuuccuuccuucugcuugagaguuuuggaccugaaauaugaucuuuaugguauaaucacuucagaaucucauacaaaggccucuugagguugaugguguccagggcaugcaaucgggaugcgcccuguggucagcuggcaccuacccugccggcaagggccugccguuuguguugcgucuuccaucagaugucaccugugcuggacacacguggagaccuagccagcccccagagacccaguuccagaugcagcuuaacuuuuauaugccuaguguguuccaggugcagcuuaauuuuuauaauuucuuguuucugacacugaucaucauaaauacauaagauaaauguaaaauaacaccacuauuuucauaauucccaauguacuucauuacuuugauucuguauuucuuuucuacaugccugugaacuacaggcccaaucuugcagcauaauucaaaaagcguuuuuaugacaauguucucucuaugucguaggaaaaauauguaugcuucugauuuuauaaagguuuuuaguuuacuuauucuacauuuuccuauauuauuaaauuauaucauaaacaaggguguuuuaacauaugcuucgagcccuggagaauagaaaagucuuauuuuacuggcaucaggaaauggauuuucuucuagguaugaguuaauuuucuggaacuuuccuuaaaaugcuacaauuauuuuuccauugaugucuuuacugaaauagguuaugcacagcccuuuguuaguagagcaugcugucaauacagcuggcacuuuuccaaguggcuccgggucaucguggugagccuggaucaguucuccgugcgccaagaggugggccguggugcugcaaggcguguggaggugcgcggagguucggcuuuugcacguuggccuccucugcugggcucuggaaggugguguucccacucccuccuccuuggguuccuuuccacuucucacugcuucaaacaaguccccuccuccuugugucucaccugcccucggcuggaagaugggcggaugacagagucagauuuguugagccucccacgugccaggcgugugguccuggaagucagcugauuuccuugucccaguuguguuaagaggcaggugucauucccacauggggucauggacaaggcacccggguuuggagagguagagccccuuggcaagccaugcagccaauggccagcagagcacaguggcacggccagcauuuuaacugaggcuugaagcucaaaagcauuuucccugccacaccacccugaagucaucugcagaagccaaaugaccaaguuuuucuggcacagcagugaauguuauccuacugucauucuuuuacucgacacauuuuuguuaaaagcucacuuggacuggcgaggaugguugccuucucucuaaagagagcagagagcuggccaugccggcuucugcauacucaccucccuuucccuccccuccccacccaagaaaucccugccaucuuuugcauucagguccaagcuccugagccuggcacgacaggcaucagagugcucaucacaggagugugcagagccauucgucauccauaugccuuuccugguuuuggacuggcagugccggugcucugaggcaggacacaguuggcaucggcccugcugaaccuggccccuugucuuuauaugcuagggguugacugaggccagugaaugucuuguauacuguaggugcuuaacagcagucugucaaacuuuccuccuggagucaaaugucaugagcuuugugaccacugcuuuccagagaguuucuuuuuucuguauuuuuuuuuugaggggggcagcuguguucuagguguugaugauguuuggagcauacccugugaauaacagaugugcagcucuguauaggaucuucaugggguuuaaaauccugaccuacauauuuuuuauguauacauaaauacacauauacauauaaauauacauauaauaauaauuaccuauugcccucaauguuauacaggacuguguuuuaaauuaaacauguauugugugucuuauuuugaagcuauuccaaugccauuauuugggaaccauugaaucugaaaauccugaaauauugcaaauuuuaucauagcuauuaucuacuccauguuaauuuucaguuguuuccagcuauagaucaguuuucuuugucuaagugcuucuuacacucgugucacugaaaaccugaagaguacagagcccagccccuguuuugggugcuuggauaaggggagcuuacugguggauaaggaaaacuccagagacugagagcucuuuggaguuuucugggugcuccagcacagggaugcuuugcaaagauuccucaagcccuucugcuuguacaaccaccagaaggugcuuuagagaaggggaggcacugagaugacagcugugcaacucaggaugcacccaagacagaaaaaacacguucaucuuugugagcuugaguugggcauccuuuccgccguucucccucuguccuucuuggaggugcugaaagugugcguagcuccgucucccugccccuccucccuccacugggucaugcaggggcucccuggacaccagauagugcgagguccuuccccucgccuguguggaugguggggaggcucagggcccacugggugaccggaaauccuuucuccagugggcucauugugcucuuugugcucugcucagcagccgcugcccucgcuguggguuuccuuugugauuaauccuuaucugcucaaaaaggcuugcuucacauuugcccuuggcugcuggucccuggcagagugcaacucugcugccuuaugccuuuuuuaaguuuuuggauuccuuucaaauuuucucaaaucucauuacccugauuaaacauuuuuucgauuaaaaauuaaauuucuagaaaagugucaggaaguaugcaaauaaacgcuggcaugcuuuccacuugagagucaucaauugcuuacauuuugccacauucgugguuuuacugccucuccauauuacucuuguuuuuugcugugccauuugagauuaaguuguaaaggucaucucccuuagccccugaacaugucagcguuagacccaaggacaaggauuuucuuuuacguaagcaugauaccuuuauuaaguucaggaauuguaacauuguugcaauuuuauaucccauguccagugcacgcucacugugccaguuagccuagcacugcccuguguguuuccccaagucagcaucuggucuccgcgacguauacugaggccccacauugcccugccuuucuuugggcugcuguucuuuugcuagaugaguuuugaguuuuaagguuuucuuacccccauccagcuccguggccacauuucugcuagcgugacuccagggcuggaggaccggggguuggcagccuucucuugcuuuuccugagcuaggauucguggcgacagaguuggaacuacuccaggcggguugugacacguccgucuccccacauggagaacgguggcuugccaguuccccuugcgucccuucggcuggcccggagcuuggugcguguggaugcugccgucugugagcccauugugagaccgcacggcugaaacagcugaauuggggaauagcuuucagcucuuuaucucaguggcgaucuuucgcugugugcaguuucccgggugcaggccggggcaugacuucauucuuuagguuaugcggcaccccccgcgcgggcugcuggcucagucccccugcuugcuguaucugcgucuggggaccgccaccacccgcaucugucuccacgugguggccauccaggacucucagugacgacaccgcagacgguugagcugggagcccucacacacuugcaggcaucaucaucccagcaggcaugguggagucuggggagaugcgcaggaauucccgcgggcucuuagagucuaguguucaguggaaauucgugcuggggauaaagaauggcccuggcuggaguggaauuucgaugacugccacaucaucuucaggaacuccauuguauucuacgggcagcucccaaacccaagacugcuggcagcagaaaggccuccaggaaggcaccuagugacguagauaacaaauccguuuuacgugccacauuuccucauaggaugugcauaggaucuccuuuccugaaagccaggacuggcaugcagcucccugguuugggguugcagccaccuguguggagucaguuggcugggcuguguccuugucaccagaaucagcuccccugacucucagcgucacacacuuccugaucccaggcucacgcgcugugaagccuggugaaagcacaugugucgucucuccuggguucacagccugagcugugcgcuaugaaugcgacugcacacagcuguaguuuagggugccucaggcucaacacugugugagacuuguuuuugacuacuuuaauacuuuucuuuauuuagaauguaccccacaccuuuucuggcuuugugauguacucaaauugccuucguagaauuaggaaaucugcauauggaaaauaaaccaaaaucguauugcagucggcgcuuuccucuuuccucuuucugugauuuucuaccucccuaccuuucuuuauccuuucuuucaucugucugaaaggaagugaggucacacuccacucauucccagaucacuugaaacauuuggagccuaagggagaauggagaaggcagcgagaaggucucuagcagucaaggccgaucgaugauggugggacggcgcccacagcccagcaucuugcagagccgaggugggcugagcugcagcagcacuuggcgauccagcaacagggaaggaggggaagaaagcccucuuaagacacagugagagacaauggggaaaguguaaaaagcaugucccagaucucagagccuaaugcccugggaucacguggugcaggggccauuggcccugucagcucaggagcuccaguggccuucaauccccccaucaaccccugaguaaggggagaggaaggcaaggaaggagagauggaaggaaagaggagaaaaagagagggagaaagaaagagacggggaaggaggagacagagagagaggagagggagagaauauuauuuaauacuuuugauucacugggccaaaguagcaugucaaaacaauuuccuucuuuaaaaccuuuuggauuuaauuaaaguauggaacuagaguuggcauucuuugguagauucugaagcaugaggccugaaugugcauccauugaaauacauuauuuuaaccuuuuacuucuuucuccuccucuccuucccuccuuuuuucccuuaucuuucuaccguccucccucuguuguucuuaggaauuauugggaauuuggauuugguuuugggcgcagguagggguuaggagggugguugccaaguuugaguuuuaagagggaaccugcagccagguuaguugacucagcuaacuccagaggacagaaugaaugauucuacugggaauggcaaacaggguucugagagcugaaaauacacauuuuaugaggucugcaacuccuuaaagucuaugucuuucccucccaugaagaaggaccagagucugcgguccuuugaccucagaaauaauuaaccuggacuccugagggguggguguggaaugccuccuccccguucagccuucauuccuggcugggagggguuggggacgcagucugggguguguguuggaaagcagugucucagagcaggcugggagcacagcugccgcagcagcccucuccugccaagcagugcgagggaugaggauguccugaacuuuuucuuuugauacaguuuuuacagauguguuggcucugaaaaaaugcuggccuacuuuuuucuuuuuuaaauaauaguaaacauucagcuguuuaauuuuagguuuuccuuuauuuacaaugaggaauucauuuuuacuuggcccuaauguugauagccuaaacuuacauuucuuuaaaguuuauuugagagcccuaauaaguguuuguaagaaaugaucuauaaaauaauaugccauuuaaugauuaaauuuacauuuucauuuaauauauaauuggugaacuguuacuauccauacaagaggcaaaaucuacuuuuucauucgucuagaagauagcaucaaauuccauuuugaugauaaaaauaaacacaggagcugggcauggugguacacgccuguggucccagcuucuugggaggcuggggcaggaggaucgcaugaguccaggaguuugagguugcacugagcuacaacuacagcacugcacuccagccugggcaacagagcgagaucccauaugccaaaauuuuaaaauaauaauaagaauaauacgcagcuugcucauuuuaaugcaucuuucaaagugggucuguaagggcgugguggggcucaguuuaucuuaguaaucuguuuugugcuugacaugguaaaggguugggugguuuucccaauacuucuugauuacaugcuguauucugucuuaucugaaccuccguuccugauuuugaaguauuucaugaggggugugacaucauuccuggaggccaaggccgucgugaauucacugcagacagcugucucuccuuggucuggggugguuugucucuggcuuggacuggagaggauacacuguguauucuuggcuuugaguuccuugacugcuuucugcugcgugggaguuuuccaggcauguuuggagagcggacaggguucagccagcuagaccuaccugccugcucuggagaaauuugguucacuugauccaaguucagaugcacaauuuaugguguccaacucugguccacacacucaggagcuccucuaagcucacgagguccuugggggaucagugcuagcagccgccuuuagggcacaaguguugauggacuccuugcagcccuugaaaugaaauacugguuuuaaaauacagccguaaacuggaagguuaucaugaaggagacuuagacccauuggggaacacaucgaagugaagcagaucaggacagcuggaaauuccaggcagggaggauuaaucagugcagcagaaucaggagaugcguguuucccugaaacauguauuguuucacuuuccuucccauuguaugaacucuggacccuggggguuaaaagccugggccaugcuuccucuucuuguacaguagcaggaaugugggaugaaaagcacuccgagauuguugaucuuugugagauuuuugccuaaauaaaaaguagaauuaagagggaggaggaagaucaguaagauuuaaaaucccauacuuaaguuacgcacaugaaaggaacuucugaaaaaugcuuuugccuucugauuugcucuaaauaugugucagcuuccaguuggacaguuuaauuaccaccacucugggagggcagacgcauuuugaaguaguagcugcauuuuucauguuguauacugggaaggcugaugguggagggugagggcgcuggguccugcccugggcggucucagccccccacuugcuggcgggcaggugcagggcaagcucuuggccuugcagaccucgcgguccuugccugugggacucaggcagugacccccaccucucggggugcggugaccguuaagcaggaaucuguuucugaagcuccuacugcacacgggguacucaaaaacacugguccucuuuccauuccuccccuaauguggcguugaagaaaccacacuccacccaguuaaacccucagauggaagcaugggccuccugcauguuucuaaauucccuuuaaauaggacccaguguuucccagcuucccgcccggucacagcugggacccaccugcccugugcccaccugcccugugcagccacugugugcuggccucgaaaugagucacucacugucaccgggggacagccggugucccggcucugcucuggccuugcagaagcucugaaugaacaaguggcaggcacugcaccaggcccgggguggcagaggacgcagaguguccuuaggagacaaugucuggcagagccccugccccugcgcggcuucccucacugucuccaccugggcagcucacaggaagcgcccucagcucugaugcaaauccccagauggcuugaggaauuccccuugggugcgguucccugggcacagcaggaugugaguucucucuaggagggauggaaccugggcaguccaucgcuucugugucuuccuucuuaucuucaguaauuugaaucuuaaauuuugaggaacuccacuugaucuaaaagcuagggagcccuugggcugcugggaagccacagaagcagcacugggguuuuugcucuccaaaucuaaacagcgguagcacuucaggagaacgcagcagcaaaccagugaguuagcaggcucccaaauccgagagguggaaaggaagcaacuucaaauguuguuuugagagaauccaaaauugcccaagagcuaauagcuuggcuguggaauuccaucagaggcagucccuucugggugaaguugugaugggucggggggcuuccugcgccagggcggugugugggggcuccauucccccuuccuggggagcaggcugccucuuguccucuccuguggugagcucugcugugaccacauuggggcuguaaggggaguucauggaauuggugaacaaaucuuuuucacauuuuuaaaauugugguaaaauacacauaacagaaaauguacuauuuuggccuuuuuuuuuuuuuuuuuugagacggagucucgcucugucacccaggcuggagcgcaguggcgcgaucucagcucacugcaagcuccacuucucggguucacgccauucuccugccucagccucccgaguagcugggacuacaggugcccuccaccgcacccagcuaauuuuuuguauuuuuaguagagacgagguuucaccguggucuccaucuccugaccucgugaucugccugccucggccucccaaagugcugggauuacaggcgugagccaccgcgcccggcccacuuugaccauuuuuaaguguagaguucaccggcugugaguacagucauacuguugugugaccguccccaccauccacuccagaacucuuuuccucuugcaaaacugagacucaguacccauuaaacagaaaaaaaaugucauacuguaugucagcacgagaggcaugcauuccgucuucaucucuagaaagcuugggccggagauggccuuuuguaccacccuugccguggugacacuugguuuuaguuggcugugacuacuagggaucuaugaguucaguaagucacaagccuguccuguguggagagguuaccuguaauggugugaugugguuucacuguauccccacccacaucccaccuuaaauuguaauaauccccacgugcuaagggugcagccagguggagguaauugaaucaugggggcagucuaccccauacuguucuccugguagcgaauaagucucaagaguugcgacgguuuuauaaaugggaguuccccugcucaagcucucuagccugccgccauguaagauguggcuuugcucuuccuuugucuucugccaugauuaugaggucuccccagccauguggaacugugaguucauuaaaccuuuuuucuuuauaaauuacccagucuuggguaugucuuuauuagcagugugagaacagacuaauacagguggcacggagcagagauggcacgagauagaagaauggcuccugacuucagagugaaugagagagauguaagauuagguugccugguagcaugauccauguacagcagccuucagaguaacggggaugcagcuuuacauccauuacguaaagaaggaagagcgucugggaagcugauauuuuggcuguggcccuacuaugccaugcaugucagccgacuaguccaccuacagauucaacuauugcacaagaacagaugcagagcccggaggagaaggcagcacuuagcucccacuuccuuucuuggucugauuucugugaccauuaaauuaauauaauuaaauuagguugacugaccuauuucuauuuuaaauuagaauauuuuaccauguugcaaacacguucuuaaaaauacacuuuuaguuucacuuguuuuuaugaaccagaaaguccaaaaacuggacaauaagcucagcauagugaauuguuccaguaaagauucgcucugguuuuugaaaaggaaaauucauguuaagccaguuuccugucuagucagcagagugcaacagaagaggaaagauggacaauguugauuccuucaccuccuuaggcuaaaauaagauuucccaucuuguguuuugcuccaccuagauuuuguagacacgcuuaaaaauuuuuuuuaaguaguauuguuaaugaaauacuuucaguuuguuucagauuugcacaaaguuuagaauaaauauguccugacuggagagugaaucaugcaauuagucacuggacugagugaguuagaaccaccuaauuagggucaaugagcuaaaaaauaaaaauaaaacaauuaaggcuagacggaagaggaggaaauggugacuuuuugaaaagaaaacaaggucuggagaguauugccuuaaaaagguaaaaugugcaaauuaacaagauggaaaaaaccauugagugugguucugaaaacugagcaaagggcgcacgcgucagaaauggcuuuggaagccaagggccucacuccagggaccgggcggccccgugucaucugaagucuuugcauccgcaaaggaucccauagguugcucaggaucgccggugaaugagauccucagguuaaauaaauauuuuggugacagaucaaggcugcauauaucuaucauacauguauuuuccacuuuuaaugcuaugaaaugcaaugaaagacaucuaauauuaaaacuaugcugaacuuauuuuuugaagauauuuaaugauuuaaggauuuaaaauauauauauugugggaacuacaguguaucagcuucuuugcauaguaagacuaccaagagcucuaguuaaaccgaaauugaagucaaagcaacaaccaaaaaguuaacauuguuuauuaccuuauuuauuaaauuaucauuuauaucaccuggcaauuucagauugacuauuuuuuaauaaagaggcacauaguugguguaaauagauggaaauacauuuucaaauucaaaauauuuauuaccauuuaaauuuucuuuucuuuuuuuuugagaugaagucucacucugucacccaggcuggugugcaguggcaugaucuuggcucacugcaaccucuggcuccuggguucaagcgauucuccugccuuagccgcccgaguaucugggacuacaggcgugcgccaccacgccuggcuaauuuuuguauuuuuuuaguagagaugggauuuuaccauauuggccaggcuggucucgaacuccugagcucaugcgaucugcccgccuuggccucccaaagugcugggauuacaggcaugagccacugcgccggcuuaaauuuuauuuucuugagugcugcccgguucacuuuggcuccacgugacuucugcucauuuaagcuucacaguaugugguagcaaaagguuuucuagaauuuucuggauguuaacaugcuuaauacaaguucuuugucuuuaggaaccauauuucuauuucuacaaaucucauagccuuguuguauuguaugcacuguaggcaaugggaaaauaaguauucaaugaaugucagugagaaaagaaagaaacgagggcuauuuguguauuacucauucaaauggaaggaccagggacauggaaugaauuauauuuuccauauuuuauguauuucuuauuuauuuuuauaauaaauuaugaaugguuuaaggcugcuaaauauucuucuuagguuccuuuggaaaaggcaagaguuccugaaguuguagcacauuucaauagcuacauagcauuacgcuugucaauuaauuagaccauuuggcuucaagaguugcugguaaacucuauuuauguauucucuuuuuucaugucuuaagagugagacuccccucucaggguuauaguggggaagugugguuuggaaaggaggccucaacaugcacugaccuuguacaguuaaccacagugucucacaggguccuggagagauagcucuuggcacccucugccacuguucaaauaccaguguaugucauugagagaccauggcuuugaccagcaaaaguucaacuuuucucugugguauaccucaguuuuucuucuuuaaccacaaauguacuugugcuuuuagguagguccuuuggaaguagcacuuacgguuugcagaguagcauuuuugguuuaccagccguuaucuuccauauucuuauggagaguuuuaguugcuguugugcucacauuugcucauggccuuggaaggaugucgcauggaagucucccagauggaucucugaccacuugucaaaugcagagaagguuugccgcaggaucucuuccacauguucguuauucuguaggguuuguuaugugcaguuucuauuuacauuauguuugaguuuucaaaccugguuuuaaagauacaaaucagauaauauuauccuuagaaggugauguuuucaagagugauuucuuuggguuuugggaacugugcagcagcauuucagaaucuaucuuuuauaaguaguauaaauucuuccauuuauuuuugaaaaguggcuuugcaagugagugcaguuaugaaaacuacacuuuaguuucauucuggcuggcugggauuagucuaaacaugaagauuuuuuuaaagacaugucuggugucugacaaaagagaugaacagcuaugauugcuaucauagagacuauuuaauagucccucugugaaauggaaguaauauuaaauuaaucaauagaaugcauuuguugaaugcauagugagugcgugguuagauccuaucccacaggaaagaauaucuauuugcuauccuuguugcugaaaguaucggauagacccccccgccgccggucuggggcaugaauagaguguagcuggguuaaaguggaugcaaaccccucaccccauggccgaccuccgcauuuccaguugcaccuguaaauacaccagggcuucaacccucuuuaaacuucccaauguucuucaaacucccugugcacguucucauuuccauauuugguucccuugcuuucucuuucuggaauuuccuccuuugcuuucccgggcacugacauccucccugugguucugggcucugagguccaguucaccugcucccucgaggaugcacguucacagugccugcugguuccugacagggcagcaccacucagcaaguggccauccuccucugcugucuucaccucuuccucccgaguaucauccucguccaaaaccauuuuuccuucuccagcaucuuguagguuuguugcaaucauccuguggagucauuuaguuuuuuugauguguuuuuccccccggacuagaauaugcccgaagguagaaaccacgcccuauucacccugucgcuuggggcccaggacaacucuugaacaucuuaaacauuauauaggugucuugucucuagccggagauuucauggggaggaggcugaaauguuaggcaagauuuuaaaacaguuagguaugauuuaauagauaagaagaacaugagauauacagcgugauuuguagaauaaaaaucuucacauaaaauuugucuaauugacaguagaauuaccagcuaagaaaaugagaccuauuaccuucuccugucauaagauaaggucagucacagucuuuucuuuccucugccuccuucccccucccuuccugccuucccccucccuuccugccuucccccucccuuccugccuucccccucccuuccugccuucccccucccuuccugccuucccccuucccuuccugccuucccccuucccuuccugccuucccccuucccuuccugccuucccccuucccuuccugccuucccccuucccuuccugccuucccccucccuuccugccuucccccuucccccucccuuccugccuucccccuucccuuccugccugccugcccccucccuuccugccugcccccuucccuuccugccugccugcccccucccuuccugccugcccccuucccuuccugccugccugcccccucccuuccugccugcccccuucccuuccuuucccuccuuucccccuguuccugguggaaucaccguucuuucauugggaaaccuccugucuuccccucaugacacugaauugguccuugagccaugaccugccucccucccuugcacucuucucccgccuucuugcggcugcccugcucuagcucccauccccaagggcaaggacguccuugcaagucuccucauuucccuucccuccucaugcuaauacacuugacacaagucucacagaugaaugccaccaaaauccagcgaaugggauaggucucccucaucucuaaacuuuuagacccuacccaaggccugcuagaaaaugagguggaaaacacuuggccuuuugugggcacaggcagcugccccaccaguguccuugcagcacucuggccuucaggcagcccugugcagggcugaagccgacaccugggcuguucugcuggcacacagaccuccuccgcgggaagugugcuccugcuggcuuguccagccaccuuccuuguaaugggcuuagcgugguaggggccacagcuucucuccucuuaaccagcaagcuccuugagaacacagcucaugucuaagucauccuucacccuccagauugcaaguacaguggcaagcacauaguaagugcucauuaaauugcuaccaagugaguaagaguagcaggccuguucaguugcauauuccccaguucuguggaaaaggagggcuuaccuaagucugcuuuuuagaagaggaauuuaucuuuuuaggauggggacacacagagaauggcaggaggucauauaauuuggguuacauuccaaaucuccacuggaagagauuagugaugucgcuauucugggggagaagaugagcacaaaaucagcaaugauuuaaaauauuuaauuguuuaaggaaaaaaagugguccuacugccaccacugguuuuacuaaacucuguuuuugaguugcauguccgucaugcuugaaauauuucacuagucacuuaggcuuuucauguuuccuuuuaaaguauguuacaaacuguagggcuccuuaaagggucagcugguggaacgcagugggauaaauagaacaugggcgcugcugugucuuccucagagcaaagccacccucccgcuucugugcuguguaucacuucccagaggcaaacggagcccucaugauaugcuucaaagagaguucuguugaugggaaaacuaucugcauacucccucuugcuagccguccaguaaaccuauggaucauggcauuaagcuagaccauuuguuuggaauuucucgcuuaaugugacaauaugcagugcacuuccuggaccacagagggauagacagcagcuguuggcuaagucauccucugauaggagcuaagugauccucuguuaggagcuaagugauccucugguuucaaaccuagacccaguugggaguucuucugaaggcugagugcaguaaagguuguggguggggucagagggcauggaguuuuccaugugugguaucauguuggcgcucaaaaaguuuuauauuuuggagcauuuuguauuuuggauuuugggguuaggaauauucaaccuguagcgcauuucuuuuacaaaccuucuccuacuccaauuaaucauguugaugggcaugaagacagcacauuauacuuuauauauauacacacacacauacauauauacguauaauuauacguauauauaauacauacauacguauaauuauacauauauacguauaauuauacguauauauaauacauacauacguauaauuauauguauauguaauacauacauacguauaauuauacguauauguaauacauacguauaauuauauguauauguaauacauacauacacauauaauuauacguauauguaauacauacauacauauauaauuauaaguauauguaauacauacauacguauaauuauaugcauauguaauacauacauacguauaauuauauguauauguaauacauauauacuuauaauuauauguauauguaauacguauaauuauauguauauauaauacauauaauuauauguauauguaauacauauaauuauauguauauguaauacauauaauuauauguauauguaauacauauaauuauauguauauguaauacauauaauuauauguauauguaauacauauaauuauauguauauguaauacauauaauuauauguauauguaauacauauaauuauauguauauguaauacauauaauuauauguauauauaccuaauuauauguauauauaccuaauuauauguauauauaauacauacauacauauaguuauauguauauauaauacauacguacauauaguuauauguauauauaauacguacauauaguuauauguauauauaauacauacguacauauaguuauauguauauguaauacauacguacuuauaguuauauguauauguaauacauacguacuuauaguuauauguauauguaauacauacguacuuauaguuaucuguauauguaauacauacguacuuauaguuaucuguauauguaauacauacguacuuauaguuaucuguauauguaauacauacguacuuauaguuaucuguauauguaauacauacguacuuauaguuaucuguauauguaauacauacguacuuauaguuaucuguauauguaauacauacguacuuauaguuaucuguauauguaauacauacuuauaauuauauguuuauaugauacauacauauaauuauauguauaauacauacauacuuauaauuauauguauaauacauauauacauauaauuauauguauauauacauauuauauguauauauacauauauacauuuuguauauaaguauauauaauauauacaauuauacauauauaauacauauauacguauaauuauacguauauaauacauauauacguauaauuauacguauauauaauacauauauacguauaauuauacguauauauaauacauauauacguauaauuauacguauauauaauacauauaauuauauguauauaauacauauacguauaauuauacauauauaauacauauacacauauaacuauguguagaaacaugcuuuaaaauuaaauguuauuauaaauuuggagauuguagauggaauagauuaaaauguaauuuauuuggcugggagugguggcucacaccucuaaucccagugcuucgggaggcugaggugggugguucaccugaggucaggaguucgagaccagccuggccaacauggugaaaccacgucucuacuaaaaauagaaaaaucagccaggcaugguggcaggcaccuguaaucccagcuacuugggaggcugagacaggagaauugccugaacccgggagagggagguugcagugaguugagaucgcgccacagcacuccagccugggcaacagagcgagacucuaccucaaaaaaaaguaauuuauuuaugauuaggaauuaauaaagaagacacuuaugcccaguuguuggaauuucuguaagucuucccguaaaugugcuaucacuuuucagacagcaauuauagacuccuuuaucagagucaguguuacugggacuaaggagaauuaaggcggagaagacugugccucugcuguaagucagguguggguucaaggucuuuaugcucucaggcugugcggccaagaucugaaaaguuaaacuccugucugccucaggaaugugcugucuuaauucuguaccggcuugcaccugugccugucuggcagccuguucucgccgucuuucccucauccuggguucuuccuaggugaacagcccugacuuuucgcaacucagcugaagugugcccuaccuuggggguccccgagucccccucuggcaugcccgugagucucugcucaccucccuugcagcccacguuuuauuguaauuucaccuuuccuuauccagcuugcucacacacucagcucuguauucuuagcacuggggggugccuggcccaugcaggcgugcaguagaugggaagugaaucucaccaccuguuaagaaaaagauaaguaugacugggcacugccaggagcugugaaggagugccuggcacaggccugcuggugcuuccccugccccacccacucacccuagucuugggcauggggccuuggggcugucuugcgugggcugggcuugggagucagauguugaaagugaaggcagaagcccacauggccggugcaggccaggguggcaccaggguguggaaggaguaggccauggaagaugaaaaccgggaauagcugggagaacucccugcccuucagcacagccgggagccgcacaguucuccaaagcuggaagaaauaguccaacgucuuuuuucgugccugucuggguaaaauuugcuguucuucaaagggugccuguaaaauaggcacugguggaaugaagggguuaaagaugaaaguuacaaaggaugggagcagggcuggugggaaaagaauccggggaaccgggaagaguagcuaagagugacaacucuaugggugggagauuccuucucuggaauuagggaguuugaguuucauugagagaacgaaaugucucucaagucuacauauuugccuggagcugacacuugguuugggaggggcuccgugggacccggaugcuggggacgcacuggccuugccccacugugcuagugcgucaggccagugacucacaagcacgggaaggcucgccccaggucaugccucccaacaguguuuccacccaugggucccagcagacacacacgaagcccaccaacucauuucacacacagccauccaaggaaccacugacccauggcaacuaaucauacucacaucugcuugcagcuggacaaagaccaaugaccuggaggugaagugccggucuucauggucauucccuccaggccauccuauuccccaagcaggaacauuuaauguccacccccguuuagugggaaaaagggaagaaaagaagugaaacaugagucaacaaaauuauaugacagggaaaaugagaccagaacuuuagucacauguuguuccuaagagaagccaagaaaacacccucauuuccucaaggcgugugguuucuugggagccuuucugcccugcaaacucagucucuaauugagaagcagaauagagcauguaccucacauguacaaaucuuagucauacuacagcacagagagagacauguuacauauuagaaauucacuguuucucacauuuuuugugcuuuuuuuuuuuuuugccaagaauguaucaacucuuguuguuuucaaauuagggcagaaauauuguguaacucuaaacaguaguagggacuguuuuguuucuaugucuuccauuauuaaauggaacagaaauauuauuuuauuuaccuaaguuguccuuucaggggaguuaaugaugaauaauuauuuucacaucuuugggaucacaucuaucuuacauuagucaaaacaaaugaugaugauaauaaaacaaaugcagaugaaagcacaaugauuuugaguucugugagaauaagggagagaaguuaauuuuaccuuuaaaaccacaauacuaaguauauuuuuggaaguugaaaaauguuaugcaaauguaagcuuuuaagaaaucauuauuuguacuacaacauuuggccuauauuuuacuguuuuuuaaguaauuuuuaaaugccauggacacuuuuuuggggagcuaauuuuauugaaguuuaucaacuuacagaaacauaucaaaggcgaaggguacagcucagugcauuuuccccaaagugaacauagcagugaacccagacuacggaccagaacauuaccagaaggcacgaagucccuggaguccucuucuagucaguagcccucacgaguaaccaggauccaacgucaucuuguucggcuuugacuuuuacaggaauggagucacccaguuugucuucuuuugugccugcuucagcuugcugcgggugcuguagcuggccugcccugguguggccggggacucccuuccgugaauauaccccaucguuucucagucccuugaacuguuuccagcuggggcgauuguggauagugcugcugugaacaggcuuaagcacgucccuuuuucucgaauuuuauugaaauacaacaaagugcaaacaucacaagugcacagcucgaugaguuuuuaccgacguauacacccguguagucaccgcccgcaacaagcaaagaauguuuccugcaccccagaaaccucccuugucccuaccuuugccacacccccgcagaaggucaucacaauucugacuucuuuuccccauagacagaugccuccguucuugaauuucauaugaugggaucauacagagugugcucucucuggagaaguuuuaagauucuuuuuuagggcauucuugggcccuggggguccauggagcuggggagagccauuuugcagagccucacagccaccgcgguuaaaacaagcgugacacaagcagcacagcggcaaacaggacagaagcuagaaaguccauucuccacgugcagucuuugagguuucgcuauccgaaaaaagugugagugccugcugcaucugugugugguuaucuuuuauucaccacaccagcauuuugugugugugaaugaaguggaauuuaaaauaauagaauugaggccgggugcgguggcucacaccuguaaucccagcguuuugggaggcugaggcguguggaucacuugaggccaggaguucgaaccagccuggccaacauggcgaaaucccaucucuacuaaaaauacaaaaaaauuauccuggcgugguggcccgugccuguagucccagccacucgggaggcugaggcaggagaaucgcuugaauccagauggcagagguugcggugagccgacgucgcgccagugcacuccagccugcgccacagagcgagaccccagcaggacgugaugaaggucaaugggguuuuguccaacuugccucaguuggagcaacguaccagugcgccccugccguguggccguggggcuuaucccugggaguggaauuugggggaaggagccggggccaggggccagggcccagcuacagcggaggcggcugagcgccuuccagaggguugggaaugucccgcucgcaaucccgccgggagcguguggggcccgcgcuugcugcguacucuuaauucugcccaaguagcccuaagauacagucucuugccuccauacgcuuauuuaguuggguagggaauuauuuaaaagacuccccgaggaagugcugcaaccaggaagagcccucgacggcaguaucaccaggaaaguauuuugacauuuuugcacagcauagggaaugcgagaaagaauuugaaagauaagcuguuuagacuuggcagaucuccacaugucccuauuuggugggaugugaaacacauaaaaauugugaaagcugcgauguuaaaggucuaucuuccaucaaaagcaggaaaaaaaaucagaaaauugaggaccucauccuguuuaacucauuccaaauaugccuucaucagaagacaugucccaguuaaacuguauaacacugcacccuucuccccucccucccucccucccucucucucugccacacacacacacacacacacacacacacacacacacacacacacgaguagcauagcagcugguauucuucgguucaguuaaaaaggcauucuguaaacagaaugagugagcuuuccucuuuuugcauccucuggaauggaauucacuguaaucuugagaagagcgcccucuuggucuguagaugcgagaaaaccagaaauaggcuuuauuucuuauuaaaaccauugacuucucuuccuccccuuucuucuuuggcacucguacuguguauuguaaaaucuuuguguauuuuaagaacuuaauauacuuuauaacgugaauacugaugguggaucucugaauaucuuaauuggagcaugaaagaaaaguuucacaguauuaauuauuuuaacauauccugaaaaguuuaagagacuuuuagagaauauaaaagauauuugguuuagggauuacuuuguaguaccuuuugcauuccuuucauauuguauuuuuuguuuucguuuaaagcugaucucugcuauugaaguuaugugugcgugugugugucugacagaguccacuggggacuauuauuauuauuuucuuuucuguuucaaacacaguuaagucaguuuggcuuccauuuggagacaacuuauuauacucuguaggccacauggucuauggggaagaggcuaaaaggacuuucaaaacugacuugguuuucauuaaguuugucuacaguuuuaggaguauaaauaauaaauucacccccaaccccaagagcuuucuaggguccucuuuuuccacauuggucugggguaccuguguugcuguuguccauggcuggucugcuuuuauaagagagaccgagacccccgccuuucuuuccuuugagaacucccagccauauuccccgucuuccaaguggagacugccuucgugacccacuuucauccucaugaccacucggguuaagugugugccucacaggagcacaacacaggcauugcuccaggaacuuggaacucauugacccuagaacaccaaugaggggaaaaccaggaagaggaugaguaccgcacagaauguaccaguucuucccauucuagaaucugaaacagaugguaugggagcuuaucuguagggucauccagacaccgggagaaugcagagcccucauaaaggcccucagauaugcagccagcagggagccgguggaguccaccagucugcauauagcuuuagauuuuucugggaguccagaugcaagguguauuuccucaggaaaugaugaaauggugacauagcuuuucacaugucaggucaccaaugaaauugugaaccuggguaaccugcauuauuuauguaccccuuuuaaacacaguaauuuacaacagugaauuaagacuugcauuaccugacuuuuauuuuaauucaccauuugaagcuuauacauuacaccugagugaaggggguacucaggucauccuuuguauuuuuuuuuucuuuuuagcagugaaccauugaacugcagcuaaaauaccuucauaugccagggugaaacccagcacgggcccuuauaugacagaaaggaccagaauagugauauuuuaaaauagauuuuauuuaacaaaguaaacauacaucuuaggauauuuguuugucauucuugucauucuaaaggcuagcuuuuuuguuuuuuuuuuuuaacaaaaccauuuacauaaaaugcuaggccacccagaaugugacacaaaaaucaugaucuuagacaucuuuuguucugaaaagcuaacccuaauuuagauauuuuuggaaugaucaauuuuuuagaauugauaaucaaauucccuacacacauaaagccaugcauguuuuugguccaggauuaaaaaaaauuacuugcuuaugaaaaagcguaagguggugggggaaggccggggucgggggucaguccugucucaucucugauuuuccccaguguuccuuaguaccugaagugguccccaggguaaaacuacccacccgccugucaccggcaccggcuggggguguuucuguaccaaaagcacaagaagcgucuugacccgaggguccacagucacagccuugcagccucuuaucugcagucccaggcaauggaagcauucacggauggcuuaagggcccaguuccaggaaauucauuuuuauaaccucccucaaauugcagaaagauaaagcuucugagauuuuaucaaccuuucagaaaacuccagaucaccaaauagccauuuucagcuucaaucccuuaaaucccugcuuaaucugcucuuucccagaaagcagcaauugacucacaagucgaaaauccacacuacuucaggcugguguugaguuucugccagcuaagcccagaugacugcuggacauuuccuaaauggacucugcagauacaugagacuuagccugguggguuuuccuuuugguaucuguaggagggggaugaaacacugcagaguuuaaagaacagagauguguuuccaaacuuggcucaaacgcaaacagguugugggcaguggcauaaucccagcaaagaggcugccccgaaacuccagggacuuggagaugaccuggugauggaauagcuggucuggacggcuccaggugucaggugccagaugccagcgcacuccccagaguccccggcucuucccuggcuacucugugaucuggagcagucagguaaucauugccgaguucccuguuuggagcuuugucccacagugcuguugugcacgaaugcacugugguugaggugcgcggugccacuggauuuccaucuacaguuguuacuuaagguugcuuagauggguaacaccaguaacagcaccaagaauacaaccauaauuggguacugauuucaucaauucuaagaugugcauuuauugauguuuuaacaacucuggaauugggauagaucuaacaauugauaaugugucauuguuuaauuaguacccuucuugauuucuuaguauggguuuuacaauuggugucgucuuagaugaaguacagcucacaucaggcucaaugcuacgggagccuggugugagcuguaugugaggcugccuccaaagcacucaggguguaccggggagacacagaaguaaacaacgagaaacgugauaagccugacaauagagacaugcagucagcaauucgcaggagccagguagggagcaggugacccucaccuggggauuagacacaugguaguacuggcugaguuagguaccucuggugaggucucucaguacugguauuuguccauuuuggaagaaccuccuggagcacagguuacagauuuuggccucaucucuuuggaugccucugaguggucaccaaaacccagauuaugaagcaaaucugugcacauggauugauuuaaaauguuaggagguuaugagaguguaggcugaaaauugccuaaaaugugagucagagaaaaacacagaccuaucaucucuggaguuuuuuuggacuguugucagcuguccccauuuccaaaauauaaaauugagaacagcuuacugucuuggaggcacuuguucagauuuagcuuuacaaaauaaauaucuccagaugugauuguuuuaugcaggcgucuccauggcaaugcagcugaggcuggaauauguuguuaaaaauauacacuuugcaugaucacaauacuauuaguggcaugauuuuauuuucaggaaaugauaaucaccugaaguagaauauaaguaaacauuuuauaucagacuuaaagcagagccucuaauaaagcuuauuaacccgauuauucaucucauaccucuuuacauucuguccacaauaccugugucugucaugguuuaaaauugggauucuucuaaggaaauugcaagugcguguauguaccgacguauuucuaucuuuucaugugaugacaauuuuacauaauggaaauugaaguuggguucuaauuucaacuuuguccuagcguguuauaauaaaucuucuaauucaguuuccacaucuguaaauggggauggcacuaccuaucuugaaaugcuuguuaugaucauuaaauaagaugaucgcugacugugcguggcaccugguaagcguuugaacacgugguagcuugcuuccuuuccagcuuuuaucacaggcuuggauucauuuccuuccauuuuaaaaguuaauuuuuauguuagaagugaacuacaggcugggcacagugucucaugccuauaaucccagcacuuugggaggcugaggcggguggaucacaugaggucaggaguucgagaccagccuggucaacaugaugaaaccccaucucuacuaaaaacacaaaaaauuagcugggugugguggcggaugccuguauuaccagcuacuugggaugcugaggaaggagaaucacuugaacuggagagguggagguugcagugugccaagaucacgccauugcacuccagccugggcaacaaaagcaacacuuugucuuaaaaaaaaaaaagugaacuacaagaauauuuuguuguugacuguucuuuaaugugacguucaagcuuuaauugaauucaaaaaggaguucuuuaagauuggggcuuaaaaaucagcucauuccuuuauucuguucuguacaaacuuuuuuuugcgcggccguguguccuugagaccacgucauugggagcucucagccuccacggucuuaggucugacaccucuaaauaagaagcaugacauuuggguagcuuugcaaauauggguguugcccuguuaaacuaauccccgagggagucaacuucaaauagaaauuaacaaagggcaaaaaguauaggugacauuguucacuuuuugggcugaguaacacuugggauuuguucuacucaaggauuuuuuuuuaucuauuugggcaggggaucugcacccuaaguggaacugcaugacagccccaugaaaaccagugcagauaagauuguguccgaaggacagggcaggcuucgcucauaaacaagucaagaugccagaaccaucuccauuugcauagugcccucgcuuugaaaguguucuucuauuuaaagaaguuuucuuuuccuuccaggguggcugugcuggcucuggcuguggcaaaugugacugccauggagugaagggacaaaaggugaguugccgaaauuuaaaucacaacauuucuuugugaauuggacaguaaguacuacauuaacaguaaccgaauaaucagcaauucaggugaaagccuuauuacuguuuugauaauuuccccagagcaauacaaaugaagccaaaccaggcuugacauuacuucugaguaguaauauuauuauaauagcucuucuccaaagaauguaauaguauguggcaauuaauguagaaaaacauauuugguuuauuuuccuuuuugacucuugguagaaaaucuguugaaucuaucguacuuuuucgaauugauguauaagaacuaauuuuaacauuuuuccggaaaaagaaacuaguuccuauucuacuugaggaccuucucuucaaauuaguauuuuuaaaccaucuuuuaauccaucacaugcuugucuagauuuauuuauaaaaauauugcuugggaaacuuaguguuucccaaauguaaaauuaaaauguauuucuuugcaagcaaacuguuccccucccuuucauuuaagaaccagggcuccagauaaagauaaguuucucuggaaggcaaguugaaucugugcauuucaguugguuggaaagagggugccuggcuguuuuuuuauccagaaaacagugcagcauccugguacugucugugggucaccguggaaaccagguguggcugugaggaaaugccaccaccuuaagccacucagccuuuggugcaggugcgcacagcagguugggacccuguagaauggaguggauacucuguaggauacuguuuccagaaagcugaaggugucauucuggcuagcgugugaauucuuacuucccuccccggcaugccagagguuuuauggggccacagacugaugcuuucgaaauucagcaaauucuaguuuacagaaaauucugugguuucuuuuugacuauuugcugaaaugccaacauuauuauuuuaaaaaauaugccugauaggugauggcacuaguguuaccuggauaguuuuugaaugaauggaguauguaaggaaaguuucacaucuuuucauaucaacucuaauuuaucuucaugcucugcucucuuacuuuggauuuuucuagcgauuuccagugugcaugcucaagaguuauuuuaaaguagacgcaaguguuucucaugccacagacauuuuguuaaaaaccuaacuugaaauauacaagugaguucaccaaacucauaaaaauguccuuaaaaugauaaaauggagaacuuuggggucccaacaaagaggaauuaaggccuggaucaugauuaccucuguuuuccaugugacuuugaaagcagcagggcuggagccaaguuggcccugcucccuccuagggacagcaggguugauguccaccuccauuuccauuugcuucuguccagccggcaggccuuggcggccccuccuggcucuggagcuuuacauacuuucuuauucuauccgcaucuauaaacuuauauauauuuuuuaggccaggcauggugggucacgccuguaauccuagcaguuugggaggcugaggcaggaggaucacuggaagucaggaguuugagaccauccuggccaacacggugaaacucagucucuacuaaaaguacaaaaauuagcccagcgugguggcacacaccucuagucccagcugcucaggagguugagacaggagaauugcuugaacccaggaggcggagguugcagugagccaagaacacaccauugcacucuagccuaggcgacagagcaaggcucuaacucaaaaccaaaaaccaaaaaccaaaaaacuuguaacuuuuuuaacguaauuuauuucaguuuuucccaaaaauccacucaucaaaacaugacaagggagaaugauaggguguagccuucccuaccugucaacugacaucuccacaaccugguaacaccccucagagccaagccgcuuccacuccgagugggcuacacauguguggggaaggcaggggaggcgguguccagcaccuggccugaaggaaaggggccgccaacauuucaucucaacauugcccaaggaggagcccuugcuggggguggcccccucuggccaggcgaggucugugccuguccuggcuuggagccugcguggggcuugcgcccugcuuaggacaggaaggcagagaaguguggggccacguggaaguugugucccgagggaggcuccaugccagcuuccuacaggggccagcuuuagccuugacacugggagucagcagagcccgggccaggacugggauggaaggagcaggauccugcuccccuccuuguguggccuuagccagguuucccaccaagggaccuaggccagggagcccagcaccuccaggacuuuuuuggccugaccugcuccucuacacuccuguuucuccauugccaacuuugggguucuuacuguuuuuuuuuaauuuuuuuuaauuccauaaagaacauuuaaaauaaaaugcuagcaagcucuaccuuagaccauucugaauuugugauuuaaaaggcaaugaugauugaauggauucagaagaccucuugaagucuaggccuaggacaauagcuaaaugguuuaguauuauaucauuuuaacaaaaauggagaaggucuauuuuuuucucaucuugagcauaaacauuucagguccuaugguucacacagcauugagaaggggaaagagcccuuccucccacugacagaggaaauuuuaaacaaacuuccccuuauugucuuggaaguccuguuaaaauaaucaauuuaaugaugugaaaugccucagcuucacugagcuaggguuuccgaucugguucccuuucucucaucccaaagucagcuaagaaagaaauguacucuaggcuggcaggucaagagaagaaguggaucuuccucaguggcugccaccuucuaccuucugcacuuccugccaccuucugcauauucagagcgucccagcccuagaaaugccgaccuaguguaaaaacaaaaugacuaaagggguuggaauaauggaauacaaaucuacugguuuagaucacuagucugcuuaugagcugcaacugaacgccuucuauccucauagaaauuauuuugauauucucaaaugucuacacauuaaauugauuuugauugguuguucuuuaaacaggacaguaggaggcacagcugagaugcaguuaaaguuaccaagcugggucagaaugucacagccuuagaaauuuggaaauuauuacuucuaagacauauuuucccacgucucuuugaggagcacuuugacacuauuauuugcaaaccaucaguauccucaacagaaacuggaauaucuccaguacaaaucucuuuugacuaaguucugcuuucuauggcgauaugacagaauggacaaaaugucuuauauucuguagauacuauaaauacauuuuagugcaacagaucauugcuggcguuauaaucucauaguuuucaaguaaucaauaaauacuagauagcuugaucugaguucaacaguuaaauucagcagguuucuacuggauuucagagagucuuugcugaguuguuuauuuucccacuugcuuggaaggccacucauaucuucagauguuuucuguuagguaauuaauuuggccuugcacacaguggcucugugcuccuccagagacugcggcagugugggaaugcugucugcuuguacugauuaggguuuugaaugcuugccuucacagaaauagccaaaaguuaagcucuucuuuugagugauaauuugauuuucucaaguauuuaagauaguaggaaaggcaacacauucccagaaguuacugcuauaugcuaaggaaauuaaccauuuauguuuugcuaaaauagaguuuacacaagaccucuuucaaauaaucuaaccugggagcccacguuuccauaacacuaucaccauagucugugacccugcaguguccaaaaaagggaauuuaaaguuaaacuagagauggaagacugguguacauaaauaacaaggcgagaguaaaccaucacauuccaggagaaucuguugggaaaacaaauacaaaagucuuucugagaaggaagugaucccugggaccuggagcauaaaaucaagggacagcuuccccaauucagcaggaccccagccucucauguccucacuaauuugccaggcuugcuuagauauagacuagguucuucugucacacguacaugugaagacacauguuaauugaacugcauuaaucagagaaaacagcucuugggaccagcugauaaaugcugucauagcaaagauuugacgguuucuacuauagugacuccaaaaagggacauucccaagccacagucuugugagcagagucucaauuaaguagaauuguagcauuucuagugaguagugacaacuguguggauaucucauaccuucuuguaauacuuuaacccugcugauacccagauccucagcaaagauauagagaagcagcacauuauccuguuauuacuaauuagauugucuauaaaucacagcuccuguccacauuggcucugcauugcaauaauauugucaucagauagaacaaccaagacugcuuuccaagcagagaacuuugaagauggcauugcuaucugucugucuaaaauguguaucuuaucugauuugaaaaggcuggagaagucuguggccagucuggaagugauuucauugcuggcccaggaaaucugggaagaguuuaaugucguguauggcugagcuuguacaggauacccuuucuuuuguuauggcaaacaguuuguagcuuuaccagccauuuagcgccuagauauuugacacaaucgguguauguccaugucacaccuuuguauaaaccugucucucugcaucucaacauuuggcuauagcugcugcuuuuacacaacggaucuaggcuaggauagaaaaauccuggcuugugagugucagagcaagaaagagaaagagacuguaucuugggccaggccuggggccgaguauguuuuaugcacauuauuguaauaucuauuauacaguggaagaaaccaaccagcccgggcuuuuuccacuuggugguauugacaguuugagugggauaauuuuugguugugggucuguccuguccauuguaggaugucgagcagcaucccagccuuuacacaucggaugccaggagcacccccaccccagcagucgugacauaaauauaucuccagcuguugcugaaugucuccuggcgggggguggggggugcagacucacccuggauggaauaccgcugaacuaaccccaucuucuauagcuaauaaaagacaaauaacaggauucaggcacuaaccagaguacgacucaguuucuacuccuucagauaagcagacccuaaucugagggagucgggccagcugaagacacggcucagaauauccgaagucuugagcaaguuccuuuccucuuacugacucuguggcggacccacugcgccccaggccaccugccaaggacagcaagccuucugaagccuuucucuaacgggucgggacggggaggacugcuggaggaccacaaagaaaugagccuacuccucuggggcccugggcagaccucccaguuccuguucuacaggagucaacgugggccuccagcccgguucaacaacuaacccacagcgagccccugugugugacaaggggcaggucagccagucagcagccacuccugccccauuguccccuccugagacagguuaggggugcccagcccaucaaaauaugcaucccaccccauucuggauugcuuuucccugugcauuaggaauaaaaccucucuaaggggaaggcauuuugaaguaagccuguuucaggccugugagaggucugcagaaacacccccagcgugagcacugggucaccccacagccccugccuuucggaaauccugguguagaguccgcuccacaaggagcuccuuccucuguuugaaggcuggucgucuucacugugucuccgcgauuacccaggacgugggcauggccaugcuucucacacguccucucuuugacucaggaucaucgacuugugccucugccuccuccacaucuggaagaggcaucuucuuuucccuuuucacaggcuacuuagagcuggagagggauugugucugucaauccuuagauacaugauuaauuaaucaacgcauguuuuucaguuguuacuuugcugggcacuuugagagaugcaaaaugagcacucuuaguauauuucucucaaggacauacaaaauaagaagaaaaauauuaucuguaaggaauaccauaaaucuaauaccuaaauacaagaagagaagaggacagauuuuccagucuguugaauuagaugugccauuuuacauugauuguuuuuuauuagcucccauugccagagacauugcaaugucuacgugauaaggaguuuaggcuugagcuugcaugcugguuuuaaacacaucaucuacaacauucuagucguuuuugugcuauauuguaacaauugucaaagugccuuagaaucuaacauuaccuuuaagguaugggacucacuuuuuccuaagaucauaaauuuaggguauuuucauaguuguaauuaaaucuuagaugaaauuccuuuuugagacagggacuguacuuuauuuguauuuuuggagaauucaauaaucuucaauuuauaaauauauuuauuuccaugaucuuuccucuaauuuacacauggguaacaauagacauaguuuuagccauguuuucauuaugaaauuaaaauauacaaggacagagugcuuuaaauauuccaccauauagauagauggacuggcucuucuccuguuauuccuuguuauuccuaguaucuguguagaauauauuugcaucuccaguaauuauuaaagaauaauaauuaccuucuuguaugauuaucuuucuugcauaucuucuuuuuuuuuuuuuugagacagagucuuacucugucgcccaggcuggugugcaguggcgucaucucagcucacugcaagcuccaccucccggguucacugguucacgccauucuccucccucagccucccaaguagcugggacuacaggcacccgccaccaugccaggcuaauuuuuuuguauuuuuaguagagacgggguuucacccuguuagccaggaaggucucgaucuccugaccuugugauccgcccgccucagccucccaaagugcugggauuacaggcgugagccacugcgcccggcaucuucuuucuuuuauugcuguuuuuaacagaauauuaaaaaauuuuuccuauaaauuauauuaaccauuguuuuaaacguuaaagguguuaugcuucuuagauacuaaauucuuuacucaagcacaugaaagcaaauauuuuuguguagacucuuugaaacuuuggauaaguucauucauuugaacuaauaauggugaguuauuaauaauaacaguaauuuauuaaguacuuaauaugugagacgcacugugccagauuugacuuagugagaauuucaaaucuagucuauuuaaaaagaaauucaauuuucuuacuuauaaggugugaaauauauaccauaaaaucaaaacgcauuaaaaaguguuccuuaguguacaauacuagggggauuuaaaaaauaaauauaagcuuuguuuagguagugcauuaagcauauuugagauuacuaauuuuuugagaucaauugaaugccuuuguuuauacauguuuugaauauuccugagagacaauagugucuaguuuagccuuucccaaaauaugaucaucagaccaucuuuaggaugucaacagauguuuccuccgggauggaaacgggaagagguuccaaggacacaggcguuuggggaaaacugaguucagguuaaauggacauuuguuguuuugcccugggaugucucagagccuguaauaagauaguguaucaucuggaccuuccgugggugcugcgucauauacaguuccccacacuuauuugaacgccccccuguuuuuuucuuuuucuuuuuugagauggagucucacucugucacucaggcuggaguacaguggcacgaucucggcucacugcaaccuccaucuccuggguucaagugauucucacgccucagccucccaaguagcugggauuauaggcguguacccccccaccuggcuaauuuuuguaguuuuaguagagacaggguuucaccauguuggccaggcuggucuggaacuccugaccucaagagauuugcugucucggccucccaaagugcugggaugacaggcgugagccacuguaccgagccucugacccuuuuuauuucugaagccaggaacggccuuugugaaagaguggaucgguggauaaaaccuugauucuaguguaaguucccccaucuacccacuguuuuucaccaaguuguuuugaccaaguuaugcccugaccuggaaauuccccagaguugcuaaaagaacugaaugggggauacuguacauaagagcacuuaagcaacuuaaaaugucacauguagggacauaugcgugucaugugaauagcagcugcauuuugaaguugcaauaagugugaggaaaaugugcuuguuagcucagcucuagacagauccauggauagaaagacauagacauggauccccauccagcuaaguauuugcaauccgcaggugaagccuggaaacccagagaaauggaccuguuccauccgugacagaagcgcucccaggaccuaaauuaaagggauguuagaauguuuugagaaucuuggcagggccauuagguaguguuuguagcuuuuggaugcuuuugguggagggaaaaugagaugggcucacuugggaggucugccugcaguuuccauccaaauuucuaaucaacguugugguuuuaucauccauuuccggaaucauuaccccuuaaaaugugaggaaaacgacucuccuuuucuucaacuccccaacuuuuccaaauaccgcugcgaguuuuuguugccaacagcuuuucccaaugugcguguacuuaccaacguccagacuccucccucccaucggccagccuugcuuggucuagcuauuauucaaaggggaacaugcgugagauaucacuucguuuuugccaucuaauggauuccaccccccaaaguaucugacuuugacacucaggcucaucugcaggacccgagggugucuucccuccccucccguuggcuggcuaaauggguuaauagaauacauucucuuuuccuuuuccguguuuugucuggcguuugcaaugccaagauuuuuuuccagauguccccuauuuccuauuuccacauaccgcacaugaaucaucaucuggcagaggaaucgugagaauccaugugaucagugugcguucccacauucaccuacuuuugucuuuuuugauaguucuuugaaaacaaugaauuuuuuuaaaaauaugccugaauucaaggguaaaauaucaacaauguacccuagaaaagccccuggaagcagaucuaugcuaaaugguuuauuuuauucugcacacgaggcccacccgucgcuggcuccccuaugccuuggacgucacugauacacacacaucccguucccgaacagggagagugagcugcacauucucguuuccagcuccacuuccuaguucugcccaccguaaaaucugcccuuuugccaugcgcugugggaccuguuagacucaggagagaccaucauacaaauugauggcucuugauuugcagcuguaucuggagcuuaccgaaucuagugcagcuuuaaaaauagggagccgauucuguuuccaaguucagaaggagcagcagaaaaugaaguaucucgaauggcagaucacaugccaugacuuuuaaagcccagagcacucuccaggaguacaggcugucauugguguggcccagcaccggcagccucugucccgacuauuuaugggaaaaaauauuuuuuuguaaauaugaucuugacaaaacauuggcuggcaggaaaauagcuuucuuuucaggggagcaaaaugagaguguauauuuuaauucaagaucaaagacuuaacauaaaacaaacccugacaaaugaaaacugggcaaugggauuuuccuccuguuuguugguagaauauuuugagcauucaaacacguuucuagacagcaaguugugaugcuagauaauuagguaguguggguguggagaacugcacgcucaaaaaugguauuaacagaccuucauccuugugaagugguuuagcacaaugugcaauuaaacaaaggaagaauuagucagaguuaacgagcaaaccagauggcucuggggacguggugccccuuugucagauuuuucuuccuuuggcaaauccauuaaacaugguaaaaguauacuucauauagcuuagcuuugguucgucacauaguuuuaugaguuuaaugcuaacuggccccaaauucaaugauucuggauuuccucacaugagaaucugacacgagaagcuaacagugauuccuggcuaauuucuaaaaagcuguagugaaaucagaaggguuaaagacccuugguacgguuucuccuuuauuagauauuuggacaaauaccugaagguaaugaaugauagaugugaauuucuuacacacgucuugcuagagcuugaggacuuaaccagagaauuuucugugggcgucccgcuguagcauguuagggccuuagguuaauuugcccuccuaggugagaaauccacaacccuaagacuugaguacccaagucuguggcauguggugacaugcuugauuuugaagugguuuucccuagaagauugguaaaggaaugacaucugucuauaguagagccaguaaauuccuugagcuggagaaccaauguccacucaucccagugccuccuuguccugugggcuccugcuguacccgugggccuggguaguggccagcggcaguccuggagccugcccuacagguucaugauggaagaugcuagccaguaauagcacaacugaacccccaagugaacacucugcuaagaccuccagggagggagaaggcacggcugcgagaauggauguccaaugggaagaaauugaucugcagggggcagggaagggcaaaccgaacggucauucgcaggccccaaaagcucaggcagccgcucaggugcgguggcccaugauuuacgccuccaaauuccauuucccuguuugacgucagguuuuucccgauuuggaaauguuggugcuuugagaaauguccauggacaacugugccuccucaccucccccuucucacuuccacguacaagacuccagaauguuaaaggacacaucuccaugagugugaaacuguuugucgcuguuugacucucuguguccccauguggggcuccccagucucaucgauauguccugggcaagggcaagaggcaccucgguggaucuuguucccacacugacugucuccucaccacgcgggcuggaaaugcuguguguuuuucugagucagggcuuugggaggcagcacccugucuccagguucuuggaguuuuauggaugcaacgucauuaaucauccugacggggcugauguggguggcagguguuggguucugccuccugauugggaggaggggcugggugcccugcccugaaucugaauguagaggcccuggguaaacgggugugcccuguccugccuggaccacacaucaggagcccugggagcagagguuccgggcggcuggaggccuccuugcuuccgccucugcacguggaaccugcauuucuucacaggagaccguggcuccacagguguccugccugucagggcagaggaacauaccacggggggacuuccagcaaacgugaggaacagcacgcuggcgugacuggggcagaaagcagagugguguuuucuucuuugggggccuuugauagggaccugggcaggguguggugggggccggaggugcaguggcuucugcaggaggcuggggaggcuccccguggucuuagaggaggugcaccacccgucccaccucacucgcccccuuuacccuucuucccuuuauaaaauuucugcccuuucuguuccucccaccacaauuucccauccacuuuuccuuucucucuguucagggcucauguacaccugugugauuuuccagggugucacgacgagcccugaugacccgcgccugccaccugugugcuuuguccucucuacuucacaugugugcaugcacacaucacgugcaugcacauaucacauacacgcacacaccacacacauacauauacacgcaccacacacauaacauauacacacaccacacacacauacauaccacacacaccacuuacauauacauggaacacacaccgugcacacccacaccacgggcacacacucacacacacacgcacuuucuucaggaaccucccagcccucccccuccaccacguggccugaauggagcccuccucguccaccuguuuugggcuugguucugcuccuuuuuccugagugggggauuuuggagggugcugcccuugggcacucaguguggauuugaugcuguggaaggggacaggagagcuggugggccaagcugggagggcaguuaccguggagugagagccaaggccagccggcagaagucacccacaagagggugaacgucggaaguggggcccaaggaaauuacugacauuuuacagggcagaggcauagggcuuuuucuuuuccucuuagucuccccaggaugcuguaauaggauaccacagacugggugguuucagcagcagaaguguguuccucccgugcuggaggcuggaaguccaagaucaaggcuccagcagauucgaggucggcuguggaccccuucuucauaggcagcgcgagggcgggggcucucucuggggucuuuuuucuaagaacacuaauucuguucaugagccucaucacuucccaaggccccaccuccaugccaucaccuuggggguuagaauuuccacacaggaauuuggggcggggcauggacauucagaacacagcacuuuuauuauccugggaugcaggacacguacagugauguguggcgacaaaaugcaucccagcuguguuuaaguaacuguguaauuggcuggaaauuucucaaugugaaaaaauucgagucauucagauuuaaaguugaaaaccuccuaagaggaaagaguugggacucugaccucuaaaacccuucuaaauguuaguguccucugaguugagaucuuuccugugaagcuggagguacuucaacacucuacuguuacuggccuuucuagagcaaaagcuauuuuacugaaaagaacuuugguaugcaguacaugucagaacuguccacucauuugaagugaaggaagaucaggcccauaaugggugauuacuucacaagcagacauuuccucagugucagcuauguuuucggugauguauucugaggaaaggggagcggugacucugcaguauugagccaaugugccuucauccucccugucucuucacaucugcugaugggaaaaccaaaguuuguggaauccccaaugccaucugguuuuccuccccuuuuucuuuucugaaaaaucacguuccaaguugaagcaaucauagcugggaaauuuuguuacauuuuccucacugucugugguuuuuuccauucgcuaaucaauuugauucuccauauuuuauuccuaaaaucauuuuaucugggcaugugaaguggacgcuaguacuugaagucacucuauuuaaaucuugccugacuuucuuaacuagcuguucugauuucuguccuccucuagagacaauugaccagaugccauuucuuugggcuuccuauuggauaaggccgugaacccaaagggagggggaaauagaugauaauuuaggaacaugggaguugguauaagcauccguuuccuuuccugucucacucauuugccuuuaggaaguuauaucguuaauccuaaaugugugucuucccuguguuucaaagaagagucccccagccuggaggcugcucauucgcauucugggucacguguucccuuccaaggcuucccuguucucccugccacuuggagggggcgcaggagccgccugcugggugcgacgggccagaaguggguagugacaggcccggaaguggguagucauuaaaaacuugccuugcacggaagcuacucaguaugugcccuucaaaauuggauuuuuaaaggaaucugcuucacccagugacagagaagaacacacauguucuuuuccauccuguccaauauuuuguuccugauguagaccccccccccgcccccgcaccaccacuccucaggggcauccugugcuugauagcggggugucagcucuggaagcaugugggugauuuuacugcagaagcacguggcuuggcaggugcuccgcgauggucccgcccagcugcgcuuccugaguccuguaaggcgcguguaugucccugugcaucccuuucccaccugucaccgggcaccucuugcccagcgagggugacguucaaaugggcaccugaggacugugugugcagcgagguguagcuccacccaggaggguguauuuagggaccgcagggaccaggaagggcucugggaucagcuccuccacagcgggccuccccggagacccgagacagggcugccucccuguccuugccugauuuguuaucccaaaauucugggccuaacccacggcaggauauuuauguggaauaucaaauaguuguuaaaaagaugacugcuuucccuguuucuucacagaacgugcugauucucccuguggagaaccaagggugggcaccuguagguuuagaauucccaugagagcucaguuuccaccaaguuggcaauuguauauuugggaaucaagggaaggccauuucagggugcauggcugacuggcccucucuugccaaagacaaauugccucagugaugugucccagaccucagacccugggagugggaggucugggggcgugggaaccaggugcccccaaccugccucuuagugaagcuucucucucuuuaugucucucugucucugucucuucguuucucucucucuuucugauucuguguuuguguguguuugugugugugugugugugugugugugugugugugugugucuaccguacccauacuuggucaucuaucgcccaauugauguaacuuaaaaaaaaauccauauacgugggaaaguguaacauguuuauauacucuacaaucuauuuuuauuagaaaguuuauaccucauaauuugcaaacuguaacccaguuggucuguuuccacaucuuaguuucuagccgaagaucucaauauuuuagucuauugacauuaaguaguuaagaaaaaaaggcaggaaaugauacuguaaguuuaaucuuuaaaacgucuacaaaguaggcauagugaaaauggcauuaaauaaggucuuacugauagaaauuuuuaaauaauugggccacaccuuggauugaaauauaucuccauauuaucuuuugaaaacaggcuugccaacuuuaugaagagcauugaggugaagagagauuagcagcucagggaagaccauuuuuaaguauuuaugaaguagcuauuuauugucuuaauuaagcaccgguauuuugcauugaguuugcaauuauaugcuuuucuuaucuauucaguuuuaaaaccaagauuuuaagcaaaacacaaaagaaaaaacuucaagauguuggcuuaauuucuuucuuugggugacuguauauguuuuaaaggaauuaaugguguuuacuuaaaagagauuaaaauucaguuauuuauuaauuuagauugaucucacuacugcuuuuucaaauuaaugagguuaggcuaauaguggguuuuguaaaaccuccagcucugcugagauuaccuuguauucuaugggcaaaguugguuugucuaguuuuaaccuggcaauuguauaucugggagucaagggaacuguucuuaucucuuagauuccaaguaugauuaauggaguauugaaauuauugcagcaugcugggggaaaauguuaucagugauaagauacagacaaguaacuugcuuggggguaaggaaguaaucuggggauuucagaccgguguaugucguuagcuacuuccaggcuaaccauggaggagugugguggcuuuacuaagacccaggcugaccugacagaauaaauggaauguucuaugcuugaacugccugaauuacagagauauuuauuaaggaaaaaacacaaaaccuugaguauaagauaaaggggggaguuucuugaaacugucaucuuuuuuaaauacucaagaaauuccaauuuucuuaugucugucuuagccacaaaaacaggaaugagauacuuccugggucaugacuugugggaacacuagcaguguggccuuuucauucucuuuuaaaacauucuguggcuucagaggaaaugcagcuggcuuguuggacauagaaaucgugagaauaaacacaaaauauuuacguguuuaaaaagcagugaagucagaccaguuucuuucagaaccauuuguacagcauuuaacugaauacuugagcacguuugauuuuuaaaauaaugcugccagguaaaacaggcagguggagucaucccugacuuacagaugauggcaaagcugauuuucagagcgucccagggguuggcgcuggagccagcaccagaauuccaggcuuagguucuuugcccauccaugcagugacugaagagagagcaugaaaagcagggcgcccggagcuccgcgugcucacccggagugcaggugcuuguuuuugcagucauuugaaauuaagauuccuaaaucugcacccucuuguagauuuauaucauuuucuugggaucuuuccugagucacucaugaaaauauuuuauuuuuguuuauuuauuuauuuauuuuuugagauggagucugcucugucacccaggcuggagugcaauggcaugaucucggcucacugcaaccucugcuuccuggguucaagcgauucuccugucucagccucccaaguagcugagauuacaggcgugugccaccacgcugggcuaauuuuuguauuuuuaguagagacaaguuucaccauguuggccaggcuggucuugaacgccugaccucaggugauccacccgccuuggccucccaaagugcugggauuauaggcgugagccacugcacccggcccagucgugaaaauauuaauugaguaccuacccugugccaucuguucgaagugcuggggggagggaacgagagggaaugccagucacugccugcuggguuccagcaucuccuggaggugcuauguacgcggcucugcacacccuggcaagggaaccgcagggacuacggaaccacucagaggauggggacccuggauguccccuggcagggcaccuguaaaacccaauuuugauaaauaauuauaucuaacacauuuuuaaggaaaaaaaaaagaaagguuuuucuuaauugccaaugagcaauucucucaagguuuaaaccugaagacugucuugcaugcuuuuguauuauuaacuauaauucuuaucuucagaguauuucaucugcaauuuucaaguuuacuuuuaucacagaccaaaaaaagaaaaaaaaaauccaucaccuaccuugugguguuuccugccuuugcuguguccucguuuuguuccacaacgcugccccacacccacauacauuauuaaguucacguuaauaacauccucggcugucuaaguacuuaggcacuaauuggcauuuuucaacauuucuguuaauguagaacaugucuuucgaacccucaggggccuugcuuuggagcuaaugaaaauaaagcaaagugucuuuauaagaaaaaaaauuaggucaggagcguuggcucacaccuguaauaccagcacuuugggaggccgaggcuggcggauuaccugaggucaggaguucaagaccagccugaccaacauggugaaaccuugucuguacuacaaauacaaaaauuagccaggcaugauggugcacgucuguaaucccagcuacuugggaggccaaggcgcaagaaucgcuugaaccugggagguggagguuacagugagccaagaucaugccacuguacuccagcuuggaugacagagcaagacuccaucucaaaaacauauauauuuuuuucuuauacaaacucagaagagagcuaaccucuuauugauauuuuguuaucaauuauuuauguuccugcagucuuucuucuuaccccaaaucuuuuaacuaagucaugaccuagaauugugauaaauuucauggaacuucaaaaaaaaagacgguugugcuggugagcagaggcgugauuucaugugcagacucucagcaccuccuaagugugaucauuccugcaauggcuggagcucaaguuggaagcauucauuuaugccaugugcauuucuaggucuuugaggauaguauuccauauauauuuuuuuuaauggaguaaguaaaauccaaaaccaaaaguuaaccaaaguguuggcaguggugacugggcauuucagccccugcccuggguuagggcucucuugagggacauuccucaguuggcuucccaacucuuggcaggucaguaccaagccucuaaagucuacacggaggcugccucuugcuugguguguccugccauccuuggggugucacccaggcaggaacccccagagagcucugugcaacuuauuuggaggaugguuuugcuaccacugggcuuuuuccagcuuugucauauuagauaaaggccuccugcugugccaacaccuagcuucgguggcugauuuuggccucugauugcugcagugugcaacaugcacaaccauccacaccguccauagcugcagcaagugagguuccaagccuguagcagaacacuuguuuucuguacuguuuuucucguuuugaagauguuuuuaaaaauauauauuugagaaacagaauguuagguaguagguuuagaaagaggcaucugugauuuugguuuuaaugaguguucaugcugauagguuaagcaaaggagagaauguuaucaucuuuuuugggauccaaaaaacuggauagauuuuuuuuucuuuuagaauuggcaaaacucaggagaauggacuaaauuaccuuaaugcauaaguuuucuauaaacuuauaguggaagaagaccaaagaagaaccuuuacauaaguuuuacuggcagugggauguuuagcagugguuucuuagagaccucccugugauuacauuuguaucuauuuuaugcaugcuuuguagaauguaauuuuuucaguauuuucuauuuccauacagcuauuuuaaaaauugaauuugcuauuuuuucuguauugucauuagauucaaauacucucccaauuuauaaaauggaugugaaaaugcuauccagaaaauauccaucauucucauuauuuauaggcugaccgcauuuaccuguaacgcaauagccucgauauucagguuacuaguuuuuauauuuaauuuuaauuaaauuuugaauccuaauuaaaaauauuuaccauagaguucuuuuaggccauaucaaagugauuucucucacuccgcccacagaauguguucaauggcacugaauauuuaauauuuuaauaguaauauauuacuacaaugaauauuuaggaaaaagccuuaauucuuuuuuuuuuuuuuuuuuuuuuuuuuaaagcagagucuggcucugucgcccaggcuggagugcaguggcacgaucucggcucacugcaagcucugccucccugguucaugccauucucuugccucagccucccgaguagcugggacuacaggugcccgccaccacacccggcuaauuuuuuguauuuuuaguagagacgggguuucaccauguuagccaggauggucucgaucuccugaccucgugauccacccgccucggccucccaaagugcuaggauuacaggcgugagccaccgcgcccggccugaaaaagccuuaauucuuuaagguccaccagggagguuuaguuuauuugggggaaaauguauagucccagagcucccucuaguggcgagcagcugcagcccacggagacuccucacccaagcccugauugaggccguugguuccuccgcccgggccugucacgggcuggauccacugucugccagaguuuggguuuucuccagaucauucagugucugaguacuucuucaacaagggggugcuuggcugagaucccaugggugugucugaggugccagggcccgccggggagggugugaaugugccuguuucacaugaaggcagcgcucucgaaugugcugaggggugccagggcccuggggugcugcugugugggucgcaggugccuggagguggaugaagggugggugucuacggacgccccgaccaggagcuuggcccuucacaugggcauuugaauguguuguugauggagcccggagccaggaaaauacaaguguuuccagagaacgcacugucugcuggugugguuugaugcgaaaacggaauuaagcuguugaugacagacgcgcugccugagcgcaggcacacguggaaucugacugagcagguucacaagccuuuggaaaaagaucaucaucauauuuuucuuccuuuccaacguggaaaucugacugcucugggggacugacuuaaaaugguucuguuuaacaauauuugaaacggaguacugcuuuggaguaagaauuaaugagagcauuuuggacuguuuuuucugaaaaaagauaagaaaaaacucuugaagauaauaguugccucuggagaccuuugcugcugcucacagcuuuacugugcgcuuccaugagugagucuccacuuucaucauggacaaaugucuggaacuuugguaagauuuaaagaccuuuggaaauuuuuaagauuuuuuuuggcugccaguaauuuaucagcacucaguucuccuagaacauuuuuacuggaucggggacgucagaugguuuguuugcuuuuggauggcuuucggggaacuuuuaaauuguuuauaagaagaccauacugagggcccccuugaguuauucuuguguugaaugauaguucuuuagaaaguauuuucugaaggacucuuuuuaauucauuuuuuucuuuuaagcugaugugcaaaguggauuuucauggaucagaaaauaucuaugguuuuauuucuuuguaaauguggaucuaucagaaauauucacugugcaucuccuuuguaaccaucgccuucuagcuuuggauuacauaugacuugaguguucagcucugucagucaacuucauagugaauguuaaaauucauauuagaauacuugagccuagaauugugccagaauucaucaugggcucagauaauguuucaacaucaggauuuguccaauagaaaucucuccuugaacauggacaccuggagacaauucugcauuaaaugcuauagcugcaggcaggcuuucgcugagcacaggguggaccuucuucaucacauggaccuuaucgugagggcuugggauuuuccacucaagaauccuggggccagaaguccaguauaaaaguuguaguccaggcuuggccauacggaggaaggcauuuucacuucuaguuuauccagcccagcucccaccccucagaccccagccacuguucuuucggccaggagacuccagcacugaguucucucccauucuucacacagauuugcucaucuccaucaucggcagccuugggaguagucagaaccaagcuaaugauagucagaaggaggacgguggaggcccaugaaaugaggaacuugcccaaacaaccccacgugcuuuagaagaggcaggacaagucccgaagucuccuagaaauagaacagcucucaugauaucugaaagucauggauuuugaaagaucaaaauucaaaagauaaaaacuuugaauuuugaucuuuuccugggcuagcauugugcgauaggcaacucuugcaaugccagucaggagccacaagccguucugguuuucacuuuugauacagaauuugauaaauuacacaagauauuaaacacuuuauuauaaaacaggcuuuguguuagaccauuuugccuaacguaggccaguguuuaaguuuucugagcauguuuaaggauggcuaggcuaagcuaugauguuggguagguuagguguauuaaauguguuuuugaguuaaaaauauuuucuauugggcugggugcaguagcucacgccuguaauuccagcacuuuaggaggacaaggcggacaaaucacaugagguuaggaguucaagaccagccuggccaacauggcgaaaccccgucucuacuaaaaauacaaaaauuagcggcgcaugguggcacacuacuauaaucccagcuacugcggaggcugagguugcagugagccaagauaguaacacugcaauccagccucagugacagagugagacccugccucaaauauauauauauauauauguauauguauguauguguauauauacacacacauauacauacauauauauacacacauauauauacauauauauacacacauauauauacauauauacacacacauauauacauauauauacacauauauacauacauacauauauauacauauauacacauauauacauauauacacauauauacgcauauauauacauauauacgcauauauacacauauguauauacauauauauacacacauauauauacacauauguauauacauauauauacauauauauacacauauauauauauauacauauauauauauauuuucaacuuacaaugggcuuauugggacauaccccaucauaagcugaggugcgucuguaugugcugcucaagcucuugcguauacccacauaguugauggagggccacugcacacauuuccugauauucacugucucaagcuagacgucugggcuggagggagaaaaugagaauuucgggaagaagauacagauuugcagccacgcuuuuuaugcaugauugguuuaaucuuugcugcuuuaauguuaaauauuuaaaugcaagaaauaauaguaaugauaaauguagcugcuaagugcaacaauccacacuguuaaauuucauucacauacuucuagugaacacauauacauccuuuuaagaguucaguuguaugucucauagagcaaaggagagugagcacucacgccuuccucuuaggcaaagcagacccucuaggggaucuccuugcaucuguccccccucaaacugugguggcaguauuccugcccugacgucaagccucaugguguggagggagcucccggcggggccucgccacagaguuuuccaugaccccgcggcacccaccgcagcuuucccaccccuuucccagcggcggcauucaggaaaugguccugcagaugucucuucugaugucucuucugauggugguugggcucaaggaguuggccuuguggaauuucggaaagaguucugcagucacccacugacugugacccauccuugacaucauuucccuuucacuggauacuuggugagcucuggcuucaaaugugagggcuuucauucccugaaugauuugcagucugcucguaaauggaaaucucgaggcgcuagaugacagaaagcagcagcagggccaucguggucccgaacgcagcuugcccugcaccucucagccacugcugcggacuccagccagucuggaauggugccuagaaugcuuggacugcaaaggcgacggggguccuguccugcccaguaaccuuucacuaccucuuaaaguuuuuaggauucguauguggaauccuaccucaugcugagcgucauguuaugcaauuggcuaguucagcaucccaugacauuuuauugaauucaaacaccaugaaugaauaaaacaauuucauugccugugaagaaguuacaggguugagguggagaaggaauugcaguuucccugauaagcauugcuuguuucccuuggaugcacccagcacauggaggcugccauacccaguacacucagugcucaguaccaaacccgguacccguacucauuccgugcguagaggaagcccccgagagcuggcagcaucucugugugugcuucaguccauugugaagauccgugauccuaauauuucagauuggaaaaauccauuaaaauuuugauuuaaagauauggauuccaugucagccacugaaacaggccuuugacaguaagaauuuugaugacugcuuauucuagguauauuuuguguuaacaucaguuuuuguuguugguaauuauauuuuccccccacauuuagaagcuucaugcuauuuuaacuucagcuguccuggguauuugauuuguauuugaauuucugacuuagcuaugacggaagcuuauuagaguauuugcuuuccugaaucaugaacuuguuucuacaagcauuggaagaggaagggaaauaauuggguauuauaaaaugacuuucuauccacgcauuuuaaggauuuuuuaaaaaguauaugcuugcuuuagauaaugcauuaagcaagaauuuuaaguugcuccaugcaugaaacccuauuucaugccuaauuuacaaugccuaauuuuggugcuaagauuauucuccauguuguauucuuucaucuuuauagacaauggcacuuuguucucccuccacaaauucugaauuucaucauuuggggacacagcaguagucaucuccggcuuuggcguaugauuuuccuuuuuugaucagugcucugcauugcacugauguucaggaaugagagcacaagguucagcugcacgaaaacuuucuguguaguauuuuucaaguuucucguuucuuucuuccauuuuaaauagucuuugcugugacagacaaugguugugguuuucauuuuugccugacaugaagucuguggccgccauggauuuuuggaccuugccuugagcacaccaugggaaacagaugaucgaggguccuguugcucccugacucuaacugugcacauucugccuugagcuccaguggaaguggggggucacuguggucacguuaguagcauugccaguugcagcugcaaagucuggcuuggacccugcuagcuccaauaaccuuugcacaacauguccagcucuuugcucuucuuacaauccugguggaaaugugcuaaaaucuuggaggaauaauuuggccccauacugcaugcuggucgccagcuaacuguauagcuguuuaagugcuuauucuguccguuugcucugcucugguucccauaauaaccuuggacaggguacagaguauuagauuauucgugugcacuuuuaucuggacaaaagauuaagaacguuaaaaaaauauguggggaauggcaagaaccauguccauggaggagucacuuccuucuuagcuccuucauuucaaagcucuggggauacacagauugcuuaaacuuucuggugacauuugggaaagaauguguucuugcgguaaaagcaaggucugggaauuuggauuucuguguucuguucccagcagcacgaggggucacccagugacguacgacaagucaguuaagcaucggaaucuuaauuucccuaucugugaaauggacauagaagggucgguaccuugggcugacaugaaguuggugaauuguuugauguucugcugggaaccggcuugcucuagugacccagaaaaaacagggacuaugguggaggcugaccucauuucuauuucuggcuguagugcugacucagugagaaacuuguagaaaucaguuaaucuggcucugguccucagugcauuccaugguuaaauugagaauuauaaaaucuuaucaucgcuggucucauggcgauacugcccauauuaauuaaguacuaaaaauacuccaccaaauguauuagaaagcuucuacauggaccugccuuucucauuuccuuccugucugauguuggguuacuuggggcuacacaaguccauauuuauuuauuuauuuuagccgcuguuuggaguucaguccuauucugguuugagcagacuuuuccuauauccgaaaacugggugccccagauuggugaccuugugcacuguaacuccuuacagcaggauuuucugccauuguguccuggggccaucacugcaggguguauuuaaggagcucuucauuugaacaaguccuggucugggaauguuuuuccuuccucacugucacaggccucagggagaaggagccagccuucccugucaaaccuugggaucagggcccucguggagucacgucugugcuucuggccgacucccuggaugcugcuggccugaaggggcagugccacaguauggggcuugagguucuuuaauccauuuacuguuugauucaauucuuuaggguuugaaacaaucucucccauauuuauccacauacugugucuagacuccugacauauccuuucaacgaaacacagcucuauggagguguggcggcugagucccagguucauaacguccuuccugcguuuguaaaaauggagcaggcaguuaauucaccaguuaagugccaggacuggcugagugguuuggaaagaaggacgacuuuggauguuuauguuaugugguguguagcuugucgguugauuuuuacuuucaacuaaugcaacuuugagaaaggcacugaacacuaaguaauccugccugugaucuccaaacugucugccuuauguuuuuaaaucagcuaacaaugguuacugaaucuacccaauucguaugguaaggcugcacugaaguccacaugcuguaaaguaaauagguuuucuugauuucuuacaaugguuauggguuguuguuuuuuuuuuuuuuuugagacagagucucacucugucucccaggcuagagugcaguggcaugaucuuggcucucugcaaccucugccucccagguucaagugacucuccagccucagccuccugaguaacugagauuacaggcgugcaccacuacacccaacuaauuuuugcauuuuuuaguagagaaagaguuuugccauguuggccaggcuggucucgaacuccugaccucuggugaucugcccgccucuaucucccaaagugcugggauuacaggcaugagcgagccaccgcacccagcccaaaaaauacucuugaaagacauuucucauuaaagcccaccaucaccccaugauggcccaagggaggcuaagcaucuugcaugaggugcacacuguggacucugcccacccacaucuccuaauggucucuaaagaggaagacgucuuggaggcuccaucacagaaucucagcacugaggcuguugcuaacaagagaguuccauugauugagcgaaauuauaaccaguucagugaaaaacaccucgcuauuuguuacucuauuuacccaagaaauuauuuggcauuaaguacauauaaaggauugugcuaggaaugagauauaaauauuuccugcccucaagaguuuaaaacacaguagagcaaaaccaccugaaguagucguugcuaucuguuuccagacacucacuguggacuugcgcaaggcuggaugcugcuuagauuuauuaugggaaguggcucauaggauuauagaggcugaggaguuccaugaucugccgccugcaagccugggaacucaggacuccugaaguguaacuggguccaaggccagcggcuggagagcccaaggggcuagugguacaagucccugaaucugaaggccagagaacccagaguucugauguccaagggcaggagaagaugggugcccagcuccagaagagagagaauuggccucucuucugccuuuuuguucuauccgggccucaacuaacaaugacaccugcucacccugggugagggcagaucuuccuuacuguccauguauucaaaugcccaucucuuccagaaacacacccucaaaaacacauccagaagucaugcuuuaccagcucucugauuauccugugacccagucaacuuggcaccuaaaauuaggcaucacgggccaggcgugguagcccaugccuguaaucccagcacuuuugguggccgagguggguggaucaccugagaucagaaguucgagaccagccuggccaacauggugaaacccugccucuacuaaaaauacaaaaauuagccagcgugguggcgcacgccuguaaucccagcuacccgggaggcugaggcaggagaaucccuugacucaggcaguggacuuugcagugagccgagaucgugcaugcacuccagccugggcaacagaaugagacuccaucucaaaaaaaauauauauauagccaucacaguuggucaccaauuccuuccucuguucuuuacugcugccuuuugccugacugauguuccucuucuguagggugaaagaggccucccgggguuacaaggugucauuggguuuccuggaaugcaaggaccugaggggccacagggaccaccaggacaaaagguaagcacggcugugggauuggggguggguggauguaagauugcccgcauucuugagauagcggugaucaaugacaauggcauuucuauucuguuccagggugauacuggagaaccaggacuaccuggaacaaaagggacaagagugaguacaguugcuacucacaaucgaugauuccaugcgugggacaggcccgcuuccagagccgggcaccuuuucccuccuuucuccuugcccucguccuccaucuccucucccagcucacacagcacgggcaggcaggcgcgaggcaggcagugaggagcagcccgugacucccugagccccaguccuucccauggggacugugcacaggcugagcuccuuaguccuugguucugcaaacuugcuuucccccauuuguucuucuucaggaaucucuucugggcauuuuuuaauuugggggaaggggcaauugaugauguguccacagucauuagacagagaugacuucauuuaauggaaaagucaugguauuuucagagccagccuugcucuuccuccucuccaccucuuaguaaugaugaaaugggagcagaguuauuuugugcaugggcagccuuauguuugaagggaucagcagucagcuuuuaaaaacuuauuuuuuuguuuuuuuuuauuucaauuuuuuuugguacaggugguguuugguugcauguauaaguucuuucguggugauuucugagauuuuagugcaccugucacccaagcaguguacgcucuaccuguuacguaguuuuugaucccucaccuccuuccagccuuccccccaccugagucccgaaguccauuguaucacucuuaugccuuuacauccucauagcuuagacgccacuuauacgugagaacauacgguauuugguuucccauuccuggguuacuucacuuagaauaauggccucuagcuccauucaaguugcugcaaaagacaucauuuuguuccuuguuguggcugaguaguguuccauggugcauggauuccaccuuuucucuauccacucguugguugguagguacuuagguugguuccauaucuuugcaguggcgaauggcaguagugugcuuuggguguagcauugcuccuguaagccugggccaucugcccuaggcugugcccucugcugccucuugugcagagugcucugucugcuuuguguguguucugacaccaaaaaugagggcaugacuccauuaaccggggagaugcaggaggaggaagugaggcuucccggcucuucacugacacgcuuuuacuuccgcccucacagggaccuccgggagcaucuggcuacccuggaaacccaggacuucccguauguauagaaaacgugcucuacuucuuuuaugaaauauucuuccaucaggcgauuuucugccuggguuacauuuucacuuucuucauugcagggaauuccuggccaagacggcccgccaggccccccagguauuccaggaugcaauggcacaaagguaaauccagaaccgagacccuccuuuuuguguguguuuacguaauuuuugcauauuaaggagucagguagugugauucuguuaauagaguuuuauuugccacaauuggaaaguugcuugucuuaaaguuugcuuuauuuaguaaggaaauacaguuuucccauauuuaguguaccagaaagauauaauuguuccuuucuuuuuuguagacuuuuauccuaaaauugcauuuaagcacgaaaguuauuaccuauaaucauuuacuacaucacguaagaaaaugccauuaugggccuuugucccuauuaaugauacuaucaagucuauuucuucuuucauaaagugguacccaguagcacagcuugugacaaacuguuuuuaggaaaugauuuuaaccaacaaaugaaggguagggcagagugaugcaugcgaugucagggcugaugugucugccacacacagugcguaugaaugaugcucugcugucuccccagggggagagagggccgcucgggccuccuggcuugccugguuucgcuggaaaucccgugaguagagguuauuuagggcagaacuucuuucuuuuaguuaugacuucucucuuuucauuccauuuccuuuucuuucuuucuuugcuuauguuuuaauaacuuauauuuuauauauaauauuacaugauaacaauuuuaaugcuaaugauauuuugagaaaaacaaaacuaacaccaaaacuuucuuuuuuagggaccaccaggcuuaccagggaugaagguacauuuuauuuuauuuugcuuuauuggauucauuacagggaaucuguuuacaacaagugccauagaagcacauucucuuuaaaccacuuuggcugaucgauuguuucugaacacacuucccuaaacucuguuacaugaaaagacuguacaaguaacccacaaacucagaucucagacucuaacguucagacacuuggcacagcuucuuaauggggaauaagcagcggaaggaggccuggugugguggcgaaggcucacuucacccaaacuggggaggcagaugggagaauggggcucccugggugccucucagacuucccaggagggaaccuggggcagcuuuucccaggcgggguguugaugucuuggggcucggcugcuggcaucagcccgaccucagacugugcagucauguaaugugucggcugugcuugggcacagggcggggaccucgggcaucuggauguugggaucagccuugucaaagggaggcuuacaggucucagcagcugcaguagagauaacugcuuaccuggaugaaggugagagucccugugcucgcuccugugauucagaacacguaggaaauagauccucauaauagcccuguguguuagcaugcuccagagacacagaaccaggagcauguguguguguggccagagagaggagaaacugcuucuaaagcauugguucucaugauugugggggccggcaaacucaaaaccugcagagugaggugggcaggccagacaccagagaagggguggaguuguagucuugggucugaagguggugugugggcagaauucccucuuccuccagggaggucagucuuuuauccuguaagaccuucaacugaugggaugaggcccaccagcauuauggagggccauuugccuuauucagagucuacugauuuaaguguuaagcucauuuuaaaaaucccuucacagaaacaucuggucugguguuuaacccaauaauguggccuagccaaguuggcagauaaaauuuaccauuacgccgugcuuuuauaaaaguauucauccugagccuuuucucaaaagagaauucuuguuuugugaggagagccuguggucacgcaguagucuuucaaccagagacaagggcccuugucuagaguugggggugguccucgggcaguguggcagaccccuuugcuuugccgucucuacauucagucccggcugcggcucaguugaccaggcagugguuaacgcuggccauuaagacggcaaucaugaugggagagauggccaggcuauugauuuccaguguagacggggucuaaaucccagacuuaggcuaguccuguaacacuaauauaugccaacuaucaaagaguuuucagcuucuuuacaugaaugucgauauuugcaacuuucuauuuucuuucuucauccucuagggugauccaggugagauacuuggccaugugcccgggaugcuguugaaaggugaaagaggauuucccggaaucccagggacuccaguaagcauuugcugaaucauuaugaacaugugccaccucacccucccaguucgcaucugaacucauuucuuucucaugcauucuagggcccaccaggacugccagggcuucaagguccuguugggccuccaggauuuaccggaccaccaguaaguuuugggggcugucucuccgaggcaaucauuuaaaaaacaacuauauugagguuugaaaauaaauaauaauuuaguaaaaacuuuacacaguuguggucgcucuuaauuuggacauggcggaaucagcuucccucuuacuaaacguuuggcuggcaucccgguacccauauacccagagcugugggaaagggaugaugauaguaccauaaacugauacccugaaacaaauaaugcagucaugguugaaggggcuggcgggguacugcugauagucacagccugugggagugaguucaaagauggacagacaggcugugccccaggugacuucaccagggagcaggggagauggauugguauugguauggucacaccugaggguccugcaccugcuaggaguggggagggaggggaagcccaggaaaaauauuucacaaauaaauuaucauguugaccagagaaucuuaagauaacgucagccugaagaagggcuuaaagcucccuagaguucugaauccuauuuaauuaaaaugcugucucucccagggucccccaggcccucccggcccuccaggugaaaagguaaaaguucuuuucauuuuuuguucuuuggcauuaguauaaggcuaucaugaaauugcuauagcucacucuucuuauucuuucagucucuaaaaaaaaguuggaaaauuaacacuauaucuaacuauaccuuuaaguaucuaucauauaucauuuauuaucuauugauuaucuaucaauauauugaucuuuucuuucauccaucccuuagucaauacuuuggaaucacacugauauuucccuuaguuuucuaaugcaagaguuuaaaaacuguaaauuuuuaaaaaggucuuuggaauuuuugaucagucauacuuuaaaaacuuuuucauagacauugaauucagcaugaucguuacuuuccagaaaauuuuaugagaguuaugggacaaagcuauugccugaaaucuaccaucuuauugcauuuugugugagguuuguagaaugacuuugaacgaaguagacaaaucuaauaaugagagccuaauuuuuaauccacagggacaaaugggcuuaaguuuucaaggaccaaaaggugacaaggugagugcauauugcucuggagugcuuucauguugaaaaccacaguccucaccugacaguucccaccuuuggaucaaugucuggacucuuacaaguauaguuacucuucucugcauguucuugcauuugguaguuaguguuuuccuuaaaaugccagcauuauugaauuuauucuagcuuauucaguacgcuagaauuuauggaagugcucugugaucugacaagcagagaacaacgagacuaacuccaauuaucuguacaaagaguucaaacucuucuucgucagugaugaggucagaccuaggauuuaugagucaaauuuaggacuugaccauuagaugaguaacccuguaagcccugcagagcgggaguccaccgccaggaaauugggaguagcacggugggcagcggccccucaccaccggccucucuucucagaggcgggcauguccagggccaccaccaggagaauuaggacuagcacgguuggcaguggccccgcaccaccggccucucuucucagaggugggcagguccaggaccaagugggugugggaggagaugcaguguggagccgggagggcacagaccacacagcagguggcuucauccugcagagaggaggcaaguggugggucccugauccucuccaggaguuucccuggaucagaccaaugaagcaggcacuggcuaagaagggaugccugccauugcuguagccagccuguggaaggccagauucuccucugacauccaagcugguggaggcaauuacaaccagagcgcccaauacaguggggccuggauggaucuggaugugcagguggccucugcuugccacccaagauuuuggcccagucuuuucauaaacuuugaaauauagugacucugaaauguaugcaguuguaauuuuuaggcguacccggcaguuaggaugcccgaggagggagacucuugaugguugucuuauucugggauuaccuaaaaugccuucuuuuuucucaagcucuauuagguaguuuguauuccuuuccuccgugccaucagaagccaguauacacuauacaggggcacgcaaguccggaggugucuugcagguguucagauuccaugguuauuccugagcuaguggccacccauagaagaagugaaauucuccuccuggguuuagauacuuguuguaucaucuuccuauugaaauuugauuuucugcagaggcaaggaugauuagaacagaauagaguauaauuacauuuuaaaaauagguguuuuauuuuaggcuuuuaccucucucugcaauuuuucaugucugcauaauuguuuucaugccuaauuaauuuuacauuuuuaugucgacagggugaccaaggggucagugggccuccaggaguaccaggacaagcucaaguucaagaaaaaggagacuucgccaccaagggagaaaagguaugagugggcuucaucagugaauacugauuuucuaauuuuggacaaauuccaaaagauaaagagaaaaugggucaaaacucaguuuuuccagcuacauucaauccuggucuggaaaacagauuuauagacuguucaguccauaaaauacgagccccuuugagagcagagacagcuggaacuggauugguccaagccugaucugaggcucaccccgcuggaucagggcuucuuaaaugugccccaaguuggagauggcuuggucaggaggagggagcugggcuggggggcaggaggggggcagggccagucaucaugggucaagcaugauaaacccugcccugcuuacauuuauaccagucaaugucaagugagugcuggagaucaacaugaauuucuuuguuaauauaucagaaaaagguuuuuuuuuuuucugcuguguguuuaaugcagcauauaacaaaugauacagcuguuugauagugcugaucugucucucgaauucuuucagggccaaaaaggugaaccuggauuucaggucaguacucaguuucugccuaucauuuuuaggucaaagaccauaaagauuuaaguuucaaguuuuuuucaccuuaaguuuaauaucuaucuaauuuaaauuuugcuuaaauagacgaauaaaucucuuugucuuuuuauuccuuuaaggggaugccaggggucggagagaaaggugaacccggaaaaccaggacccagaguaagugcuuuccaaaguccuuuuaucauaaaacaauucuccuuccaugcggaaaaucgcagauucacagaaacacaagaacagaaaaggcucguagggacuucuaguuuaucccuuucaugccccgaagggcuuuuccgagacucuccugagcuauaucaguugcaaggcuucccaggcaggcgagguccuucccuguuuaaggauccagcacugaaggugccaccgccggcuguucagagaggcuucugaagagcccugggccaucccugaaaccuucgguccugcucugagagcagcagguugguuggacuuugccacccagaacaccagacaguguuugcacagccacaagccugagaggcugaguugcuuuucacuuuagggauggugguggcgugagacccaccccacugccagucagcugggaugguucugguuucuaccuggaaggagcaugcagaaaccugcauuaaaugaagcauuugcauaagcuugcaaauacucagcugccaauaggcaaacuucucuaauguuagcuuugcuaccaagauacaaucauauuuuagaagacuuguagcucaucggacucugcucuuuaaaaauggaguucucuuauauuguaacuguuucauaauuauucaucauauacaauauuacuuauuauugugguauugucaacuuacauagaacccucauuuaccuugcuuguguuucauaggagagacaacauauuaagcuaucugaaucagagcuuugguguuauauccguuauuauauauauauacauauauauauauuugagacagagucucacucuguugcccaggcuggagugcaauggugugaucucggcucacugcaaccuccgccuccuggguucaagugauucuccugccucagccucccaaguaggugggacuacagguaccugccaccacacccagcuaauuuuuguauuuuuaguggagacgggauuucgccauguuggccaggcuggucucgaacuccugaccucaggugauccacccaccucggccucccaaagugcugggauuacaggcaugagccaccgcgcgcagucuauuauuuauuaaauacuaacguuuacaucuuuauucuacagggcaaacccggaaaagauggugacaaaggggaaaaagggagucccguaaguguuucucugugguuuuuacaagcaggcucacuguuccuaccacuggccucugacgguuacugcuucucucuucgguuucaggguuuuccuggugaacccggguacccaggacucauaggccgccagggcccgcagguaaacgcuggcacuauugugagccuuuaucuucacuuuccaauucaacccagaagucuguuuauucuuuccuagaauaaaggacucuguacucaagggaaaaaaaucauuuaugcuucuucuggguaaaaacacaauuuagugguuuccuuuauguucaugauuuuuuacaaaauaaaaauauaugaaaugugccauucauucaaauuuuuauaucuuuuuuugguaguagauuauuuuuuuccugaucauaaagcaauagaaaauacagaaagauaucacgagguaaagaaagcuuaccuaauuuuuucuguuaccuguucagaaguggccagaguucgccuuguuccuaugugcauacacaagcaggcaguuuuuaaaggugauagugaacaagacaucuugcuuuuucacguaaugauagaaggaggaucuauuucaauggccgucaguguaauuaugaugugaacauccaugccuuuuguugcgugguauuuaggccauuuccaaauuuguaugcuuacaaguauuuuugcucacuugucuggucauuucucugucaaauuccuaaaagcguaauauugggguccacagucagacacuuguuuugaaauuuuugccacaugcaaccaaauugccccagaaaguccuucugccagaccagggcccuuuuaguuggggaacuaacuaaaaaaaaaaaaaaaucuaaaaaauauuugucaaucugacaggcagaaaaaaaaaaccucauuauugcuuuauuuuucucucuuaauaugagacuagguaauguaagucuuuacuaauauaagagauaauuuuggaauagucaucaccaaaggcgaauggaaagcugcggggagggccucaguagccuacgguuaauuuauuaaagccagggacaaaaggaagaaacccuuggcuguaauuuuuugaggaaguaaaauccuguacauuuuaaaugguagauauauuuagaauauaguggcuaagauauuuauguccucuagauauuucuaaaaucuucugguauucauauaagaaaaaucaaaacauucaauucuuguuuacugccuuaauuuaaaaggaaaauauauacauucaugguaaaauguacauaucuuuggacuguuuaaaucauuacgaugacguuuauauaaaaauauuugauaugaaaggguuaauuucuuugaguuuuucaucuacuauggaugagauuaaaccuuaaagugaucagaauuuauccacuaauguuuucaguuaauauuagauuuuacauuaugaccuccaaugcaaauuugagaaaaucuucaccuaaaaacaucauauaaaaugauuuauuuaagaaaauguauuuggaaaucaugcuuuuauauuauuuuauuucauuucucuuuuuaaaauugaaaaacccugguugccaguuccgcucaucaaugauucuguuuuccgaggaagugugcaguugaugggacaaguaucugggcuuuuguaaggagaauaauuagcccccaacuuauauuuugcagagaucuuuauuuucaugugucaugcgugugcaaagcaaaaugaaaucuauucauuuuuguuguaaucgucacagaaugagagauauuaaagagagaaaaauaguuuuaauuuacuguaggcacacucuauuuuaccagaagaaauguuuaaucugcuuucugcaagacaaucuuuauaguaagaauaugcaaggaaaguuauuuuuucuuuuguagggagaaaagggugaagcagguccuccuggcccaccuggaauugugaguaagagugcugucccugggucugugagagcgcugggggaggaaggagaggacccugggucugugagagcacuggggggaggaaggagaggacccugggucugugagagcgcugggagaggaaggagaggagaugcagggcacacacccacagcugucucuagaauugcauuuguuauguaaagugguucaugcuacuugaaaugauuuucuaauuuguuguacggaguuucguguuuauuauuuuuauuauauuuugauaauuucugcacaucuuuaaaucacugaaaaugaaaagguuugcacaugaaugagaauauuagcaacauauuugacuccuuuuuuuuuuugaaauggagucuugcucuguugcccaggcuggagugcaguggugcgaucuuggcucacugcaaccucugccuccuggguucaagugauucucccaucucagccccccguguagcugugaucgcaggugcccgccaccaugcccagcuaauuuuuguauuuuuaguagagacagggccugacuauguuggccaagcuggucucgaacuccugaucucaggugacccacccaccuuggccucccaaaguucugggauuacaggcaugagccacugugccuggccuugacaccuuuuuuaaaaaaacgugguccauugaggaaaauuuuuguaagagaaacaggucaucuguaauuuaacuauccugguaaaacaauuuuuauuuuugcaaauaacauuuuacuacuggucaacauacauauuuugcauacuugucagugaugugugugacauuuaaaaaugggcauuaucauguuugcacauaucuucauggugaucauuuucaguguccuaucagagaguugugcuuuaauuuuuuuagccauuuugcccccagacuuuuuugaaauaaugaaaauguuaccguucucuccuuugcugccuuccuugcagugccacagguaaugcguucacacagcccauuuuauuuauagauuuacauugaaggguuuuacuuucauuuuuuaacugacaaaaauuguauauauuuaugguauacaucaugauguuuuauauauauaacuugugggaugacuaagucaagcuauuuaacauuggcacauuuuaauaauaucuauuaauugauacaaaggaauuauaguucaaagguaauaugcaaaaguugacuuugccgcuugucuugaauuccauuaauuuagaaucagggccagugaauuuucuccuuguuaaggagccgaaagugccucuucuugucuugcgaccuuaaggaagcgccuacuuuuuuuuuuuuuuuuuuuaagaguguuccucucauaauacguuguaaaguaaaacauucuguuuauggcuaguauguacaauuagaaauuauaaaucuaagccucaaauugauguuacuccaucuuuaccucacuggaguguuacaaaagcugcugccaggcaaacuauuacaaaaggaagcagaaccgccugccuggcaggauccuuugcagggaugguugcagcauguuuauuccauaugcuuucguuguuguugcuguuuguuucuuuguuugagacagagucucacuccgucacccaggccggagugcaguggugccaucucagcucaaugcaaccuccaccuccuggguucgagcgauucucccgucucagccucccaaguagcugggauuacaggcauaugccaccacgcccgacuaauuuuuguauuuuuaguagagucgggguuucaccauauugaccaggcuggucucgaacuccugaccuugugauccaccugccucagccucccaaagugcugggauuacaggcgugagccaccgcaccggccugucccauauguuuuagaggcuuauccccuuccuccuuguccgcuaccauugcugcuacuucacuuucauauuucuugaaauaaaaacaaauauguacauuucuucacucauacugcuuuacuauacaggacuagccauucccaugccacgggaugaucaccuuuuccuucucgauucagguuauaggcacaggaccuuugggagaaaaaggagagaggggcuacccuggaacuccggggccaagaggagagccaggcccaaaagguagcuuucuugccuuuuuccccccuccuccuacucccccuccuucucuccuccuccucuuccuccuccucguccucuuccuccuccuccuccuguuccuccuccuccuuccuccucccccuccuucucuuccuccgcccccuccuucucuuccuccucccccuccuccucuuucuccucuuccuccuccuccuccuucucucucucuccccacgcuuucuauuucuuccccucuuuuugucuaguuuugaccuguguuccuccauauuuuggaagcaucugcaggccuugcaggacugucugugaccaggucuccuccaaguuccuauuucacugucacaacaggcuucaggagcccuucgcuguagcuuugagagcaaugcauuuccagagugggggcucggguggucucccgcucuguuuucuacguucccuuuggccauggacacuuaccaaugcaccaagcaaggcuuucaguagagaaauaagaaguguauacaaacgggugaacuguucuguuugauccaacacucucuuucucuuuucagguuucccaggacuaccaggccaacccggaccuccaggugagacuccuuaacugauuuguuauagcauacuugcacaccuucugugcuguuuauauucugaauauauaauuuaucacgaauguuagauauuugcacacaaucgguagcaaucuuacgacaucuuuucuagugaugaaagcagaguagacaagugcuuguagauaaguaucuugucuuuuguaagugaccacuuagcauguuaaugaacauguacacccuuaugucucuccuggggauccagaucuauucugcccagcucugauguaaccccaccagagccagccugccccccucuuuucccacggcucccacugagcagguccugucuuuccacagagccccgauucuagcacagucaggcgccuuccuccucagcguccugaccacuuuccccucucucugggauguuucccagcuggagaucagacuccaggacaaaaccccuuccagcugcugugcccagccccagccuugccucccuggaccccggggcuccucagggugaagucauucuccagucacuccagacgugccaaccuguguuuccuggcagacugcgcuuugcagaggcucgcuguugucucuguccauaugcgcagaugcacguguguccacgugugugcgugugcaccugugguauucucccaggucccagagcugacccgauaagcgucugauggaaacgcucacgugcccuagcauuggcacacaacggaguguucgcagccuuuacgcuuuuugcuuuguuuuugauguuuacauuuauuuuuguuuuuauccccguuuauuauuuuauauuuguuuccuuuccagcuggucuaaguucuugcagagcccccuuuuuuccuuuauugggaacagacgacaccccacacagcccacgccuggcucagggcagggccuucguccacucccacuuucucucuuuucuguaaaaacucugacucuacccuuaaaagcaucccuuuugucucuucuuaauucuuggauucucggaaaugugugacuucaugucuccucacagaagccuuguuuacugucuacagccuuuuaucuaacccuuaguggucucuuaacccagacgcuugauaaaaagccauugaaguugcucuggcuggaggaguuacccacgucccccucccaaagucgcugcgcugcucucuguccaguccugcccugggcucgccuguggccuugaccauugccucugcccgcccccagcucccugaccguccuccucacccugagggucugguuggccucgugcccggguaguuccuucauuuuccucuccauuagacaugcugccccucauucaccacucaggaagggcacacaguauuuuguggaagcccacaggggccgccccucggggcucuuggcugccuuggagcacguugugcuuguggcuuuucuccccagugacaggcuggaugucucaggcucugugccccuuuggucagcgcucuucccucuccucuccaugcugcucuucauuccugccaagucuuccugcguccuguuucccucgacuguccuuuuucucacacucuccucaucauagccugaugcugggagcagaagcuggugcgucccucacagaagcagcagagcuuucuccaugcagccuccugcaccaccacucucucaagcccugcguccggccucagcucucccaggggcacauggucuuacccuuacagaguuacaguggcugaaccugaccugauauguucacaccuaauggcuacucugacuucaaacccuuuuacagaaccaucuuguguguccuuaguugugauuuucugcucuuucuucuagauugccaacccacugaccaucccuuugcuccagguccacuuuagcuuuguugaaugacauuucuaugcccucauuggccaaguagaaaugcagugcacccucuacagccuuuuuaaaauauguugggaauacuauuugcacugagagaaauucacagauuuuaauaucuacguaaugagucccuguucuuugaaguuaauuuguaggaaacauuugacugucagcaugaaauggcaagacaccugccagcuuaauuugguuuuacaugucuaaagcaguucccuuuucagugauggucugguuggauuuuuaccuugaacagaguuaggagaaugaguuuaugcuguaguugcuaaguggcccugagguuacugaugugagcuucugucugguugcaggccucccuguaccugggcaggcuggugccccuggcuucccuggugaaagaggagaaaaaggugaccgaggauuuccugguacaucucugccaggaccaaguggaagagaugggcucccggguccuccugguuccccugggcccccugggcagccuggcuacacaagugaguucccucagaaaugguuuaauguggggugcaagcagacaccagggugccgggcagacccagguugggggcugugauagucccccacagccagaguguaauagaaaggcguggauucuucuaaucauccauauuccucuaagggaaucuucagagaaugaaccaugcuacaaaaagcaauaguuaaaauuucaaaauaaagcugguuuaacggaguaaauaacacguuaaccaccucugagacuccuggcaucuaaaguuaaaaagcaaaacuguugaguuauguaauuuuuauugaaaacagaaugcauucuucuucaucuagagauacaaaugaauacuaggacacacacacacacacacacacacacacacacacacacaccccagaaacaaggaagacaggauuacauggguaaagauuacauuaguaaaguccagaaaagccagcuuuuauuccagaaaaggugaacauguaacauggaagucuugacucaauuaagauggccguguggucccaauacaauaccaaagcaaauucgaagaaaaucuccaaggauuuaagccaaccugugcaaugggaguguguucagauaccuggagccagccuuuggaaccugcuggaucaaaaccaacgugugcucuguggggccccugaaacacgaauccucugugggguugauugagaaaggauucacaggcuucaagucccagcaagauuuauuugcuagaauucaagcaaaucuuuacgaaagggaguucucauggaugaggccacuguugggggcugggccaggacuagauggagccauggauuccagccuggcagcuucgauggggaaugugaucuacaugaauuuggguaggagaaagaacagaucaugugugacuuuggggaacuuuucuccucugcucuugugauugugugaaacaugggaaaugaagauaaaauauugcaguccuggagacacucaauccagaggcuccuuuucucugugugucugagagaagguugugagcucugaccaaggggccuuuggguuccagauucauucagcggggaagggagugccugggaggcagagaucuagcaguggugacaagacucaacagauccugcuguccuggagcaaguauuccauggggcugacagggguuacccaagacaagggaauucucaugaaugcaggagaugauaaguccagggauaaacuuaagcaggagagucaacagaggguucugggguggggggugggcaggggauugugguuuuaagcagagugauuuacaaagacaugaagggggugagggagccaaugguggggaaaucugggaaaaggacauucuuuuggauguucguaauuuugcaagugaugaaauauaaacacacgucauguaaaaauaugaacuuuacacucuuguuaauugaaugggauguguuagcugagcacauuguaauauuuacuauuccagguuuucuagguggccuuuuuaguccacguaaauuaaguaauucucaaucacagaguaucgaguaauaauuuagaaaugagauuuguacuaagauuuauaauguauguuaaagaggcuacaucuuaaagccauugcuaccucaggacuuaucgauagagcauuaaccacacaaugcagccauuugugcauguaaguucugccacugcauucuugucucaaguggguacagccagcucuaaaccaucuguggcugcagauacccuugaugagaaggcguuguaaaauguaaacucuagauuugcacuuuagaacuccucagaaauaaucacugcauaaaaugaauuuaaauggacuuuggugaggauguacuauuuuuuuuuuguuuguuuguuuuuuguuuuuuguuuuuuugucagggauuugaagggauucugguugagcugaagcaggcaggaguuaugcucuggaaaaggaguauaacaguuacaugucucucaauauucuugagcauacauuucuagagucaaggaauuaguauacccuaggcucacagggaugagagauguggguucuuucagugaaguaauuuaggggcugcucuuugaagcauaaacauggaguccacuuuguuuaagacgauggugccagcugcaccaaugucgaagggcuaacgaggagccaggcaggaccagagucaccaggagcaggucccuagcaguggcugugggggacccauggugaccccacuugggcuuucuugccuccugugcuuuguggggagaaacucagggaaagacacauaagcacauaagcaacaagcaaagcaaaagcaccucccccauaguuccuacacagcggaagcuaacuuguucugcugagcucuaaaccaagucaucaaacaaggugugggaucuuuuuaggcauucugguucuagcuggggugggcgagcuggagaguugaccuugguuaauauauucaagcccgagggagggccccacagccccacuccacacccuggggcccuucuauagucugggacucagggcguccaggugacagcugaacagagacugcccaugacuuugucauuaggugaagacccuguaagggagaggggagggccuucagugcuggugcaugaguguuaggguuaugccugggcagggaugcuggauaccaaguuguucacugugucuuuuuucuucaaggaucuuggggaaggaaauauaaacuccaucucaguguguauccaaaucauaaaacaauaaacaauacugauauuuuuuacuagaaccuaggacagaugguguguacauuacugcaguuuauuuuuaugccucuuuacauaaaugaugcucagaauugaaugugaacaauuugaggcauuuccucgugggcagucugcagcucuaaaauaaugauuaguuuugcuguaaauuggguuagagggggaaaaaaggaagaaaauuuuucuagucucagcuuugacuagaugcaugacccuggacaaaucacuuaccuuucuugagccucaguuucuucauuuguaaaauaagggugaugguaggcacuucgcaagaugaaaugaaauaguauacaggacagggcugaugcaccuacagauacuucagaauuugugaaauagaaauguuggcagugauggcuugggauggugaguggguggugggugguguguggugauuauguuuugcaagugguggauagccuaagaugauuuugaaacaaacuaaagcugaauuucuaacacuugucaaauagccuaaaauauuuugguuuuauaauagagguugaguuaggagaggguaaaaacaccuagcuaugauccuauaacucugacaacucaauuucagauggaauuguggaaugucagcccggaccuccaggugaccaggguccuccuggaauuccagggcagccaggauuuauaggcgaaauuggagagaaagguaagaaauuuugauuuuuuuaaaauggugguugugucuuugcguaugauuuuuucccacauacuuaccggcuuuggagccaagugggggugggcagaguuagggcguagguuccuuuuauuuggaacccucuucacaaucucuuccuagaauaagcaucuuccggaacuuaguugaugaucugggugggaaagguggagacagcccugaaagucagaguuuugccccuucucccuuuccgaggaccgugaagucagucuugcuacagugggcguggucagcagauaaaacucagacugauuuguuaccgcaaucuuuccauucaguguuugagaagagacuucuguuaccaaagaaugcucuucccuccuucaagccaagucaaaaaucugcacauggaaugcucaccaauucuuccagugguguuugcaucaucagugugagcaaaucuaccguugaugcauuaaccagcuucacucugggcucucgguuccaucuuuaaucuuuccaaguguuugccuuacuacccgcacaggacacuuauuuaucucuuccgccauccuagacacagagguggauuaucacugcaucaacaguccugccuuagaggggaauaagcaauggauauucugauauuuauaugccuguuaguaacccgagaguaggacaaauaggaggcugucccucaaaucaaccccacuguguaccauuucugccugugaacuguaaacauguuuuagucuucaaauguguaagacagaaaugaugcauggaaaaguuucagccagcaucuuagaauucugacagccacauacacugcaggaccugaaauggaagcgaucuugggcgucaucacaggggugccacugaucugagucaguguacaguuuggguuuuaaugagucugucugcucuaguuaccaggcgcucaguacuuugugagaugggcucuuccauuuuaugacagauccagcguccagagguucuucacacugcaaucuuagcuauccaucccccagauccuaggagaagcaucugucuucucgagucuucccauuccucuuucgacuccaucgucugcugggaaugcaccuugucuccccacccaccugaagccuugcgaacagacacacccacgaaugccccagugcccagaacuuagcuggguucucagcuguguuguaccgugccccuuccacugaugggcuccugcucugccuccugaaagagcucgaaaugaaaccaugugccugcucccacacuucgggggcauggccuaccugcacuggcccuguuuuacuucugacugaggggcaucccagggcagagugggcaauagcagugcccgugugcggcugccagccagggcagggaugggaagaacauggccacgccgccucgaugucccuggcaugggcuucucugcgagcacuuuuugcucuguauuaugccugauuugugccuagaaaccagacauuucaauauuuaagacacaggaauagcuaagacaauguaaggucucugagcuuggcuugaaaaucaagacuucagauguuagaauuuccaaagaagagcaucuccucuccuuuuucagggcugcagucucucuccucuucuguccuggaucacauauguguucuugcuuuuguggcuucuuauucccaaguccaccaaccagugaaguccaugaacuggacuaagcacucaaccaaagagaaaggggauggguaguuuucacauuacagacaaauuacaaaagucaagucuuuucaggcugauaggcacaguugaauuucuggaccacuuuuuacugaggcagcccugucuuuucgcugggagaagaacuuggaucuuuaagcagugcgucuguggucacacgugacgcgugcugggggcagugggcccguucauugacagacagggacgugcguuugacugcaguuuccacccauuagcagagagcugucuggaggagccauugccacugagcaaaccuaaguuuggauguaauauguuagugacagccuugccuuuuucuguucucucagugcacugcggagacuucuggucacauguuacacguaagcaccuuuguguuuucuuuuuuaggucaaaaaggagagaguugccucaucugugauauagacggauaucgggggccucccgggccacagggacccccgggagaaauagguaagacccacaugugaaaaggaccaggucagaguuugcuuugguguguuggcaucuuuccugugaaagggauuucacuccauagaaggccugauuuucggcagccaauccuaaagcauaaucagaagaauguugggccccacuuccaggauuuguccacauugcugggaaugaucaagauggccucauaaagauuuccuaauaaaagacagcagcauaacaguucccuccaugccacagauucuguuaucucacaagcaguuaauggaauucauguuuuuccuuuaaguggucccugggugugugggcaggggggcagguguggggugcuggaagcauuccugcuuccggguguacaugugcgucgggucaccuauucccuuucugaguccgucuugggcauuuuaguuauuacucucuuuggauuauccaagcaaucauccacuuccuauacagauuuuuaugcuuuugagucuuaagaaaagguuuugagaagugucucaugaaugcuguguugcugucuuuuucccucucucucacgaaagguuucccagggcagccaggggccaagggcgacagagguuugccuggcagagaugguguugcaggagugccaguaaguaaaccugucugaguucauguacauaucagaaguugccaccaagcacguggacagaguugugucguuuugcauuugcaagcauggcuucugccuugugugggagcugguaaguguugcugugucgagcccucuggagugacuccaugcggcccuugucucaggagaaugagcaagacuguuacccacagagcccaaaucacagcugccuuucuucucaccuggucaacauuuuuucggcugcugccgaccuguguucagguguggcugaaugggaguguguccuucccucagggucucugggauuucuggaaacaaauggugucacaggagccacccccacacagccacagugcagagccgaagugccgucuuucuguguuaccagugcugguaacaucauaucagaucaucuaaaagcugguuagucaguagguucagcaucaauaguuucuaugaaaagaucaaggaaagcagaucuguuugccucugaggauuagaaauauguuuuuauucuucuucuuacaguugaaaauuucuguuacaacaucuauugugcaguugcuuuuucaaauccauaaaugaaauauccggaucacauugacaugaaaccuuucaauggaacaaaauaccagcuucuuagcuuuuguaguuuguuuuaaaagaauccacuaaauagaagagcauaauaauaaucuugaauuuugaaggacauuauuuucuugcauauaaugacuucuguuucugaaguuuugaaaucucaaggcauuguuccucucguauuuucuuuguucuucugagcuuugcgagcauggacugguuuccacaauuccuuucauuccuuuuuuucuuuuuguaagauauugaaagucaaauuucagaauuauucauuucugauguagcccuucaaauuuuuuaauuuuuaaagauauugcuggaagcuucuacaaaagaaaaccagggcaaaagcgaguugaaauagcaaugacccagcuggaauucagcaaucauuuucugcuuuugaaguuagaucuugggcuuuugcucuccagaacuucccuggugccuggggagcugaguuagaaguugcaauuguuuaagauauaucuaaauaaauuagaaguucaaauaacuggguagcccugacuguaguggggaucaaagacagaagaacuuugaaggaagcagaaaaggacguuuuuaaccucuaugcaccgcuucaucuccugggcuuuccugguggacuuccugccucaacucuggcugaaacucagucuagacauaucuaauaaaagacggaaaaagaggaaagaggugagaaagaaggaauauugaggaaagaucauaauauagaagaaaagaaagaaaacauacaaccccaauucuacuccuuaugccuucaucaggagcuccuuucuuuccggaguuggaaaaagucucuaaaaauaaauuuauggguaaauaauucaauugagaaguuaguaauuuuccuuuuauuggaagcuguauuugaagcuccgugauuuaacucgcucagaaaugugguucucuuauuuugaauuuggcuagaggcuaaaagagauauccauaaacgagcacacaggagaguagauuaaaaugugaaaugcucugauuuuucauuugacuuagauagcauuucugugacauuuccuuuugaaagacaaguauuugauuuuggggaaagaauaaugaaucacaaaaggccgacuccccgagcggauugaugaugcccagguuggucugagcagguuucaugguuccuggucacugggaggaugaauugaaaccaacacucccugacuuuuuccacaguggcaccacuuuuuagaggcagacagcguaggugucagauuuucuccaauuaaugcagccaaugcuaaauuuuccaggcaguaguugaauccucagcauuuauuuucagggagacggaucaaaagaccuuugaacuacuuagaaucaagaaguucuguggcaaagaaagcacacgagauguccuagggucaccaaugucacuguuuuaaaaacccagauuucucccguaaauagaaugauggcaggcaaggucaucauuguuaaaauaaaaaauuauauuuucucacccuaagaucacaguauuggggagcuuuauauuuuuaggcugugaguaaucaccauaaaauaauauaaugauguuugcagguugagaaaaauauacauugguuauaauuucuuacacuaguauuuuuuaauggaugaauauugccaguucaguguauacuuccuccaguaucucuuuuguucuggaugccaaggauacaaagauaggaaaccuugguccuacccucagagcccugaaauacuaguggagagacagcucugcaaauagacuguccuaaugaagcaaagugauuuacagaaugaggaccagaaggcagcccgagcccacaagaaaggccgcauagaggaggcuaauuuuagcugggauugaaggaugcauaggagcuaauauuaacucaagagaaacaguuuaaaaaucccaaaacaccuuucaaguaaauaacaaauuuuccaugacucucugcuacaauuucuggcagguggcucauagaaauaauuuguugccuuuccugggacccagagcaaauagacuggguguguuccaccuuuccugaguagauccaagugaagugucccaggucauaaggggcauuagagugcggggccagcucagaccacugguagucguccaugagaagcuucugccaugacaggagcgugcuacgucagugccaucugaucuggcagcugcuggccagugguggcuguugagucuuugaaaugcagucacugcuggguacgguggcucacgccugaaaucccagcacuuugggaggccgaggcgggcggaucaccugaggucgggaguucgagaccggccugaccaacauggagaaaccccgucuccacuaaaaauacaaaauuaacugggugugguggcguaugccuauaaucccagcugcucggaaggcugaggcaggagaaucucuugaaccugagaggcggagguugcggugagccgagauggcgccauugcacuccagccugggcaacaagagcgaaaaucugucucaacaaaacaaaacaagcaaaaaacaaaacaaaacaaaaaacaaaaacaaauguagucacuguaauggaggaacugcauuuuuuguguuauuuaauuuaacuuuccaagucauauugaacagugcagagaguugcugccgacucucuccauacuucuggaagccugcuugaugggauugggccaggagucagugcaucgugguugguauggaagauggaaugggaggcagagcagcuucucccguuccuuagccugcgauguuucagcuguuaggaagcaauucaggcaggaaagcaagucugcuccauuuagguuagucccacauuugcuguuuguuugacuuugagcaggacacagaaguccuucaagccccaccucucccccuguguaaugggcagauuuuacucgcucaucccuaacucuccuuagcacuccagaggcacaggcauaagguacaaguuuugcagcuggaaaugcauaaauguggaucccaguuccagcacuuucuggcugaguagucuuggaucuaucagcucacuucuuugaguaucagcuucuuccucugcuauguccugguuuccauguuuuccuugcagagcugcaauaagggucagagaugcuauagaaugggucauagugccuagcaggcugguaaccaaugcuagccauauuuucagucuaaagauugggcaaauguuggucuguccuugguugaccaacuucuuccuuugagaagcacauagcaucuguacacacagaagcgugugcaugugagggauucauacauaucuaagaaccuucugcaaggaaguuuaugaaaaaaaauucacauuaagugaauugugccagaguuaaaauucugccaagucgacagggagucugaagaugccuuucucaggccuaagugaacaagucaaugggacaauuguuggaaacauuuucuguuuuucuugugaaacccaagucucaggaugcuggaggagaagccauugguggguauggguguucuuugcaguuuuaacuuuccaggaacugagcaacguucuagugugagucucuugggaaagucaauuugacucugcugacucaacauaacucauuuuagagcuggcccagugcccacucccagaguuucaucucucacuggugcccuggaaguccuuaucucuucuggaauucugggcaugagcauaaaaggaagccuguucaauaugcacaggaguauucagcacuggccaggaggugcugacggguagcucagugggcccagaagcuggagaaaaggcuucugcgugcugccgguggggcugaggcagcaggcagagcugaggacagcgauuguucuuugagucugucuguuacugaagcugcacaaugaaccacacaucaaucagaaccuucugacaggugcuguguguuccuaugaauguugagcaguuguuaggguaagaaaacuccuggaggagagcugggugcccaaagccacacuauaacucccucugccccauccaggucuuugcuugaaauaucuaauuaagauaaguguuuuuaagaaaaacacaagaagugcagcagaccagggcuuugucacagagcuccuggcuugcaucuagaaaaucaaugaugaggcaugaaugcaugaccauuuucaagaagguggcuucuugauucuaugguugcuuguguuacagucacacuggugugcuucauggauggguucuucuguggaucacaaggcuuuguucuuacagggcccucaagguacaccagggcugauaggccagccaggagccaagggggagccuggugaguuuuauuucgacuugcggcucaaaggugacaaaggagacccaggcuuuccaggacagcccggcaugacagggagagcggguucuccuggaagagauggccauccgggucuuccuggccccaagggcucgccgguauguuuaucuccagacuuugaaugugcauuuuacaguguggaucugcaaagcauugagaaaugaguaauuugaaucauauugauguauuucuaucuccuugaugauggcacaaaugaacuuguuucaugauucaugguucauggaacaacuuaagucuauaaaccuaggcauugccaguuauuauugacaaauaauuaggugauaacagaucagugucuucugaugcauuugggggaacugaacagauguguuuguguaucuuuuugcuuuggaugggaggugaaaucuaaaguuaauaguauucaugucauuguuuucaaaagauuccagguaucaacaucucauucucuaaaguaucucccuaaguagaugagggaggaagaaugcucagcuuagggagaagaaugcugguuucacuuauuaacuacaagguggcccuccugggaggguagaugaaguaaauaaauagugugagccaguuaacucuaguacuuauugaccacaaaugucagaagaaugcgauaaggacaggguguuggugugucucugauaacggugucuuuuucuucuucucacaucaggguucuguaggauugaaaggagagcguggccccccuggaggaguuggauucccaggcagucguggugacaccggccccccugggccuccaggauaugguccugcuggucccauuggugacaaaggacaagcaggcuuuccuggaggcccuggauccccaggccugccaggugaggccugagaaacucgugaugcagcaugaaguuguaaacggagguuagggcaggcaccucgggugcacacagaggccugggguucgcauaggccagggcgcacacuuggcuuugauucuuccaggaauuggggcaggaccugggcaagccuucagccuuuugugccucccuuuccucauguaugugaugggccagguaauaugcagguggagaacuuggguuuacaguccucauaaguaaguacacagcacgcaccagcuaaagucagccuuuguauagaagucacaccgaggucaagucauuuuccucuccuuacccauuuggcuuuccccgaugagcagcccauuuuggcuucugugcaucccgaguggugugaucuccaccucuucacagucggcagacgccugugaauggauuuagagguccuacagcgcgaugacgauuucauuccauggugguuuuaguugucugcuguuuuuggagugaaucacgcgccaagcucuaugcugagcauugacaacacauggucaaaaccacagacguggucccugcccuccugcacagccuguucagagguuuuccagagaaccuguagcagggaugagugugggcucccucgucguucuccucucccacgacuugcuuauuuucagggccagcgggagggggcuguggcgcuaggccuugcacacagcaggugcuaauaguuuauuaucugacugcgauucccaguagacauggagcacgccuguucuucccuagaaaaucccggaaugagaagaggagaggcuaggaaugccuuguguguagaugagggaaguaaaugcgcguugcuaggaaacauucaaaaguuguaaaagugagugaaaggacuuaaggugauuaaaaauaucuaacuaguaaaccuuaaaaaacauaguuauuuauaaaguagcuggggccaggugcgguggcucacgccuguaaucccagcacuuugggaggcagaggcuggcagaucacaaggucagacauuggagaccagccuggccaauauggugaaaccccaucucuacuaaaaauacaaaaguuagcugggcaugguggcaggcaccuauagucccagcuacucuggaggcugaggcaggagaaucgcuugaacccgggaggcagagguuguagagagccaagaucucgccacugcacuccagccugggugacagagugagacuccgucucaaaaauaaauaaauaaauaaauaaauaaaguagcuggauauuugaaauacccaacaauaaccacguuggagcaauuacagcaugccguucuggcucgcaagugugcugauuaugucaauaaccauauugagccuguuuuaugaauuccuauucccauuagggacuaauauuuccuuauuaauauacaguguauaggcugggcacgcuggcucaugccuguaaucccagcacuuugggaggccaaggugggcagaucaccugaggucaggagcucgaggccugccuggccaacauggugaaacccuggcaucuguaaucccagcuacuugggaggcugaggcaggagaauugcuugaauccaggaggcggagguugcaaugagcugagaucgugccauugcguuccagccuggaugacagagcaagacacugucucaaaaacaaacaaacaaacaaacaaaacacacacacacacacacacacaguccaguuccuaagcauuccaguaugggaaaugucagccaguguuugauggaagcccagguguagugugcuaacauaacuguuacucuuauccuucucccuguugguauaaucagugaguacuuagcaucaaguucugacucuguugaugguuguucuuuguuuagaagcgucccagaaaugucucuuuuaugacuccauuagagguaggggauaccggguuugauggaggaggacuucggugagccaggcauagggacuuccgaucacuuucccuugggucucuugauuccacaaucaacaaaucaagugcugucuuugugcuugugacaucugcagauuuccagagcugucgaagggaauuagcuuuucuuuuggcgagaaacuaccaucagagaaaccaacuggaguacucacaaauauacccuagcagauggggaagaaggcuucuggggagggggaacagggcuguugauccucucuccccacagcuguagggcuccuuggccauccagagccaauuagcuucgagauuagaaaacagaugucuuugaucugccagagcuguguguaacugugguaaucauaaaagccuggugcccagggugugugucaccaacagcaggcauuuccuagggucguucaguuggcguuucccacagucuguagcuaaagaaugugcuggcuguucuagggaggccccacauagcuugaacucuuacgagguguacgaagauucagugcgugcauucuuggaggggaagccuuugguccuuucuuaacagcgaaacccugacacuccgguggcucuccuaggcaugagugcccagagggccggggcugugcuuccuggcuugggaggaaggaugguuuugccuguguugcucaagugagcgcagagcucuccagcugcaccauuacagauaauggaucguucguaaucacccgcggaucauguuguuuggauaauuucccaccaaacgaccguaauuuaggucaaucucaaagcaacuuagacuuugguaaauugagagagaacagcaaaaguauuuugacuuuuugagaccggcucacuaagaaaucaccuagagccaccucacauguuguuguuguagauuuuucagcuucuugugacucuuaauuguggacucuuaagggauucuuguguccaacaaacaucuuggucauuuuggacaugcaaacgcauggggagaagcguagcucucugugaaagauccuagaaacaccaagggaagaaguggagaacacaggcagaggcucugcucuccgggcacucguggugcuggguaggauguggcgugcagcccacccacugcguguccucccuguguuccgugugguccucauuccuucaucguuugucuuugcucuuuuuuuccucuagguccaaagggugaaccaggaaaaauuguuccuuuaccaggccccccuggagcagaaggacugccgggguccccaggcuucccagguccccaagguacgauuggaauuccagcucaccgggauaccacgagaguuuccucacguuuuucucacgcugacuguuggucuuucucaccacaggagaccgaggcuuucccggaaccccaggaaggccaggccugccaggagagaagggcgcugugggccagccaggcauuggauuuccagggccccccggccccaaagguaacccugccagacggacccgagccuuugguccaccugugacuucugugagaaaagaggaggugguagacaucaaaacaccacagaagcuggugaccgcuguucagggaggcuuucagaagagcccaagcagugcugagcccagugauuucaggagcuucuaggcaauagcugccuugcaguguaggguuugguugggaagaugggacgcuaaggcugugcaagcugcaugggcacugccaccaauggugcccgcugaaacccacccuccagguguuugcuuuuuauccgugaggaagacucgcaguccaccugaacacagccaggguggguugggaguugggggagcgcccagggggaggugcaaggagucgcagggaggggccuuugcuccgaggggaggaguccuaccgguguuagagccgucacuuccugcugaaaacuggaaggaggugaggagggaauuucuuuucccccugcuuuucacauuucuuaggucuacuugucccucagguagaccuugaucaacacacuugucaucacagaccuucuguucaggacugaggagaaggugcugugagcacaaaagggacguguuguguaaggaaguuugucuucguacaacacaccacgcagccacacuuagguugaaaucuccuccaggcucccaggcuucuuacccagaggcuccaggccccauccacccucacugcuguaggcugcuagcuuggagaacaggagacggcagccccuuuccucugacagccacgcaacgcccacccacaccacggcugcuucccucaggcugggcgggcagcagagcaucccuguucaggagggccaggcgcugaggccucgucacacucacaacucccucacauuccaccauugccucacacagugccuccuucaccugaggccgugacccaugugacauggaguugcuuggcuuuguggcagugaggaggacagacccuaucugugcagcagccucacagaagaugugauucgggugugugccacugcaaacuuacaaauuacuggacaucggagaccucaguguugcauacaaagggucugaacuaguggcuggccagcuucauagcccaucagagcuuccagagcggggcccagacagugggcagguguccuucagugacagauccugugggaucuugaaaagugggccugccuuauagaccccuggggucugcauuucuaaugaagugaugguggugaccugcccccccaaccacaccuugaguagaugaauaaagugcccuucucaccugcaggcgccaagggguauauuuguuuuguuuggggagaguaggaugggaaagaaaaguuugaagagagcagaagaaaaggaaaggagagagaaagaggagggcagaggugcuggaagagacagcaacgcaccugaccccucugccgggcagucuccccuggccucuuccagccaccucggaaggccuccacaguugaccuucucagaucaggucggcaucucugggcaagacuaaaagugaagaaaguggggaacggcauuguaaucgcaaugauuguuuguuuguuuuuuuuuuuugacucuuuaaaacagguguugacggcuuaccuggagacauggggccaccggggacuccaggucgcccgggauuuaauggcuuaccugggaacccaggugugcagggccagaaggugagugccaagcauucccuccaugacccuucucccccauccuuguuauuaguuggauggaaaaaaugcagguugugaacgucccaggacauguugggccagcagauuuuuguuuuugaugaaauaacauagaauagaaaguaucagagaacguagcacauggaaguaaguauuuugaagggaaacacuuguuuugauuuuaugaaacauuuguuucaauuuuaugaaauuuuaugacagacauuuucuugccuguguaagcugaaacucaggguaaaauauguuucuuacugugagaagcagaugaaggcuguuugaaagccacuguccugaaagaaagcauagucacccaggaugguuucucagccucagcacuacuggcauucuggguucaauagcucuuuucuguggggggccacccugugccuuuguagggcuuuugacaggagcagcccucccuccaccuaugggucaccaaaagagcaucccccuuccacccagucacaacugaaaaucucuccagacauuggcaaaugucacuagggcgaucagauugccccggcuugagaacuguugguacagggugaagucaggauucuccuugcccucaaauauucugcuaccaacuugccuauacuugaaauucugcucagcaaaugugagcgacuaccgauuagauccuuuccuguccugauuguaaggaaccaaugugaaauugccagaaggcauugguaccaaacgggagaaagggccaacggccaucgauaaacguugccagugauggacccagguggggccugcucccuggcccucaggagagggcagaugggcaccacaggggccgugccucugggaucccagggggguuucuuccggagaaauaccugacagcagggugcccuccucugguggcugaggcagaagagaaaccuuuggaccuuugucuuuguacaacccgccaccagcuuccccugauaaccuacguugcauuugaacauuuagucaaccgcggcaacuugcggaucaucuuaaacuuagugcaagacucaggaguuaguaaaugccuaauggaaugggaaugaaagauuuaauuuaugauuaaaaauaccaugcuuuuucaagcauccccuugauggaguuuguuccauuuugagaauuuccuucugggacaaauagggaaguuaccacugcccacuaauguccaaauccucccucucuggaaauaucauuugcagacaggggacaccgguggagcccugugauuucauggccaccugcuugcuuuggagccucacaucuaugccuaaauccaggcuguuuccaaggcaccuucacccuuuauuuuaaucaucuguaucuaucaaagcccagugacucaugccauaguuuaaaaugcuuaauuuacugugaaaccuucauuaauccaaaaaacuaaauaacugguguccaugcuagcccuggaaccuugccaucucuuaggaagaacuccauuaacuacucacaaaucauauuuggcauuuuaccgguuacucagggccagugcuuugucacaggcaccaggcugcagaguugaggggacaagcucaggucagaagacuugagaaaaaugucauuuauccguggggagccuugcuuuuccuccuuuguaaaaugaaaacaaugaaaguuacccaccuauggggcuuguggugagauugaaaagauauaauagguaugaggaagcuuugcaaacgcuugaaaaggguugagcagauaauauucuuacuaaaugcauuggcaguaucuguuaagucuucacuuacgcuauugguuugauaaaaauacugacuuugcaaaucaauuugcuucucugugcuuuggggauuuucagggagagccuggaguuggucuaccgggacucaaagguuugccaggucuucccggcauuccuggcacacccggggagaaggggagcauugggguaccaggcguuccuggagaacauggagcgaucggacccccugggcuucaggggaucagagguaacuucaugcagaucagucuggaggguuucgaggacaggaugugcuuauuuuugcauucccagagccccuaccgaguauauuugauauguauuuguugaacgaacgaugcaaaucuuagaggccuagagcucguggcuuuccguugcuggggccauucgugugcaugggucuccuaggccgggagacgugccacugcuccuguacagcuuacucucaauuuuucuucuccaggugaaccgggaccuccuggauugccaggcuccguggggucuccaggaguuccaggaauaggccccccuggagcuaggggucccccuggaggacagggaccaccgggguugucaggugagugacaugcuucuagaauuaucuguucccaaaagcaugcuuuucugaagcaugggggaugaggccggggucccuauaaagugaagcuuagcacaauguaugagauaaaaagagaaaaaaauaaaacucgaguuugugaaaauagguuugauuguuugcuuaaauguagucccagauucuucucccacccacugagaugaugugccaaacaaagagaccuuuccuuuauuguguacuccgucacguuucacauuuuauucuaacugaugucucuauauuaucuuuccauaggacgguuaauuagugguggauaauuucaacuaauugaguccaugucuagaaccuagcuuugccuuugaucauaauaaucauagaauuaagguggugcauggaaauuagagcaaaacuagcccuaguccuaaguacugcgacaaggcagugguggugcuuaggguggccuugcugacucucaaugacaggaaaggggagugcuuuucuuuuagaacaagagccauuugauuauccugaugaccccaaacaccaacaccuaacagaugauccauucaaguucccagugugggcgugcucacgggcuuucugcagaaagucauaguuaaacagagcacuguacauuguagaucauucuguaaauucugcuaaaaguuauuuguguuucacccaacugcaggcccuccuggaauaaaaggagagaaggguuuccccggauucccuggacuggacaugccgggcccuaaaggagauaaaggggcucaaggacucccuggcauaacgggacagucggggcucccuggccuuccuggacagcagggggcuccugggauuccuggguuuccagguaagugauuuuugaacuucugccuggauccaucaugaagacaugggccucaccuuauucuuuuuaugacucagcauuuacugucagcauucagagcaagaaaauguucacaguccuuuccuuuggccacagguuccaagggagaaaugggcgucauggggacccccgggcagccgggcucaccaggaccagugggugcuccuggauuaccgggugaaaaagguaggggagcugauaacccuagaagcucauuuugugucuauuucucgaugccacuugggaaauucucaaguugucauagaucauauuucccuuuaagacgccuacaaaagaaguuaggaacaucaagcagaaggcugggagacccccuucuuccaguaggauuccuggugcucaaugcacaugggguugaaacugugcuuggccaagcaaaucagaaagaagcugggcuuuccuucuuggcacagaugagauucuucuugugagaaaugguggaaucuucagccaugccaagauacagggaccgaguccuuaggcucagauuaacaaccugcgcaaguuuacaaggcuucgucuuuauuucuuaucguuauuugaaguuguuccaaaauaaugucuuuuacaaagaaauacuguaaauaugacacaugaaaaggucauuuguuuuguagaaugauaaaauuccuguucuauuauuuuguauagaacugaggggcacuaugaauaagagugauaaagauauguaggaaggagagaaauguaaguuaucuaaaccugaaagccaagucacaugcaguagaguuauuagcgaauaaugaauuguagaaaauggcuuuuuacugcucauuuaccugggguuggauucuucugugucucagacacuggccauuaaugccauuuuggacaaguuaugagugcuuuguagccuuuuugccagcugcugucccugucaacaagaacgugagccuuuugagcaccucugugacacuggcccaggcucaccagugccuucucuuuccucugcaggggaccauggcuuuccgggcuccucaggacccaggggagacccuggcuugaaaggugauaagggggaugucggucucccuggcaagccuggcuccauggauaagguggacaugggcagcaugaagggccagaaaggagaccaaggagagaaaggcaaguccaggaggcuucucauggccaagcucggaaccacaaugugccuuuccuggguuaucggguccuccauaaauaauaaccaaaccaaccugcguuucugcagcaacuugcuugcaagcaaaugcgggucauugcuauuuucuucucugauguguaggacaaauuggaccaauuggugagaagggaucccgaggagacccugggaccccaggagugccuggaaaggacgggcaggcaggacagccugggcagccagguacaguguggagcuccgguccccaguguggcaagggcucaggaugaggccuguguuccccagcucuuucuguagaugucaaccugucagacugcuuucuuuaugguucuaggaccuaaaggugauccagguauaaguggaaccccaggugcuccaggacuuccgggaccaaaaggaucuguugguggaaugggcuugccagguaaacuggauuuagaagaggauucuuuagcaugugugcgugugauacugguagggcaugucugcagaaugagauccucuucagcugagacggacagaauccaggcacgugugucuuucacaugaauucacauccccagcucugaauggucuccugcucagggauggaugacauuuggcugacagaauggccauugcuaagaaaacucaccaucuaauggaauaaaacaugggcuguauacagucaacuuuugaugaucuccaagugaccauccccuugucuaggaucucccuaagagacgacggcuucuccauccaggcuugucagccugaguagcuuauggcuccagagcccuuuguguuaguucagaagaauucuccggacuccucugcuccaaucccggacuagccuuaaugcuuugccaucagugucuauuguagugagagcagccgggaagaggaggagagugcgggaagggcuggguggugaugguccucagagcucacucagaaagggggagaguucagaugggaagcccaucuuuccaucuccucuugagucuugaccaggugcuguuaucacuuuaauuaaaauauaagcaucuagauugcuggucaugccuaugugugaauaagccuggcuaccagcaugcaucacagaaccgagugugcacagacuccggccugcccgccucauagucccugugacgucuggcugaugagagcuggcuguauaauaaagaacauaagauccauuuuuauucuguugagaaaguaaauauucuagguaguuaauguauuucuucccugucuuauaacaugauggucuuaaaggacgggagagacauuuccuagcguggcucugaugugaucugggugacugacguguucugggucaugagccgauugauacaugagggaugugcauucuuguaucucaaucuuggcugguugugggggauucacguucuuguaucucauucuuggcuggcuguggaggcacuuuuucauuuguaauaccagcacuagcuaagcccaaaucaaguuucaauuguuuguguuuauaggaacaccuggagagaaaggugugccuggcaucccuggcccacaagguucaccuggcuuaccuggagacaaaggugcaaaaggagagaaagggcaggcaggcccaccuggcauaggcaucccagggcugcgaggugaaaagguaaccagcgcucugcguggaaagguccccuucucccagcucaguggagaugcugccugagaaaugcucagcaaauaucucagcacacucaaugagccauaacacacagggagucccauaaggcagcacaagucgccucuccuuccccuuguauucacuaccucucccccaaggaagaaucuagagacuggugagaggcuaaggugggagacagcugucagugggauaaaacagagaggauggaggacgaagaggaauggcagguagaaaccagaugguuggcucuacugcucuuaaguuuuccucuccauucagaaguggacuuugauucuuugaugagaaaucuggaaauggaguuuugcaaugcaauauucauugcaccaaaauguauaccauuaucuauaacaugccuacagaugcaugcccauggacaaauguaaaguuaauaugccugacuuuuacuugcagggagaucaagggauagcggguuucccaggaagcccuggagagaagggagaaaaaggaagcauugggaucccaggaaugccaggguccccaggccuuaaagggucucccgggaguguuggcuauccagguaggugaggggggcuucucuuggacuuggggaaucuaagaaaucaaagaaaagcccaaacuuauggauguucugguguuuuguuuuuuucuuuaggaaguccugggcuaccuggagaaaaaggugacaaaggccucccaggauuggauggcaucccuggugucaaaggagaagcagguagagggcccucuuugggacacagcccgggcacauagagaacaguggccaggggaugggaggccccaaggaguucccaucacagacggggagcagggaggccagcuguccugucucccaucuucagaugggcaaacugagucuagugcagguuacaggaucuuucugaggucuugucacuagcaggaucuaggaccuaaaucuccaaacuguuuuuguggccaucauggaguuuuugucaccagcuuuugagggucaggguuuggugguguugcugaaagcacgcaggguccuuucugaagggaagucagaacugaccucaggaaaaccaggugugcuugggagggaacagcucccuuaaaggaugucagcaaagggccauuuuguauggcagcuagggugcugugagagguuaugcgggugucugaugugacuuuucucuuugaggucuuccugggacuccuggccccacaggcccagcuggccagaaaggggagccaggcagugauggaaucccggggucagcaggagagaagggugaaccagguauggcccaacgccccauucccuaucagaaucagcaguguccacucccagagaccugcagacugccuguguucagugaauaaagcugggcacagaauggccccuagacugcacaucccugcaacuacuuaaacacugauguggauguguggaguagagugggaugaguggaggggaagaagggaagggguauuuauuaucccauaaauacugagggcaucuuccccugaaauaaccugagcucucaguggugagucagagacacauaaaauaccugcuguuagaacacuuuccauuucccuugugguugcuaugacaaaacaaagcaaagcaaaacaaaacucuuuucuuugcccagcauuuccccauuugaggggaaaugguuggaaauauugguuggccccugagucugcuccugucacuggugggcuuuaacuuggccauaacuuggacaaaagugcaggugugaugaugacaaucacauacacaguaauauuuguauuuaaugcaagagagagauaaacacaccauuugaagcagguuaccccugacuuggggggacacugggaggaccaccaagagcauccacagcuauuggugcuggcuuucuuuucauuuuuuucauuccauaacuuuauauucuauacauuuguuuuucuauacaaacaauucauaaaaauaccccugcacuccuuucccccgauuugaaucuucccucaagcccuuugcugacguuugucaucuccccagcaucugcugccccaaaucucuuuggcuuuccccaccucccugagaauagcaauuaguggaugguugucugagaaucccauuugcuuaucuccagacggcagcaggaaacaaauacucauuugcacagaucauuugugcuaaaugccguggugguucugagcugaaagguacuuaggaaaaaguacuaaauuaggaacauucagucaaggguaucuuauaacuguaggaauaucauuuuauuacaagggugcaauuaacuaauaucuauguacuccacaauauacguaguauuauugcagaguugauagugcuuuguguuguaccugcagauggauuguuuaaguaaagagaaacguggcauuuuacccucaucuuauaggucuaccaggaagaggauucccaggguuuccaggggccaaaggagacaaagguaaucuuugcucacugugcucuuccuuuucaaccaaccgcugcugccugauuagcagaacaaggggcagugucuucaggaugaagccccaugccuguuggccaggcagcaacgggauggaggaugggugcugagcccagagggcaaugccugcaagacacaugugguucccuucuaauuaauggaucaaaauggcgugcaguacacucaugaucagaauuaucuuuuacuuggacuaauuuuguaaaaauccagcagagaggcgagaccccugucauuuuuaugccuagaaggucaucagaauauugaaauucugacuuucuagaacugguuauacuuaugugaaugcaggacaguauguagcacacaccacgagacaaaaacaugcccugcgcagccacgaugugcucaguacuaagugcagcugagaguuggccaggagcuugggaaggcagucucuucucucagagagcugagcauuucaugggaaagcaaaggggacacagaaaauacaaggcaugugagcugcacgacacugaagagaagccacagguggccgcagccaggagcucacacacagcauccaugggcaugcuuauggcccguggcugggcuggcugagugaucccacucagugggaggauucagaaagcccuggaaggccuuggacuucagcugagaaggagcaggggcacggagguguuguuucucccacccccugguucuccccgagaccagcccagaguguuuccuuggcaggcauguagucugacacugggaaccccuggguugagaaggauggccuggugccgggugggcugccuugggaauggacacuucccucucccuuaacucacagaaucccucaaacacagagccccuugcaaaugcaccugcucaaggggucgcugugggcuguuccugcccugccuuuccuaccuugccaugugaucccgcacacuccuuuggacaugcugcacugcccuugcacaaacucuacgcagcaccuugcguuuuccacucauugcugugugaaauagcagggagaauccccaggagaagagaaucccaaaugaccacuuuaggucuugacccuauuucauucccuuuuccuuuguuuuggaaauaaccuuagaauuuuggcauuuuuauugguaagauuuggauacuauguuuaaaacuaaacauagaauuucuuuuuccuacaagcuguuacuuuuuaauuuuuuaaaccugcucuauugaaguuucacugacaggucauaaacuacaaauauuuaaaguggacaauuugauaaggcugacauaggucuacaccaugaaaacauccccacauucuagauagcaggcaaagccuucccccaaaagucuccuccguggcuucauaaucccccccuccugcccucuccccauuccccaagcaaccguccaucugccuucugguccucuagguuaguuugcauuuuccagcaguuuacaaaaauaaaaccauacacuucguagucuuuucagccugacuacucucccacgacauaauucguuugagauccagcccagugguugcucacuucuuucuauggcugaguagugucccacugcauggauauaacaugauuggcuuguccagcccauucaugugcugauggagugaggcuuucguuuagcagugcaguugcugcagaugucuuuaaacacaauucagaugccuuugccauagaacacgucucgugagaaguaugaaaacgauagcuggguuccuagcauucugagcucuuuuuccagccaggccauggucggauucuaguguguuauuaaagagaaggagggaucggagcccuugcugcaguuuccuguggugucccuggaagcucccucugagcgguaccuacaggaugaggcacgccucaucccaucucugccguccacgcuggagauuacuguucugcugcugcguuucccaucaccucaaacuguuuuucuuguucagguucaaagggugagguggguuucccaggauuagccgggagcccaggaauuccuggauccaaaggagagcaaggauucauggguccuccggggccccagggacagccgggguuaccgggauccccaggccaugccacggaggggcccaaaggagaccgcggaccucagggccagccuggccugccagguaagggcaucucgccaggggccagggcugaggacugggacagaauucacaaaaggaaauagcguaaaagaaauaguuaaauucucaauugggcuuuuuuauuuagaagucugcagcauuuauuacagcuugaaauuguguuuggcccccaucgagucaaagcuuuucuuguauccuuucugucaaggaauuuaaguaauuagggagaugcaagaaaggaaaugauuggacaagccuggacucgugccccgucgguggcguuggacuuaaaccagcgcagcacuugggcccacuuguggguucuggugaagacccccguagugguagcacagaugcccgggcaccacugaccgcaggccauuuuggacacggagacaguggcauuucuaugucuguccuuccuuccuuccuuccuuccuuccuuccuuccuucuuuccucccuuccucucucccucccuccuuccccuccccuccccuccucccuccccuccuuccucccuccuucccucccuuccuuccuucccagaccuuccucaauuucugucucaaggguucacauugucgguccaguguuuuaucagagauaguaguguuucuauucccucccucccucccuccuuccuuccuuccuggaccugccucgauuucugucucaaggguugucacuguugguccaguguuguaucagugaggggccguggguggcaguauugauagccccacagcccagggacacuugugcauauuuaaccccaaauguguggcuuucuucucuuccauuaggacuuccgggacccauggggccuccagggcuuccugggauugauggaguuaaaggugacaaaggaaauccaggcuggccaggagcacccggugucccagggcccaagggagacccuggauuccagggcaugccugugaguuauugauuuguagauuuuuauuuuuaaaggagucuuuucuggccagaaguauucauaugugucuauguguguauguauuuuguguauguauauauauguguguguguguguguguguguguguguuacacucccacauccccacuaaaucaguucuuucuuucuuucuugccaguaacccacaucuuuauuggcaucagaguaggaaacuauuguaacauuuuuuuacaauccaguuuuccaagaaccauaaaagggaaauguuauacugcuggaaauuauggcucaaugccuaaauuuaagaccuauuuacaaacucaauguaaaaagcaagccaauguuguuuugcagagaacaauucuguaaaacuagcccagccaucucuuaggacuggcaggaggacagggaauugcaguugaacaguucaagucauaaaagauaaccagcaauauuccaucuuucuuuacugaccugauccagauacagagucuaaguggugacuuagacaagccuucagaagagcacaucucagggugcaauaagugaccagcagccuuguguauuucugugugugugugugugacuuuggcucuuugcugcaccugaauauauagcccuucuuagugguggucauggaucuuugguuugauuuuuagcuuaaccauguccauggcuaaaggauuguguuuacguggcucgcucauucaaauagcuggauuagcagagcuuuauucucugugucugucucucuguuuccucuaucugucuccaucugucugucucucugucucucucuaacacacguuaggagaaagagagaguauaucaggggagaucaugaauaggagggauuugagacagaccucugcaguuauguuggagcaagcgggguucuucuguaagucaacacauguucucccuuaaagggaaagcuuugaacugcucaucagcagcagagacauaucuuagagucaucagacuacuuucucaaggauggauacagaauagcuaagcuugcugggugcaaaacaauacguggugcugauuuacuucugaaucaguaaguuaugaaaugcuuauaaauaauuaugcagaacuggcuauaaggaguagcaacagucauguuuacccauuccuuguccucaaagcuguguauaucuccacaguauagcaaauguguaugugaauguauuuuugggccccuauugcuauauugcaguuuuccaguaauguaagccuagguaauuugucaaauauuuauguauucucauuuuuauuccucaguaacauagaaauauaccccauucccggcugggccugguagcucacgccuguaauccuagcacuuugggaggccgaggugggcagaucaccugagguggggaguucgagaccagccuggccaacauggcaaaacccugucucuacuaaaaaugcacaaguuagcaugguggcucaugccuguaaucccagccacuuggaaggcugaagcaggagaauugcuugaaccuaggaggcagagauugaagugagccgagauggugccacugcacuccagccuggaugacagagcgagacucugucucaaaaaaaaaagaggaagaaaaagaaauacaccccauuccuggugccagucagugucugucugucucuguauacauacuuauguauaaauauguguuuguauauauguuuauauacauauauauuuguucauguuauuuugguuugacacuuuuaaaauaaggcuaagaaacaaaucuacguaagaaauaaaacaacuuguuacauguugcuguccacgacuugagaaaggaacgacuuguugaaauggaaagaaaaugagccccuauuuuaaaauacacgaauauugccacaguauaaaggaaaauacucguuccuuagcauuucuuaauuuucuuugcauauuuaaaaucaguuuucagauaagacaugaaacuaauucuaaagaaaacugauugcacuugaggauuaaggggaaaguuuucagaaaagcucguuggcuggugcuggauggcuauguugccgucacagguguugagggggcccuggcucugucuauggcaucgugcugugagcuggagguggcaagggcaggacauuugccugcuccucaggcgcuuccccuguggauggacaagcagaggagauacaugggagggaaacaaaugcuucuacuuuccagcuucccgauugaggcacaugcaaagguguuguuauucugucauuuaagaaaccacaaggcaccauuuguucacaaaugugcuuuccagaacauugaggggcuguuuccauuuuccaacuagcagguuacuggagagacuuaaccuacauauccugagcaauucccaaccuccucuuugcgugucuaggguauugguggcucuccaggaaucacaggcucuaagggugauauggggccuccaggaguuccaggauuucaagguaagacagcacagaccuugcugcacagccuuugcagcagcagacgcugugugaagagcuugcuaaccucgggcaccuuagcacugauagcaccgcugccauuauagcacgagauacuguucucuucaaauuaaaaauggcauuucuguguggcagcccaauuuguauaaucuuauggaugccaguguaaagacauucugauuuucuuauuaagaaucaguggaucauuaauaucucaauaagaagucauggauuugggcuauucauuaauuuauucauauauuaaacacacauuuuugggcugcuuaccagcuccccaggcacugcaguuuuuacugcugagucagauacacgugaaaggugaauaaaacaggucgcagccucaaggugucuugugguccaacuggggacaugugugaaucagaucgggaccaaaaacagugcccuaugccccuccacuaguuggaucauuuuacaguuggcugcaugcuuauaaaaauguagcuucuggguucuagaaaaaagaguuucauuaaaaguuuuacacacgugaccagaaauaaugcuguuuucuuccuugaagauaaauuggaaauuuguucacugucuaugugugcauauauguguauauaugcauauauguguguauauguauguguauauguaugcaugcauaagcagguguaugaauguguauauauggguaugcauauaugaguauauguguguguauaugcauuuaucuauacauuuguguacauguaugugugugcacuagagagagauauauacacacacauauuuguauaucauugggaauucugugcaagacagugcuuucccucugcuuuuagguccaaaaggucuuccuggccuccagggaauuaaaggugaucaaggcgaucaaggcgucccgggagcuaaagguaggagaguuuguugaucuguggacaccuuacuggugcuuugugaaaauguaaaagccaggaaugcacagaauugggguguuugguuuuucauaugugaaaugacucaaaaaucauuaaaaacaauugauagggaauucuuugcagcaagucaagauuccuguaguugacauuuuaaccagcgacuugucugaaaguagaaucugauaaauccaggacugagggaacuccaggggagggguggccgagguucucacugacaggcucagaauucagaaacuucccaaggcucucaaguuagccugaaaucaaccacugaaaguuauaauaggaaagaaaaucaaucuugcacuuagagacggagugcauuccugcugcacaguaaagaauucuuccugggaaaggugcuguuggcuucuccaccggugggagccuacagcaugaaagucgccgaaaaccacaucaucucaaaagggaaugguuuaagcacaguauucauccugcuuccucuuuacagcagaccauacuucuagggcaucauuuaauuuuccaaaccauguuuugggagagagaaugagaaaccacaugcccugagaaguggaacccaaggaaggagaggggagggaggguguguggaaggugagggaggguguguggaaggggagggaggguauguggaaggggagggagaguugaggguauugggcugaaaacggggaggcugaggggaacucgcacuuugugugguucuuaccacaugccaagacuugccaugcagaagaaggauuaaguucauucgucacucaaagaucaggaccagugugauacuauacaguaaggcagguuucagaugagugugggaaaaauguccuaaucgcagaguggcacucuccacgucagaagcgggggcugcuugggaagaacaagcuucucucccugcugggagggcuggcaugaggcugcagggcaguugucaggggucccagagcccagaaugcagugggaaguuacgcugaugccccaaugccuuugcccgagaguucaggauuucagguuaaauaauaaagaugugcagauuggacauguuuugugaagaucugauuaccuggguuuugauaaugacuuuaccuuugagaaguacguuccauuuggauagcuucacccgggauucuccuucuaaaguuguuuccgccccaguauguggacagugaaauugaucaaugccuucccuauucccacaggucucccggguccuccuggccccccagguccuuacgacaucaucaaaggggagcccgggcucccugguccugagggccccccagggcugaaagggcuucagggacugccaggcccgaaaggccagcaaggugagaaggcuuggccugugcagggcgguauggggagcccagaggggcaguggucagaguuccuccucacccauguaucuaaaauaaguuucuggguaaugauuauacacacacauaugaauaugaguuucuuaccucccuucaaugcauaucaaaaccuaugacauuuuuaaagggaccuaaaaaaaauccagaagaaaacccaggaaaagcuagaggaacacauaacaacacaucuguguucaguuagaaaaacaugggcucaaagaaccagaucauuaccuuucccccuccugccucccgcuccagauggggguggcauguagcaaucuggaaugguaaaaaucggugcucuccauccaugcccccaggagcgcugccugauuggcacugucuguacaauucucuguuauuuccugaaacccuaacauagucuucugcuuauuugagugaaacaucuccuauuugaagagcuacugauaaggagugggugggaaguaaaggagaaugaaaacauuuuaaaguugaaagcaucaaagaaaauuuaaugauacuuaagaauaagcuagccaggcucacugggucacaccuauguaaugccggcuuuuugggaggcugaggugggaggaucacuugagcccaggaguucaagaccagccugggcaacauagggagagucugucucuacaaaauaauaaugauaaaauuagccaggugugguagugcauaccuguagucccagcuacucgagaggcugagguaggagaaucgcuugagcccgggaggucgaggcugcagugagcgguggucacaccacugcacuccagccugggugacagagcgagacccugucucaaaaaaaaaaaaaaaaaaaaaagagagagagaaagaaagaagaagaacaagcuauguacaugaaaacaaaaaaacuauccauguugguauaucuguugccuaaaaauugagaccccaguauauggcugagagggaaaguuauccagucucucauucccuccacaucaccugccuuuuccaaaccaaucugccaaacagcaagaaaccagggagaacucagaacgaggugcccaaacacacacccccuuaugaauauccagcugcuucugcaaagucuguacucgacuuugugggaagcaacuccuggcuguccgagaaaacguucucaucugcagugagacuuuaugcuuggcuccuugaacacugaaaaggacauuuaagaagggaagaaagagauacagcuuacugccauacaggaucauaaauuauuuuuccucugccucagguguuacaggauugguggguauaccuggaccuccagguauuccuggguuugacggugccccuggccagaaaggagagaugggaccugccgggccuacugguagguugcgaaacuuccaacguaauuacccuugaccaggaucuuugggauagaaggagcagaaccaggcauggggaaacagcagaaugaaguuggauauaucacuugacagauuuccgaagaagucuguuucuuagaagaaauagaaucaaauagaagagcugaagaaguguucuuuuuucuguguagagacagauauugaucaaaguguacguuucccagauguuguugaaaggcagccaauagugguggcccaugugguuuccuaagugggaugugagcugcagcugugaaaauucuauuucagcaaaggacaagggaaguagaaaugaaaauaaugccagcauuggcccaaaggcaugggaugaacuugaucugcuuccuuaggagaaggcacacucgaguguccggugaaggcuaugaugcaaaaggcugaggccacugacuaauugaacaaagagcucagcccagcagaccugggcacaguuuggcacguggcacaguuagagaggggacagaagcaggccuugccugcgaggucccuuacugcuccauuuccauacgcaggcuuugggcugcuauggaggaagaaacaccuuaagaugagguuguuuaauaauucuaugauaguccuccccaacaggagccccacgauuccgugugaaugacaugcacagagucacgucauucauuuauuuucauuuauucauauauccauuuucauaugugucauauauucauugaacuaaauuguucaagcaucugcucugcaccgagaacugugcuuauaaaaauaucuugagguggcagguaaaaagaaaaaguuaagacaccaugaaggagguaggcugcuguauuuaguuagccaugcauucuuuuuagacuuuuuugguaacaugaauagguaggauacuuuguggaaauauaaaauauuaaaaacucuuuggagaaaaugauuuugaaagccuuuaggggagcguguuuguaauuagggaaacuaauuugucuccuaucuuccagguccaagaggauuuccagguccaccaggccccgauggguugccaggauccauggggcccccaggcaccccaucuguugaucacggcuuccuugugaccaggcauagucaaacaauagaugacccacaguguccuucugggaccaaaauucuuuaccacggguacucuuugcucuacgugcaaggcaaugaacgggcccauggccaggacuuggguaagaagccugcagauccaugcauucauucaguguagguguguugagugccuucggugugcagugcuggacucgccucugcugcugcagugagggcaguagcgagugaaacacugcgccaugagggcgguagccagugaaaaagcagcccggccccauuucccuccauugauuacaaauaaucgguucaacagcugcuguauuacuaauggcaagccaagaaauguggagacugaaucuucgaaaaucuuuaaauuaauaaaacuuuagaucucaucuucaaauuaucaaguaggaucaagauuccuggagugcacuuaacaauuugcauugaugcggcuuaaccauugcucuuuguaaaaaaaaagguccauguuauccugucugaaauucucuacagcugcugagcucugcuccucuaguuuagaucagcagaaagcuacauaucuguccucauuaucuuaaucugacccagauauccuccaccaaacuguguuuuaauuuucucugccuuuaacuuuuaucaggguuagaaucagcaagcugcuauagaaagagcaucugcauuuucugcaaaacuguugugaaagacauugcccaauuuguuacuauccaucguauaacgaaccauguguuaaguuccuucuagaauucagcuuuaggaaaagguuucuuugugcugguaaacugguuuuguuuccuuucaucaaaaauguccuacauaauccuuuauacauuuccauuucagugauuauguugauuauauguuuuugcuuguuguccagcugaaauccacuuuacauagagauagauugugaauuauaaaggaaacaucucacauugucuucuuccuugucuaggcacggccggcagcugccugcgcaaguucagcacaaugcccuuccuguucugcaauauuaacaacgugugcaacuuugcaucacgaaaugacuacucguacuggcuguccaccccugagcccaugcccaugucaauggcacccaucacgggggaaaacauaagaccauuuauuaguaggugagucgagcaucuguaggaacaaaugcaaaauugaagaggaaaagucucuagucuggacaagcauauguuuucuauuuuucuccaaaacguugaauccauugccauuuagcuuauuauuugugauauucgaguuuuguaauggaaaucuaccauaaaaauuauuugacauaaaagucaguuggcugggcacaguggcucaugcccguaaucccaacacuuugggaagccgaggcgagaggguugcuugagcucaggaguucaagaccagccugggcaagaugacgagacuucaucuccacaaaaaauacaaaaguuagcugggcgugguggugugagccuguggucccagcuacgagggaggcugaggugggaggaucacuuaagccugggauguugaggcuguagugaacugagaccacaccacugcacuccugccugagcaacagagugagaaccugucucaaaaagaaaaaagagucagcuauucucuuuuaaaauuguggugcaaaaccauggugagauaaugccaggcuugcagagauaauuuauauuuugccugacucacuguggugguugccuuuccuccugugagcaaggugaugccacucgauucuucagcaagcguuggaacaguguugcucaaucuuucuuuuuaaaaaguaacagcuuccccaaggagccuuuuaagacauuguuuucugaaucaucccugccccuaugaauuuuuuuuuuuuuuuuugagacggagucucgcucugucacccaggccggacugcggacugcaguggcgcaaucucggcucacugcaagcuccgcuucccgggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggcccccuaugaauuuuuuuaaaaguuauuuuuaauuuugguaaaauggacauaacauaacauuuaccaucuuaauaauuuuucagugcacaguguaguggcauuaaguacauuugcaguguuguuuuaccaucaccgccauccgucuccugaacuuuuuuauuuucccaaacucaaacucugucccuguuaaacacugacuccacaucccuccugccagccucuggugaccccccauucuacuuucugucccugugaauuugacccccguagacaccucauguaaguggaaucauacaguauuuuuccuuuugucacuggccuguuucacucagcauaauguccucaggguucaucuauauuauagcaugugauaggauuucuuuccuacuuagggccaaauaauauuucauugugcauaggugccacguuuuguuucuccauuccucugucacuggacacuuagguuuuguccacaccucagcuauugugaacaaugcugcuaugaacaugggugugaaaauauuucuuugagagccugcuuuuaauuguucuggagguacacccagaaguagaauugugggaucaugugguaauucuauuuuuaguuauuugagaaaccuccaugcuguuuuccacaguggccacacccuuuacauuccugccacagcgcacagggucccaguugcuccacguccucaccagcaugcguuguuuucugcguuuuugauaguagccaucccaaugggugugagggggccccuaugaaaucguaauaccgcagacauacuguguaucuccucuguuuguguauuguauguauaucugugcuuuauacauaaaauuauacagauuuauacauaaaaaguuauacaauaauacacacacuccccaguuccaccaguuuuugcucccuugggugauauuguacccaucgaaaaugcauguguuggacugagcgaucucccuugaguguuuauccgcacuaauaucugaaguacguuuucaggccccaggagccucccugauaggaaguaagauggaaaacugaaauuauuaccacugaaaauaacaugacuguccucucuuugccucuuuccuucuaauuaaaaguuuauugcuggccaggcacaguggcucacgccuguaaucccagcacuuugggaggccaaggcaggugaaucaccugaggucaggaguucgagaccagccuggccagcauggcgaaaucccaucucuacuaaaaauacaaaaauuagcugggugugguguuacaugccuguaaucccagcuacucaggaggcugaggcaggagaauugcuugaacccagcaggcggagguugcagugagccaggaucgcaccauugcacuccagccuaggcgacaagagcaaaacucugucucaaaaaaaaaaaaaaaaaaaaguuuauuucuuagaaauauucagaaauaauaggaaaguggccagugaacaaauucauuugacuaagaagcuauuccguaauuuuacuuuuuacauauuaagauaaugauaaaaaaagauacaaaguuuuuuauauucccuuuaaagaaaucagcagucuuugaauaugaagaaagauguagcaguaucagguaggaagugcccuacauucaacagaaaagggaaaagggaagcaaaugcuuggagucaccccuggagcuccugcccagcugccccaggcugugccuuuagcccaacuccuuucauuagaugaacaugcccuguuugggggaagaccaggguuacgugccaggcaauuccuggcagaugacaauuuagugagagagcuaugccacgugggaccauggaccagagggcuggaaggugccuccuauguaggaaaaucuuagaucuuugauccccuuacauuaaaauaucuacugacaguuuucuuugauuuuuuuugagcuauaagaaaacuuauuuuauaggucuuaaaauggagaauaucauucauuacacuuccagaauggcacuuuucagaaugcaggcaauacuucaccugugugaguggcugccagauauugacuguuuugagacuuuucuugcucagaaccaugccugauaacuagaaggaaaaguaacaacuuuuguggguuucuuuuuuuagcuucuuuuacacaacagguagaaaaagacuauucauugauagguuuccuguuuacuuucuuggcaauguugacauuugaccuugauucagagcuccuugacaggagcucuggcaugcccuggugguaguccaaaaacaggucucagagaagcugugugucugagaccagcauuucugugugaugcauuccucucaguaaaacaccccuggucuuugagcaccaagagucuaagucucuguauguuuugauccugagaugagcuucuaaagccaacggggaggugcuaaaccuuagagucuaagcaauggggcacagcauuucccacuuaacaugucauuggaccagaaaguccugaaaugucccaggacuuuacauuuccagauuuuuaugucuuccuguuaguugacacaucgaagcucagcaugaagggaccuucccaggcauguacuugaagcugcugcuuuugcaucaagucugccucuacuucccucucguagagaggcugccccuuugucccugucucugagcaagcagguuuccacgguuacugaacuuagugguuuccacgacuucucaggacuuacagguuccuucucagcucuucccuuuagggagguccgaaagcuaaauuuuagaaacagcaaaugacacaaaagccuucguuuugagcagaaaagguggcaguuuuccagcuuucauccgauaguagggcacaauuuucuaaguacuuucuagcuuucugcagacaagacucacgaaauaaauacugauugcuaauugcucugacgaaaagaccgcuggauugagagcaaggagaacugcauuuucguucugucuuggacacaacuaacccuggccuuaguuucuucauaugcaauauggagaauuuggccaugugaauuuuaaggaaucacacagcucuuuaagccugcaauggggcaggacccuugaaucccucagcccagagacagucugaaaaagacaaaacccuucccuccaggcuguauuucuaggucucgugucuagcaaacagaugguggcagauguauaaggccaauuucagucacuguuguuuaacugaaccuuuuaauucaucugcauuugggugaauaaaauagaaaauugcacacaccacacauacacacacacacagacagacacacacacaaguccauggaaaaucaaaugacucauucagcccuauucccccuucugauccacguucaugcaaaugucccaguauaacuagguguaauuauugacaccauuuauagucauuuaucagcauuguuaacacucuguucauuuugugacuugaauguaauuauucacuguugacguuuaauuuuuuuuuaaacaaagcauuaucccaccaucaaggguucccuucauugagagggucuuagucagaacacugugcuguuuuaauguguuucuggugcagucccaaggcugagcugaaucagccuggcuugggaggcauccuguccuugggaggguccucuggaggucacuucagcggcaguggaugcugacagccuuggaccuuggacaucugagccaagagggcagaccaaaaagacaaguuucccgcaggaggcccauguggacauucagccuuaaguucauuaaagcaugcauuauuugucuuaguuacucaacucacuaagugcauuucuuauacuaaagauuauuaguagcuucaaacuguugcauuccagaaggaguagcucuuggauuucaccagcauuuuuucugaagcauuuauugugcuuguggaaauacguaugcauuguugaaagauuggaaaacacucaaaugcccaaagaagaaaaguugccuguaaccccagccccuccaggagagccacuguuagagcuuugccuuccuauuuuccccuucuacaagacagacaguuaaauaacucguguuggaucuauuuuuuaaacaauauuuuaggggcaggucucgcuauguugcccaggccguagagcaguggcccacaggcaggccgagcauagcucccugcagccuugaacuccuggccucaggcaguccugccucagccuccccaguagccaggacuacaggccuguguccugcucuaauuuuuuuuuugagacggaguuucacucuuguugcccaggcuggagugcauugacacaaucucggcucacugcaaccuccgccucccagguucaagugauucuccugccucagccucccgaguagcugggauuacaggcaugugccaccacacccagcuaauuuuuuguauuuuuaguagagacagcguuucuccauguuggucaggcuggacuugaacuccugaccucaggugauccacccgccucggccucccaaagugcugggauuauagacaugagccaccgcccccagccauccugcucuauuuuugaauugaauguuuuaauacugagacaggcuuauaaaaccaacggggagguacuaaaccucagagucuaagcaaugggcacaauguuuucuacuuaauauguaauuggaccagaaagacugagugaggauguugaguguagguaacggggcagugcauggagggcggccucugcccugcaccccggcugugcugagugucucugcuccacuuccaggugugcugugugugaggcgccugccauggugauggccgugcacagccagaccauucagaucccaccgugccccagcgggugguccucgcuguggaucggcuacucuuuugugaugguaagugucuggggagacgccauauuucccgggaagagccccacucacgccccauagucgccucugucuggugccuccacaccuuggaguucucugcaucucgcugcuuaagccccuccuucuuccuccaaccauccccuuccaaagcaugccucaaagccuggccugcccugccuggugacagcaggggucuccagcaccagccagaacccuccccugcucacagccaagguagcugggaugagcaucuuccuggaaaugcaggcccaggccucugcuucccuguggcugcuccacucaggugcucuacgggucuguuccagcaccagcaauaugaacagcuucucuauacaaccagcuucuccauacaaccagcuucccuauaugagcagcuucuucauaugaccagcuucuccauaugacuagcuucucuguaugaccagcuuguucauaugaccaguuucucuauaugaccagcuuccaucuuugagcagcuucucuauaugaccagcuucuccauaugacuagcuucucuguaugaccagcuucuccauaugacuagcuucucuguaugaccagcuucuccauaugacuagcuucucuguaugaccagcuucucucuaugagcagcuucuguauaugaccgguuucucuauaugagcagcuucuccaugugaccaacuucucuauaugaccagccucuuuacauggaguggaggccucuuucagggaaaggaggaagagagccuccacguggggaguacacauucuacuacaacaugcacgagcuugaaagcagaagcuugaguuagggagagaacacccgagggcuggccguggccuccacgaaggcccuccuggggcagugccgccugggacccuucccagagggcaaggacugcucuccuagccccagggcuucccuuucccacaaaagccaacugaaacagaaaacaaggccccuguuugauacacucauuguagcuuauuuuauucuauuaccccaguuggcaguauugauugaauauauacaagccgugaacuuguaagaucagaguuaucccggaauuugccaauucccaguaaaugacccuacacauacaucugcaccaucauuggaaguccuagucccaucuucacacugucaggaaugggcaaguuguacauuugacccacagaugaacauuauuuauuaucugauugacaggcuucauagcuauuuucuucuguaaauuauuccaauuguagaaaaaauuggcgggaaagcauuuuuuuaauguuugagugaggacgcugaggguagauaacaagguaacucacggaugguguggcgucugcccugcgccccagccguguggagggucucuguuccaccuuccagacgugcugugugcgaggcgcccaccauugccauuuccuucuacugguuuuuucuugugcuuuucuacacauuuuuccaaguguagaaaaaguuggcaggaaagcaauuuuuaaaauguucgugcacguguacaaguuugauuguaugauuugcuggguugauuguacugcagcuacacucuucauguugcaaccaccagauuaacagguuguugcaauaauucgaagugcugcauuguaacuacuuuaucgagagagccagaaagguugaaaaugcuguauagagaaaucaggacacuaacaaugauguaagcuugccauguucauuaaaagguagauuggauucgccacuccauaaucauaagaaauacugaguggaaucucugugugucagagaaagcccacaguugcauugaggacccacaggaaagcuguugucaccaccaacccuuguccgggugucaaaaggccugaaacagugauugcccauaauuugucuaaaucaggagcaaacgaaaauagugacguucuagagaacagugucuuccagcaccuccucugaguucucaggacgguggcucugaucuggaggucuggagaccccguccuugccucugcuccgccuugaagcuaugugauccuggucagauccgagaauguccucagcugggaaucaguggaguuagccuuguccucaaaggucccuugugucuccaaaauucuagaguucacauuuccuauaucugaaauaauagucacggggcucuguuguaaugucuuagucaaguuuguaugucauucauuuuaaggucuugauuucugaguacaggaagguccuacuuaaaccugcuagaccaaaaugcaauuugauauaguaguagcuauuuuuuucucuuucucuuguuuuucucucuuuuuaaagaaaaaaaauugaaugauuauucuuuaccuuauuauaagauaaauagcaucuaauauagcaaauacaggaaugcauuuguaaagucugauuccacaucaguuguuuacaacauuauuugaacauuuuggcuauugucucaugacccauguuagaauggguuggaguguuucaaaucuaauacacagugagcucuucuuuaaacucuaaugaagcugggcuggucaccuauuugggaagcagccauuagacgaucccuggggccaugcugagcaccauggggccccagccaugcaggcacuggcuugcgggccagcccgauaauuugggcacagaguguguccuguggugaccacaugaggcugcaguguguggcuuuccagagggaacacccuggcgccuuccugggaaggaucgaucucuuuccugguguuuggggagggaaccucugacucacggcucgcaucuguucugcagcacaccagcgcuggugcagaaggcucuggccaagcccuggcgucccccggcuccugccuggaggaguuuagaagugcgccauucaucgagugucacggccgugggaccugcaauuacuacgcaaacgcuuacagcuuuuggcucgccaccauagagaggagcgagauguucaaguaagugggagcacugcuuuuuugcaggcugcuggccccuuugugacuuuauuuuuuaaucauccgcgauccguaacaccuuccaaugcaaagucucaaagaugguuagcaaugaauauuugaugcuguucgacaugggcagaugaccgagacgauuuucaaaggcagaccuucagucacagguuuaauuuuuucauuuaccgaagaaccaugaaagaaaaaggucauuuuccauuuuuucuaggugaguguacuaaaauguaauuaaagcaacugaaaucuccaaacagagcauguuugaaauacaguauauuuaacaaucccggggagaagaagugagcagcguucauuuucaugccauucauaacacugaucguaauguacacuuuguguaaguucugagugacuucacaagguauuuuuuuagaccugugcaaauaaaaauuaauuucagcacaaauucagcugaaacugagagggaagacccuuccuuccuuuuccauuaccaaaaucucaccuuuaaaaugacuggcccaaguggcuacuaaccuugcuggaguugacugggagccgggccgguccccgaaggccaggaacgcauaaugaacccucuaucccgagccccagcugcagccccgcuggagccaaugcaggaggcugacggagcuggcacagcugcuuacuguucauuuccaaaacaagcgcuucucaccccuggagaugagccuuuccaucuucaccuuuuuggagagaauuauauggaacccugcuaugauccugucucuuuccagcuuagauaguaagaggcagaacaacauacacgcuucucuaauucguuacucauccaaaaagugccgcgugccuaacuggugguuuauuggagccuuucaaggaacuggaaacuugacauccaugcugcagauagaguuuaaccauucacuaccaaaaugagcgcacuuuguucaugccucagcccuugcgguguccucuuauaagguugauagguaaugauggguuuuuuuuuuuuaaccagcagccugauacaauaaacuaaaauguuuucccaaagcaaauuagguaagaucccauuaauuuaaauaauaaacuugaggguacuagaauuugcaccaaaaguuaauaaaauaagcagccucaauuuuaggaugaggcacucucauaaauggcuauuuuaauuuaguuuaauuaauuuauuuauuuuaauagaauuuucucaguaacaauuuuaguucagauuuuaccuuuucaacaaucaaaauaauguagaguuucuaagcuugagaaacacuugggacauugaaugucuuucccucuuuuuggucucaaagcagaccaucugcauagaaauccuucaaaaguuauaaaaguauuucgaggucuagggaauuacuccagauuuauuacucaucacaucauuccacaaauauuuaaugaauacuuacuguguguguaaaguguugcagagaagaauaauaucuucuucuuacccuggaggaguuuaugaucuaguggaggagaauggaaaaaaagugaaauuguaguacgaggaggcaggguggcacagaggggaauggccaaggcuucggagccagacugauguggcgggacuucagcugugcccuauggggcugugggcacuggggcaggugccagggccugggugugcagcugguaaccugcaguguucugugugcgugggaccgugugugcacugcacccagcaccugccugcucacugggugguaccagguugaggccugaugccaggggcugggcugaucccuuagagauuuccgagcagggcaggagugccauguuucugacgugcugugagaugauggccaauggucugucucugugucguguuuuaggaagccuacgccguccaccuugaaggcaggggagcugcgcacgcacgucagccgcugccaagucuguaugagaagaacauaaugaagccugacucagcuaaugucacaacauggugcuacuucuucuucuuuuuguuaacagcaacgaacccuagaaauauauccuguguaccucacuguccaauaugaaaaccguaaagugccuuauaggaauuugcguaacuaacacacccugcuucauugaccucuacuugcugaaggagaaaaagacagcgauaagcuuucaauaguggcauaccaaauggcacuuuugaugaaauaaaauaucaauauuuucugcaauccaaugcacugaugugugaagugagaacuccaucagaaaaccaaagggugcuaggaggugugggugccuuccauacuguuugcccauuuucauucuuguauuauaauuaauuuucuacccccagagauaaauguuuguuuauaucacugucuagcuguuucaaaauuuaggucccuuggucuguacaaauaauagcaauguaaaaaugguuuuuugaaccuccaaauggaauuacagacucaguagccauaucuuccaaccccccaguauaaauuucugucuuucugcuaugugugguacuuugcagcugcuuuugcagaaaucacaauuuuccuguggaauaaagaugguccaaaaauagucaaaaauuaaauauauauauauauuaguaauuuauauagaugucagcaauuaggcagaucaagguuuaguuuaacuuccacuguuaaaauaaagcuuacauaguuuucuuccuuugaaagacugugcuguccuuuaacauagguuuuuaaagacuaggauauugaaugugaaacauccguuuucauuguucacuucuaaaccaaaaauuauguguugccaaaaccaaacccagguucaugaauauggugucuauuauagugaaacauguacuuugagcuuauuguuuuuauucuguauuaaauauuuucaggguuuuaaacacuaaucacaaacugaaugacuugacuucaaaagcaacaaccuuaaaggccgucauuucauuaguauuccucauucugcauccuggcuugaaaaacagcucuguugaaucacaguaucaguauuuucacacguaagcacauucgggccauuuccgugguuucucaugagcuguguucacagaccucagcagggcaucgcauggaccgcaggagggcagauucggaccacuaggccugaaaugacauuucacuaaaagucuccaaaacauuucuaagacuacuaaggccuuuuauguaauuucuuuaaauguguauuucuuaagaauucaaauuuguaauaaaacuauuuguauaaaaauuaagcuuuuauuaauuuguugcuaguauugccacagacgcauuaaaagaaacuuacugcacaagcugcuaauaaauuuguaagcuuugcauaccuuag

SEQ ID NO: 15532 - RNA, 205810 nt, Homo sapiens
cggugcgcgggcggcgccucaaaggggaggacccugcggcgcggguaagaggcggcgggagcgcgcggcccgggaguguggcugcagugcgccgggacaccagggcuccgcgcuccgcacucaagaggcucccgcgucccaaccccucgcgcccgcgcguucgcggauccaggccgaggaccgaaaggggccgcccgagcccccggggccggcgcccagagagcccagcaaggccggccgcccugccggugugccgccggcgggugcuucuggaagggccaaugcguucgggcagcagccccugaagccgagcccgaggugagagcgacccccgagcggcgcccagacccuggcccgagagcaccgacuuggagcgccuugugcaggcuagggcugcacgcucuccugcuugggaguagaaagggggagggugggagagcgaagaccgagcuccucggccaaggagcacccacaggggccuaacgggaggcucuccuucuuuccgggucgugggggggacggcccuccggucaccccugcaugcgggccgcgcaccgcgcuguccccgcgucucgcggaccgagaccggcggugaggaugggcugccucccucauccugcgcuaaacucgcuuugucugucgccucuaggcuaagugggacugaccggggcccagaguggacgaaccgccagcauggggagagaccagcgcgcgguggccggcccugcccuacggcgguaagcgacuuucugccugguccccgugggucacgcgcgcauggacccuucgguguaacucucggggacugacaagccgggcccgcacguucacgucucucuuccucccuuucccaugcagguggcugcugcuggggacagugaccgugggguuccucgcccagagcgucuuggcgguaaguccuggcucccgcgcuuggacuugcgcgcccgagagugguugggacguuugaguggccuuggagaaggcagcucguccgugcgcucccgagugugugugugcguguggauguucgccaggcugcccaccaagguucugagaaagcuugcucuucccucaucaugcuuuccaccuuuccuuccccuuggguucccagcgucaauccuguguuuugcaagcgucggccuuucacgggaacugggaacuuaaaauguagccugaggcaccguuuucguugcuuugggcaaagcugcagccguagaggccaggaaagugugucagucacuaggcagugagacgccaggcuuagggcgaaaaaaguuuuccuggaacucgggagcugguggggagucucugucacggacugaggguuuuuuguguuuuuaaaugggagucucuggguaaaggggcggggcgaggaggcgaacgagacaaccuuaguauuguuugaauugaagcauugcgagggaacaauggcagaaaaaccgcguuuucucccaaguccuguuccggcccuggaagagcugcuccgggcgccacacugggauccuguucgccgagccugccccuccacgccggccgugcacagcccugccgauaccgugggugcagcuggcgacugcacugcgaggcuuuguccauuuuauacguuuuguuuaaagaguaggagccacuuuuacugagcuuuauguaaccauggcuaaaaugaagagguuugguaggugaauucggugcaggacucaaauguuuagacaggagcugaaagcggagggagcuuucgagauguccgcugucccuccucuccuuacuguggccgauggaguagcccugcccuguggcagccggggcccagguggauuccuccugggaacgaccccucccuccucagcgcgcacugugccagagcaguacacagguacaaagggcaaacguguucaugauuucauuugaauucuguuguuuuuacaucguucugcccugauguaaaacaaaccaggauuuuaaaggcagugagugaugaggagcuacucccacuuggggaagagcugcuaacuuuacuuuuccgcugcuguugguuccgguucaaagcucgguuugggaaguaagaggaggacucggagacuuugaccagagcacuccaggccaaaguuuucuuccaguucaggucugucucuucgucccagccccgacuuaagaucagaaccuagauauuugaacuagcccagugacccugugaauucuaaugcacaggucuguacugcauguaagacuuggcucagauuuaugaaccagaagcaaugcaugcacgcgcacgcacgcacacucaaagaagggggcgaucccuagaaaauaccacaucgggcugugugugcuuugguugugcugccaccugcaccccuuugucccuuagagccacuuuuauaauuuccauauguucaugccuaaggauggugggagucccagguauucuuuucugaacucauccuaaaauugguagaaagaccaccaagcaccuaggucuaaagaucuagguauuagccugggcauggcggcucacgccuguaaucuuagcacuuugggaggccgcggccuguggauugccugagcucaggaguucgagaccacccugggagaaacacgguaaaacccugucucuacuaaaauacaaaaaaaucagccgggcuugguggcgcuugccuguaauuccagcuacucaggaggcugaggcacaagaauugcuugaacccaggaggccgagguugcaguaagccgaaauagcaccacugcucuccagucugggcgacggagcaagacucugucuaaaaacaaaacaaacaaacaaaaaaaaccuaguuacuaaacauagcucugcccuaaucucuuaaauccagagccccaguuuccguacucugaagaauuacggcuucacagaggccaagugcccuaaggcagauaggacaccucuaugccuccccaaaaccucaucauugcugcaagcucacccccagucucuuugacucuuugaucuuuggauggcaccaagaacauugauugcccagcagagcuucucaaagugcaggcccccuagacccccagaccuaaacccugaaaggcuuguuaagaagucaggccccaucucagaccuucaggucagacauuccaggguggaguccgggacuccgccuccccacaugauaccagaaucugggaaccacugagcuacaguauuggguugagaggcaguugagauuacuugccaauucacuuuauuuuccugggcuuuagauucuaacucaaccaaaaaaaauagauauuuuuaaucauuuuacuagggaccuaguaauauguguuguuaagagacauguaguuuguuacguucaacaaggggcuggucuucuacuuacucacuucuugguaaccacuggcuuuaauggcuguuccuugugaaauaauguuucaauuuucaacuguauugauuaaagauuuuucuuaauuguggcaaggacucuuuccugcguaggucaguucaggaaaaagggcugccgcugggagcccuuuggcuuguuuuguuucggaagcagcuaggaugggcagugaagagccuuggugauuacuuauugggcacuuccugugugccaauuugucuguacuaaugcuucuaauccucacaagcaagcacacugaugagcuagguaacuauuauuacccccauuuuacaggugagaaaagccacaaaggguuugcagcccucgcccaagguuccugucuuuguaacugaaugagacggauuagaacccaggccucuuccuccacaccgagcuucccagggccugaaagguggccgggagggcacuccugaguuucagucuuugagucuccuggggugugggugcuuucuucuuggucuugaccguggacuaacaguggagcgggcacugauuccuaggaaggaggcucucccccuccuuccuccucugcuucucccacugugaggaucaggggcagcaagugaaggagagaagcaagacccuucccaaagggaggaaaggaagccgaaaucccacggggcagccugggcucuagacucagugugaacccaggugaucugugugggcaccucaggacacacucccugcuguccaaggugcccuuucuaaaggugcccuuguuugaauguggugccaagaugcacaaaauggcuucguguaaggcagugugacacaggggucccaucccagacuugaggcaggugacggggugcaguucucagucuggugggcagcugaggggcugccgccuggggcggacauucgccaagccucugcguccuaguucuccucucccccaaaacggagguguuacucaucccacccaccucauagaugggggugcugugaggugugugggugcaugugaagcgccuuggagggucuggcacagccugggugccaggagguauccccugggccuguuuaagggacuuccccucggcugccuauucuaaccuucauggaggcuugaaagcacucacuguagccgcucugagcauugucaccuaucuccagaggcuggcagcagccugagggaucaaauaugcagccggcuggguggucaccugaggaccucuggccgggaccuggggccacaauagacguggguucacguaggcaucagugcggggccccugccugccacccugccgcuuaguuuccaggcuguccucggggcuccagccccaggaaauucgccugaccuuccuguuggcugccaccgccuucccugcccuccaggccggcagcugcgguggcaaguccuuuccgcaggcuuugguacagggaggagagguguucaugccgcacgaggcccagagcuuucuguaaggaucgggaaggacaauucuuuccugcauuuccuggagcugaagcgcuauugcucaaaacauggcccucugagaagaagggaaaagcacgggguuccuccucugcucguggauaaacaagcauaucucagcucucuggaggcuguuaaagucuuccuccauggguggcuuguaggacuuggccacgauaaauaauagcagagauuugucagcagcaucccagaaggagagguggguaggaaggguaaaccgaaaagcgcaggagaggaaacaggcucuguacgaccaggcggcuauguuuacaaccagagagagagaggugaagaggaaaagguucuagaauagaaaaaagauuuugcuaaaauaauaaaaaucaaagaacuguguuuaauuguguuucuggggagagggaaagaaaauggauguguaguuuaaauaauagagaaacucaagggaaaaacugagugccauggagauuuaacuuuucaacccuguguugauaauauaaugaagagaucaccaucuagaaagugguuugagaaugucucauucuuuuuaucugaagaagaauguuugucuuugauuagaggguuuuagagaaagcucugaaacuggccucaugcuuugugucugcuggugucuacugugugaucacugcugaagguaggaggcaaugucugcaacccccagccuuggcugauagagcuugugaaucagggaccaggaaugacacaauagucuugagaggccauaaagucuaauccagccuguugcuaaccggguucugacuucagggcaagacacuuuacgugcuuuggcucuggagccuggaagagaauguuguguggaauggaucucucaggugaucaacauaccaugaguaaguuagaggucagcagugagggcuggccugugcaggugugcuaagaccugugagggugagccggggucuccgcugugaugcuggggaugagaaagcccuuccagauaagcuccagaauagaaucuauccagccugcaccaggauaucgcuuagaaaucaauaugccacaugggacuuuuuaucuucacggugucgagaagcuucuggaauccaguaaauaugugacauuucucaguugagaugaggaaaagggcagaguuccuggauaguccccucuugcuguuucccucuggugcccacucccuucaguuaaugagacccugucaggacaggugacggccuaagugacucacugcucuugauuucauugguggcuccggaggacgguaauuuuuauuuugguuaccccugaaaggagaaggcggcaucuaauucuagggagacuucacaggugucuccaguccuguugauguggccagagagugaauuucaaaggacgugcgagcagccggcguccacccggcaggcucccaccccggugccccgcguccacccggcaggcucccaccccggugccccgcguccacccggcaggcucccaccccggugccccgcguccacccggcaggcucccaccccagugccccguguccacccggcaggcucccaccccagugccccguguccacccggcaggcucccaccccggugccccgcguccacccggcaggcucccaccccagugccccguguccacccggcaggcucccaccccggugccccgcguccacccagcaggcucccaccccagugccccguguccacccggcaggcucccaccccggugccccgcguccacccggcaggcucccaccccagugccccguguccacccggcaggcucccaccccggugccccgcguccacccggcaggcuccuaccucggugcuggguuccagccccuccccugucuccugagcuccuggcuggcuccugaguacucugcuucacugucuucuguugccuuggaugaagcugccuuuugaagcaacaugcuuuuuuguaaaaccggcuccuuugaagugcagccugguauccuggggcggguccugggacagaaaagcugcacuaguggaaaaacuggugagauucuagcggaggcugcaguucaaugugauaauguugauuucuguaccaauguugauuucuuaguuuucacagaaaugugccauaguuuuauaaaaugucaauaugacaucaugaugucugggugaaggguauacagggacucucuguacuaucucugcaacucuucugcaaaucucaauugcuucagaauuuuaaaaugcucccaggagucagcagccagucacauuuggugugcaugggucagauggacaagugcauggagaaggcugaaagcagccagucucgaaugagcagaugugggcagcaagagggaaauguugcucccauucuuuucucucauagaguaagugaacagaagucucuuccacuuaguggaaaauacagcagagguagacccaagcgaagccugaguaaaaggauuuuuguccccuggccguggguggagucauuugugaagacggggagguuucccuguggaguuucugcagcaccacaugggaggcccgguggagcugucauggggccucuucuucgcuggggagggaaguggccgcuccguuguuuccugagcccaagauggaagggcaggcuuguaucacagugucgcugcaaggacagaaaacugacaguggaggagcccggugcugcccauacgcgcucaccccuaggaacgcaucaggcaguacccucgugcccuccugggcugcacagaaugggagcccccuucccgccugccuaggaaaccccaugggccacagggacgggcagguggcagguggcugguggcugguggaggacuuaggccuccugcacacgugggucaccugauagaaagggacaggccauggcagugggauucagagucccagccucucaguggccucagcuucuguguuaguuaggggccaagggaaaggggccuggagccaggauggccaguggcuguugccuugcacaguugccugucaucacccugccauugauaacuggaaaugagaagcaugagcagagccgccucugcccggccccugccaguucugcucugcacacccugucugcacuccaggccuuagccccggggggauaaggauggccugucccuuucuaucaggugacccgcagcagguaucacacaccugcacauggcuggagccucuguccuuugcaacugaggcccauuucagggucuagcuaaagugucuucuccacugauaggauuuuaaauucuuuaggaucgaggauuauaagucaugauuguagcucuauagacuugaaacauuugucuucacccaucauccacuuuuuuuguuuguuuguuuucguuuuuguuuuagagguggagucucacucugucacccaggcuggagugcaguggcgugaucuuggcucccugcaaccucugccuccugaguucaagugauucuccugccucagccucccaaguagcugggauuacaggcacgagucaccauucucagcuaacuuacguauuuuuaguagagacaggguuucaccauguuggccaggcugguuucaaacuccugaucucaggugauccgccuaccucagccucccaaagugcugggauuacaggcaugagccaccacgcccugccaucauccacuuuuucucccaguaacaugucuucuuuagcugacauugcuguucccacaguccaaguucagggcaucuugcaucggcccucauggaaugauucauggguaccuuuaucugcccgaggccugaaauacagugggcccucaacagagcuuguuacauaaaugauugcaguuaguuggcagcaaugcaagcagauccuuuggaugaggaguacagucauggaacuauuaauaaaagaggagauuaaaauguauuuauucuuacuguggguuuuuuuuucccaaauuaucugcuuucucccacuggauaaaacuagccguauaugaugauaaaggaaucauggaucagucugaaagauuugcauuuuuuccuagggauuguuucaaccccacccauagaauuccuguuuuguugcuuuuacccaguucagugaucucucaugugggaauuagagaagaauguguguuuuugaauuucauggacugauuaucugguaccuggugguaaauauuauauaacaauauuuuuccacauguugaguguuuuuggaucccugacuguggaguaaugggacccugugagauccaggaaaagggcuucuguuggugcacagggucagacacacgugcccuggacugcaucaaaagccaugguuuguccacgagagaaaggagaugccgauuggcagccgugaugcaaucauugcaaacugugucgggaaggagcaucgcagcgaugcaggcccuggagccaccagcccggcccuccuucccgcucuguccuccccgccuuccagugacacuggcuccagauuaggugaaaggaagagguccccugggagauucuuugugggaucaccagaaccaaaccuaagagagcauccugaagaugcuuccagcauuccagaaccucucggagcagcuaaaacacccugcgaagaaacauagcaaauccuguuugcugagccacuggugcugcaaacugcucuaagccacggaugguucacagauggguaaacugaggcaugugcaggaaggcaccugguaggucaauaggaacaaaguggggagugaaaccuagaacuugccgauucuaaaaccucugcucuuaaccacuggcuaggugaauaagccccagccacagaauauauauacacgucaaaauacagaaauugugguacauguaaaacauagauauguauauuauauguagaaaauauguuaucaaucuacauggaauauacagacauagaugauagagauaaaagagagagagaacacacacauacauaugcacccuguacucacacacacacagacacacagaugcacacauacaugcaugcacauagacacacaggcacacguagacacacacaugcacccagcacacacauacagacacacacaugcacauauagacacacuugcaccccacacacacauacagacacacagaugcacacacacaugcacauagacacagagaugcacacauagacacacacgugcaccccacacacacagacacacacauguacauauagacacacuugcaccacacucacacauacacacagaugcacacacacacgcacauacacauagaugcaaauacacagagacacacacuugcacccacacacacacagaaacacauguacacacacauaaacacacaugcucaugcguguacacacacacacacuuagccggaggacgcuccugguuucuuucuucaugggagcagccaaggcagaaaaagacuauaccugccucuggggagcaucaaacagaccuguuucuuuagggucccuucugcagagaggcuggacagaggcgggagggugacugaguagccucaugaacucugaaaaguaaaggcuaagaugacugcacucaggagaggcccuuaaaggaugaccaagaaauacaugagaaugggcaaagggacaauuucaccugcagaaccaagaguccugcagacacaacccccaaccggcccucuccaagucuggcuugaaacuccgggccacugggguaaaugcugcugcagcuauguaaaggggaaaaggaggggcaaacacggcuuuauguuuggcuguuggaaaauucugcuaguccuaauuuagagaaagacuuacugaaacgcuaugggcaaaagagaccuucccaaaauuaucuuagacguacaggaaacccagugggcacuacagagagacaggggauuccauuuucccuggaccaaugccagcuuccuuacgcugggucuucucucaccgccccguguuugugcugcuguuuuucauggaaguccccaugcgccaacaggaggauagguguggucuguuaaaaagaaguggagccugugggcuugagcccagcgacugggaaaagucacuuuuccuuucugagaaugcuugucuucaucuguaaacgggaauacugaaaacuaugucccagggucucauguaugugacauucguucauuaaaugaacaugucugaugcugcuaggaauaauucacucacgaguucuagaacaccauggacucgugucugggucagagcaaggacaagcaaggaaccgugaagucugaucagugugugugugcgcgcggguaugguuuggguuguccaaauaucugacccaacuuuacuuuaaauaugucaucuaggauuauucaugguaagaaagcaaccugcagacguucacuauuugagagccacuuuauuuguucuauaugagacguucaguacgauugauuuuguaugcaguuguacucaucagcaagcaccuauaagagcccccacucacccugcucacaggaaaugucaggacucaggcaugggccccacagaaauagggccagcuggggucuuggguucgaaacugcuguugcugcugcccagccaggugauguuggugcgaguauucaacucuuuacacuguaguuacauuucuaaaacuggguuaaaauaguucuuaccuuaugcacgugcccagaggagcaagaagaaauuggcuguagagaguuuagcaaucuuagcauugcggugcuugaucaacacuaguucacaucuaccuggcuuuagguuguuguuuuuuaggucuucauccucaauaccuaaagaacuugaagccacagagagugaaguucaaguuaacuagaguuauuguuaacucuaguuaacaguaugaaauaaugaaauauuccauauuucauuaugggcagguuggggguugugucugcaggauucucgguucugcaggugaaauugucccuuugcccauucucacguauuucuuggucauccuugaagggccucuccugagugcagucaucuuagccuagaguuaccuuagccaugguacugggacaggaggaagugggucagcaggacuggugggugcgggggccuguggggggagguuuuagucuucacgauucuggugccuggagugcugagacccugguggcucugagcagauggccgcugagugagaacugguggagaugcgccuuccugaugccuugagacgguuauuuccauuuuccuuaaguuuaggaaaugucacccaaaggaaacauuuuaauauuaauuaaauuucagucaagguguaacuaacuuauuuccagaacaaauggaaacacuuauaaacaaagaacaauuuguucaaauaaccaugagaugcaaguauaauuuagcaaagcaagaaaacucaagaggcuuugguuuggcaacaugacauaaaaaugcagaacagaaucuuaggagagaguuuccuucuugagagagcagaaagauucccuccauaccauuuccuagcagcgcaacuacuucucagauuagcauggaaaggccucccagacuagcccguacccuccaacagccaggugagucaggccaagacguggguucccugaggaagauucccgcuggaaauuucagggaagaaccucaccuccuucccuuucuuccuuauuugguaguuguccuaauuguaacaagcauccaaguuacaauucaagaccaaguagggaccugaggugaucuccuguccugucugaaauccaccuuccuuuccuagcuguucccgccagauuucagcgcccucuucccuucuccucccaagacagucuuagcucagacaggauuuccuuagucuuagucaucagcucuuauuguccggccuccuccuuccuguuguaaaacaaggaaucuuaacagcaaguaggccaaaauuguguaucuucagugauaugucaauuuccugccgguaagugcagacaucagguuuuguggugguuacccacaucaaggcgccagagguuggaaaagucaacgcauuucuaguuaaggcacaccgcacagugaguuuucagcugucugccuuggcuuuugugaaugugucucuguccacccgaagguucugguucucgcauacugggcucuccuuuugccaggcgcagccgcacaacccaggaacaguccuaacccauuacauaagguggcuaggcggggcuggcggguggcacugccaggucaccuccgggcacugggugacccagucauuggcccccuacggcgacccccugccgcgugggugccacuggcaccuccccuggacucccagugcugugauuucugggcgauuucucugcucuccaacaagagugauuuguuaucugcuucucaccugauuggaauuuaauggucuagaaacaaaugaguuauuucacucaggagggggaaggaagucagauuagucaugcuggugcuugauuuuuuuuuaauccaagaauucuuuacuuaagaaguaaaagcaauuaagaauaguacugaauccugccuagaaguuccagaacaaggaaugggaugacaccgauagauauuucaaauaacuggaaaguuuaguucccucugaacaaagucuaacucugaggccaucugcuucuuuuuauaucaaaacagagcagcgucucaaagaaaauaaguguauuuaaaaggaaagaucauagguagauagaauucauccguuuuaaaaguugccuuuuucuccuuuuuauagcaccuuucaaaaacaucucuucuuucaacacuucuagcucaucagugagagagaacaaaaggcuacaacuguugauucaggcaacauuuuugccuucauguugauuuuucuuccucauuggguuuaauuaacuagagugucuaagaauaaacauagaaaaaaggccuguuucaugggcuuuucuuagucuuucacauuuaaaaaaauuaccuuagaucuuuauucuuucuaaauauuucauguguuuaaaaacuagguaacuuuccuguaauaaaaaauaaaaucuuggcacauuaucaauauagcaccuaccuuacaaacacaguguugauaaacuaaccaucugaagauaaucuuacuaaugucacaucaggucucauauaugugcguauuuauauagugugcauguguguguguguguguaugugucuguguguauauauauauauauauacacacacacacacacauagagaguguacauauauauauacacauaaugcaaaccuguguccauuuuuaauauuuuuuucauuguuuuaaauugugguaaaauauauguaacauaaaauuuaccauuguacccauguuuaaaugacaguucaguggcauuaaacauaucacauuuuugugcaacugucaccauuguccgucuccagaacuugcucaucauccuaaacagaaauuccaugugcauuaaauaccucugcaucccauccuucccccacccucuguuaaucuauucuacuuucugucacuuugagugugacuacucuagggaccucacagaaguggaaucaggcaguguuuguccuuuugugacuggcuuacuucguuuaguauaauguccuuguauuaguccauguucaugcuacugauaaagacauaaccaagacugggcaauuuacaaaagaaagagguuuaaucaacuuacauuuccacguggcuggagaaaccucacaaucauggcagaaggcaaggaggagcaagucacgucuuacauggauggcagcaggcaaagagagaauguaccagcaggggaaaugucagaugcuuauaaaacuagaucucaggagaacucacuaucaugagaacaguaugggggaaaccauccccauaauucaguuagcuccaccuggccccacccuugacauguggggaugauuacaauucaaggugagauuuagguggggacacagagccaaaccauaucaguccugaagaugcauccauguuguagugaguggcagaauuuccuuccuuuuuaagccccaguaacagugcuaugcuuuuuaaaguucuuauuuuuaaacucaguuuuguuucuuugguugacagguuucaaaugguuaaugucagguauugcaaaucagagagguuuaggaaauggcgaugugagacccagcuccagaugaaggagcagggggcaaggaagccuggggcuggccugccugccugucucucggaggcggccugcccgugccucuguucuugauguuuguuuugcuuucugguaaacguucaccacucucccgaaggagguuggcuugggccgcacugaguugguuuccucugggacaggcaugggaagcuguccaggagggaaccgggugucugggugggaagccagugagcgaggucuggguugcccacacaggugcaggcaccagaccuaaagcaguucuccuggagcaguuccugaagccccagaacugcgugagauuccucaggaggaggacaggggauggacgcgucaagacaaggggagaagacauauggggaaccccgggaggggcugugagaggaggcugugaucgggugcaggccuagaucuuccccauggcuucaccaaacugacggucaccagccuccccucuuccugugguacuggggucagaagauggagaguggagacagggagccgauguccaccucuggucacugcccuucuucccugcuagacuucagguugcuaagggcugggaacuugguuuauucaucaccagguccucccacagcacaggaccuucacauagaugcuggaguaauuuuauuaaaucaguguguuauuuaacucuuccacggggacccuaagauaguuaagguuucucugcaggcgcagcuggcagcaugaucagaggcuacugaggccgcccgagucaggucagcuggagcgggagggcggaugcccagaggaggcuaacaaagggcguguugccaucuccuuuuuacauuuugaaggcuuuggcaugacccccaauaccagcuguuacaaccaacccagccugggcacuguugcacagucuaggaggagcaaguagacaaagauagggauccacugauucuaugaaaacuugcagcugauugaggggaggugucaguccaugggaaguccauaccacagggguugggagcuacauuccccagaguucaagggccuguugcugccccacugccuuagauuccuaugacuggacaucagaggcccacuggugacucuggaauuucuguugcacccucuguggucagggagcucuaaccaggugaugccccgaugccugggaggaggagcgcauccacaggcaguuccuugccugagaugaugucaggcaucgggaugagggcccccccuguggaagcuggacagccgucuugcuguuugcuuuuauauuuuuugaguuagucaugcuaaauauaaugucucugcagcuguaaaaccuggagcugaagagaaugagugucugggaagcugggggccagcccacaggcuccucuccuagacagacagagcaugcaggaugcccagugccagcuuccccuaccugcuaccugcaguauugcauacaauaagggcagguggaguugaagucagaaaauuccaaaggaaaggggcuuccuccuccacaccaaaucuaagcacaggccccagguggcucccugaggacagggaccaagccaugggcacgcugcccccagcgcccagcugggcaucugcuguagcagcuggagucuaagccacacaauagacagagcuggugggaggaaagagagagggaaagucgagauuccuggccaggaccgaagcuaaguaguuuggggacuuuuuguucagaaucacaacacaaaucauuaugcugagugcgaaaggcauggcccucaaaaaugugcaccuugggucaacugaagguuccucucucauugguuucacuugauuugaauuacagucgaaaaaauuauuggguagacagacauuggcuuaucugcaaagucaaacuaaugcaaaauaugcuucaacugcaagacagagugccaaacuauuucaauuuaauagcaugguuuuuuuuuuucuugagcuucaaugcaaagggaagccaggcaucuggccagugagcagucuaugagcugagcugugcuuuucuucagggcaggcagagguuggccaguggccuucuuggcacucccagaaacucagcuucaugggcgucaaggguaagaauguggaagguggucugguggccaaaaucacacagucccuggaugugguggucaccauccaccaauguccacuggugggcgauaacuggacucgcuccuucuugacaccuguccugcugggcucuugauauugaggcuacuggaggaaggagcuugccugagaaggcacuuccacaaggagagggaucugaguccacaggggaggggaggucucuucgccugaaugcaugagaaagcauacuggacaugaagccccaguccuggcugggggucagaagagaugggccggagcagcacugcccgaacggaugcacguuugacucagccgauuuggaucaggcaggucuggggcuccugggacucugcauuccuaaugcucccaggugaugguggugcugcugcccagggugccacagugagcagcagguccuagaagacagccucuggagggcucuucuggccucgggauuguuucugccuugagugguugcuuucuagcaauagaaaaauguguagguggggccucccggccccuggaaucucccgccaaucuuuaaaacguggugaggaccacccuacgcuugccugcugauugauacagcuuuaggaauugggugagggaaagauaauuuucaucuguugguucuuuggaaggguuaaggaauuucucauuuacaaagcucuuuaucuuuugacgugugggacugagccuuccaggaucaugucaugccugagagcacguucgacccuuagcauggcaaaagcagccuucacaugcacaaggaggauggggagaagaggcaucguaacugacuguaugaaaacgucugcguccccacaaagauggacuuucuuacaccauccaccuuagcucagccuuuuaccaaaguuuaagccacauguguccauaauaauaaucggaaaucaacgcauuuuuaauaagcauuuagaaccaaugaucagaaacagaaagugacacuaaugcuuuguggagaguuuacccgaagauuuuuuucucuuugaaaugaagucaaaagcacauuccuccccaccuguuaccucccuaaguuguuaaaggcagcccuguuucuccuggagugauacuugauucucccuggugauggucugccaugcauugaugggcucuaguuaaaacaucucucagacagaguccuuuggaaaauuccaugaaagaaaccgccuauuagagauaaaagcaaagguuaaguaaccagauagaucauagaagugucucccagggaaaucguauuggaagaucaguggcugagguaaaggacgcugggcuugaacacuuaacuaaggcugccugaucacuggaggcuuccuccuggaggcuucuaauccccgugucgcuucagccuuucugucuucucagauugcuuaccccgguaggugcugcccuucccuucgggacacggaagcuacacuuugcuuugugcauugucaaggaggagaaacaggcacuuccugccuuaugaauguguccuguuccugaauuucuuuuuuuuuuuuuuagacggagucucacucugucgcccaggcuggagugcaguguugagaucucagcucacugaaaccuccaccuccuggguucaagcgauucuccugccucagccucccaaguagcugggacuacaggcgugcgucaccaggccgggcuaauuuuuugguauuuuuaguagauacaggguuucgccacguuggccaggcuggucuugaacuccugaccucaagugauccucccuccuuggccucccaaaguagugggauuacgggcaugagccaccaagcccagccccgaauuucauuuuaagucauuugcucagaacccagauggcaccugcccuucgcccaggggugaggagcuuccaccucggaguucaaauucaucuccaucagucccuguggaaccugggaggagaucugaauuuuuuuauuggaaaaugcauccccugugagaugaauuuauaauccucccucagcaaguugcugguagaauuaaauucuacaguguacauaagguacuuaaccacagugucuggcauagaauaaacacccaaaaggugcaauuccugcacuuuccucucuauccucgugcaccuaaaccucagccuccucugucugucucccuaguggcagcugccagccuucugcuccccugagucacggcgucuuggcaaguacugcccaaaguguuucaauacagagauagcucuucagccucucuuucccuuagcacauugcaggccccaggaauuguggaaacaggcuguuugaggacaucugucauuugagcuuucacucaccccagcaugcuggggcccuucuugggcccugcagccuucagggcgaggucacacagaggggacacgcugggcccuuccugcugccccgcgccugucuggcugccucaucagugacuccuggucugcugggaggugcccaguggaacccccuacaucccauccgauuccuaaucuauuuccugguggucaaccuggcccucugcucggccaccuguggacagcacugccuucccuugaguguggguugguucccaacaucagagcaguucacacagucucagauggcagucacccgcccgcucaagagcgugaccacuuugugaccugaucaaagauagacaauaagcuuggcuucgugauaagccuguuuaauguauccccuccucuuauucccagaaguuuuaagaaauauucaauuagcgacucagagucacaacccagauaccucugccugucuccagcagacaccgcucccaccccagcccugugguugcuaaccugggcuagccuguccccagcacacacacaccccuccugcuccaacucuaaggugcuaacccaggcuggccuguccccagcacacacacucuuacaucugcucccucccugguuuaugauucccagggggcccccacccauggaauuugggcguccccaguuacucugguuggguuguuuaccccuccacuggcuugcuuccugcccuucccgggggguccucaccaacccccaagagcucagcacacacaaucacccacuccggguauuucagacaaacuucuccucgcgucacagaccacauuugauuccauccaaaacacaaucugugauaucaccuccaccacccaaccagccgucccagcaggucagucucagaaauauaacucugcauuuuacauuugacucuugucaucaaaagacaagcaauugaaugugcuuuagagugauucucuuaaauagucccagaugguuuuuaagugugugucuuucuauagugaagagauugggggugggguguuggguuggaaaacaaagaaauucagcuugaaguagucagcuuguguuguuuuaggagaggaauucauucugugggugucagugaagcauuaaaauccccccaacagcuccagagaaauaguucccugcuguggcccacaccccagcuaauucuguuuucgucauuaguuaaggcaguuguccugggugaagucuuagcacuuguccaucaucuuuuaaaacuuaacgcuugaagcaaaguugugacuguaaacagcuuugcaacucuucggucacacacacaaaaugauucauuucucauagucuuaguaaagucuaaauaaguuuuuaucauauuuuccuaaaaucuuuuuuaugaaagguuuuuuaaaugaugaagugauguauagaacuguuaacucaaaaucauacaccacaaaccucaucaaccuagacuaaucacucugacuuugcaguaaacuguaggcaagaaggagucuucaguuaaauuaauagucuggaaaaguugaucaggaauauaaucuguuuaagaaaaaaaucuucuuaaggaacuucugggacacuuacuugugggcaaaaaucaaacguucuugauaaauauuacgaauuuguuuaauucguccugaagagccucugucggaggaccaugaguuccuugcucaguuguuggauuguuuaaaaaucaguuaaacauuguuucuguuuucaaaauuuuccaauucagauauuuuuucuguuccaccauuaaauaaaauuaggaauauuuuccacucuggcuuggcaugggagaagagacaaccccuggcaggcaaguucacugcuaucugaagcaaaugcggugcaagcugagauuuguguccaucgagcauuuuacugucuuucucugucucaucccuugguuucaugaaauaugaaaauagaacagcgcacuuuucagaagaaaucgauggcucagacacauuuaccuuaaugggcugcugggcacguuuaauucaacgacugugcggugguaaggaugguagauaaggacauuguucucugaagggcucguucuagaccagcuugcccagacugcugugaaggugauccaggggcccagagcagacagagagaugacgcccagagagacgggcgggcuccgucacccagcagcgucuccuagcagaucugagauccuagcggauccaaagcuaccauggagcccuaguccacugcagucuugauaaacucaugcugucaucuaauucacuagcuaaaucacuucauauauuagaucacuuuuugagaaaauuacaugacucacuguuuuuaaaagccugcuuuggaaaugaugaacagaaccuucuaguaguccaaaacccauugagcuuuguagaacaacauuauggaacaaauuuuauacuucuuugagguccuguauucuggcgaaaaauaaauucuucuucuauuuuagcacaauguguuuaaagcccauaaucagauacagaaauagaaaacaugcuaaucugaauaaaaugaagaaguaaauggagaaguuuagaccuuuaagcaaguugcuuguuacuucaauacuugggguauucgauuuuuuaaugcaaauguuuucaaagauacacuaauuuugaaauaauguaagacaccacugcaaucacucuuacauucccgguagaccucugagagcagcaaccacccuccaccaccccacuaacaucaucuugaaucaacgcuuuaagaaaaaacauacuugcugcagugguucuggagcuggagaaggaagauagagccagccacaggugggcgugcccugcaggggaaggcgucuaguggucccuccguaccacagagcauucccacccucuucccucacugcgggugccacauauuuguugugguuucuuugugguugucaaagccaaguuucauagguguuaucucacuuuauccucauggcauccuuggaaauagagggcacaggugcagucauaccaaauacagacaaaggaaaaaugccaguggaagucaauaacaugccugaggccucugguuugugaagagcuggugcuggaacccugacuuucuuuuacucaaaggguuugucccaagcgaauuauuccagguccacacggcucuguuugaaguacuucgguggaugcauccaucugguauucucaaccaccccaugaaagagacagaggaagguuaugaccaccacggcacuggcaggaggagagaaaaacgcccagugauggcucagcacacccagcaaagugcauaauuccagagggugaagggugaguuggugcgugcagugaaauacgauaugacgaggccaacuuuucaucuguuuaaaggacaagaccaagugugacagauucaaguauaugucuuuaaguugccaaaugaacacuguguguauuuugcuuuuugguaaauacaaauuacucuucugaaaauuuggaagcacugugacaguuuucuaaugaaauuagacggagaaugaguuuuaccauuaaggacucaaggcuuuccacggccccuuuaacugagaauggaccuugauuuuguuuugcgagucacucuuacagcugcaugacuucaucucaagcaagcuaaauaaaggaauuuucgguauuauaacggucacuaagcagacaacugacgugucagcgauuagaagggguaagguuucggggcgaguguggaaagauacugcuguaacacgauguuuuacucgguggcuucauuguguagguggguggcgagucggaaugaagcugggaggcgcgggguggaggcgggggggcagccccaacuccagagcucuucccagccagaaugucagucugauuggggcaaauccccugaagucuauugaaacuccccaucugccuguucacaauucaucuaagcaacucugaaaagaggauaaaccuccucaggccaguauuucugggauucuguuaugguucaaagcagagugcauaucuuuguuuuuccaaguguccgaugucugucuaccucuccucuuggaaacgcuucuccgauccgcagggcacgaugggguccccgcggccugcggugccuucccaggcuguaucuacaugcagcagggcugacuugggccuucuccuuuaaaugaaagaccuccuacuagauacuuuuugcugagagcaauuaguuuccaaaacagcaauuaagaagaguuugcuagcaguaacugccagcagaguugccuguuuugaccuauuuuggcugagugguuccucucuaaaugguuugguaaucagacuauuaggcugcuggggagccuuccccaccacauuccucuauggugugucuuccaucuacccgaucucgccgugccaucacuacucaugaaauugcuguuuaaauaaacccuggguguucagauucucuuaggaucaguaauauuuuuuucuuuccaugcagcuuuuuuuuuaaaggaaauuuacugauauaauuuucuucuagaaagaucacaauggucuuaccauccuccaaaaaucagcuugaacauuuuauacuggucuuaaaauaugccaauaaaaucgugugauagugccaggccauugcaaaggacagagaaagucauauauuacaguucccaauuauuugagaaucauccuaaaagaggagguaagaacaggguuauuugagagauagaaaaccuaccccaaaucuccauaauaauuuuucugcaguaguuuuccuuuuacucaucucagauguccaggcuguuggaaagaggggacgaauccuaauuuuucuggcuuauuaacgucaacagugaugaaguccuggagccaggagagcagccggccguggcugccuuggcccaugcagacucacgccugacccucguuacugggccgcugacuuccacggugcugagaggugggaaaggaggugcacccacagcccaugggagguggggagggugauguguucacagaccgccggcagcucuugauucaaaucauucacaaccacaaagccaaguuucuaagaccaagggcaguaggaggaauggaggcaauauuccaaacaccgacucaaaaccaccaacaaaagaaugugcuaucuaguauuuacucucacaauguuugccuuucucugauuccuaaugaguucaagcacuuuuguauagaucuacuggccauuugguuauucucucugugaucugccacuuccagccuugugcccauuuuccuguugggugucauuuuccauacccacuugggaacucuuuguauccuaaauacagucgcccauuugguuaccuguguugcaaagaccuuuuuucacucugucuuuucugucuuaaugauguccaauaagcugaugccuacguuuuauugucauccaauuuaucaauuuuuuaugguuaguguuuucccaagcucauucauuaauucuaaauuuuacaauagauucuguuguguuuucuguauguaaaaucaugugaucugcaaauaaugaugguuuuacauccuuuuagucauuauacuuuuuucuuuuuucaaccuuauuauacugucuagaauauauuagcaauguuaagucaagaaaggcuuauuagccaaguauacauuaaguagacuucaccaaaaagcuuugaaaugcauauugaaaccuacauaagggcuauuugcagaacccaagcucacauuuaaaaccgcgggaucuccaaaauagcuuucuggacuaccuuugaauggaaagggccauggcaaacaauuuuccaaguccuccucaucuuuaguuagguuucggucagagauucaaaugcaagagggauguaaaccagggaugaagugauaguggcagcaacacaaguucguucuccugucgcaaugauagacaggacggcucccacacacagcaccuucuucuagagcacuuuuccuccucuucucuccuuuuguccucuugaguuugaacauugauggugguacaugauguuccuaaaaagacaagcacaggcagauagagagaaacguugggcccacggaaauaugaauucauccagauuucuacuguguuaacuuuuaauagaggaauccccuucuauguuuguaccauguguugccauccuuaaaaacucuguguugaaaggugaccaaugaguccuuccaguaguaccugguuuccuuaguaauugacuugucacauauuucugcaucaacaguauucucaaaugcacgcuuacuuucagcaauggugaagcucacugcugagcucaaaguccuucacaaucugaacacacggugcuauuuccagaagcccaaauucccaugguagcuauguaaguuguaucucugagucagcaagaagugggugcaugaggcuucccaacccaccagguccuugcaggcagccaggcuugcuucuggagagggcagagggugaagggcugcagcugugcauguggucagccccaucauccuaaggagauauuccugaguguccaagaaaagcacugcuccacccuacuuucugaccuugacuuaugaccccuccagggguguagugaccaccugaaggccacuggcccgguuacucagaaauguaccucuuugaaugcugccugccucgagguguaccucucaucaucacagaaggaccaccgcuuacucuuuguuaaugaaaucugagaugcuuccaccuuccuauucuuggaaaacauuaggagucccacaccucuugcagcccugauguccugggacccaguguccaucccacauccagccuacuucguccaagccagguccucugagcuguuugcugugacauucagaggcagcuuugcuaucugugagguguguucugguaccuacaggcuccgugagcacugucuuuccucacugaucucuucuuuaauucucuucaugggggcgauuucuuguagcacuuuuucuucuccaaacauuuucuaacuuaccuaagauggguuaugauugagguguccccuggcuacgaccuacugcaccugagaugggaagaggaccgcucacgaaccgugguccugcucccacaccccaauaauguacaacuuuucauaucgggacacagccacugccucugcgagucugaacucguugccauauuucugugugcuuuuauucugggccuugggcagucccaucuguuuuguuguauaguuaugauuauaaauaauaagagcucuuaccuugugugauaaguucuuaucacgaucuagguccugggcaaggugcuuuacacgaaugaccucaagugaccuuuagauuaacccucugagauaggaacuaaugucauccucaucucacagacaaagaaaccgagucuagaaagucaggucaugguggggccggcaccgcccauggagcuggacuugggugcuggccccaugcuccugcugaguucggcuggauggcagugaccaugcuugcuuugagggcgagggucacacccagguguggccuguguccccaggugccuagacacggccugaacacagaggcguuugauaaaaaauguacaauaugacgcacagucagugccucucuuuggggcugaauagcgcaugcccuuagguuggacaguaaaaucggccuucuugacauucagaaaggcugacccagcuuuggaacucugcuugguuuguuuguucguuccuuuguuuaucaagcacagcagauguggcccgcaucuaaccuguugugagcaccaccaccaucugcauguuggaagugccugcacgaugcccuaaggauucuguuccagaggcuucccuuagaugagaccacagagcagccgucugccuggggagcagacccauggccgcauuccagaaagaguguucaugcucauuucuacuaaaauccagguuucgcacuuggaagcggcuucccuucccaaguagaaacacauuccauuuccuucauaccugucguggucauggcacacucauucaagauguuuaugagcugaacauauuugcuccuuacaguguggauuuauagucuaagaaacuuggaaaagccuccaugcaggauauugugagacaggucaagaaaauuccauuccccaagaacaaauguuaugcagccaguauauaacaaugcuuuguuuaugcagagcauuuaggaauauggagaaaugcuuaaugugaagacaaaguaaagaugcaaaauuguauagaaaguauaauccgaguuauguagaaagaagugcaagagaaaagaccagggaaaaugcugaacguucucccggagcaggccugcuucagcccucggucugauucagcacagucagauccacgcagcccgucuucaguccagggaggaggaagauaaagagcugggggcccagcuccaggugaccucaacuaucucucugucccucaccugugcugcugcccugaucccugggcaucuucccucugcagaggccgagcccccagccugugucacacuucucaucccugggcuucuccuuggcccucugggcucaggugcagacauucauggauccuguucauugauccugugguugggagucugcugaccuccuccacugccugcaaccgugucuccaacacaggcgacuccugaguucucuuuguaaugcuucagccauggcuccugcugugguuuggcucuguccccacucaaaucucaucuugaauuguagcucccauaauucccacauguuuugaaagggacccagugggagguaacugaaucaugagggcgguuucccccauacuauucuugcgguagaguaagucucaugagaucugaugguuuaauaaggggaaaccccuuuugcuugguuaucacucucucuugucugccaccauguaagacgugccuuuugccuucugccaugauugugaggccuccccagccacauggaacugugaguccuuuaaaccccuuuuucuuuauaaauuauccagucucacuuaugucuuuaucagcagcaugaaaauggacuaauacagcucccuuggugcccaaaguggugacugagcuccaguuucuugucccugauguccacucuggcugauccaaacccaucacaugacaaggcuuggccacccaucuccaagguggugacauuuuacucucaaacugaagaagauaaaauucugggauccaaaauuacuagaugccuuucuucuauggaguuuaaacuacuucacauauacuauuucacuauccucacaccacguuuuugaaacaagggugggaaacagauaguuguggcacacacuguucaaaguuuccacaagauccuggaagucugcuccccuguagugugcuuugcaaaaagaagacucucgugggcuucuguuggcaauguagacucauccagucuccuguggauggccacuucauuacuucuaacccaccuuuccccccagagcugacauaugugaaaaugaagacugcaaaaauuugccucuauguaucuucuuggaguuuuuugauuuuuaacuuuuuuagucucggcuauuuugaacuauuuucuccacugcucuaauacauugaaguagagaauugagaguaggccauuuccucuuuuccuggaaaauauucugauggcucucuuugauaauuugucugauugucucaagcauaacugaucuuucaugaacacgcagggaaucauaauggcgcugcacucggaaaguugaguauaauggugcuauucaugaaaauagaugaauucaaaaaaaugggaagcgaauaucaaaaugaaguuggacaaguagguuuuuauaggcuccauaaaacaaaaugcaucuuagaagaggccugggaggugggauaacaauagcggccgcuggaggagggcuccugcgcgcugcccagggcugggcuuucuuucugauccuuacgacgaccuggccuaguaggccucauuucaucuguaaaggacuauguuguggaggaaagaguuaaacauacuguuguucccuuuccuggggaaagggggucccuuuuuaucugcaucagggguuuugcuuggggaauauaggaggcaggacauggaccucaggggguggcaucucaucugcaagcagcucaucugggagcuuccuucccgaggauguuugaacauauuauauacagagccuugaccccagggccuuauuccugaagcuuucguugaucagcuucugggaagccuccagcaaaggcaguucuuccucugcucccucugaagcaguucaugggaagagucaccacauucagccuggggcuggcauccucuggacaacauccauucccacguggccuggguugccucugugcuccuucacgggacacucacaccaguuccuauacagguuacaucagaaguucccaaauguugcucuggguacugcacugguuagcaaugcaguuuucaaaguuccaaggagaaaugaggggaaaugaggaaaacagacugcguuuaucuauggaugcugaugcuguuuuguacacguaggacguauaauauaugcucacugcauucaauccguaagccuguaggccagugacaguugcaguccuggcgcucugauuccgcgguucuggaauggggcaugggcgccggaaguuuuagaagcacccggcaugaugcugaucacagccaaguuuggaaaccacugggcucgugugaaggacacuguacccugcuguuuggaaucauaaacguaagauuuaaaaugggcuuuccuaacuaauaagugccagugagggcucaacagcugaugggcaguggaguccagagugauggucccagcaagcguuccagcggcaucugccaaggcuggaagcuguugccaggcucgagccagagcagcaugggcaggaagcuccugaugggcaguggaagugagauuggaccagcgucagagggcggauguacugguggcaggcucagagaggguugccuugggauucacaaagcauggcccaugguguccagacugggggcuuuugaaggcuuaggcugauguucccccuuagccacacccuugcuauccaaaagguccugcuccacaucugaccgcaagcagcccucugacacagugcuggaggcucuaagaaucugaagucugccugucccagggaagucccugcagcagguucugcugugugugucuguguccccaagacauuuuucaggacagcuuugggaaaagcacuuuuuaacuguuaaaaauagagagagcauugauacuugugaagauauauguacucacuaaaauauaugcagugagcauauauucacuaaaugaacaugcauugaaaguaaacagcaugaugccaagggcuugaaguuccuuuucuuguugcuuuguagguuaaugaggccagggguguggauuaacaguauucuggaaucacacaaaacucuccaaaggaaccauuuaugccaccgugauaggaacugcguauugcucacuuggauccuaagcugauuuuuaaauuagaucuuuccgugaucccuuguugagucuguuucaugugcauuuuauuauauucuauaaauauuucacuaguuguuucuaauaauuagagaaaaagugucuuucaucaauuuaagagagaagggaauagucuguuaaggcugagcaguuacugcauaugaaggcuccaauggugagcuucuaccauuagcuggcaaaaaagagcaaaaaugcaauggaaaacagugagggagagagagagagaaagagagagagaggagagaggcacaguuacugagccauguggccaacuauuaaaacuaggagaaaagacacagaaaauguuguguguggggggggguggggguaaaaugcucccccugaagagcacugaggcucuagggagcccguuaaacccagauaauucuacuagagcaggagggagcuggccugggccuucccaguuagcacucacugaaaacaacgggccucugccgagaagcuaaaccugggaccccagggaugguuuaucuggaagauuaggggagaaacgugcaaggcagccaaggcaauccagccaucucugcagcugggaaaaggagugauuguuuuccugagcugcuagccuggauuugcagaaggaaagaaugccuuguuucuguccccugaagacgcaagcugaaaaaaugucuggcugcucuucgccgcccucccagguucucucccacagccaagaacgacuggcugcugcccugagccgggaggucacaacgcuuguggaguaaggagcucggguuuuuguuuggggcuuuguuuuguuuucuuaaguaucugcaggacaauguuuggaagagucguaugccccauaaaaggaagaaaauggugcucuuggauuguaaucagugacuugugguuggcaguuaugccucugccuucaguacugcaggccugugccuuccacggaccuucccuaacaucauuucuggagaugauggggccagcucuuuaagaaacuauuuuuucacguuaucaugugguaagaacagagaugaaccucagagaugaagagugugauugagcucagagaaacuucagugacuugauuuuaaaugggccaaacaguuggauuucuuuuaccuuuugugcagaaagccuucguuuagagaaaagaggacugaauucugauggacaguaggugugggaggggcagcauguuaucacaauagcaucgugaugagauuccuggauggagggaaucacuggugcuugcauauuuggggcuucaucuuagggaaguucccuaaaaucucuguagcacccaguuuucgugggaagaaugucgugggagcaggggcuucccugaccuuggaagccuggccggucagucucaaacgaguuuacugccuccgacccaauugugaggacugagccagagggagugcaugucagccucagccuccagcagcacagccccuuucucuacaagccucagauauaggggaaaaaaaacaaaaacagagucaaaaguaggucuucauuaauaaaagacugggaucucccagaauuaaucaucuugcucaucuuuuccaguucuggaaaucugaucuuugaaccugguauccucagucuuagcacaauaccugggaccauaauagaugcucaguaaacuuggugggaggaaaaaaucaaagaaggagucaaaauagaggugcucggugccgaggaguugcuaaccuggaccauccaaauaaugacagucuguggcacuucagaagcauuccagaaauggaacaauggcacuccaugaagcuguauaaacucauaauguauccuguaacuaacccaguauagaacaguaacacuguuuacacugauuggaaggaagaagguucauccuggcgguuuaugacauugccagaauggcuugaauccuugagggugggugacagguagaguggauaauaaaugggccuccugguucacagagccugagaaccucucacccaaugggcaccuggugccccugcagaguccagucuaagaggacaauuuuuuuuuucagauguagucuuguucuguugcccagguuggagugccugaucucagcucacugcagccuccgccuccuggguucaagcaguucccugccucagccucccugguagcugagauuauaggugcacgccaccacacccggcuaauuuuuguauuuuuaguagagaugcgguuucaccaucuuggccaggcugguguugacguccugaccucgugagccaccgcgcccagccaaggacaauuuacucuagccacagauauggccaugguccucauguaagcugacuacaaauacagcaaauccaccuuuccaaagacuucauucuaaagauguaaaagaacaaaaagagauaaaggaagaggaugagaagacuugagaagaguggaaguguagaaagaaaauguuuaagguucauccccuccccaccuuggggaguuccuuuggcagcaucuucugaaggguacuucuccuagcccaggggcagaaagauccagucuuuuggggcagcugcggaagaaaggagagcaguccuguagcucaugaagacauuacgaagcacaaagaacugcacagggacagagagucuuuagggucucgagcucacucuauguccuuggcuguuaaguuccccgagagcaaaccccagcuucucgcuugcuucaggcucugcaugugugagugugacccuuggguacucucggggcguuuucagccaugcgauucuggggacuucagaggacucuguuccuuucugacucguguuccggcgucuguggauugcucccaacaggaggaggaguauugucuauuaagggaaaagauuucagugaccuggcagcagggagcgucgucaguguuugacuguuuaugguaugucagggagcugguuccuggcaguggcuuccccagggguggggaggggugugcugggggugacaggaagcacugaaucacgacagagaagggaaagaagcccgcccgccacuuccgguguucacugagcaggucgguggccagcgcugccuucgcaucagaaccccauuuuaaaacacauccaagcgcguggcgucaucgggacgacgggcuucuccccaguagagugucagaccaacaccgcccugcacaaagcucuguguucccugcuuucugucauguucccacccauagccagaaaucccagcugcuggccguccagccccuauggagcagugacuaaggguggcugugggacucacucacgagccuuagguuggguguacauaguuuguggcugauuagguguuguuaaggauuuacuguucagggcuguugauuucugccacuggcuugucuucucccaaggacaaggggccugccuauuggcuuuuagaucuuagcacuuagcagacucucagaaguguuugcuagaggacguuuucuggggaauguccaccugcacugaugaaaacaacucaguaacaacuccacuuugagaggagcagagcaggagccuuccuuaggugugcguaaggggauaccggcuuuaaagacgccaggcugaguugcugugucaggauugauucuuuacuucuccaucuggagguguuucugcuuuaucaguuucuccuuguuuccagcucugucucgcugccagagggccgacguuuccuggcuuuuguuguacuguggcacacagucuguuuugaaaggacaggagcauaauaaaagcggauaugaaagaagggccagaugacaucacauagaauacuggaggaaguccgcguuuguggauguuuauaaucucagcauguuaguuguuuguaauaugauaagagcacuuuugauacauaggaggacuacaagccuuguugcuuagacaggacucacgaauuuuuaucuuaggcucauagugacgaacagagaauggggaucuuggccuggaucccaagugacccuggcucauugguugaccucggguacaagauucggcauagaugagccauuuaaauugugccuaagccagcuacucauugaauuuuuuaaaagaaagagagagauagaauaaagaaagcuaagaauuugacuuauuagagaugaauuagcuuacuaaauuuuuuccuuuugaaaucuuacuucagagaaauugaugguaccuagaacuuaacauuaaaucaaguaagacccuuuuaaggugaauucuggaagccauauagagucagcauuauaugcaugcuuacucagugaaaauccuaaagcaugcaagugucuccauaaagagcaaucuccuugaacaauaacaguguugacaccugcuguuccccaggucuguaucgugagauggaaauacaccagcaucuucccccacuaggggaagaugauaaaaugcagguuaagaacauggaccauggaugcuggguacuuccugccgggagccgggcacuauccucaccucuucccguggguuaaucuccuuucauccuaacggcaaccccaggaggcaggaacaguagguucuacccauuuuuuaaaugaggacccugcagggcaugugggaugagcauuccucacaagaccgcccccacgaaacauggccuggagcccgggcacccuugguccaaagcaaaucaaguuucucccaaacacagugccauucagagcaaaccaaaucugcagcacuggagacccgcacacccgacuggaagcuuagggcagggcaaaggcacaagacagcaucauagcacucuggagcccaggaagaacccaucuucuugcaaacacuccagauuaagcguaaaaagacuagaaaaaucaacugucuucaugcacugguauaggagagcaggguagagcuggcuccuaaaauuucacacucaggagacucuaaaaaucgugcucaaaccuaaaaaugugugcaugcuaauuccaaauuagccuuaucgacagagguuagcguccaaaacuuggucuaaccuaguccagggaacaugcaaucuuugcaacuucauacugcagugacuguguguguggucucugauuguccaucgaacacaagaauuaaaaucccaacaaccuagugaggggcagagaggagugggauugaaaauccacuguugaaauauccagguagauaauccacucccaaauaacggagugcugccugcgccuguccguacccagugggugcucuccucugcuggccccaggaguaggcgucugcugugacuuagagcagauuuuaugcacagaccuucuuccaggcagagaaaaaacuaccgagugugaguucacagcaaaggcauccucgaucccugcugaugugggaaggcauagguacacgccgucugaaagcugccaggcgugauucacuuggcagcguaccuccaggagaaagggcggggcagaaauucagaaauucuaacccagaagccaggccagcagguagguaaaguggcugucgcaugggugugguguuguccauggccccaaagccccugggacuuugauggucaaguuugcaaagauaaagcugcaggcaccugaggcugagccugcccgggcagcgcagcgcugcugugugccaaugcaaacggggaccuuccuugccuagaccagucuucaccaaccagaacagaaaucuuauuguauucugaaaaaggauuccuggaucucuuucauuccaugcuuuucagauuuuuuucucccaaauuuagcacagagggcagguuuugaacagaacucuuaaacugaagguacuucucuggaauaaauagcuucaagagauggacccacuuuguuuauuaccaacagggcuaaauauuuaccuuagaccuauaugccaauacuaaccacauacacauuuucauucauugccaaagaauaccaagaacuggcaugccguauaaauaauuaaaauuuaguguagauaaugugugagguaaugcuuauauuagaugaugucucggugaacucucucccuaacgaaacagaagaaaaacaacauagcucauaaauauguaaggguauuuauucuaaauguaacaugugaaacucuucacugcauguguaccuaugagucugaaaacucacuucuaacuaugauuacauugauggccucuugaacaagaguuaaaagcuccuuguaacuuguucuucucaacacggagacagaacaaaaucccucaggcuauuaaaaggaugacaugacaaauagccuucauaaaagauggucuuuuaugcagccaauuuucuuauuaguuauuugacgacaacauugagguuuaaaugaguagccaaugagagaauauugaaguaggcuguuuguuacagcacaucuccucuaacucauacuugcugauagguaauuggaacagaagagaaugaugucaguaugagauggaagucauguuaguucaugcgugacauuuuucccagcaugguguuuguaccacugaguaacaggauagcugaggguaaguagaagaauacacaucagcacagcaaacugucaaggaauggaacucuauacgagaccccagggccgcaguauucucucucuugccucgcucaggccacauacucuccuuagaaaugcuuucuccacagcucuucccaaucuuuggucauccuguccuugcucucugcaguguagcagucucagcacuuccuuacacccccuucuaugaaacuaugccaucacuuuucuucaagauaaacuguuuuauuuacugcaauauuucuuuacuugagaaguuaacauguccauuaaacugugcuauuauuuguauuaggauugcuaccaauuuuauuaaggcccuaguuacaaaguugcaucgguauugaguggucugccccagcucuguuuuucccauggaccucggugguuugcugugugguuuugcagagugugagaauuuuucagaaacagucauauacuguguuacagcagaaaagccuguucuuaaaaagaaugaguggggacuagaugugaaucaaugugauuugacuuucuucuucccaaggugaguggcugguguguuugaguuggucuugacuacacugacaaggaaggugaggguauggaggacauuccaagcugaaggaacaguguguacaaacgcaaguucuuugcgaggauggaacuucagagguguucauacucaaugcauugaaaauccucacauucccucagcauguaaaauaagugauuaagcauuccgcuguaguugaaagaaaaagagacuuugaaaguggagggaacaguggaugcaggggagcagaaccccagucggcgggucucaggagaagcgaagccugcuguuccugggaagcaguggggugcaggaaucagaggacagcagaugcuggcuucacacccucaccuucccuauggguacagucgaggccuccucaaacacaccagccacucaccugggaaagaagaaagucagacucacauugaugcacaucucguccucacccguucuuuuuaaccugauaugggcucucaacuaaaggguuaauaccagaagcacccaccuagcuaaguaccgaccuagacagccauuagugauuuacaaaaacaugaaggguggccaucuauauuagggguggagaaggacagggggcaagggaaggugguuucuggcaauugguccacugacacacccccagcugcugugugggacagaagucacgugagucagauagcaacacccaggcucucaucuuguuccaucucaucugugccugggcauguguaccugugcacagggggaccaccuucugcaagguagcuggggugcguguuaguucucagaauagugccagcuguguguccacuucaugaugacaucaagaagaugggcuuugggauccugcccacacccagcuccggggcgcugcugauguaucugggcaaccccagccaggauccugggcugccucuaucacccucacaaccugggggccaggagccagcaaugaaggccagugagaggugaauuuggaaaugaggagcuuuccugggguacugaaggaacaguaucaaaauacuugaaaagaaagagaacucuuucuuguuugaggcuuuuggggcguuguuuccugcguaacucaaagccuugggaaucccagacagaaagucauuuaagauuaacuuuugaaaucaagugaguaagaccugauucaaaggagaauuuagccauggguuaauaaauauaucuaaauugcaaugaaaaucuucagcggucuuagccguugaucccguggucaccauagacaauauaaggagcagugucuauggcaggagugauggaacagauuucaggaaguaacuuugagugagagaagcaggggccccagaacucuagugaccaagacauucgaagacaggcaaggaaaccuucaaaugcaggcaacucauauuucgacggggcacccuccagugcuccgagauggaaauugccugcauuucagugcccuguucuguggcuccagugcucugcuguaugcccacugugaaggcugcuugucaccugugcugcccagcucaacccggccccuuuggucgcuguccugccugccugacggcugacgacggccccacacccaugucuacacccuggguguuugcuguguagguuccaggcuucuagaccagaugacucaagaugaggcacaugugagucuccacccagcaccuaauaaaaccacccaacaaaugagggcucagcuccucccggggugaaggccagggugcucuguugacuaaggggaggccaugaaagaacggggaagacuggcucuggacagagccucauccccugcgcuuaucguggcucacugccaagugcgaacaccuggguccacgccuccgcaugccgggcccgugugcacaccugccuuccucgcuggugagagggcgcaucucagccugcuuuucgccucuagaaaggcacugagugugaacugugaagaaguggccagggcagaggaugugugucaggaaaugccaagcccccuuuccucacucagccagauggccuaccuguccucaccugaaaccaggcccacccaugcucugagaucaucucuagcccaggacaaggcauuuccaaggcagcguuggcuuagacuauguuggcugggcuucaccucucauucaugugucaggagcucuaggccggggagccaggcauuggagacccuuuagcugggaaggcucggggggcugaguuacaucaccaaacccucacagcagcccugugcaagggugccaucauccucccuuugugcagaagaugcuguggcuucaaaggaccagucacuucucugccugaacucuugcccuuugcuacaucauucauguucccaguuggccccucacaccugcucuucagcauccuggguucucagcaguuccuaccuggggcccugccugccaucccuccacugucauucagccugcuuuaaaugucucaggaugacuaaugucacugggauguguucuggcccuggccuuuggcccaccacacacugcaugcccuggcagucaaauuccugaauuuuuucuggagccaguccugcccgucaggacccaagcuccagcacuaaaguacggcugucagagguggcccugccaauagcacacuguguguggaaaacacccagacauugagcugccugaggagaaauggaagguggcccacuuggccggucauugcucguuaaaauguaaaggugugcagauaugaaaacacggggcuuguugccgaugacucaggggagggcaccgaacgucaugccuccugguuaugucuugccgccguguugaaccaggauggggaaugaucccauuccucagguauucgucugggagaccguaaaggauugcuuccagacaggaaggacgucugucuuccuaaagagugucuagcccaacucguugaacuacugucauuucuuucugguucuccuguuccaaauacacagccugagcuccucccuccuucucugagucucucaguuccaugaggacaggcaucgacgcagucauaacugcuggcacucacuggcauuccagaaaagcccauggggcuuauucauuguacgugggggagcgccccuguccuucaggcauuucaccaucuugagcuggugacuaguucaagaccauucuguagagugaacacauuuauuuaggaugcccuugaaguacuguuaaacaaaggaagcugaauuggcuggcuuugcugcccggcauauagaagaaggauuugugcugggugguacaacugugaccugcacuuccucuuccauauaccuugcccugcuaauaccauguuggaauuauuuccuuaauuucuaaagcugcaugugcggaaauggcuuauauuuccuguuuugauaaacuaauagaacuuuacugagaaccuuguucccgaguuggcuuucuucucuuuuggccucuuuuuugauuaaaauaguaauucuaaaaguccagcuugacuggacuugugucaaagacaaagaauuguauagauuuuuuuuuuuugccuugaaaagauaacuuuuuagcuuucaaaaggaugauaacuuuuuaacaauagguaauguugaucuuguuugucacuuggcguagguuuuucaguauuccucuguggagggaauuuggguuagaugcuaggcacaauccaaucgucagcuaucuguaaauucccuucagaggauggcucuuguuggcuggagguaaauuggcuuaaaaagacuuccuuggacaagaaguuucuuggaacauguagaggacaaaauauucuuuguuuugggacagaugaguuuuguucuugcgauucauauaacucgauuacugcucauuuucuaugugcaaguugagaacaaugaccagcauuuuuuuucauucgucuacauggcauccacuuuaaaugauacucaugucugaagagggcugggugcauuuccaugguuuguucccuugcuauauguugacaauuugcagugguaguagagaaauaguagucucaaagaguuuaaauuguuuauguguuuuguuuccuggcauucagguugucauuuaaaccuauuuuuuuaguguccuaaauauaaggaccaaucugccauggagagaagugacauugggcaguuuucuccacguuuugagaugggcgauuccucagacaucuaccaaggaggacacccuuuuccccgguggcaaaggagggacucucccucugccugguggcacaggauccuagugaaggcaacacgauacucucuucucacugucauugggucacucacagaagagccagggcagcaaccaggaggaccggauguccucuuaauccugcagcugccacucuugaucucugcuccaacuccacuguaucccauugauaaaugacagagucucugcuggcagccaggcagcuagugacuccaagcaagaaauucugcauuugauccugauaggagccugguucaagaaacuagaaccugguuuuccuuaaaggguuccaugacuuuuauucuuccagagguaaaagacucaccaaggaaucuagauugugcaucuggagugauuugaugucuaugguaaaucuauccaugcaaacagauggauuuucauaucuucuuuuuuuuuuuuauugagacacagucucacuccgucacccaggcuggagugcaguagcacagucguggcucacuaaaaccuccacuucucggguugaagugauucuugugucucaaccucgugaguaguugguauuacaagcgugagccaccauguccagcuaauuuuuacauucuuaguagagacaggguuucaccauguuggccaggcuggucuugaacuccuaacuucaagugauccaccgccuaggccucccaaagugcuaggcuuacaggcgugagccaccacacccagcccaauuuccacaucuuucuaaauguaaugaugccaagauuuaaauaagacuccaaggaaaagaauuuccauauaugaagucaaccaagaaaucccucacucaaagauucccguucugcaccuggaaaaaaugucuguugcauuccaauugaguagaauguaaucuaagguuucuggaaaacacaucuuaugccuuuacauacacugccaacuggcuccuaaacauuuccaauuccuacaguuuugaauuggcacagcaaugcuggcuaccaguuucagaacaggaaaaagaagagcucuagaaggauauuuugaauuuuaaaaaaauuaaaagagagaacuacaauuuuuuuuagcacuuggagggauuagaggcucagccacugaguccuuagggcucagagccgccccagaugcagcacaggucacagaggucaaagcaagguccaagggccaucacuuuucuaggacagacaugccaggcacccacugagucauggaacaugcugaaccuguaauaacuccuaccuucuguugcacccagggugaugguucagugguuuccagcuuucucacuaucucuaaacaaagccuguuuucacaaugcccauccgaccaccuaguguagggcuuugcaaaccucggugugcuaaccuggaagucaugcuagaaagcagguucugcuccaagaaaggugggguggggccugcauuccucacuagcuccagggugaugcugaugggcccuguccacacagcacacuugccauggcgggggccagcugggagagcagcugcccuucagacaagcacucaugaccucuuugacuuugugucuaagucccugccucugaucaguuuuccucucuguuucccucuuauucccucccauuuuauuugugguacaacuuccagguaaaucuuccucaaacucucuguccagugucuucuuugcuaccugcucucucucuuguuucuuucuuucuuuauuuuuauuuuuucuuuuugagauagggucuugcucuguugcccaggcuggaguacaguggcguaaucucggcucacugcaaccuccaccucccgggcucaagccaucuucccaccccagcccuccaagcagcugggaccacaggcgugcaccaccacacccagcuauucuuuuuguuuguuuguuuguuuguuuguucguuuguuuuguacagacaggguuuugcuuuguuacccaggcuggucuugaaccccugagcucaagcgaucugccugccugggucucccaaagugcugggauuacaggcaugagcccccgcacccagccuucucuccugcuucuuugcugccuguggcuuucucuacccugcuccucccuugccggcguggguuuugucccuaagaacuggugcaagaaugaccgguccuucaucucuuccuugcagcucagagacuuucaagucuaccuugcuucuuagguuuaugcugcuuuggacacuuauuuccuaaaauguauaauucacauuuauuuuucagaacuauuccuuuugguuccacaacacuaaagaugucaagagcuuacaauaaucagacuuagcaccccuucccuuuguccacagugccucugccagcuucuuuaauuccucugccuuucuugaaggagcagauaaguccaauggggucuggccuccagguuggugugugaugagauaguuggcaagguaggacugccugcagguccucaguaaauguucauucauuugcugagggaaguaaugauucaucccccuaggcaaacuccuuccaugauuuggaauuuaggucugaaguuuccuggccaaugcgccugggaagccacugagcuggcugucagcugaguagggacuaaggauguucaacuguggguacugaaaagcggcacuagauugaaauggaguccugagcugcaaguuggggagcacagcaguguuggagcauccugaaagucauaggaagaaugggcuucgagucacuccaacucaggauguuccugauucccugauaaugaucaugaugaugaugaugaugacgaugaugauggcaugaagguggugcccuccuaggccuggagguuagggguagccagucugucucugcuuucuagcagugagagccucaggcugucaggcagggagguuggccuugggagguaggcauagaaggaauaguggagcauagcagagcccuagggcgcaggccugaacacagccaguccucucugugaacaggauaaugcaauacuuaaggacccacuguuccuaauuugcucucuaaccauccucuucuucgcagcucuuaccagaauuuaaauuauguggguuuaguuguuuguuuacuuauuucaccuucuugucuacuuggucaccugccacagggcaggagcaaugucuaaucugcccccuacucuauacccagagcccagcacagugcauggcucagaggaaauucacaucagugaucaugagugaaugaauuuguaaagugaaagcguggaugaaggaccucccagccccuugcccuuugucauguuaguuuggaauuggggaugugagguguccucucacuggugcaguugaaggaaggugccggauacgguucagauuccucgguggucccgaguucccuggguggggagguucugugugccuaugaggaggugagagucaggcauucuccagggaguagggugcccccaccagcuuucacaggccuucuguaaaacuggucccgccaggccuugaguccuuuccugccuuggggugaaggacacccagacaaccacaggaguuuggccagccgggcugaacggcuacagcacgccccacgagccuggaucacguuccacaccugcaguaggagcugcaggaaccuccuggcccugcgagcuucaguggggucagcagccaggcacaccugcagggggcgucagugagagcugggcauuggaauugcccuacacaguugcugccuuggaaauucagacuugaaaugagaaauuaauggaggauugaauugauguuucuuucaugagccugugauuguuguaaaaagaggugugucaaaugcuuggugagacccaugcaggauucuuuaaagaacacugaggcaaaccagaccuuauagggaaaaacaggccucacggagacugaaguuaaaauauggaccagggccaguguuucuucaugaagggggugagcagagauuugaggaggcugcagggugggaggaaacucaucauuuuuauuaaggaguugacaagaauaggaucgcggcuugucuuugauuugcguuaagcaguaaaaugaagggauaggcuggagggcugagagcaggguggcagcaggugcgugcagucgguaugccucugcuggagggaguggccaggccacagacaugggacaccacauagcaguccucacacuccuccucugagguccucagggaggcauuugugucucgagacuguuucagagacccaugucuucucaggagaugccaaggcucaggucagagacuuguugaguuuuuaagagacugucugaagcacacacccugcccuaauaagucaauauuucuguuccuccuggagaccucacauuccaaagugugguacuucgggcucuuguaaauguuggaauuccuaagacucucucuggaggacagguaagaugucagugggaacacacauacacacaugcacgugcgugugugcacgcacggcuggcauguccauggaaacugccuuggcguggaaugagcagggcugccucucaaugagguauuccuucccucacaauauagcacuggagccaucgguacauguagaaaaguguuacugggagguaucuuaaucagccuacaaguccuaguuccaaaaguaagaaugcaucauucauuuuugaguggguuaugaauaacucacuacaacuaaauacagugaauaucguaaaccuagaauaaggagucuguuagaucaauuugaaaccauucaaaucauuucaaccuuugauuuauauggagggauuuggcaaguggcuuuaaaaucaaaauuaaaaauagcuugggaaacagcagauggaggauaugaguugaugcuuuacccuauagacccaggaggcccgccugcccuucccagacaacuggccaaugaauuauugggucaacugaggaccucugccaagcgccuguucaugccucccucacguguaguaaaaggcaugaaugcgccagcccaucuagucuugagcuuuggugcuaaacuuucuggcuuaguauggaguuggauuucuagaaaucacauauucaaaucaugggauuuaugagccccauugcagauaaacauuggagccauugaaaaauuggcaaauaccuaggaucguguuuucagggcgugagaggauuuuauauauguuuacuuuuacaccauaaacuccagcugccucauuaccucacucaagacaaaaagaucacuggaaagaaauguaaaagcuuucaagguacuguuuucucugaaggguuugggacuuuccacuuuuuggaguuuuuuuuuuuuauaguaguaacugaugcaucagauacuauauuagguaaagaauuauaagaagaacauaaaaaacgugaaacucucagaugagaguucucuaguagaaaauuguuagcugaaagaaaaaaaaaaucacccauacaaaaggaacauggagucauugcuggaacccaaggccaacucuugccaggagguuuugggucagaagccugcguguccugcccuucugcccuggacuaucuggaagacccugcugggcggcaguggcagagugggccuggccaugccacuugcaccuccacguggacaugcagcuggugacaggaaaggggaagguuccagcagacccgcuaucacaaaacaacuuacagagggaguccccaagugauaguccuguuuagucauugacacguaacucagaagagagugaaaaggcugugguaaaauacaauuugcuuaacauuggaaaggguucugucaucugguaaguuuuacuugcaugauaagguuucaaucagugaacaccagaagccagccuuguccagggucccuuagguguaacugugugauaauagggaggcuccaggcaggcuggcagaggcuggcugagggugaaaagcuagauuaagauucaccugugagccacugcucaccuguuuguguggggagggcugcaguagcucaacugugugugggagagggcugcacuagcucaccugugugugugggggagggcugcacuagcucaccuguguggggggagggcugcacuagcucaccugugugugugggggagggcuguacuagcucaccugugugugugggggagggcugcacuagcucaccugugugugugggggagggcugcacuagcucaccugugugugugggggagggcugcacuagcucaccugugugugugggggagggcuguacuagcucaccuguguggggggagggcaguaccagcucaccugugugugugggggagggcugcacuagcucaccugugugugugggggagggcugcaguagcucaccuguguguggggguggagggcuguacagcucaccugugugaguggggagggcugcacuagcucaccugugugugugggggagggcugcacuagcucaccuguguguggggguggagggcuguacagcucaccugugugaguggggagggcugcacuagcucaccugugugugggggggagggcuguacuagcucaccugugugggggcugagggcugcacuaggucaccuguauagggcggagggcagcacuggcucaccuguggaaugaagguuguacuagcuuaccugucaggggagaggaggccugcgcugagacucggcugaucagaaaggggagaaaagagggucacucugauugccaucaucucaaaacguuuaauacugucacgauuugaaaggaagagcuaagguacuuguccaguagcccaaucuccaaguccaucuuugaucugaauguugagaucaaggaugagaaacaccuuuuugccccaucgggauugcccauccagggaacucccuccauuucccacugacucacuuaagguuguaucuccuucucugaugaaacacucaauggggucacccacuugccugaauagguccugaggaaagccucuucccggcauuccuccuccuuacugagcauaagugugucccguagggcgaaggggaaagaaaguggacuuccucugccgacaccccucaaaugaagucgcaagugauaucgguggugcagaugaggguuuggcaucccgccagaugcaccugccagucccuccuccucacauggcccucccuuugaucaccaugaugggugucccaugagggagccaccguuugcaccgacaccuccuccuccccuccgugguggcccacuccugcccaccucucuggguuccccgccagcauuuucuccaggcacaugcuccacauguccaggcagaaggcagggcugcugcccaugccccggaguuucucaugcaugccacaggccugcuccuuccugauuccucacuucacauggaauccagauucucggaauguucuccugacgcugaagguccaggacuuugcuuggcaucgggcaguuuauaggcacuuuuuuuuuuuuuuuugagacagucuuacucuguggcccaggcuggagugcaguggugugaucucagcucacugcaaccuccaccucccgguucaagcgauuuuccugccucagccuccuaaguagcugggaauaccggugccugccaccacgccuggcuaauuuuuguauuuuuaguagagacgggguuucaccauguuggccaggauggucuugaucuccugaccuugugauccacccgccucggccucccaaagugcugggauuccaggcgugagcgaccgcgcccagccuagugagaacuauuuaaagacuccuugaccauagaacauacagcaccaagggugaacccuggucucaacuguggacucuggugauggugaugcgggcagacucagcgauuguaaccagcauacagguugguuccaaccuguacauccuggugcaggaugucgauggugggggauuucaggggugggagagacagggguauauuggaaaucucuggaccuuacacucgauuuugcugugcaccaaaaacugcucuaaaaauuagucuauuuuuuuaaaaaagccuuauugaauguuuugaaugaaucguuucuagaguuggaaggauucucaacagaugauauuuuaauacauguuguaguuggcaauguuuagguaacuuuucuuugccuuguguuuuauuguugcagggugugaagaaguuugaugugccguguggaggaagagauugcagugggggcugccagugcuacccugagaaagguggacguguaagucacagcauugcaauaaauaauauuaucuuccucauacagucaugccucgcuuaacaacgggguaccuucugggacacguguggcugggcaguuucaucauugcuugaacauacuggagaguacucacacaaaccuagauggccgggccuacuacacacccggcugugugauaaagccuguugcuacuaggcuacaaaccuguacguaggcaguugcgacacaguacuauuuguauaucuaaauacagaaaagguacaguaaaaagaaaguaaaaagauguaaaaugggacuccuguguagggcauuuaccaugaacggagcuugcgggacuuggaaguugcucugucugcguuggggagugcggggugcguggaugugaaggccuggggcgugaccgcgcaccacuguagauccaucaacacugggucuuaggcggcccuaaacuuacguuuucaauauuuuucuuucuucaguaauaaauuaaccuuaguuuacuauaacuuuuuuacuuuauaaacuguuaaacuuuuuaaacuuuuugacuguuuuugcaauaacacuuagcuuaaaacacacauuguacagcuguacaaacauauuuucuuuuucuacguuuuuauucgauguuuuuuucuauuaaaaaaauuuuuuuuuacuuuuuaaacuuuuuuguuaaaaacaaagaaacaaacagacaugggagccugggccuacacgggcucaggauaaucaauaucacugucuuucaccuccacaucuugucccaccagaaggucuucggggcaauaacacgcauggagccgucauccccucugggaacaaugccugcuucuggauucuuccugaagcaccugccugaggcuauuuuacaguuaacauauguacacauauaaauaggaguacacuccaaaauaacaauaaaaaguagaguauaguaaaugcagaaaacagugacgcaguugcuugucaccaagugucauacacugcauguaacugcauguccacacuuugaugcaaccagcaacacagcagguuuguccccaccagcaccaccacaaacauguggguuaugcgcugggcagauccggugucaucuuagggcaccacuaucuucagugcagucuguuguugaccaaaaagucaugaugcggugccugauuguacuuccauuugaaaugagagugucuuaaauuuucugaguaagucauugcauacuuugcuaagaaauuuaaucaauuguauucuguuccacuagaacaaacaauaauauaaugcaaaauugggucaauguauaccacuuuccuacaaaauugagagcaauuuuaauuuucauaagcaucuuuucuuucauucauuguucauuauaaguacguacguguguuugcauguguguauauaugugcauauauaaagcaaugauguuuuauaguuauaauaagcagaaaugucauaaaaauauucuguaaagaaaaaaguaguugcauuuauacugcaauauaguuauacaaacuagggagcacuggcaguuguaucauugcuaacaauucucacuuugaaaauauuuacucccugaaugucuuugaugugguccgucugauagauaaguaagaggaaaaaaggguaccccaaaucaucaccauuacaucuggcagaauuugaaauauugcccugauauuggauuuaauauguucaaucaaagugauugaucucugauucuguugccuuuaaaacugauaucuuuaaaacugagucuugguguuacuugguuuaaaaguauuauuuauaugugcaccuuuaaguccaucuugcaugugugaagguguggggaguaguauuuuguuuuaugacacagccuccuugccuuuauucccuggacucauguaucuacccuaggacacaugcuugucuacaccuucguuuggcaaaugccagguugucaaggcaacuggaaacucuucccugaauugcccugauguuguuggaaucagaaauuauaacagcccuuggguguccaaaugaguuuccccaaguugaauccugaagucaguuucuaccguagccauuucccaucccuaccugccaggaagaacgacccucugcuggagcuuggccuccagggcugaggugcgaugccgcugccuccucuccuguguccccuccacaaaaucaaaugggcacaguucgugauagggaaccucuuuauaaauacugucuuccuauuuccugaccugugacugaucauuauuucacugucaaaaaucacaacugaggaggcuuccugccccuuugaucaaagcucccaucucuccaccugcugcauucaucauuaguugcacuucucaaaacaguuauuuuuguuucgguuaagcauuccucugccugcuguggggacuuuaugguuuagaaauugcugguugaagaucauuuaucagcacuuaacaaggcuaaauaauuuuuaaguuuauggaagccauuucacaagauguaaaauuccccugggucucaugcuauggauuuucccaacgacacuucuguggcagugaugagaaugccugacugcagacucuccaccccgcagcccuugacuggcucagccuuauaugggcauggauagaauuggugguauacacauaucugugagacuagcugugugggacggaguucgugucuagagcgacucugcauucuucuccaugucaucagauaaacagaacccaaacaaacugaguagaggugaccggaucuguucuuuucacuuucuaugauuauuuaaugcagaaucaacauaguaacauuuuccauaaugccuuuaggagaauuugauucuucaguaaacauagcuaguucagauuauuucaguauauaauggcaucugcauagcaguguacuguuacacgaugccagaggucuuuucagugagguuauuaggaggggauuucuaaggauccccaagacucugugauuucacgaauucacagcacaggcauugagaccuuuuuauuucccagcgucccuagugaaggaaacaccuugagucucuuucuauacuuugccaaguaaaaugaaaaaucgacaccuucugguuaaucugauuaacuugaguaauccaaaacuccgugugggcuuggcuguccucuaguuauccagacggguuaucaacacugauccaauuaagcugugauuggcagcugucugaaggguuguacaaaagacagaggcaaacgauacccgccccccaccccggggccuggacugugggauccacugugcacgcgcagcacucauguggccugaaaucuggcuguaccuguaccucugggugcugcgugaugcuugacacugucauuucaccugggccgaggcccgugcugccaagggaccacacagccagucacuggaguguguuaacaaucagcacacagggcugcucuguuaauucaggugagacccugaacauucacugauaaagugauagaaauagcugaugauaaaagguaagaaagagaucagugaugccauuuaccauuuucuuauuccuggagauauucuucuguguguuacaggagacaauuacucucaggacugcugcaucuacuguauuaaaacauuuuuaagauagagcaucuguuucaauacuacaaauccggugcauguggcuuaacuauuuauuaauuaacagauuuucccaaaugugcucuugcagaagcauugcucugucugcccuacuuuuggacugauaguauuuuuuuaaaguaagauaauacauaaaaauagcagcuggacagagcuugcugucgaaagggcugugugcauaguuuguucuuucccacagcuuccccugggguggcucccgucucucuucccuguggugcuacuguaacagcccuggaaaugccuggcugcagacucgccacaccccagcacuuggcuagcucagccuuuuaugggcaugguaccccaguucaucugugcgucaccauggugacagccaacaucggaaguuguacgucacuggauaacuuuuggacacgaagcagaaaucacaagcauacuauggauuccaguuccaaauggauucucaugugaccagugaaugagcuuugggucaauuugcagagcuuuguucauccuugggcggugagugguagacucucccagcagggagagaauugcuucacccagacagaaccacccagucccauagauaauuccagcaagccacagaguugaggccugaagaggcaaggcaggagcuguguaccggcugcuuggcacugcccacuuccccucccugggcagagcugggaggagcugagccaggagccagcccauguccuguaguucacguacgagcacacugacuucaggagggaaauggccucugcaaaucucacacccagauuguggcagaguccaaaacaaaacucaagucuggggacuuagacaaauucuuuuuccagcauaaucaucuucuguguccguacuccucuucccauaugucagccuagaagagugaggcucuccgggaugcagggaagaacauaggcagcgugagaagagaguuuccccucguuaugcaagaguuaugguucccuaguuaacucucuaaccacuucuucaguuguuuuguggauuaaaaaauaacuuuaacaaaugauucagggcucuguuguuauuugagggucuguauuucaaauaaucucuaguaagcauauuggaauaauuauaaaugauaaguucgauucauugauacugcauguucucagauuuaccccuccacugaauaccaggcaaucaucagcaccaaacaaggugcccgccccuagcaccuuucacugcagcccucccaggcucaagcaguucuccugccuuaggcccucaaguagcuggaacuauaggcaugcaccaccacaccuggcugauuuuuguauuuuuuuuuuuuuguggagaugggauuuugccauauugcccagucuggucuugaacuccuaagcucaggcagucugcccaccucagccucccaaacuucugggauuacaggugugagccaccacacccagccuucuuuuucuauucucuuuucaguuuucuuucuuuauacaccauggagauggaaggcaguugaaugggaagcaucaaagugaguuucaguuacagaauuucugucagaguuaucagcaccacgcaauguaaagguuaauaauauagaaagcaguagaggggcagauaggaaaucggagucaacaaauaagacagcuuugcuuugcuuguuaacucaccuagcagauggugaaagucuuggauuuuuccaaguaaggucaauuuuaguucauuauuucaguaacuuagccagguuccuguucucccccaaacaucugauuuuugaccauaaacucugaucagauagguuguuucaaauuuuuuaaugacaucaaccuucacagggcaccuccuauguccuaaggcacuuggguauuccagaaacugguaaauaugaagacugguuggauaacuccguguugggaauuagugagauggucaaauggcccugucacacgacaacagggaaaagagaacccacgucaucagccccugaacgagugaguggaggccucugcaucacucagcaugcauccaggcgguacccacagugcccccuguggccuggcagcugcagcugagagccuggagacuaugcuucuggaagguugcgauugacaagcucgcucaaguaagcaguggcugagugcuuagggcaacaaguuguguuuagcgacugcauuuuuucauguagcuaagaguuucccacagucuaugggucccuggacuugggucaaauaguccuuagccucaccagauuucuuaaauucaacacuauaaaucaaaguaaaagaaaccagagagaaacugagcaaaaauagcugccaagagaagagggaacgagugcucggggcggguuggaggcagauaacgagaaggcaagaaaauucuuugucuuuggcuccugcugucagcucagaggggucaucuugagaugaaaaagaaaaguccccagccuuggggaaggaaaggagagggugccccacgcagauaugaagcaaagccauuggcaagauauucucucuaaggagagcagcggucuugccaaaggcaucuucuauuguguauugccgucauaaacccuacccuuccauguagauagccaggauuuuaaaauaaaacuaaaucuuccccaaggagagaauugcgaugcccuggcagcaugggcacuuuuguguggguguuuccguggcuagagggguucugaaauuuuuguauuuguaguagagaugggguuucaccauguuggccaggcuggucucgaacuucugaccucaggugagccgcccgccucggccucccaaagugcugagauuauaggcgugagccacugcacccggccucugucuuaguucuuugaagaugugggcauguguggaauaaaaacaucagugcugcuggucggaccucuuugcaaaccaacugcaauuuuuccagacagauacuuuuaaacggugugcccagcauacuuagaaaaagaaaucuccagcuuuuuacaugcugcacagaaagggcaaggaauuagucagaaauagcaaaaacaccaccuggcuuccaggcuuuuauagcccugucuacacauagcucucacucacuuucaaaaccaugcaguuauuuuuaguguggcuuuggagcaaagguggucuggcucauccagcgcugcaggggcuguggcaacugggucccgugauuauuuucugugggugagcuccaaacuggcccauuaucuaucaaauccucaaugguguuauagugguucuuuugacauaaaauauuuaucauaugggugggauggcgaguggaggaggggccagaaauucguaauugcuucucucuuugucagcugcauaauuaacucaauucuaccacaauuuauuaaaagucccacuucaagagaaugguuaaaucucgcuggaaagaaagagccacauuaugcucugaagcuccaaguuucagaaaauauucuuuuugugaauauauaagcccaauaggucacccaucuuggucuuacuuucaugaaacccugacuuuauauugugcuuucuuuucaucuaggauuuacuaucuagaauagucuuacacauuugcuaugaguuuccugucucuccacucuccccagauccucccucuaccccuggcuccaaacucaacggagauuggauguucaguaugguaacugcuaggcacaugcagcuauuucaauuucaguuuuaauuaauuaaaaugaaauaaaauuuaaaauucaguuauccuguucacuagccacaccugaaguacucgcauagccacaacuccagaagaugacugcucuguuuacuucuguauuccuggggccuaugcagggccugacacaugguggauauauacuaaguauuuguugaaugaauacauauuguuuuuaaauuuuaguagccaacuguggcuaugcauaauccacugccuguguuaggggccaaguuuccuguuuuucaaggcauuuucucucuugcuuuuuuuuuucgaggcggaguuucgcucuuguugccugggcuggaccgcaguggcgccaccucgggucacugcaaccuccaccuccuggguucaagucauucuccugccucagccucccgaguagcugggauuacaggcaugcgccaccacacccugcuaauuuuguauuuuuaguagagaugggguuucuccauguuggccaggauggucucgaacuccugaccucaggugauucaccugccucggccucccaaagugcugggauuacaggugugagccacuguucccggccuggcauuuucuuuaauuagaacuagaugucucauugaauggcgcaccaaaguaugaaccucgagacuuugucacaaagggcucugugaccuuggguagggcacaugacuucuuuaaaggagucuccugagggcuucacaccuugcucaaaugggccuuccagagcuuugcacaccccucccccuacccuucucucugaaccugcccuuucuccacgcaauggccuuggcucuccaagagucacccuggccccauugcagccccugcugcuggggcauccuccccgguucauugacuccuuccuucucuuacaccagugccuuacaugcaguugcugauagaaaauacauauuugagcguugaaggaauguaaaacuccauugcuaaaacgaagcuagggccuuucuuaggauggaggacaugaaagaaaaugccacuuccaaagcuccacacuccaucagauugacaaguuagcugggaucagauaauaauagccauuucaugucuugauuaaaaaccucacacagacuccacagaacuguugauaaacuagagcaaaaggaauucacaguuccauucuucuuauaaaccaaacuaaaaugcugacuuucgaaauccuuuuuuccgaccuccugauggaaaguuuugacaaguguagcacugaagcauuucccccucucugcuagaggagaaauggcaaucuucaaagaccauuguuuuguuuuauucgcuuccaauucauucuuaguaaacaauugcaggauuucuaaaaagaccagaccauaguaguuaccagacaugagaugcuuucuaaaagcuacuuugaauagaaauguuuucucugaaucugucuucccucaugcagcaggaagaaugucugaagcuaugcuaccuucauauagaaacagcguccacagucagucuucccaguuggguuuaucucagcgguccuuuagagguggucuacacaagacucuaaauguuccugccugugagcggucuucuacuagacuacuucaauaauaaagagaaaacuacuagauuguuuugcaaaguuuugaaauuacuguuguuguuuucuucuggagacaguaaaauaauagccaaggggagaaaauggcacaaaugaucaaaccaagcaaccguaugcacauuuuccucccugaggggccuuugaauuugccaccuaaaugcugcaugcaguggguaccccaggaaggaggaaauggggucccuucaucucugcuuuauuuuguccaucauuaaaucagaaggacaugguuaguguccuucaucuucgaagggugaagauggcugcauacauugucuguuacuaucauugacauuaggguaaacauauaauaaauguauuuuuaaaugaaacagucauuucaaaauguccuuaggaagcuggucaaccugaggcccugagcugccugcacuucugagcccucuggcaucucacccaaaugaguucauugugguguagaccacugaagcgcucaaggugucagaggucugacucaccugggaagcacaaagcaggccuuccaaaggccauauguccccacugauuagaaagaucaaaacaccccugucccuuuccucucuguguccagccuagagguuugcauucuaggagaauggcagcagccagacaccucccaggaacccaauguaagcccuguaucgauggcagcuuccugcgaagccacugugagcgugugaaaaauccccaccguaggaacaaaaguuuuuguaucuaaaacacuguuggggugaauaacucuuagagguuuggaaccagaaauaaagaaaaagaacaaaauaaaauggaaguaauuaauguuggguaaauaauaucuuuggccuaacaaguucuuggcuccauugucagcauccguguuuucuauuaaauuguugucuuugugaggcauuauuacaguucuucccucuuaaagucuguuuugaauaaagaaaccgaagguuggaugaauucuauaguuagguuggucucucucuaaugaagauuaaaguucuggcaugucuuagcucugcauggcaauaauuacuuuuaaaaaaaugcacuuaggguggugauuauggcauuguaaaagucuuaugaaaaugagauguaugucaagagaaccuuacuaucaaaaucaguuuugugcauugcacccaugcuucgcaucugucagcaaaagcaggcuuucucagguuuggugaaaggaauauugccguggccuuugaggacugaugaguuuccacuaauuuagagcaaaauuaacagaauccuaugagccuggaggaagcaguucacuuuuguuuguguugcuuuuagcauacugcucauuucaacccugcuuagagaaguggcagaucuuauacccucaggcagcugggauaugccagccacagagggcaagauccauaaucuuuaacagauuuuacuguacacguucacagccccaaccggccauaccauugcaaccuaaaagaaagagaggauugaauaagcaguccagaaaauucaagcaaaacucugaaacaggaagccaggcuuccugcacuugaaggccuugggguaaauuccucaucauuuaacaccugaaauuuugcaaauauuuggacuucucuucgaagaaugauagaauuauuggucuagaacaucgacuagucuucucccagccccguauucaggaaggacagaagaaugcauuggagacugaugaauauccacucuguucuaaggacuccagggagagaaauuggauagacuuuacugguaacuuaaggaaagacaaaaaggcguagguuuauauauauccagaguaaaauucacaaaggccucaagucauuaaagguauuacauacuauugcaaaagaaaauaauccaacucccaaaaguugaacuaagaaaguuccucuucuuccaaauaagguuuuacuuagagacuuucagucccacuuaaaacuucaaagcaauaagcuucauuucacagcuucacuaaaugaaaccuaaugguagacaugccuuugacuagacauaaaguaagcauucuuucuagagaaaauaaauagaaagagagguuucuuucuauuuccuuaucagcuucaccucuuucuuagaaaugauugcucgucuggacagcauuugucaugaguuuguuuucacuuuaaagcaugaaggggagagaugaccagggagugauacccaucugcucaucuucaaggauugcguaggaguugagcuguagagguuucacugcagaaagccaguauugucaagaagcauccugagaacauguaauuaaucucuacaaaugguagaauaguuacauuagugccauaauuuguuauauuuaagcuauuuuucuaauucacaaucaacuaaggccaaagaaaaggggggggggggguugagcucaauaauagcauuaggauguuuaaugugaaauccaagaagacuaaaauaauacaauuaggccaggcgcgguggcucgcaccuguaaucccagcacuuugggaggccgaggagggcggaucacgaggucaagagauggagaccauccuggccaacauggugaaaccaggucucuacuaaaaauacaaaacaauuuagcugggcgugguggcacgccaccuguagucccagcuacuugagagguugaggcaggagaaucacuugaacucgggaguuggagguugcagugagccgagaucacaccacugcacuccagccugguaauagagcgagacucugucucaguaaauaaauaaauaaauaaauaaagcaauuagaguuacaguauggcuauucagguugaccauuccuaauccaaaaauccaaaaucugaagggcuccaaaaucagaacccuuuugagcaccgaccuggcacucaaaggucaucucguuggagcauuuuggauuucagauuuuucaguuuaggguugcucaaccaguaaguaugugcagauauuugaaaauucaaaaaacucccaaauccaaaacacuucuggucccaagcaugucagauaaggagcacucacccucugaugagcuucaaucauugugagaccuuuaaaaucuaacaccauuaauagagagcacuauuaacacuauggacaagugguucuuccagccagaaugcccaucgguagcacucaacagguggcacuauggcauaggcuaugguuaauaaaacugcaacaaaggaaaauuuuagcuuuaacacgugccgacuucucugcagcaaucccacccuucccgccucagcuuacaaauacgcacuaacucagauaccucaaugauacucaggugacuccagccagccucaccccaaagcuccccauugcacagaugagccuucucucccaucauccacccaccagcccccuguccagccccacuuucuucaauucauugaucgcagcacagcauagggaagaacaugauuuauugaaucuuuuccauccuaaaguauuaauuaucaauagcugcaauauacccugacuucauaggaaaaccugcaccucauucuaaucaccuuguucugagcgucucacuuuccuucuuaggucuugaccuuaagauuucaacuuuacuuucuagccgcugccugaucaacguggagugaagugaaaugauuucccccuguauuuggaagcuguacuucuaaaacucuguccuagaaucacaucacucucuuuuaccaaccagauuauugcauugcauuggcucacuaguaauguauuucuaccaaaaaaaagaaaaaaaaaacaaggguuuuuuuuacuuuugacaaguuuuuuguuuuguuuuguuuuguuuuguuuuuugagacaaagucucacucugucucccaggcuggagugcaauguagcaaucucgacucaaugcaaccuccgucucccggguucaagcaauucuccugccucagccucccgaguagcugggagcccgccaccauguccagcuaauuuuuuguauuuuuaguagaaacgggguuucacuguguuggccaggcuggucuugaacuccugaccucgugguccgcccaccuuggccucccaaagugcugggauuacaggugugagccaccgugcacagcuuuguauuuuguuguuguuguuguguuguuguuguuuuucugcuucuucacucuuggauuuccacuugugcaguuaauuuuugaacuugauucaggauuuuguuuugauuccuguuaaauuguggaaaggugcagcuacaguugcugauguggagauggagaaauugaagguguucuucugcccuugauuuuccucucucccucucuccuacuugucuaauacugaucuaauucagacauagacaguccaugaagauggcuauugaccaaagaggagauuucuaaaugcuaauuccuacuaguauuuuugggacuuuauuuugaggauagcauggaugaaaagggauagcuaugcagccaucugcauacccucaaguugaauaaucagacugaggaaguuaacaaaaagaacuuuguggguggaaaugaacuccuuaauuccagaagauuaaaaagacuucuuuaguagaaggaaauaaaguuuaacaaaaagggugcccuucaaaaaugucaguuaucuuggaaggaaagaugaguaauggaaaucccgguugaucacaaagaugaauaagaugcguccuuuaaaacuggcauuuauggaggacaaggguucuucaccagcacucugcauccuuuccuagcagccgcugacauaguaagagaagccucuggaauuaucuuauugcauagaauuaguuauuaauuauuccuacaauuaagauacuuaugauacaacaaagaagcucaggaucuuaaaguguacaugaugugcguuguaugugugugugcauguaccuagaccuauuuacauuuauguucugaaauuguauacaucuuauauuuaccaaguauuuauauauuuucuguaugcguguauuuccaggggaauaacaauguacuauccuagaaaaucuuuucaaccuccagugcucaacauaggauuuuaguuauuuuuagcacuuaaucuuaucugagaacuuaaaaugaaacccaguguguguuuuuuuaauguccugcaacuuuauuagaagacacuguugcuuuuuaaaauuuaucauguuuuuauaucaagccugugccagauguuccuaaguguuuugaacaauagcugguuuugaaaccaucaggcgcucuccacguagcucugcugugagcaucgauacucccugcucucugagcauaguguagggcgggcggcgggccgucugggauaugggaaagccuggggccugggcgcugcaaagacuguucugccuggggucugacguuggccgugccgggagcucauugucuuuccgucucccccaguucuuauccuacugaucucuauaugcuguuggcuuugagacaauaggaacuccagaaaugaacagacagggaauuggcucauggaggggaaaggaggcaggaguggguggacaaggccggaaccacauuugcacccugaggagcugggagauuccgcucaccucucucucucucuguaagaaugcuacaucccacucaggggguuuccaauuguccuuacucuaguuggcaggaacuuaaaacauaacugaagcaugaacaacuggguauuuugaugaaugauugacaacaucccauugucuucagagcccagcacaccgggccggucauuccacuguugaggugguuccuugagagagggggcagaggacccugugcgggggugggaucaagcacaaagagaaaacuuucccaaaacccuucaacagacuuuuuuguuuaagaaaauaauaauguuuccgucucugaacaccaagucaggugacccguuuuuccuucaugugauuugugagcuauuucagaaccucguaagucucucugacaggucaggaauggggaaaugagaagugucauccuguagaguuucucuucucuggaauuugucuuguguuauuuuuuaauaaaaauaaucaguguuaugcuauuguuucaaaucuggagacauuuuacucuuuguguaucauugccuuucuuuuuuaauguguguuauuucuggaaggcaggcaagcuuuuuucuuguuuguaaagaucucuucuccuguugccaagagagauaaccugaaaagacagaaaauugccaacuuaaacuguagauaucauuccauugauuuauuuacagagcuuuaaaucuuauuuuguggccacuacagugaagcaaauauuauuuuaaaagcuucauaugaaauaaucauuaguagcuuguuccauuuuaaaaauugcagguguuuccuaugccuuugggcagguuuuguuguuugucuuuuguuugugugucuaaauuucccauugucugggaugugcacacugcaugucauggaaggucauuguucugguucacaugauuuuauuuccaaacugugguauagguucuaauguauguuggcugcuguguagcuguguacccauuucuuacuagccaugugguuuagugacuaaacaguuuauuucuuuauacauaauauuucucugaguugggaugucuguuaccuguuuucacaguuuaaaaggaagcauaaugauuuaguuguaaguuuuuucugccagcacuaugaaucauuuggggugucugauccacuugaauagcacaugugggcugcagaauauucauauugauggaacaacccaaacuuuaggauuuccauucuaccugccacccaaccaguaccaacuguguugugaacgcauuuuuuagguagggaaaugauuuacaaauguuagccuucuuuaccuucacagaguugauauuuaauuggaccauuaguagcaaguacaaaucuuaagaacguuuuaaaucuugccuucagagggcaucuaugguagagggcuuuggguagugaaauauuugacuacuuuucuuaaaaaagcaaaaaucagaacaacuuauagaacaguccuccugaugugaucagcuaaaaagaaauuugaagcagccauuagacuuagguaaaacuuaggauuuaagcaaaaagcugcucucuccuguccucauguguggcuuauucacacucaggggugucuccuguguugaauaaaguggccuccagcuacagccacugcuuacacaugcuugguugugcacaugagagauaaauacccaagccgcagggugugaggacguagaaauccagggcaucccuaaaauuauaucaaacucugccaaacugccugagaaucuaugacauccuaaugccuccguccuccagcaucuguggaguuggcuccuuuccgccucuguguuuuccuuaucccuuguugaguguaaguuaaucgggcacaugccaaggggcagcauccguuuucuuuuuacccccuuuuggaugcuaaggcucuucaaggauauaaugcagcccugugcagccguggccaguuuuugcacggccgcaguagagacuuggcacccuggaauaucuccagcaauuauccagcuugagaguuuucaacugaacugaaguuuuauuaauguucaucauaaucgugucacguccaauuuuaguacuugguaugaauuagaggaaaaaggagaaaacgauggcccguugggucagcaugcauugucaugauacccagcauugauugacagcuuacgguggucccggggcgaugggagcacuuuacauccauucacacuuccuccuuagggcagcuccgugauguaacccacuuuuacaaggaggaaauuaauugaagaacaaugaugugagcugcccaaaaucacaucauuagagaguuaaggaaccaaacucugacccgagaucuggagccaacacuuaacuuucccugaggggcauccuuuaaaaucuggguaugauguugcaccuugaaacucaguuguucaaaauuauucuuucuuucucaaccuuuaacuuccacaucaacucuuucucucccuaaacaaaaucacuaaaccaaagaagcaaaagucuauaaggccacaguuuugugaauuaaauauccauccuuuuccccaucuguuugcguuuauccuacucucuuuccucuuuuggaagcagcucuguuccaggaacuggcaaaucgauuuggcucuuuuugcuuuccucuuugcucacagggaaucuccucuuugaaaaccagaaagguucuccaaauauagcaaaugcuuuccucaucuccauccauccuaguuaccccucuccuccucuccucccacucuccugcucugucccacugcuccaccccugacucugcuaaccucaugccgauuauacuucuguaguuucauuaaguggauaguuuuccccucuucagaagcauuccugagucaagaacacccugaaugcacuggaaguuguucaagucuuacccucuaagucaaggugagauacuguguagaucugccaauuaaucuccuuagaggauuauuuaauccuaaaagaaauucuuauagcuccugguuuuaagcccuuucuuuacuggggcccuuuuacuuuaguccuuaucuacuccaauaaggcacauagaagacauuccucacuauaagaugugugggguuagagcuguugcccaauuggacucugagaugcgauacuucucgccauucaggugugaggauggcucaccggguaagcaucuugacuuuggcaucacauuccagcccuuacaccucugucccagccccugggugagccauguuccccuuugccgucgaauucugccucugaaaauggaaucauaguuacugccuccagcagcuccaauguggcgaugguauugagagaucagcgcagugccugucacagugcagaggcucaacagaugguggauacuaccacguuuucucuuucuguggaacuuccgcaacagucauccgcaaaaugacagaaaaugccagucaguugggcauugcagggacuguuggguuugugggcgagcaucccugcaaauagggcucccauuaaagucucauaaaggagguauuuuggaccuugagucuuuuuaaauuuuugacagagccggugcagugucucauaccuguaaucccggcacuuugggagaccaaggugggcagaucacuuguggucaggaguucgagaccagccuagccaacauggcgaaaccucuucucgacugaaaauacaaaaauuagcuuaguguugugacgcacaccuguaaucccaacuauuugggagcugaaggcaggagaaucacuugaacccgggagucggaggcugcagugagccaagaucacgccgcugcacuccagccuggaugacagagugagacucugucucaaaaaaaaaaaaauugacagagaaaaucaucgugauuaugcuacaucuuuauacaggagugguccguacaaguuuuuauucauuuaauuuuucuucugugcugcagaagcauuuccugggcuuuugacauucccugaguaaauuaaggcuuugucagccucuguucugauuugggugauuuauacaucauuaugcagaguaagcaccaguagaaucacagugucuauuucagcugaacaaaauuuuugcuaaggaaagaacuaucugacauucacuggcuuagggauauuuggggagacacgauagcuugcagugcagaguggccuccugcuuguucaugacaguacgaaaugcauuccuaaaucucuuauguaucacuucugaucugacugagaagaacuagguaagguauaaguaaggaaauagucucuuaucuccacccgcuucacuguuccuggcagagcaacagucuggaacugugagcgucagaaggucggagccuguuuuuauugcagugacucuucugguugcugcuugauaucacaugagccucugaccugcuuaacuacauuuuaaucauccugccuugauuuguauucuugguagaugaauugugauucauuauuccauaaucauuagcccccccacccaaaaaaaaaucacuauuuuucugauaguuuugaugguuuuagcaaauuuuuauauuaguuuuggaaacuuuacuuuuuuauaaaaaucaucguuuuuacauuacauauuuguuucauguugcaaauuaucggaaggaaugccucucacgcuguaaugugccugcaagcagccugggccccuugguaaagcacagaugcuaguucugcaggcccaggagggccugaaguucugcaguugccucaagcuccccagugacaugguagcugcuggcccaggggcccuacuuguaauucaaggcccccgaggaccuuccugaaacccccuuggagagucgaggccaggccgagugcagccucagguguucuccugagacugacgcauccugcuugccuuggugaggccagguuauuaagcagauagauaauucauugugugccuagaagacauauccuaaaaguuaucuuucuugcugagauauggaacuagaccugucuucacucagugaucguugaucuuuagaauggccagugugguucaucuuauuaaggggaaaacuuuaauuuuacuuauuacguugaaugucacuauguucaguuauugauuaucccaccagcuuagacuuggguggugagugucuuauacaccugaaagcuaggguggggguggggagacuugcuuauaccaccaugccagcuguagcauucugcucauggucaccagagugcauugucagauguuucuugguuaggacaucugcauucuacaugcaacaggugccaucucugcccuugcuuggggucagagugcuuuaauccagaugcaguauugguugcaucugucauuaucggcucaucugcagcuguccuuccuguguggugagccuaccccucacuccugccuggucacucuccugacccuccaguuuacuuucuggcucuggaggugcacugagcaagggcacacacucucccuguauccaucuccaucccaggaccccgcacaucccugcagcugcuccugggugugcccaccccacccccacugggauuugagcuccccucaacuaaugggcuuuccauggggaaucaggagggugggaauugugauuccguuaaaaucauuugacucaggaaaagcuuuucgaaauaauccccaaggaccaacucuuuacagaaacuccucccccgccuucauauuuuuggcuuugacuauggggaaauucauuauguugagcuaaccuuggugaaacaauacuaaaaauagagauaauagaaaaacauguuaaagaagguaaaaucaucugaauacguacuuuauaaaauucagccuaauacuuaauggcuuuauucagaccuaauuugaacauaucacaaguauauuucaacagaacuuucuucuucacagaacuuuucuggaaaaaaaaguauacugucaaaauguuucucuuauuagcaaucaaaacccaguuuggaaaagugagugguuugcucugaaaaacaacaaacagggcuugugggaauucaacagaagaauaacccacggcuuguaagaauauuaaaaccacggucacauuuuacacaguuuuggcaaaaggaauagcccaggcgucucgaaucgagauguaaugugaaaugaagaauuucaacagggcucauuaggcuuuuguucuaucugagcagaguuuucugcuuucuuggcuaaaauaagaugcaugcagcuuuaauuguaucucccuuuauucaaggucuucacuggcaaccuuaaguaucaaggauuugcugcucaaaucauuuguaaauaaaacucagauguaaggaaauacagacaagggaggacaaaaguuuuguccaaaaaaauagauauggaacaaauucagagaauuguagauauaggaaggaccugauacacuagcaagucuccuuucccaguugaggaaacugaggcccuccaugguccagaggugcgccugcggccucaugagacagaaccaggcccuuuccuccgggucccucgccucaggagauucucugagauggagaaagauucuggaauuacagccaaaucaggaggccuuuuaagauugauuuaggaagagcuaagagaaaauacuaaauggaguuguuuccaagaaacagaaauaaucagugaaauuucuuuuacaaggaaauaauugaagcaaaugcccucugcaugaaaagucgcauuaaaacccaccccagugggcacuuccugaaugcaguauucccugcagacagcauuugaacgauacuuaggaagcaaacccuucgaaccacugggaagaauguucccagucugaccuagacaguccuuagacaaggaauucggucccgcgguguauuuccuucuccacaaugugaucaugguggagagcuccacauuggugucgguggacacagucaugaauggaagcugcuucauaugaggcagagccuccgugucccaccucacgcacucuccggcuccuguaaaggggagaucauggagccgggggcauuugggccccguuuguagucuugccuggcccugacccaucagcaccugccuaguuccgcaggcacggagaagacugcaccuucugcucuuagguggcugcaccagggcuucuugaaaaggggcagcuuccucucagggacaucagacaaaaucugaaggcacuuuugguugucauacuguggagaggguguuucuggcaucugguggggcacagggacgcugcuacacauccuauaugcacaggacagccccgugaagaagaauuaucuggugcagauuaucugaagugcugaaggugggagacccugggcuagagcagugcucagcacccuaagcuaagaggcgaguacgcgugcaggugcacccgagggaaagccuugcccucagaaagccccugcaaaauuccuuggcaugaccuuccaucuugcagcucauuucuuucauguacucagcaaauaccugaguuccuacugugugucaggcucuguguauaccucaaauugaggagccaggggcgccgggcagcaguggggcucacagacuuuuggcugcagcagaagcugcaaggcuccucccuucucaugcacccccaaauccaacucuggaggugccgugucaggcgggugcacagaccauggagcuggggugcuggggucggaguacuccccauggacccccauucggaagugcgggcugcugggcacauuaguuaaucucuuggcaccaccguguuuuaucucuaaaauggcaguguugaugagccccccacucccuagguggcuaugccugugcaccccuaacacaugagagccacguuaggauggugucugggucccuugucauuauuugggaggugcagcugagcuuccugguagaaggacuuacuuagcaacccgcuccgccuuggaaagcugacccuccuccaccugccuccucuccuccaccuucuccagccccucugugucaccaggcagcucucucccgugucccagugagcccuccgcaggccagccuucccuugcaauggccuguguugccagcuaguccuguucugagaggaucugcuccacucaaaccguccccacaccuuccauguuugagcaaagcaucuguggauugcagaugaaaagaaacuucaccaaagagcacauuagucauggccucaacccagcugggagugauuugcauuugauaacagcuuuuuaacccccaggagccucuuaagaggugggucuugaaggaagucuucugagaggcuuuucuucugaggggagggucgaacagagaauuuuauuuagacuuuucucccaccagcauggacaugaguuaucaguauuguuuaugauuuuauagaggagauuuucacaagaggaacuuuuccugugccuuugccuaaugcauaguaacuauaagucacuuguuuauacagcuuuaauguguuaacuguuaaaauuuaaauauuaauauuuuaaauaagucucuauuuguauacgugcugacucaucggauucucacacucacuuagagauaagaugguuuucuaugcacacacucacauuagaagaauguagggauuuuuuccaucaauauucgggcaagagggcacuaggaggcucaucgaacacccacagggcucuacgucacacccacaagcucuaucucacacccacgggcucuauuucacacccaugagcucuaugucacacccacaagcucuaucucacacccacgugcucuaucucauacccacgugcucugucucacacccaugggcucugugucacacccacgggcucuaugucacacccaugggcucuaacucacacccacgugcucuaucucacaaccacagagcucuaucucacacccacgggcucugucucacacccacgagcucuaugucacacccacaugcucuaucucacaaccacaggcucuaucucacacccaugggcucuaucucacacccacgggcucuaugucacacccacaggcucuaugucacaaccacaggcucuaucucacacccacgggcucugucucacaccuacgggcucugucucacacccacgggcucuaucucacacccaugggucucuaucucacacccacgggcucuaugucacaaccagaggcucuaucucacacccaugggcucuaucucacauccacgggcucuaucucacauccucggucucuaucucauacccacagguucuaucucacacccauggacucugucucacacccaugggcucuaucucacacccacggacucuaucucacgcccaccggcucuaugucacacccaccggcucuaucucacacccacggggcucucacgcccagcacucuggcguccccuuuccuugacauccgccugcuccucuaccguagccagauuucuuuaggaaaaaaaugauucuuuaaaaaucuaaaauacuguaaauccuauugggaaauaacaguuauuaaaccucuucaucaggagccaccagauaucaacuuaggcugugcaucuuucugccagguggguccuuaugacccuauuagugacugucucgcacaacuggagauaccagugaacacgugauugaacucucagccucaaggacaggucagaaaaggagccucaggucaacaauguguucucgaccugcuugaauuugcaucugggaauccuccuguuaguagaaagguugacccuggacgcagucugggauugaaucugccucacuccuuuuucacucccuuucagaaacaaaugaaaggaaguguguaaaccacacagccaagcacccaacgcaucaucaucuucauaucaucguuauuauuagucuaaaauggugguggugaugauaaccccacucccuaggucucaguacccauacugagauuuuaugcucucccuuuuucugcuggauuucauuuuuucucuagaagcuugaugcuaugccuugauuauuacuuauuucaaugggacaaauuugcacuagaacuacaguauuuguuaucacugaauuuuucacgguugccauauauauauccagcaucauuuguguccuacugcuguugaacaacuacuuuaagaucagaaaauagaaguaguuuagccagucuaaaaggauuuccauucaucgaaucauaaauagagaaaaaaacaaucccuucuauccauuacuaaaccucuccauuccaaaugucuucaaacaaagcaauuaugguggacaaguauuugaggacaguuuuuucucauaaacagcugcauagugcuauagcauccuuguugauuagccaauuagaauaaauucuuuccacagcacauuuuaaaagacuuaggggaaaaaacaagacuugcaagacuugaaguuuucauagaacaaugugcacccgucuuccgcccacuuccccagagagaaauauaugaaucacauagcaguaaaugaguaaaguaucaaaacaggugcuggagacuagggagcaugaaucaucuucuuccuuagauacuuuguaaauaaaacaggauguauuuaugguaacucugugcguaaacuucuauuuacaaugaauuauauaaaauaaauacaaugucacacaaaguaaauaaaauugaagaaucuauuaaauaucacuuuaacaauuauauuaaauuguuuccuuaaauugauccaauuuugaaagaggaauuugaauaggagagaucaacaacaacaaaaauuccuccuguauucaaacuuuaaggaacgcuagcuaucuauuuuaaugagugaauaacuuauuucccaaaccacauuuuaagaaagucaaaaauaguugcaucacauuuuuccuauugaaaauauacacuuugaauaacagaaaaauaauccgcagauaauuuuuuaaagauuuuuacucagcuuagugguaauagauuucuguuuauauuaaccuuaagaaagaguguucagaauggaguuuggccauuucauuaugaguuauggauauuauuguauaaaacauguacacaaaauuccacugaugauuuuaucuaauuucaaccauaagauucugacagagaaucaacucaacuagcucuuuuaagcaucacuuuuaauguaccacauuuuuuaagugacucuuguuuauuuuuuuaauguuugcucaaacuuauggggauagugccauguucugcguauccacgcuaggauguggccuuuuugagccauggaagaugcugucagaacaggguccggaaaaaacaaauaggacacucguuauuuucuuguugauuugauuagccauauguaccauuuacaauacucuugggggacaaaaggaagagagggaaaaaacaauuguaucugaauauugcaagcuaaucuuuuauaaauuuuacccuuuaaggguugauggauucagaaauuaaucaacuguauuuuuaucugauaaaugcuaauacuguacugcagugcaguugugguuuugagaguuacauucauagguuuaugucagaucaagaauagauuuuguuggggggugauuuuuagauuguaggagguuuuauacacauaauaaaccaagaugcuaacaggaggaugcaaucagugguuauuuugugucagcccuuuucuuuuuuuuuuuuuuuuuuuuuuuuuuucugagacagucucgcucugucacccagguuugagugcaguggcacgaucucagcucacugcaaccucuaccucccggguucaagcgauucucgugccucagccuccugaguagcugggauuacaggcgcaugccaccacaccaaacuaauuauauuuuuaguagagaugaguuucagccuguuggcuaggcuggucucgaacgccuggucucaagcuaucugaccaccucggccucccgaaguguugacauuacaggcaugagccacugcgccuggcugugucagcccuuuucaagcugcagcaacacucacacugaugcacuuggccacugagaggugagccauuggcagaugauguacagaggauggaagaaggacugcugugcaggcgguaaauggcaucugccagacugcacagaugaagguuccuacccuguucacugccgcauacaggaaauaugaucaaaagagugguaguguguuuagacuuguggcucacucugugugagaaggaaaauuaaauaccaaagccaucuauaaaguagcaaaauugcccuaaaagcugcaaauuaggucguaaucauacaucaaugacagagaaguacauggaagaccuggaaggauauucuagaaauagcuaccaucuugaugguucaucucuucuuaauuacuuaagggaauuucgacaccuuauuaaaacagaggaaguccaaggugaacucuaaaacccuccuuaaguauccaauucuaugauucggugugaagcauuaucacacuugucccaagggaacuuaaccaguaauuucaacgcuucaguggggagucacacgucagauggacucuugcgggccaugcucucagguaguggcuugagucccccugcuccuccaacaaggccaccguccagcuauuaauauuacucccaauucccuggacuugcuauguccucuggcguguggagugccuggcugccgccuucauucucuaucugacugucuccugcucaugcucaaagcccacacccaaugucaccuucugggggacgcuggucccaaacaccugccuucccaagccaagucacagcugagcccuguguccuuagcacccuccaaagccacugucuucccucuccaucccccaguggacugcgagcuucuggaggaugcuccuucccuggcauagagcagacauguagcagcacuuagugaggaaggcugaggcaagcucugugguccaguuucccugcaaauagggguuuagaaggagcugagaaaagaggagaugaggguacacuguagggaagaagugauauucacaacugacagcaaggaacaaaaaaguuaaacagaggccgggcgcgguggcucacgccuguaauccuagcacuuugggaggcugaggcaggcggaucacgaggucaggagaucgagaccgucuuggcuaacacgguaaaacacugucuacuaaaaauagaaaaaauuagccaggcgcaguggcgggugccuguagucccagccacuugggaggcugaggcagaagaauggcgugaauccgggagguggagcuugcagugagccaagaucacaccacugcacuccagccugggcaacagagugagacuccgucugaaaaaaaaaaaaaguuaaacacaaaaaccacaguaugaacuaaaagggcuuagaaaucugaggcuguucccaugaagaaaauccucauccuggacuucugugucugcuaagggaggcacagugauuaugauaguuggagguuacaguguguggauagacugugguuacagugccuggauagaccguggcugcaguguguggauaggccgugguuacaguguguggauaggccgugguuacaguguguggauaggccgugguuacagugcguggauaggccgugguugcaguguguggauagaccguggcugcaguguguggauaggccgugguuacaguguguggauaggccguggcuacaguguguggauaggccguggcuacaguguguggauagaccguggcugcaguguguggauaggccgugguuacaguguguggauaggccgugguuacaguguguggauaggccgugguugcagugcguggauaggccgugguugcagugcguggauaggccgugguugcaguguguggauaggccgugguuacaguguguggauaggccgugguuacaguguguggauaggccgugguugcagcguguggaugggccgugguuacagcguguggauaggccgugguuacagcguguggaugggccgugguuacagcguguggaugggccguggucacagcguguggaugggccguggucacagcguguggaugggccguggucacagcguguggaugggccgugguuacaguguguggauagaccgugguuacguuuuguggauaaagcaugguuacaguguuuagauaaaccaugguuacagcauguggauaggccauggcuacagcauauggauagacugugguugcaguuauggguagaccgugguuacauugugugacuagauugucguugcaguugcggauacacugguuaaaguguguagaguguugagaaacgcuaaguagcuuucagccucccugacugcaccgagcaaccuuugguguaaaaaauccuccaagguuuucggacacaugcucaaguuacagaacaaaacaacugcaggauucacuuuguaagaagagagacucagguguguuucuuguguaagccacagugcuggaaaaguaggauggcuccuggggaucaccaaccccacuccaaucucagccaucauuucuagccaugcaauuggguguaucccuuaguaucuuugaucccuccuugucuguaaaaaauggaaaugaaaauacucauagguuuuauguggaguuuauaaggcaacuagugcaccauauggaguggagaagugcuauugcuauuauaauuguguaauaguauguaauacauugauauguaauauauuaauaugcaauuauaauaauaauagcauuguuauuauuucuccacuuuggcccacaaaccugaauucagccacuucuauguagagaguacucagauaaaaaagaaaagugagaugcuuacgcucuagaagaccaugaugugggacagagacggaagcaugggaucuucuacugauugugaaaggacgugcgaaacccaggcugcuggccauccccaugaagggcugcuagaagggucuacugaaaauggcccacaguugggugcuaaaugaggaaacauuauccagaaaacucacuuaaauggagcgacugaggccgggcacgguggcucauaccuguaaucccauuacuuugggaggccgaggcgggugaauuacgaggucaggaguucaagaccagccuggccaacauggugaaaccccgucucuacuaaaaauacaaaaaguuagcuggccgugguggcgggcgccuguuaucccagcuacucaggaggcuaaggcaagagaaucauuugaacccgggagguggagguugcagugagccgaaaucgcaccacugcacuccagcccaggagacagaguuagacuccaucucaaauaaguaauaauaauaaaaaaaaggagcgacugauacccacauauaccaggugcauuagcacaaucacuauuuccaaaggcuggaaggaaauagccuugccgagggccagacccugagcugcuggaggccuugagaauggcaucucacguccccacggagagaauugugaugcccggacaucacgggcgcuuccauguggguguuuccguggccagagggauucugaaauguguagggacaaggacccauuccagggaagccaagugucggccgcauucaccacccguccccugcagucucacaccugcccgaggaggcagcccagcagucgggggccccgagcuggggaggaacgcaggcggcugcagccccgagggagcccugcgcuuguuucuaagaauagguggcuuccgggaucuggaguucgguuuuucuaaauacaccucagcccggagacucggaggcaggcaauggggccaaguaggcagccuugggagugacaucacgguuuccucuuuuaaggcgauucugaggcuuccuucuccccaggccccucccgcccagcugcugcagcugcucagagccaccucggccuccaccucugcggagcucugaccugcccuggcuuggcugugccuggguuugggacaguucgguguguguuaaagaagcagagcuuuaacugcguugaggguguguuuucccuccugccugcucuucuuaccugcaguccaaacacgugugccucgguuguuucuaaagcuuccccguggacugcaugacugaaaauggacuaaaugaugauuauguuaagaagacuugacagugccaccuuuagagggaaacgccaaaaguggcccagaaggcugagggacaggggccuauguaagcuucacgggaacagaauuccuaagcuguaagguaacauuucuaugcaauaugaaaccugagaacaaggcuuaauaacagccccuccaggacggcggcaagcgagcccucaagcgcagucugcauuuccccagccgcagccaggcagcugccggcaccuugggaggcacugggagcacgcuggugacuucucuuggccaguaggugugggcguggcucggugcuccagacacuacuugaaaagggaagguuucugggacuccuggcaccgcggccucuccucugcccaaauuucaagauuuauuuuuacucguugaacgaaaaagagaaugagcccuguacucugucaugcuccaaacugcugccccauuuuuagaccacagagcaagaugaaugcuguuggaaggaauguguuuaugagagagacaguuuuuaauccaucagagagcaauacuugcgacuuuaaauauggcauauggugaaaaagugucccugugaugagucagcaaaaaaaauuauuucaccccucacauauacgaggguuugauuagcucacugauugcaguuuuacuagugugcagcacagacucaaauuuaaauauagcuugagggaaaacucugacaucagaauuugugcaugauaaacuguguugcucaaacuucaaaggucuggucuccacugcuuccgggaccucccccugccucccaggggacagauuccucgugugaucccacaggccagcugcuucaaagcugugucuuuccuugggccccuucugacccauuggcuccccugucuccacuccucacggucugcccucacccucugugaucauggcuguggcccugcgaucuccauccugucuccuugugacagauuuuccaccucacccuuucuuuaagcagcugacacucagacccauccuuccuuugugucugaugucuuugguuggguuuauaaaggcaagacacuucucccaacccaugcaggacguccucacagaucagcuucuucaaggagaccuagcccagcccgugaaugagugguggcagcgcuggcagcaugagaacaggaguugaaaccugcucucaccccggccaaagaucacaucgcuucccuuuccuauaaaguagugcaucauguggaggacauuucgugucuguaaaguaccaucacccuuuucuauaaaguagugcaucauguggaggacauuucguaucuguaaagcaccaucacccuucucccuaaucugugcauguguguaucuguagaagugugcgugugcgagaauccacccuucaugauuuaauugaaaucacagagcagugaucagcagcagcgaagaugacccucacagcuggggagcccaugcuugauguggucagcauugccucccugcaggagggcccggcucagggaguccuucucagaccccucugucuucccuauggucuauuaaucuccccaugcaagggaagaugauggacaucaaaucgacuguaggcugugcuccucugugcacucucacgagcacuaacaccucccagcaugauucuccaggacugcggcuccaagaggaaagcuggccccagaagcaggcugcuguucagggccuccuugccugguccaguccuugcuuaggugaacuccagcugaccaagauaagcauucacugcauuugguuuaagcagccuuucguguuuauuguguuagugggugcuuuucuuucuaaagcaaaaaaaaaaaaaguuuaaaaauuuuuaaaacuacccuacuucuuuuaugacuuuuacucccuucucaaaaauaucaguguuuccuaaguucgauaauagcauuugaccaaguauaguacacacuugaugaaauuaacucaguuuuauuaaaugccuauuuuauuggcaugggaugauuuaagaugaagacucucaguguuaacggccucaauucauuuauucaaaaagcauguauugagccugcucugggugccagcuacuaugcuaggugcaaggauguaaauauucguaagacacaaucaccccacucaggauuuuuugcugucuacuuuuauuguccugugaagaggaaaguuuggagagacccacuccccuccaaaguggguuucuaggucaugucccaucacaggaggaccagggcucuugagcucguugggaauuccaggaagacuuccauggaagguggcuggagucucugucuccacagauucccaaaggucacgcagugacccugcacagggagccuugaaaccuuugcaguuggagccagagggacuccacacaccuucuagcccagcgcugggagucugugggugggaccccgaguggugauguguugcacucaacgccaugccaugggugaggagcagaaccugguccacacucacucugguaaacugacaccccauuaaaccauguuuuaaaacuuguguauugggaacuucacugaacucagcaguaguuauuccauagggcagcuggaaaccauucuuuagggacuggaaaguccauucucaugcccuuugacuuccuugauguuaauucuaaaugacacauucucaggauguuuuccccagaggaauccuauauggcagggcuguguacaggccugagaagcgacagggcagccugcgguuacacuugacugaguaauccgcuuguuuagggcuguggccgaugagucccuguucccaugguauccuaaacguuugcaguuauuaccaaaucugaauucaacccucaucuuuuauauugaaauuccuuuuuuaaaaagacauaugucaaguggaagcuauuucauuuguaucugacacuaucuuuucaaacuguuuauccaaucauuugggucccaagugaauuacgaauucaucaacuuaaggaagaaacuuggagguuaagacuucuuuuuacgauacucccucauucaugaaaaaaugcguuuauuuuuaguagugcuuuggauucuguguuuuguuuguucuuugguuuuguuucuagaagagucuuguuggaagcucuguuuccagaaugcuggauuggcuguggugggguccauaacccacugccuguaucaaacucauacuucaagaaaauauuaaauaguugcaguaucuacagggccucuacagagccccuucugcuauuagcagggaugugacuuuaggucacaaaagaacuagaagcaaaauggugacuaucagaaaaccuuacccaauaggaguagccagacuuggucauuugugaggaguccggcagccgggguuccagcaucucuguugcuucccugcuguugccaguguaaauguuuuaucauagucaggaucuguugaguuaaaagaauauccagagauauaacaaugcauucuuugucugagucauuaagaauguuuaugaagaagaaauugaguagugaaaagcacagauucagagcccggcagaucuuccucugaaaauuggcucuaccgcuuacuagcgcgaugcccuugaguaauucucuaaucucuguaagccucaguguuuaguucugcaaaacagaagagcaacaccuuucuuucagggucgucauugggauucgagguagacaaaguaaucuuuaguaucuagucacaugaucauugguccccaggugcucgcuaaaaggcagccuccacccguccugagagugaaccacugcauucuucaguguucccggcuggcagguguggacugcugguucucuucaguuugcucugaaaaucucacuuugcuuugcccuugcuggauauuuacccagguuucuugggcucuuucugcccccacgugucuugcacaucccagcaggugucuccucuggggccuucucuccucuuggccccacacauucuguuugcucccaggguggauuuggaggggagugguaacaaagacccaaguuuucaacaacaaauggcaggaggugaagaacuucaaauuugagauucuaggaaaaaagaggaguuugaaagaaauacugaaauacugaaagucacgguugaauauggugagaacuuaagaguaaaauaaagaaucaucaagaaaacaagucagucagucaacaacuugacugauuuaaaagaaccaauaugaagagucuaaagaacugauuuauucuugcauucacguuccaaagcaauuuaaguaaacucaaagaaugaugcuauaguugaaacguaaauggaggaggacuggguauuuaucuccaagaugcagggagaaagguggguuuugaagaggaggaagccaggacagaauacccgaagucugcaggaaccaggagcugggacccucgagggcagugggaggagagacggucacagcagugcugugaguccgcggggcucuuccggccccucugccuguguguccacucaguaugugaaaaaugccugugaauuguucacccaaaaauguauugugcagcagcagauguccccuaccccaugcagaaaaaaagaccauauuaguacaacgccugucucauuccuguuuccucaggggaugccugagaaucccuugcuuuaaaauccucucccgacccuuaucuaacuguggucaagaauaauuguuggccauuuccugcucuggaaaccaucuggucugcuguggugcccucuauccucccuccucuuuaacuauaaauuaaguccuaaaagaaagaaguagaagaacugagacaauuuaggaccaagaaaguaaaguuaagaaauaauuguauuaagucuguaaguuuagaaagggcugauagccauggggcaggugguugauuuucauccucaccauguagagaauaagaagggaaaaacuuacauggaggauucugacuagccuggagcgagaacucacagugauucagcaaauauccacacgaacagcugcgaaguauuguugaucucccccuggugucgcccaccugggaggauuggcccacgguggugcugaaggcaacaguauggagguuggcuucaaaucccuucuggcaguguaaauucaugagaaaugcugaauacaguucaucucaugugcuuuucuuuuguaagguaaaauugagcucuuucuuuucucuaacaagcucauuuuaaaggcuauuuaagggaaacauaaaauuaaaauauaaaacugaaccuuucgcuggcucaauuucuuaaugcuaaauugcucucccauccaagaauaauuucaaaaguuuggaauuuauaaauggcaauacuuggauguggaaauuauguuaggacuccuauuuuuaugaauacaauccaguauaauguaaggcuauauaaaaugaaauauuucuguugaaauguauuucaauucuuugucugaguagugaggauuuuauuauuggauuuuaguuacucaaguuucagcuauauuuagugcugaaauucuaggccauuuuaagagaaucccacuauaaagagggaaaaaaaaaaaaggccaggcccgguggcucacaccuguaaucccaccauuuuuggaggccaagguggauggaucacuugaggucaggaguucgagaccaaccuggccaacauggugaaaccccaacucuacuaaaaauauaaaaaauagacgggcgugguggcacacaccuauaaucccggcuacucaggaggcggaagcaagagaaucacuugaaucugggaggcagagguuacagggagccgagaucgcaccacugcacuccagccugggcaagggagugagaugcugucaaaaaaaaaauucuuuuuuacaugacucagauacaaugagggucaaaguaucuuugcccaaaacauuacuguaggacucauaguaaaaaccuuccagcagaaugagguguuggccauacccccugccacuauaugaugacuuucuccaccauaucugugugcugaagagucagaugggacaguagaagcaugagagaaaauccaugcuggaaccaccugugcuugacuuuguaaaaaauuuuucucacaggucuuuagguuaaggaucuuuuaacucccuugauaauuuggcaaauagguauuuuauaaucguaaaacaagagaaaacauugauguagugcuuacuuucugccagacacuguuuugcucugugugugcgugugugugucuguguguaauuaacucacuuauuacuauuuucccccuuuaacaugaggagcagagaggcucaguaguuugccacuuguccacuguuucuaaccugguuaggcuggucagcauuugaacauggaggauaggacagucacaugacauucgcacaaguagagagaggaacguugacuucugagucacaggucuucuccugguagcgccaucauaccuuggggauguuucacagccacaaauccaaacaugcgucccagacugcaugacccguaccccaguuguguugaccuauguucauuuccuaacucgugcaauuacacaaggauggucuuggugcacacgaccucucgguccauuuucuggccaauauucaguuccuuguucucgccuugccauuugccacgcuucagucagucuuguuucccacacugcugcuggagaggugggcuccuccgcgggugggccgaugaauuacuugccuuugccuuugcuagagugagaugcauuccaucauguaauacaucaaaacauacaccagaguucuggcccaucuggugcucuuugcucagauccccuggccacucccuaauuuucuccacucccacaacuugcugacauagauuugauuuucaauucagaacaaauucaaaacaaguaaaaaagaucugauggaauuagcagacacaugucaaauuauccacagcuucuugcuggagacacauggaaagauagggugcagcacgucuccggggacccagagcuggagaacuccuagcagccuccauuuucuacaaagccacggguccuccacaggguuggcccuagugcccagaggucaacaguggagaccugucuccuccugggaggacuggaucucauaucaaugcguaagaugauaauuagguauugccagcauuccccuuacaaauccuucaggcagggcaacuuuggagcacagugguugugucuuaggagguccagcaaagccaguucccuucaacauuagaacaagucacucuuccuucuacggagcacugccugggaagugacugccacugccauguugugugacagaggacagucuuuaaagggguuucauucauuguggacagauacuauaugaaggcacauaagggauuuccugauggggaggauggcaggggaggugucccacgaucucagugcuuguucauccugucugugucucucucuccacucccugccccacuccucauguugcaaaguuaaaugagaacgugacacauuuuuccugugauuuucauuuuacauuuuuagauguggucauuauauucaacuggauauaacauuuuguuucuaauugaaaacuuuuuccccaaaaguuuuugugcuuuugaagcaaaugcgaaaguccauuucuggcagggcgcaguggcucaugccuguaaucccaacacuuuaggaggccgaggagggcggguaacuugaggucaggaguucgagaccagccuggccaauaugacgaaacuccgucucugcuaaaaauauaaaaauuagccagguuugguggcgcaugccuguaaucccagcuacucggaaguuugaggcacaagaauugcuugaacucaggaggcggagguugcagugagccaagaucgcgccacagcacuuuagucugggcaacggagcaagauucugucucaaaauaaaaguccauuucuaauuccauuugagggauauggaauaaaguacauaaaaaguaacgagucaaaagaaagaaaagguuuuagugaaaaugaauguacucuucucccccuucuauuguuuguaauagacuuaaucuuuaaagcaguucuggauuuacaaaaacaaaaaaauuauucagaguguacccauauccccucccgcuaccucucaccccuaguuccuccgauuauuaacaucuuguauuagcgugcugcauuuguuacaacugauaccaguguuggccuuccauuauucuuuuaaaugugaaucugacucuggggauuugugugacugaaucucgcagauugagaacgauuuuuaacaaccagccaugcuuguaaaaacauguggaaguuucucugacucugaaauaagagggacaagaugguucccaugcaggcuugcguuggaaaugggggagcgugcacagucuaacuccaugccccguguuuuucuugaguagcccucuggguugaaucacccuggacuucagcugaggcagggggauuguuuuaugcucaagaaagcuccaggagugguagaaucuggccaucaagauguucugugaaauggggcucuugucuuuucuggagaacaugccuucuuggcccuuugaucaugagacaucucaccacgcccuccuuuaacauugcuaaugauggggacugaccaccccgucauuaaaccccauggcagucuaagauuaagccauucagaaucuuacuagaaaugacuaagcggaccguuuuuucuugugaggagagaauuaaaggcguuuccaaucccuaaugauaaaaccagcaucaaauuguagagaauugcaauuucuuucuuacaaacagcaaauuuuugucuccuuucauuuuuuaaacuguugaacgugucagaugguaugcauagagagauuucagaggucuagucaaugugcaaauguuuugugguuuuauuuugaguuugaagucagagcacugaauuccacaaggcuugagccucacucucccuccugagcacccaggcuucacggacaugacuaauaggaguuuauucacagccugcuaccauccuuggucauaacguugcucaaggcccgagcaggccugccaagaccacaguguagcccuguuaauaucacaugaccgucggagaguuuuuggaaaaccuccucuggccgacuguuuauccgcccccauugauauuugucugaagauaaguuauacagucuguuuacuuacaaaugcgucagaacagucuuggacuucugcacggagguucugccaaauacaagucuaacagggaagugguuugggcagccccggaaccgaagaaccccucagagcaucacaagccaucacucugggucccugucauuuaaauagggauucaggcuucagguugucaguauuuauaggcuugauuggagggaaguaagccguaugagcacuuuuuaaaugaauuuuuauuucucauuuccacuuagugauggaugcacauuuuuccacuaauaaacauuugaacuuuuuucaguuuuuaagaacaucguagguggcauauuucacaaucuuggcaaggcagacguuuuuggaguaaaucgaaacuggaggccagaaguacuggcucugaacugaacuaccacuugcaaaucgauguagcagaaggaauaauggaucauguggaccacgcagaaagcgaucugagacgggcgugucagccgcauguggaugaauaguccuuugugggcaggaaggagagggaguggguggguaugagggcaggagaaagaaucagcucuguguuugggggcugugagaggacacucagaagaaggcuuuuacaccauauuuuauauucacaaguuuauuuauguuauuuugaguccaacagaaagagucacaaacguuaaacuuuagcaacccccuaaugauuggaaaagaugggcaaauccuugcuuuaagagcagcuguaucguauggagaagaagucaucucugcugggaaaacucgcgaacagaugcaggcuaaagcgaaagaucaacucuccacaccauuacauuuugaagggcuuugaaguuauuuuuagaaaaacucaaaaaucuaaaucaaaaaucagauuuuuucuuuuuuuuuuuccuacugcuuccuuuuccuuuuucuucuucucuugucccuucuccuuuuugguuguuucuauugcuauuuuuacauguuccuuuagguggggggaagauaaggugugaaauguauucaagugcaacuuuuucaaaauaauaaaauacauguuuauuaugaggaaaacucaacugccuauagaaaugacaacgguaaauguaaauaagcaaaagaucagagauauaaguguauagccaucacuuccuuuagcaaucaaauaaugagcugggcgcaguggcucacacuuguaauuccaacacuuugggaggccaagguggguggaucaguugaggucgggaguucaagaccagcccggucaacauggugaaaccccgacucuacuaaaaacacaaaugguguuuuuaguguuuuguuuuuaguuuagugguuuuagauuuuagugguggcaaaugccuauaaucacagcuacuugggaggcugaagcaggagaaucgcuugaacccaggagguggagguugcagugagccgagaccgugucacugcccuccagucuaggugacagagugagacucugucaaaaaagaaagaaagaaaaagaaagaaagaaagggaaagaaaggaagaaagaaucaaauaacaaaaagcacagucagcauuauaagauaucagacauacccagcccagaggcaggguggaguuggagaucaucuaguccaucaaccaaaucaauuuagguugauuuuuuuuuaacaauuuuuuuuuuuagccaagucaaaaaaaguauuuuuagccuuacuuauauauaacuguaucuuuuuuggcucacuuagaccauuuuaucaaaggagaucaaccacaaauuccugccgguuuuuaguuguaagaagcuuuuuuuauuggcaggaaaacugggagaauguguaaguuguuaagcagccaggccacucugugcccaguauucugguaacuauugugaaggauguuuaagaagcaggucaaaggaaugaaagggcauuggggagaaaggugaagaaaauuuauugaacaccuaucacauuuuucccucacuagcuacuuaacucacacauccgcacaggagcccaagguuaaaccacuugucuagaucaccaaggagagcaaagauaaaaucuuguuccucccguaagcccucagagccugugaugucagacaccuuguugagagauaacauucacaaaacaaccagagaaccuugauggccaucauauauuagugacauauucaugcuggcauguggggcauaagugagcucccguauugacuuggucugagaaugaagaagucuagcuuuacccauaaugggcuuuaaagcagcucuuugaguuugguuggccccagaccuaaagucuugcaucucugaaccacuuuaccuauuuucuuucccacagaggacaaaaauaaauguguggaacugagccuagguccugugaaaccuuuuauucuccagaugcauagcauucccuuggugacacaauccaguuuugugaaauauaugaaaauauuggaacuuuucaaaaauugucuaaauuuggggggaugugccaugagaauguuuaaaaugcaaauucccacacaguucaucuaauugauuuuaaucugauuaugccugcccugcaggaucuuccuggcaggaauaugauaggccaccugcuucuuuuaggggaaaacauucuguuuugaggguaagagaagauuugagugagguuugcuuuggucauggcuucugaagcuugauaauugcagaaguuccaucuguaagaugcucgauuaaaauucuagaugaauugaguaaucuccacaaggccaagagaaucuaauguucuugaauuuguuccauauucacgauagaucuaguaaccauguguaguaaucagacaaauucuccaaaacauacagccagcuggauuccugaacuuuaacaaaguuuuuaugcugacugcuucugcaaccucacuaacuagccagccuagauaggaaacucccuucuuaauucauucauaaaguaccuuuugauauauagacccaaucucuaauaaaccuuuuggagaucaauuugcauaugugauaaaagugaaaaaguuggucuucagauaccuacuacagaaaaaaaagugaaaaaguucuuaagcagaugagaaauuuaaauaagauuuuaaguauuuucugaacauuaauucaccucuugacuuuugaaacuuuggucagacggaaauguucauuccuucucccugaaagaguugaugguuagauuucauaacacagaagcuaguaaagcaaaugcaguaagaaaaguagccucccauagguauucaaacacguauucaaaauuaagacagcagaaagucuaaauguuuaaaauaugcuucauuaacuucugauuccuugaaucuauccccauuuauuaauguuuauauagagaaccaaaaaaacagaaaaauuacuaugaugacuauuaauuacaucauuuuccaaaagggggaaaaauauuguaaucaaugaaaccugaauauacuuuuauaauugauaagauuaaaaaaguuguaauuccacuucaguaacuaaaagaguuauucagaagauaaagcauuuauaaugauggaccuagauuucugcuuccuauagagauuuccugcccacguacacauauucugguuacacaggaaggcucaugaguugacuacuuuggccagccuucuauuuuguaaguauuggcagagagauacuuaagaaaaaaaaugauuucauaaguaaacuuauaauuaagagaaugaagaagaagauguagcucuuggggcuuccauugccuccuaacagaaaacaucugcuggacuuccggaauuuuccuaagaccuugagaacacacccacgcauuuccaacuuuuuuccuaaccagugaguuggcuucagcaguuuucaguuuuauagcugacugucccauccaaacaguuguucagcuuugcccuuuaucauaaauucauucccauuuguuuauugcauaguauugguuaccuucuguuaauugggagguggggaggaggaccagagaacaagcucauagguacaaaccuugucaaaacuaaaaccuguuuuguagaugaggauugguuccuuguauuguuagcauugccuuugcucaagagaaucaauccaacucauuuuaguaccaucuguaucuuucaaaaugaagaagaguaguuaaaacaauaugaaguauggcaugugucaaacuccacaaagguguuuuccauauaaacuugagaaaaccuaauuaaguggguuuugaagagacaauggagcucuguuuauauguuugccuacccaggggaacuaaaacaaacaaaacuuacuuuuaaaaagcuucuucaaaguucucauuuuguuuuagaagaacuuucagcuucauugcuuucuaaguagcuugauaucauuagaaacugauaaugcucagcacagucagcgcaagauaaguuaaccagcuuacauccaccuauauguuuagggguucucuuggucuaaaacgucuugaaaaccaaauuucugugaaucaguuacugucuuaguccacuugggcuauuauaacaaaaauaccuuaggcuggauaauuuauaaaugacagaaauuuauuucucacuguucuagaggcugguaaguccaagaucaaaguacuaguagauuuggugucugaugagauccaggauucauagauggugcccugcugcuguguccucacgcagcagaaaggacagaugcucccuccuuuauaagggcacuaaucccacucaugaggacaucacucuaaugaccuaaucacuucccaaaggcaccaccucucaauaccagcagauuggggauuagauuucagcuuaugaauuuuggagggacacauucaguccguaacauuucaccccuaaccucccaaaauuuauauccuucucacaugcaaaauacauucauuccauucuaauagcccccaaaagucuuaacucuuuccaaaaucaaccuaaaaagucuaaaguccacagucucaucuaaauaucaucuaaaucaagugagaguccagguaugauugauccugaggcacauuucucucccaguaugagccuaugaaaucaaauaaauugugugcuuccaaaauacaauggugggacaggcauaagacagacauuucuauucuaaaagggagaaacaggaaagacuaaaggaguaagugaugccaggugaguccaaaacccaacagggcaaagaacauucgauuuuaagucuugagagucaucucugacuccauauccgccuucuggacacacugggguggggauugguuccuugagucucggggcagccccgccucccauggcuucacugggcacagccuucauugcagcucuccaggcugggcaaacuggucacuccacuguucugggugcugggggcagccccacucccacaccuccccaccuagaagaaaccuacacugccaugaacagaauauuauucaugguguucugacagacugaggcuuuuucugcaacucucuucuucuuaugagcccucaccuuacggagugaggagccccucucccacaacacugcccuuguggggccucuguuguuggcccugcuccugugucaggucugugccuggucacagaaguucuccagggcaucccuuggaagcuggguggagguggccacauucucacagcucuugcacucugugugccugcagaguuggcaccacguggaggucacgaaggcuuccugcuuguguccuccagagagaccaucugagcuacaccuggacccacuggagccacagcuggggcagccgaggagcacugcauccgauugcagggagcagagacuugaaauuguucuggccccaggguccuggcauucugggccuaagauggguggggcagccccaaagauugccuccggagguccuuccucaguugucuugauuagcagcaucuggcuucccucuaccauacucaucucuuuaucaaauguuugcuuggcuacaaucucgauguucucugcugaacauguuuucuacucuucuacuaccuggacagucuaagaauuuucuaaaucuuucaguucugcucucuguuucuugauaaauuccaucuuuaauuuguuucucucuguuuacacuuuacuauaggcagucaagaaaagucaugccacaccuucacuuugcuuagauauuucuucugccaaauauccuauuuuauggcucagaagucuaccuuccacaaaacacaaguagaugagcaugauucagccaaauucuuugcugcuuugugacaaggauggccuucccuuuaguuucaauaacaugcuucucauuucugucugagaccucaucagaauggccuuuccuguacacauuucuaccaacauucugaucaugaccacuuagggaaucucuaagaugguugaggcuuucucuacagccccccucuucuuaugagcccucgucagaaucacccuuaagguucuguucauggccauguagguuuuuuucuagcaugcaccuccagauucuuucagacccuacccauuacccaguucuaaagcuaauuuuacauuuuuaaguauuuguuaccccagcaucccacuuuuaauaccaguuucugucucaguccauucguaguccaugcuauaacaaaaauaccuuaagaguaggugauuuauguacaacagaauguuauugcucauaguucugcaggcugggaaguugaagagcaagugaccagcagauguggugucugguaagagcucucugcuucauagacagugccuugcugcuaugucuucacaugacggaagggacaacaggcuccccugggccucuuugagagaugcacuaauuccacucaccagggcuguacccccaggaccuacucaccuuccagaguccccaccucuuaaugccaacacacuggggaucagauuucuacucaugaauuuuggagggacacagacauucagaccauaacaguuacugcucaaaacaaagaaguaaaagcuagcaaauaauauaaguaugauguauuuagauuuauuuuaguauugcucauugccuuuuuaagguaaacuuucugggucaauugagcuguuuagaugccgacucauauuugaagguucugcuacuccucuacaauaccagacuuauaaaaaucaauauauugcaaucauucauauacucagcgaacaugcugacaccuacugcgugaaggguucugugauaugggcagggggugcagacuuguaucaggcagcuacucucucagaauucacugccuggcagggggaggccaggaggcuguccccagcuaagacacaaggcauggcuugugcuaggccaacagggaggugccgggaguguaauacaacaaggaggagccgccaaggcucacaggaggguccccauauggacccaccauugcugaguguguguaagaagaagagcaggaccagggaggugggucugagaaacaguacugauuaagaaggaguccaggaaggaaucccugaaaagaaaaugaagaccaaguggauagagagacaggaaaggagccacagacaguucucccagagaaagaggagguuaggaggagggagugguccacaggaccuagcgccucugggagacaaggguagaaaccacaccauuucuaaaaugaguuggggcugggcacgguggcucaugccuguaaugccagcacuuugggaggcugaagcagguggaucacuugagcucaggagcucaagaccagccuaaguaagcaacauaauccaaaaaaauuagccaggcaugauggugcaugccuguagucucagcuacucagaaaguugagaagugaggauugcuuuagccuaggagguugaggcugcagugaguugugaucaugccacugcguuccagccugggugacagagucagacacugucucaaaauuaaacaaagaaauaaauaaaauuuaaaaacguuaggaagagaggaagaagagggugguaccuggagggagaucugggcuacagagaaacguuuuagaaaauccauguaaaauccaaaugcagcagauuauuucagaggucaccagggugaauuauggcugggaaauggacuaacacaaaaaagaugcugguguauauuguggagguucgggaagggugggacucaugauguguucaacaaggcuguauggaagccuggguugagucugugucccaggaaaggcccacuagugggucccggugugggacccacccccggcccccaccccuuccugccccuucuggcuuucugcuccacucccagacccgucuucuccaucacccgacguuuuccuagaagggcauaaaacuuacaccaugaggggaccuccacguuagacagggggagaagcuggaggacaugaauggccccgcagucagggcccagucaccugaucucagcucuguggaggugaauguguuugaguugcccuuuuugugaagacgugguagcugcaggcauggacaacuuacacauugagcaauuuauauacuauuugaagccaccucacuuuuucccuugguuuuugguuucugggguuuucuaagaggggagagugacucaugucuuucccacuaguagguggccuugguuuuaaugcugcucaauggauucuaagagagcaucccaggaaccugcugguaucagcccagcacauuuuuggggucucugggaaugagcuugggaaggugagugaagaacaacugaaaacaaugaagcgcauuuguggcuggaggucauguucugaugaaucccgaucgggggaagccauggcugcucuugcagugaucaagugucugccgccuggauucuuuccuggcaugucagauuugcagcuuccgagaaagugcuacugucuugcaugacaaaguaauauuuggcucaaagaaaacacugccaaacugagcagccaguaaauucuaugacagcauucaccauaauucccaaauguaaaccagauaguaaagugucguucauaaccagcggacugucagaaaucagagaaaugugggaguggccugcagaagcugaucugcugccccuacggacacugauggcuuccuucaucgaugcagacuggggagaagugggcgagguguaggccccaagcagucccaggcugagagcccggcacaggacuggaaauacucaucaggguucacaggcugucuggucuuaaggaagugacagcauaagcaggagcaugucaguaaauucacagcaagacccugcaugcaauucuauuugcaaauggacccucucacucuugcaugacuggcuccaauagaagcaaaacucagguccauccuagagcacaucccaggagaaguuucucuaugggggaugagcuucaaaaguaauuguaauuuaauuagaaauuuagaugugaguaccugguuuuuuuagugggacucuuuuuuuuuucuugguaauuuauacauuagccgagacgcuuuuccuacuacacugccagaaguuaacuucuaauagaguucauacauuuuguucucucucauguuuuuucuccgucaccuauucuucacaccuuuuaaauuuaagaagcauguauguauacaucugugcguguguguauauguauccuuggcagcaguccucauuccuuuggugauuacuaaacauuugaggacugguaaacugugaggaauugaaccuugcuggcugaaagguagaggaccagagucugccuuguuccccuuaugccuucaggggcccggcagggucuccugcuccuggggcucauccugcaagaggcggcugguauccaagcagcccaccccgaucgccuccucagggaagagggcagggcaguuaggaggcaaugcuucuccauggugcugggaaucucugugauauaaacccggugggauggaggagauuauuucaaauaauugauauuuacuugcauugaccaugaaaccaacccuucacgagcacccucucuggcccagggcagcacugcgccccucgggugggaaagccggugugggagaguccaacccugcaggaaacggcuuggagaagcucccgccugggacacugaagaagugagcgaggaggaaugaugcgucaguucaguucaccaggagaaacguggaaaggccaguguagcgaggagagcgucacacaguuguggagaugucagcagacacagugagggaccauggaugcggggcuccagccaccagagugcaggguagagaggagcugcaccuagaaagccguggcacacgcagcaccaggaggccugggcaucacauccaccgacccgaguuucacucugcagggagcagaggggccuucacguuuuuacauuagaaaggagucggagaacacguuggauuucagaauuugaaugaaggcagcuaagagaggagaugcaugagggugcagugggauggggugcacagaggcaguuccagaguuaaugcaagcaagcaaggaggaaguccgauccaggaaggaggugcugggaaugcagaggaaacggcagacuccggagaugcuuggcggaaagcccaguggaaucagugcccucccagugcagugugaggacgggggacagcagugucucccccauuucagguucugaagccuggcuugugggccuugcaauucaccgaguuaaggagcagagaaggaaagggggguuguuucuguuuuuuggaguuuugcugggagcaagguuggaggaaaugagguaagaaguucaacuugaagccugcugaguuuaaaguaucucuagacccucuagacagaggcguccaggagggagguaggagccauccaccucugagcguucacugaagccguuuggugugaaugaaguaucccaccucaugaguuuggaggggaagagagcagcaaaacuccaauguugagcagaacaggaaucaggaaggggccagaggagugaggggaaacgcaggcggguccguggccaccagaagagcccauuccaggagggagggggcagcugugcuggggccacaaggguccccagggcggggaggggcccucacagcuggggauaguggcauugcaggcccuugaagaagagugucaggccagaaaccagcucaccaugguucaaggugugaaugggggacaggaaguggcuuuggaauguguccagguucuuuuugaauagagaaaaauuuccuccaugaccaugcuuccugaaaagagaaugaacccacacucugggaugugaggccaggagaguuggcuucaccgucggcuggccguccccaaguccugccccuucucccgcuccugucugaugugagagguguugccacugcaguguauccaaaguuccagacaugcagagccgcccucuggccaucgucggggucauggauccuuuaggagugaggaagcgggaugcgcugguguggaaggccuuucauauggucgggcguggacacagagagaaagcgccaaacauccuugcggcauugcuccugccugguggaacagcacauucacagugagacaaacacaggucauaaugagagcagaagaccacaacagccacaugacacgcguacacacacacgcacacauauauauacacacacacaugcacacacacauacacgcacacauauacacacauacacgcacauauacacauggacacgcgcacacguuuacacacaugcagauauacacaugcacacacacguacacacgcacacauauauacacggacacauacacauaacgcacauauacacacacaugcacacacgcacacauacacacacacauacacauggacacgcgcacacguuuacacacaugcagauauacacaugcacacacacguacacacaugcacauauauacacacggacacauacacauaacacacauauacacaugcacaugcacacacgcacacauguacacacaugcacauauacacauguacacacauacacgcacauauacacaugcacacauauacacacauucuugcacaaaaaucucacaagaacaucacgggugaagcuuucuaggaauaaucuuacuaauauuacgaagcugaccacccaggcugugacggguaaaucgcaauauggauauuccaaccgcaaagaaagcaagaauguaccgugaucagcgcagacccaccccgggucucuaguuucccucucccaguaaugcuccuuguuccuaaugaaccgcgugcaucuuuggugucugcgcugcugccgcuacaccuuugugaacaccaaaugcgcaggaagcguaucgggagcagcacggcugcacucaguuguugccuucuauuucguggaugaaaacugcuauugauuucucuuuuaacaagugcuguugggaagaaccaguguucuggaggcuguuuucgcccaugucaugagaacagggcgccagcugagucacuucucuggaauggacuuuaaugucacuugguuuccucucacccaggacccgggcuucaugucuggacaaaugagccaugcauuaucuuuccaccagacuaaagaaagaucaguuucuugugguuuguuguucuuuuuuuaauugcggauguguguucagcauucgcccaaauaaucauuccaaaccggggagucuugggggagugcaggauguccagauagcaccagcccuuuguuaacuggagagacgacagacaauaaccccggcguggugaaacccggcccacacgucccgcccgccccagagccaaugcuagggccaucagguggcccugguagccagugguuccaggaccagcaucagacacucgguguuacuguggacaguagcuuuguacaaguuccuagcgaggugauuuccaaaauauuagauaccuuuaaagacagagaugaggaagacugaauugggaucuggcuuuuacuguccgccauuuaaccuuccucacaccaagcuucaaggcaacagggagcgugagacauccgugagcaagaagccaggcugcucagccacucgugggccacguccccuguccccucgcagggcuugcaguuaucacacucaaaguuagcccagguuguucucuaggcguuguugccaagcucauaauuccacauguucacggucaaauguauguuuagauaccuuaaguugcugcuaacauccugaggguagcuucuggcuguaaacaaacauaauucugaucacugugagacucauucuguucuuggacagccccuugggguucagugacauggacuccaaguucaccaucugauguaugggcuucugccacuggugcugucaucuggcaccuuccuaaaaccuucccauucguacaugacccccagcaccuguucuuuuucucccguagcuuuccuuuucuucuuggcgucaaauucgaagccacuuucauacccuuuuguuuucuucacgacaaaauauguuacugauguuacuguuauaucagcuugguuuguucagaaaucaaaacagugacaucuuucuuccaucugguggaaagaucaucagaacccagcuaggugguaucagugaauauuuccauuucccaaauaaagaaacugaggcucagggaagggcagugacuugccuguggucauagaacuggcagagcugggauucaaccccgguagcacuucaaaucugguacucuuccuucuugacugcacggggcuccaaaucacgugaaucuguguuuaacugaucaguguuaaaucacuucgguuuguucacaaaccaaauggccaccauucugcccuuuucuccucucagcugccuucuucucgaugcucuuaagcccucacucacggccugugggguuacugcagggacuucuaccaccgucucccacgucccaucucagcuccuaucuguggucagcacccaggccucccuacaggucuucucagccacgacagccuucucccaaggaaccugggccucugcgaagcggccuccugauuccccacaacuccccuggaacacaaagcucgucuucuccaagguccagcuaaacccugcuucagaauaugcuuaaacagccaaccuuuuuagcaugcagaacuccacagcuguuuagaaaaucuuccuaaugcagccuguuuucaacaacgaaucuguucagagaagguagagaaagcauagguuaugucuaaauauuucccuggaguguguuacuacuucagaguauuagccugcagcuccaggggccuccucugcauaccuuuugaccagcauugcuaaaaaguaacagaaauggcuuguuuggguuucaccuucuuuuucuacccaucacucuuuagcagggagggggauuaaugagccgugaaauggcuacauuugagcaggguaggguuaaagcagagaagccauguucuuaaaucaccucugcaggacuguggcuggcuugguuuuguacggauuuccaugaaccccaggcauacauuguuuauuuuuguagacaauuuguccaucugcuuuuggcuuaauuaucgcuucaggaagaucaguggaaaagauguauucagaguccaaggucaugucuguuccucaagggaagucuguguggaugacaaugcccuauggaacucuuuugaaaagccccauaugacucuucucuuucauauaccagccaaauggcccaaaccucucugugccucaguuuccucaccauaaaauggguacaaugacaguaccuaccucguagagguuugugaggacuacauaggcugacuguuggaaagugcuccgaacagugaacagucuagaguaaaaaugucagcugcuguucuagcuuagucccaaccaggggucaaagcuaauaaccugaaacacucucuuguggacccucugcaaugggcugggccuaacagguccgccaauacacaaauuuggaacacuuuccuuuaagcaagucaaagggaagggaauuguccaaccaaucagugauugaguuuguuccaccacccuguagaaaggaaaauggaauucgaugugcucuuucgacaucuuuggaacucugcagucaggacuuuccccaugggaggugagcuccccgugacaaaugagggagcugcccucucucccacugagaugagucauuguaacccaaaacaaucucaaaaucuuugacaucacugccgcuugcaaaucugugccuccagccaagggccgguggaugcuacugccugccaccucguguucaccaccagaacugcacgucacuccgaaucugcugaccucauacccuggcauagaaacaguaaaaagaccaaacaaaaacgugucuuuuuuggacccaagguugaaaucugauuuuaaaacagagacauucaguaagcauuaaacaucuuccuuuuauagcuuucucacagaccuacauugacaaacucaccccuucccuccauaaccuuuacgccccugagucacaguaguugcccugaauugcuuacgcaggucuggcuuaucaccgacaguuguccucaaaacacuugguucaaauguuaccagaacuaaauuuggaggagggaguccuggcauuccagagcccuugccucauuuucuagcgcgaucccagcagauggucugauguaucucaucagaugcugagcgcgggccucacuggcccagcccuccuuuccacaagucugguggucuccuuuuuuaugacuccacuugagaggccugggaaacauucucccugauaaugcaggugauaaaaccagaucaucugguggaacgaacaaucagaaauuccacugggcgggcacagggcuuggagaagaguugagauugcggaugauguuuuccgguagaugaaggugacugaaggaauugaauggaggguggaggggacuaaaggagagggugaaguccuccacagcaugacccacugcugcucggcaucagaaauugggaagucauuauaauggucagaaacguggucuaaaaauagaagauuccaugugggaagaacaugaauuucggagccaggcagaggggguaaauagcagugccauaacgcauguguuuaacagacagcacauggaguguguucugugugucaaauccugcaagagaugccggggacagagugugaaugaggcauggucccuaccuccaagggccucgcggucucacgugaaauguggguacagagauguaguauggcagugcccugcagugugccauggggaagaagccccggccgccuccuccaguugugaggaggggaagaugcccccagagagcccaugcuugagucacauccucuagugacccugagagccucaggcagcgagggcugcgugugccauggcccugagguuccagagaaacuggcccaaccgcuaggcacucaguuagacuggagagugcagugcacugugccagcgugggaaggggugugccagggcagugggggacaaaaaaacgcaaaggcuauggcgggguggcucgcagagccugcagagcugacacaguggcuugggggcaaggcagacaggucucucagaggcccccuuaccuuugcuucacaaaugagacaugagccagcagugcuuggcgguggugagcagccgggacugugaugugggacccucagcaugugggacccucagggcuuggggaacgguauugcugcaugcagagcaccacuggguccaggugcugugggugagaggcucaucucucugggcugcccccucaccugucuacgugagaauuagacacacuccauggcucccaaaccugccugugaaucuuaagugcuugggggccuugcugaaaacaucaacuccugacugggcaguggcucaugccuguaaccccagcacuuugggaggcugaggcaggaggaugacuugagcccgggaguuugaggcugcagugagcuaugacugugccacugcaguccagccgggcaacagcaaaacccugacucaaaagauauguauuccauauauauaaauucccuguccuuuugugggucaucagcaugaugcuggggcguucacacucgugugagacaugccucucucaaaccuuguuaagaugucagcacaugacccaucucacaugaaaaaauuaaaaagaaaaaaacaaggaaaaagaaaaauacauauauaaauucuucccaggcuccuucccuugacucccaaacugcuagaccagaaaauucacaaggucugagacuccccguuguugguacuuuggcggccagcccaggccaguccugggacagggaccacuucagaacgaucacccggaacccuguuaaaauccaggacaggagagggcccaagugcccugccugauugcuaaugagcccccaggugacucucacgcugccgacccccccgaucucucucagaugccccagaugcucucugaggucccuuccaaguccaacaucuuaugaagccuuugggaaaauaaucaguuaccaauggcaaaaagcagagauguaaaugugaaaagugauauuauauuggucuaauuucaaauggcuaucacugucuauaaucuguaagacucuugcuagggaaugaggcuuguguuugcguauuaagcaagacaaagguuguuuuuguaucauaauguaugagaaggaaauauucuuuuauccaaaauaaaaugaauccauacucuagguaagaacuuuggagccguguuucucuuuaguuucuguaugguagaauuuuuuuuguuaauuaucuuuuuccccugucuuucuguagcagcagcacucugggggaaucucagaugcauugugcuaagugaaaggagccaggcucaagacuccacacugcgugguucuauuucugugagugucuagaaaaggcaaacuacauggagggagaaacaugaggguuggaccgagguuuggagaagggagcauuugauaacaaaggggcaacacccagaauguugggugauauggagcuuugcugucucuugcugauaguggugguuacacaacucuguuauuuguugugucuguuaaugacacaccaaauaacacaccaaaaaaagugaauuuuauuguauguaaauuaaaagauaaaauuuuuuuaaaggaguaagaaaaugaagucaaaauaaaauuaacaguuaacuaggcaguagccaaaggaggagaaggacaauggugguuaucaagcauuuuguaacaacagaaaagguggaguucuauuuaaagcauguccuauucaggaacauuucaaauaaagauaagaggggaaaaaagcugugcaucacagccaguucaaacccccuccccaugcccacugccccacuuuuggcucguaaccuuuuuucuuacuuggccaaugugguguguguuuguauuaucguagcggaaccaacucaauauaaugcuaacuuaaagaauuuuuuuuucucucauauauauagaccgcuuuucagucuaaaugcaaaauagauauaacucuugguccugucccugggcugugccacagauccugagcagucacccuggaagacaggcggccugcuugcucaacucaccgggagcccgccuuuggaaggccacccacacgccuuuccucucugcuuccaccuggggcagacucugcagggcuguuagcugcuuacuaccugcagaggccccaugggguaaugacagucacauggcacaaugggaacacaccaucucagccaugagucaugccaugcucuugggugugaagaugaccuaagaauaccaggaaaauauuggcacgugccauuggcacaugaaaauuaguaaccugcgccugugagugaggucguaaguauagacaauuagcucuuuuaauugccaaucaucgugugauccugguagcucaguaguugccgccuaugcuaauugucacucucuaaccguguaaguggaggccaccagcacagcauccguaaccucuucaugacauccaggcugcaugagggugaugcucugagcauugacacauugcaugucagcagugcuaaauuagaaagagcguuucauacccauucgcggccugacagccaaagcucucugcaugcugccugcagcuccagaaucugcuuccuccuggcccuuuccucaggugcagucugggcucucagggcccugaacucauccacaaucagacuccaagucuucuuagaggacaagcaggcuuaggaaaucacaucagucuauuacacaaugauucacauuuagacaaaugaaaugcauuuauugcuaaaagcacagagguaauaaaaggcuuucccagaaaaucaacuuuuccaacacaugccaggcaaaaucauauccagaauauaaaaaguuugggcuaaaagccauugagcacaaccacccaugugcugccuauuuuuagaauaaggagcagggguuuucagacacugauacuauggguggggaagaggagaucauccacuuuuucucugcuuuaaaauguacaucuaccccagucaaaucauuucagauaaaacuauauaauagcaucuuagaauuauaggugguaccuucugggauuugaaaauuugucuauagagauaaagcaugacagaaaccaguggcuucccagacuucgccuucacuccugaaucuaauucgguccugacccacuuucaguucugcugcccugugggcugugucccagacaguuuucgaaauuucugucaguaucaccaucagacagaccagauuccauacaaggaaagcuaggucuugguuucuucagauuauuucccuggcagacuuuucuuuuuuuuuuuuuugagacagagucucacucuguugccaggcuggagugcaguggcacgaucuuggcucacugcaagcuccgccuccuggguucacgccauucuucugccucaaccucccgaguagcuggggcuacaggagcccaccaccacgccuggcucauuuuuguauuuuuaguagaggcaagguuucaccauguuggccagugauccgccugccucagccucccaaagugcugggauuacaggcaugagccaucccgcccagccccuggcagacauuuuuaaaaagcauucggcuaaguguuuuuuuccaaaugucacuuuaaagguguagacucuccuuccuuuucgaacuguucucuaucacauaagcucauuugcaggaaaaccuggaagggacauaaucucggucgccgggcaacaugccugugaugucacagcuugucuucuucaucuuugccuuuacucagcuccucuuuuguuuguuuguuuuuaggucaagguuauugaggcauaauugacaugcaagucauugaauauugacaaauguauacagcgauagaaccaccagaaucaugcuauggagaagguccauuaccccagaaacuuuccuugugcccucucaguuagucccuccccuccaccuccaguccuggcagccacucaucuguuuucugucuuuaguuucgccuuuucuagaaugucauaaaaauagcaucagacaguaaguagcauuuugugucuggcuuccuucacauagcagaaugccuuugagauucagccucaacugcugcacacaucgggcauuuuguucauuuuuauugccaaauagcaaucccaggagugagcuaauuuaauaaaaccaggaugaacauucucauacaggucucgguguggauauaggccuucguuucucuuagguauauaccuaggagugggauuguuggguccugugaacuuuagaagaaauugccaaacugucuuccaaagaggcugcacccuuuugcguuccugccggcagcccauggaauucgaggugccauccuucccagcucuuggcguggccaccuuuuucuguguauguucaccauuugaguccaucacaguuauaucucucuguggauuuaauuugcuuuucccuaaugaccacugaaguuuagcaucuuuucauguguacaacuuauuuggugcagugucugcucaaaucuuuugccaaauuuugcaguuggauuguucauaucuuuaguauugaguuuugagaguucuuuauauguuccggaagaaguuguuuaucagauauguguuuugcaaauaugucucccagucuguccccugccuuuuuauuuuuaacuguaucuuuugacaaucaaacuuuuuaaaucuagcuaacuuuuucuuuuauagguuguaaucuuugugucuuaucuaagaaagcuuugccuaauccaaagucacaaagauuuuccccuguguuuucuucuagaagcgauacagcuuuagcucuuacauuuagguccauuuggaguaaaugucuguauaucaagugacauaaaggugaagguguguuucuuuacauguggauguuacuuacuuuguauugacauuagugcuacagucugcaucacauaauuuuggagggcagaaauuccaaggguccauauaguucuaccucauauaacugaaauucuuaauaaagaauaguacccaggggugggacaaauguuuuauauacuaaauaaggagacagagauagaaaguguccaacuuaaccucagcucuguguugcauggaauaggcugcugauaguuaucuguguaauauacuguacaaauacuagccuuuacauuauuguuaccuuggaacaugcuacuaauuucaucuugccaggguagucuaaaaauugcucagaaaugcuaacugaccauccucaaaaucaacgaauauuucuaaauuuuggccgguggaauuauuuuucuagagccuaaaaaguaguccuuuccaccuuuugggacauuuuacguauuugaaauguguggcaaagagcucacagaaauuaacuaggucuuagguuggaauccccggaggaucaccaggaauugcagccuuggacaggccuugaaggucuggaacacacugcggaagggagggaggguccgcccuggggaauggagaggauaugggcgucugcugggcgccagugcccauaaaaggugagacaggaagaguccgcuuaggaaggagaagggauuuccuacuauucagauuucggcugguaagucaugaaaagcucauucuuauucuaccaguaaaauacuguacuguagauuaaaaauccugauguguagugaagccaguuuuauccugggcaacacuguuuuuauccuucucugauaaaugaaacucuuucuacucccuuacccagggaauauuuuaagguuaaugaacaaugaauggaaaccacaggguugugugauguggggcccugaugcgucauccaucuguccaccuuuguuuaagucugaagcuguagggcuacacugcgugugcccguaucugaucaucuuuugccucuuuucucagaagugaaauuccccaauugaugaaugcgggagugucgggacccugagcgcauucucuccacggucgugguauuugaguaauguggguucaagucuggauuuguugccuuuucagacugcagcuuccaaaaccagcccggauggcccaugugcgcaccagccaugacuucagagagggaaaacaaugggcagcccccgcgccccguccucacgauagucaaaauggagucugucuuguagauaucacugaaguauaaggccaagacugauugaauuagagauaauauuuaacccacauaaauacucuuauguuccucugcaugacccaguaagccagaccuuucuacugagccccaacuccaugcuuaagagguuuuucuuauugaaagucaccuaucucuucccucaggaaugccaggauggggguuaugguggucucgugcauugguucucaaacuguuauguaccaaggaguauccuggggaucaguucaaaugcagauucaggaguucuggggccaggccugagacucugcauuuauagcaagcccccaggugacgccgacacagaccucccuuggagcaguaagggccugguggagucagccagcuccccagaucugagugcaccccggccagcccugacacuggucccaucugagccccuguccucucuccucuccacuggaguucgugucacuacaugcaguugccguggggacaaaaugagagaaaccauauuuaaaacuuguaacaacgcaucaucucaaaagauagaagcaguucaacgauacuguucauuauccuguuucuuaggaaauaguaccucuacauggucugguggugggagcagggcggggggcaggggacaugacauuaccacuccuguccacagcgucuccuggcuucugaguacuuuguggaaauauuuuucucaaggauguuggaggaauauuaggagcuuuagaaauuuaggagcuuuugagauuuaugcaaagacauuuaaacuagacucuuuucacuuucugggaguaauuuuuauuuuuaaugucacuuaucacaaaaggaaagaaagagaugaaaauaacuuuuccugucgggacuuuuugacugaggauggaaguugauaaggacgaugauuagcacagaggaaaacccuuggcauguaccugguccucccagcugcucuuuauagaugcaccacacuuccuuagugggcaggaaauccuggggagaagcuccauccugaugaccaaagcguggccuccucgggccaugcuguaaauguccauuuaaucccagcaaggcaggcuuuacauugugcacagcggagagggauccaucugggaggacuaaggucuaacucacauucugcccaggcucuuccuggcccucucucagcggggaagcuggauggaauucugugaaauguuccaucucaucagaagcucaggauggacuguuuagaagugaugccaucuugacacuuacuagaauggcuauagcccaaaaaauggaaaaucacagguauuggugaggauacagaggaauuggaaccuuugugcauugcuggugggaauguaaaagggugcagucaguguggaaaaagaaauuuagcaauaccucaaauaugugauacucgugcacacauauuuacagcagcacuauuuagcaauuccacuccuaggaacacacccaaaagaauucagaacagagacucaaguagucacucacacacacauauucacagcagcgcuauccacaguagccaaaagguagagacaccccagauguccacgaacaaaugaaugaacccauuguggucuauccguacaguggaauauuauucagccaucagugaaugagguaaugaaccccaaaaacaugaucacuaaaagaagccagacacaaaaagucacacaucguaugacugauucuauuuauugguaaauccguagagacagaaagcagagugaugguugccaggggcugggaggaaagggaauggggagugauugauuaauggguuuggggcuuccuuuuggggugaggaaaauguuugggaacuagauagaggugguggucacacaacauggugaaugcacugaaaggcaccgaguuguauccuuuaaaaugguuagcuuuaugcuaugugaauuucacuucaguaaaaagaaaaguuuacagcauacuccaggaaaggaaagacuagaguuuuucauuccaaagucagacucccuaaccaagaaauaaagaugagaaagggguuuacugacagugaaaggaaaaugaguucaugaugugguuagccacuuucccccaucaaagggaauugaggaaggguugacgaaugcagauaagaaugugguuuucaucaauaagacgugcauauuuccauuuugguuaguagcagauguucccuuugaguugacuguaugaaauaaucccccuggucacugcugcuuguuugguuggcuaaaaaauaauaauaaucccacuggauagauauguaguuuaugggcaauaaagcgacaguccugauaagaaacauuuuaucccccagaagacagccggcagacacuaacaaaccgcaggccucaacauagugaggggagcguagagcuucguggcaugguauguaaucuuaagaagguuauagucuagcauagccacaaacuaaacaaaauugagcaccacugggaaggauccacaaaagucggaaucaaaacauaguuuguucccaaacuuaacaacaaaugucguguaggaaaccacuaagcauuggagauagaaugagucugggauaucgugcguccagggccagggccacccaucuuccaugagucuccucgccuagguagaaacacaguggcaauagcuucuauuguagaauguucuccaaagacacuaaagugcacaagcuucaccacgacuuaggaggccugaaauuaggcugcccgaggugaguacugauguggcauugacaggaccccucugggacacguggagggcagaggagaacccacugucucuaaaacucugacuucgguccagaccagguuacccugagggagauuucccagcuccccuugguuugaggggacaggggucccaagauucgggauacaucaucuuccauccacagccuuaaucugcauggauagcuuccaccccaaaaaaucaucuuaacuacuucccgugaugccuggggccuaacaucucaaggaauugccaguuaggaacaguaaugaauuuggaggugagaucuucccacaccccuccaugcuacugccucaaugacauuaacacuguacccugggcugcguuuuuaaauucccauuucacuucaacuguguggauugcugagaauggcauuaugaacauucugugaagacagacacgucucagcugaacaguuuaccuaggaaguuaccuagaggcaacagaagaaaagccuagaaaaauggcucaaguuccccccucaaucucagggcaagacaggaauuugacauuucacagcaaauggggcuuggcaaguaaaggugccgugugaugaaucaacagcagacucauucgucucaagaggaaauuaggacauacguuuuuuuaaguuugggcuagccugugaaauguuaaaauauaacuauaauacaauaguuaguuccagccauaggagagauagaacuuccccuccccuccuuucucauuuuuaaaacauuuuuauugugguaaauuuauuuuuaauuuuuuuaauguaacauuuuaaaauuuuucuuguauuagaaauaugcauauguccucgcuuaugagugggagcugaacaaugugaacacauggacacagggagggaaacaacacacccggggccugugggugggucggggggagggagagcaucaggacaaauagcaaauacgugcugggcuuaacaccuaggugauggguugauacuuuauuguauuaaguuccaggguacuaauaaaauaaaauaaaugcauaacaucgaaauuaccuuuugagucauauuggcgugucugauucaguggcauuaaguucuuucacguuguugugcaaccuucaccaccaauccaucuccagaacuuucucaucuucccaaaccgaagcucuguccccaugaaaacacugccucccccugucccucucugcccggccccuggcagcccucauucuacugucugucuccauggauuugagcgugcuagggacugcauauaaggggccucuauacaggaguugucguuuugugacuggcucauuucacucagcacagaguccucaagguucuuccgugucacagccuaggugacugcuuccuuccucuuuaaaggcugaguccuauuccauugugugggugucuacccauuguuggacacuugagugguuuccaccuuuuggcuguugugaaucacgcugcugugcguguaaguguaccaaagcuagccccugcuuucuguaugcccagaaguggaaucgugggaucccguagugauucucuuuuuuuaauguguuaaggagccgccagaguguuuuccaaagcaccugcaccauuucacaugcccaccagcagcgcacggagauucugauuucuccacauccucaccaauacuuauaacuuuuuuuaauaacagccauccuauuuaguguggacaaacauuuuuauauguuucagaagcucuuuuuuuucccucuaugugaacaaaaggagagauuaaccacuuaaacaucugagggucuuuuugauauuugaaugcaauacacauuuccacaguuacuggaugcauuauauugaggaaaauagagauaaaauuguagaaauucauuuggaaaauuuuuuauacugaaaugaccuuaaaaagaacccaaauaaguuaauucuuucaucccaacccaguauuaucauuucacaaugacaugacuuuaguaauuuaggauaauuuuuuucucacauuccauauuuucucuucuuaaacucuaugacuucuuuuguuagcuaucauggcaguagaugauaguuuacauauaauguucccuguagauuauagcucuuuaaaaacaaaaaaaaaaauguaguuuugaaaguaaccguaacugaucaugaguauguauugugauuaaucguggaaauugaaccuuuguuguucccacagggucagccugggccagugggcccccagggguacaaugggccaccaggauuacaaggauucccgggacugcagggacguaaaggagacaagggugaaaggggagcccccggaguaacgggacccaagggcgacgugguacgcaccgcugguguauuccccuggccucaugaggguggcggguaucucagccuugguuaauugcauuugcuuucuucauagggagcaagaggcguuucuggauucccuggugccgauggaauuccuguaaguuuuauggaagacuggaauuuuaaaacauugcgugcauccuaggcaauacauuuugugacuuaaagaaacauuuugaaugagaccuccuuuuuuguuuaugacauaaaacacguggggacuauacgugcguauucuccccgcggaauucagucagacagugaacaaauuguuugcuuuguaaacguccuuauagacuuggcuucagaauugagacgauuuugcuaaacugcacauuguuugguaauaaaaagcuagagugcuguccagauacucgcccuaaagagccagucuugugaucucguucgaacuauagagcaaccugcauauaaagucguucagccaagagcaugggcagaaugaagcccugcugagcauuugugcagcuucucaaguucuuuacagcaaccucacauaaaacgaaaaacaaaaggcaugguuuguucaugagaaaaaucucaaaaugcaauaaaauguguuuuuauaaccuaguuuacuuuacuucucguggcauaaaaaaauaaacaaaacagccugacucacagccuucuucacagggacccacgagcagauuucccaggguuggcuuccuggccagaccugaccucagggaucaauguguuuaucgcacguucugacccaccucccauccggcuacugcugugguucugagacaucugcuucacaaaccucacacauauacacagaugugugugcccguguccugcagaggcagguucuguaucaccacacacgcacacgcacagggagagagacuccauucccaggcugcacgaguagggccaugccuugcagaagagaaggagggaaugagugaguggagggcagugccagagaacucaugcguuuccaugagaucuuuagucccaccgucgaggagacauccgcagagcagaaggagacagucagggcaaaauaaaggaagucacauuugccaagacaagagcugcaagccagugaucucggggcuaccugaaugguaggcucaaacaggcacuuggguuuaccacauggcccugaacaaauaaggaaauaauguucacaucagucagaaucuugagaaauggacagaaaugaagaaucugcacaacccaaagauuaaacaaauuaggaaaguauuuucauacuaauggccugaaucuaaaucacccauuuuuaaacuacucuuuugaacucuuuggagugucuuucaguuuugucuccagcugaaaucugaguuaaaauggaaugacauuauggaaagcaauugcaacucaucuguaccaaguuuccuucauguuuccacuuuacacucacuuaauaucagaggcagaugucucacaaacuagggaagaaguaaucauaauuuggaggaaugauuguggugagcaggugaagaccauuuucuacugaaccugcugcucaaaggauccagucucuuaaccgcagaacucugauacuacaaauuaaguuaacauaaauaucaccugccauaaguaaucaguuaacaaauguagaguuugaaggaccuggaucauuuuagcugauuagaaguuauauauaagaagcgauaugcaguaaaaucuuagaggaguggucucauauagcagugaaucuaauuugaugcugagcagagacagacauuuagcucaauauaacugaaauuuuucuuugaagcacaauuucagacucagauuagauugacaugcaauuucaaauagaucaguucuaagcaaguaagaaagaccaacggcagacaaauaauagagaaaaauuuaaacauuacaguucauuuuaagcaaaagcaucacagaauacuaaaaaucuggagcagaacauguggagagcuguuuucucaagcugaagugcaagggccccuuaugucuuuauuugaaaggccacuagagugccagcucugcaaacagaucgagaagcugccaacaaacagggauuccucuggcucaccagagaguuugacugagccuguuggaucucucaucugacggcaccaguucaaccaauggcuguggacaucugaagcaaagaaaugugcaaauaaaaguucuacuuuuuuauuuuauuucuuaauaucauucagguuacggagaacuauauguaggauuuguuguguggggguuuugagguuuguuuguuuuguguuguuuuguuuugagacagagucuuguucgcccaggcuggagugcaguggugcgaucuuagcucacugcaaccucugccaccugugcucaagcaauucucauggcuuauccucccgaguagcugggauuacaggugccugccaccaugucuggcuaauuuuuguauuuuuaguagagacaggguuucaccauguuggccaggcuggucucgaacuccuggccucaagugauccaccugccucagccucccaaagugcugggauuacagguaugagccacugcgcccagccaaguuuguuucuuuaucuugaaauuuuccaaauuucucaaaguaacuguaaaagacaucccaaugcucucaaaaaucacucuggaauauauguuugguuuauuaucaagaaaacuaaaguuuaaaaguaacuacacaauaacaaagcauauagcuaaauaucuauuguuuaaagaaacagcaaaacaggcuguggccagguacugcauaaauuauagauuauuaacccagccccugugugucuccuggaaccagcuuaaugcagugaagaugcccacaaauuuagccugagucccucuagucauugcagacacuuggcuguguugccuuuccccacccccagacauuucagaaaaccugacuugcuuuauauucauguuuaaaaucuaaaaggucauguuuccuaagaaagcaaacaagaggcaaucagcucuucuaaacaugacaaggccauugauaaaaucacguugcgggugugucuucucuguuuaggauguggaucugugaaacucacuaucuaaaaugcaguuggguacaacugauaaggaccucccuguuuucccugagaaggagguagcugcuucuaaaaucuuuccuagaauuuuuaaaauguaccuuuacuuguuuucuacagggauaaggaccuuccuguuaucccugagaaggagguagcugcuucuaaaaucuuuccuagaauuuuugaaauguaauuuuacuugucccugcugauagacagucacucaacuaguaagacagaagaaaccccgacaguguacuucuuacccaagcccaggugaagcagaacuuugcuucgaaaucuuuucccugcuuagaacgauaccuuaugccuucacuuauuuaaucuuucauucauucauuuguucacuuuugaggugucuuuuccuuggauucaugccgggaacauggcuuaugagaauauaagacuguuuuaucucacaguuacaugacaacuagaagccugcugguuggcugauucucucacugcucucuuucccagggacacccggggcaaggugggcccaggggaaggccgggcuacgauggcugcaacggaacccagggagacucagguccacaggggccccccggcucugagggguucaccgggccucccgugaguauccccacagcgccugugcuccagggacgggcagaccccugcuaagcccugccuuuauaaccugggggagccucccgcucacuguggccagaacggaagcauaacuguauguugacgcccaagacaugacguuucuggauucaaguaacuucauuuuucguauucuuuaaauguuagauagaaaaucauuguugugguugauguuguucacucucagucucccaagugucacuucauuuucucccaaauucucaugcguaauaguggaaucguaaacgcaaauuaaaaagcugaaaccuugacaaaauucuguccaucaccaucuuuaucagauuaugaaauacuuugugacgugggagugcaguuauucuccagcagauacgaugcaggaguuuguuuuuuaauggaggaacuuuuauauaaucaucuguuuuguggccucauuuauuuuuuaaggucuugguaaaacauccugaaaugugucuucaguaguacguugcuaccuuauuuccaaggaaaucuugcaaauucagguuuagacuaaaauuuuguuuggugagacuuuuuauuuaaaaacaaaaacuuuaaaguggggagggaagaacagucauuaaucaccuucaucacguuuucaccugaagcaaauggaguucuccuacucaguuccaccuccaccugcuaguucaccuuuccucggcuguuucuguuuuaugugguucaauuuuucaauaaacuacgucaucuucuacucuauauaucaucaauuucauuaucaagaaacauaucuauuacuuuaagugauucuuauaguagauguugaaagauauuuacacaugcacauauguauuauguauaugccuacuguuuauauuugacacaauuccaauuuuaaagaaugacccaguaucuauucugcaaaugggugcuuguguuaauauguucaguacacuaaugccaaagaaagcacguaauaguauuaucagaaauaaaaauaacauuggcauacuagaggguugguugacagagcauucauuuggguuuugaaaauaauuuaaauccuaaaguauuucuguuuuaacucuaggaaagauaugauugggucaauaggaaauuaaaggucuuacccuuguugcugaauauaggguugguguucagaauaacccccaucagccauaagaacaauuagaccuugcccacaaaagucaauguucagucauccacauuaccauagcugcaccgaauguuaauggacucuuuuuguuguuuuuucuuuuuacaauauaucugcuaauuaggggccccaaggaccaaaagggcagaaaggugagccuuaugcacugccuaaagaggagcgcgacagauaucggguacguuugcaagagaugggagggguaaugaagggacccaguguaaauucucaacuaacaaaguuaauugccaagugaacuuugcauguaagaaugaauguacugaaggcaugccuagaauggcggcauaaucuaaaagucaucuuacuuccgaucaggauguuuucaaucuuauuuuuaauuguguguuuaucucuuucccauauucacaauacuccaagccaaauuaguacuuguaguuaauauuaguaaauauuaauauuacuaaaauauauucugacuaaauaacaauauuaguaaaaauuaauauuaguaaauuaacauuacuagguccugauagggcugaucuguuugauaugcuuauuuccaacucugcaauaaaagguaaguaaaucuaaagaugguuaaaagcuaucacucuuaaaauuauuucuucuccauuagggugaaccuggagagccuggauuggucgguuuccagguaaguuuauuuuuauuggacgauauuccaaacaaaaguuuaagagcuucagaacuccaaguaccaguuuaccucucuuaaaaacauucucccgcugccuauccauagggaccucccggccgcccugggcaugugggacagauggguccaguuggagcuccagggagaccaguaaguaccuggacacaggugcccacucugggaccaucguccggucaucccuuccagaugccacuucuucaaugguugacuccagaugagagcuuuaagaacaacuaugaugcuuauaggcguagcagagaacaucaagacaaaacggaccauuccuugcacacuuugcugcuguuaagguugaagaauaagggcuuaaaauuauggucaccagcucucugccaguuaugucaaauuuugacuugguuccggcagggugcccuuccauccccaccccauaccuacccagugacagacagcccaucaucccugggcaaggcaaaccaaagucccacagguucauaaggaggaaauggaggucugccugugccacacccaugcuagcaggcauaucacaccugggcucauuacagcaggugagauacuggccacuguuuaacacaauggcccuagagggcucauugcaaguagggaagagcagaaaaaggcacuugcugaggcuuguguagcucucuggccacucccaccacugcacaaugagcuggaagguggauuggccacugcgagagcuccugacucgcucauuccccacauauguuaguaaucagauaaauaggccuuaacuuacacaaggagcgauuugggcugcaggugagagagaucuucucacaggaagccauugcucaagacugagacaagcuaucaagggacacuaacaccaguuccuugacagauacugagaaaaaaaugaagucauauaugucuggggagacucagucaaacuaacaguugggggguacucauaauucucuucagauuauaauaaaugacaauaauaauaauagauuuuguuucuacaaagcaaauuuccccggugcugugaaagucauucuugcaaguagccccgucugugaaagaccuggucaagguggcugaaaucagggucauacgaggcgcuguugcuguuucacuccauaggguuauuggcuuagucacggcacacaugccacaugguuggauuucauacuuuaaaugcaccacucggagaaguccggcacaacagauuguacuugcuagguccucagcugcucugacagcuuuugguucuucacaugagccaugcaaucauccacaacccccucccuauccacuccuuuguauccacuuauuuguacuuaaacacucuuccccugcaucugaaaugcuuuaauccuaagcacaguguugacacugaaugcucugcagaaagacacaccaugauacugcagauggacuuuccgcucugcagugccagcuuguagauucauucuguccaugaaaguuggccaagcuaccaggaagaaguccugcauggagucucguggggacucccagaggaagucagggaagcugucgcugcagucacagggccugggaccuugcaaagggaucagaacaaacacagagaggacaugggugaagucaaaagcccaaacacacaaaagcaaagcagaaacagcuguccguagacagccggcagauucugagaacuggagcugacccgagucccucucccccagcaugucaucucugccaagccaaaugcaucagaaaccuccaugcauccuacacuguguccuaaauauacagucaauggcuuucccagagcuuuccaccagauguuaucuggguccugggguaaagaaaaccauuuacacauuucuuuguauuuguacagggaccaccuggacccccuggaccaaaaggacagcaaguaaguugguuuuggggggugaggaugagggaaggggguacuuagguguuuguggguuuguuuguuuuuuaccauaaaacuucuugguuggcaacuauuuauuguuuauauuaugaugaaaacaguuuuggagguuuuuaagacuuaauguuaaacuccaaggauagauccauggugccucuggacauuaaaaaaguaaacagguggaaugauuuguuguuugcaaauuaauuaccacaugccuguugguauaugaaaaccacacugaggaacauuugauugaaacgaagauuagaacaauuuagggacaguucacauuuauucacaugcauugauuuacgagaauggacaaaauguaacucuaucuguuguagggaggccaaugucauucuucuuaucuggcuagaauuagguucuacaggagucuaaugucagccucuagggauauauucagugauaaucaaguuaggcuagagcccaaagcuguauacuguuuucaucccagaaagguuauuaaguugauuggaacacagcaaaguaggugguuuguuagaaacucggaggacagaacuaggguuccuuauuaucugagaaagcuggauaaauguccaagacaaacgaaugcaguugacaagggaaguauuugaucaaaaugcaacauaauucagaaaugcugggcugccagcgggaagcaucuaggaacguuuccuuugcccugugucccgauggaggacgugccaagcccacacguugccaugccugcccauugcugugaccccuggugacuacagcugccaccgcccaugcccccaggcuccuguccccucugacacagcuuccgguuggcuggagggcuugcgcuggacgccccaccgccuggcagccuggagcaggaugagaugggccccaggccaagagcagcagaaauaggaccaggcggccgggcugaggaggcagcagccaagcccugagcccaggcgugagccucagaucuccccuugcugcggcaaacaucaacagcccuccucaccccugaccaagucacuuccuggugacuuugacgaccagcucaggaggcagagagggacugugggggacucacacaaauugcauucuaauccagccuggccgcguuucugugcuuugauuucagcuccccaccagguggggaagaagcaaaaggcaaaaauucauugaaggcuuuguuuuuauuuucagaaaauaucuggacauuggagggggcggacgguagacugcagagaaagagagaucagauagggcuuaugugaccccgcugucacugugggaacacacagaaacccugggaaagaagcaaagcuguugggaguagaagaggacagugcccgugaugugcacaaauuugucaucuugcuuuuucuaugcacgaaucuuagaggucagcguugucaguccucccacacguggcuacuacguucgugaaauuauuaaauccuuacuaugauacugggccuagcuuugcuucuuagguaaaaaaggaagacaaaaaguuuggauaaagcccagagaaucacguaaaaucauuacauucugauugauuuuaaauuuccaaagauuauuaaaaagauagguaaaguuuauaugaaaugaggauuauuuugccaaaaugagagaagacugagccagaagaaaagacgaaucaugaucuucaaaugcagaguccagggagugaaauggggcugcuucuuccaucugcaggggccagaacccagggacaugcucuuagacuacagucugcagagaccauauacucacgaucgagggccagcaccaccugggguccaaucucagcucccacucauucacucugaggccuuggucaacugacaugacaaacugucaauuaguuucuacaaugcaaagcaagaauauuaugcaaauauaguugcucaguaaaguugccgauaaauaggccuuggguuucuuuuucuaagaaaaauaauuuuauuucucucugauuauuggcuuuuuaaaacuuacagaaauuauuuaucuuuucagggcaacagaggacuugguuucuacggaguuaagggugaaaagguaaaggaagccuggucaauuccagcagaggcaugcagcauuucucagccaggaaauaaaucauuuuaauuacuaaguucugugcuguaaaacuuuuaccuugaguugaucugcagacagaccauuugcauagggaaauaaucauugcaaagugcuagguugucaccuacauaccagugauaauucugcaucaacaagacgguaaacauagaccaucuaggcuagccgagacucugacacagagacauaagcucagcucaucuucagaagguggaggugaggacaugucacugagugcaucuucuccuguguggagcccagaggugauggaggggacugagacuacagccagaggcugacauggagccaucucagggaccaggggaucucagggaccagcccugguagggcacaaaggcagccguaaggaccauguggcuuuucuccuuccuuagagugcuaagauccaaagaccucauggccuuugagaggaacgugugagaucacgugcaugacaggcuuaacgcagcgccacaccccgcaagcaaaaccucaccaacacagucccauugcguucaccacaaaagccaugagcccacuguaaaguagaccugacccuuggccucaugauuggaacauuucuauuuuguuuucccuucugcuuuuugauggaacagcacaguaaguugaaucaaguccugcucaugugugaagaagaaacucuuccuucuuuacauuaaugccauagaagaagucaaaaaaggacaauuagcaagcagugggcuucugggaaaaaaaagaaagaaaaacauugaagauccaaacacauaaaaauuuauagccccauacaaugaaauauaacaaaauaauaaaaacaagaaaaaucugggaagaaaucauuggugggagaagagaauagucccguuagauauaauggagaugaaguuagagucuacagucuacaaaggacuuaugcaaauaaugaauaaaaaacaucaggggcccaacagguacaagggaggagaacaaacaguuuggguauuuuaagauauucuauuaguggacacucagcguacacuauggaguaucacuuucugcagcugacccaucaucuccauuuacugcuguccguguuaugugauaucugggcucagacuuguaugauacaguuuaauguggaaagaaaggaaaagacaaugauguucuuuugugucaaucaguuucugggagguaaacccagaauauuaugcaaggauaacgguccaguaauguucuagauagaucgguuucaccaucugugcaccacaucaaaaaguguuuucugcuaaugauaaaaaugcaaauuaaagcaaucuugggauauuauaguuacuuaagauuuuuuuuauuauauaaaaacaucuuuagcuggggaaguagucuuucauuucuucagcauuucguuuaucucggugcccaucuuggcaaccaguagaguaauaccugucaaaaaccauaaagacauucagcccucauaccuaauaauucccauauauagaaauucauuguaaggaaacaaccccacagaaacaaaugcaguccagaauuguaaacaaccuacauggcuuuuaugcauaaauucuaaaugauugcuaaugaaaggaggauauaaaaaacuuacauuaggauuacucuauuuugugguuauuauacuguaaauagguauacauaugguaaguaauaugcaaacauuaaaacugcaguauuuuggccagguuguauuuguauucgaguuuuguaguuuccuuucgauuuaaagacaacugcuuuugcuuaacaauaugcagggugacguagggcagccgggacccaacgggauuccaucagacacccuccaccccaucaucgcgcccacaggagucaccuuccacccagaucaguacaagguaaagagcaaaauugacucuuuucauaguugaaauaaaaaaaggagaguaaaaguacauuucuucaauuguauucaaccacauuccaaguagaaaaagccucaccaccaacuuggcacauuacccaugaaaacauaaccggguccucccagaauguuuucaacucuuccagacgguuacuagauucacagugcgaucccgucgucaguccaucaucucaauucugaugaaucugaagcaacaagagaauucauuuaaaaaaaaacuuauaucuauccuuacauucaguguagguggaggcuaauggucauaccguaauucaaagccagaaucauggaacugucuagcaaaauguguucagcaaaauaaaaccuacuucuuugcugacaugaagcaccuuuuuggagguucaaagucaguuuuugacaguuucugaaucauucaauuaacauuuugcuuaauugaaaucaugcucuuagucugaaauaggaauugccgcguccacucucucuacguuuggaggcugcugugccacccacccacucggaggucccacagccuuucuagggcuuccuguucccccugucaaauggggauggcgacacugaccuccuggagcugacgaggagguugcaggcgacugugaaacacucaguaccaugucgggcacgcagaauaucugggaacuaaaauagaaaccccaaacggggagaucuuaacuuuccaaauagaaucugguucccaacucuugagcaggguggggcuuggguccuguguccuggguccugcauccuggggcggauuuggcaggcaggaccacugccuugugggggaaaucaacccagguggcugaggcucgaguuaugagugaccguugacaaaaauguccugggagacggcagggagggccucuguccagcuucuggacuggagcccagagcagguuugauccacguggaggugcucaaucuuccgagucaaguuucccaccuuuucuacaacccaggccagggugggauccggggcugggaauggccaacccgcaggggcaguuguguccugcaggaauccaagguacccucagaaaugacggggacaaaggacccgccaauugcuguuucuuucaccauuuuagacgaagagaaaugggaaaaacguagaucauguuuuugaucuaugauauugacauggcuuucaacagccacuuuugcuucaaguuucaauauguuccauguguaucuuuuucucagagggccuccuaguaauguuuucuuccgaagaguauuuucauuaaggcuuuuccuugggcacguucucccaccauacggauguaaacaucugccuggaacggugugggggauaaaggaaaacagagagaaggaaagacagacuuucacuuguaccaagaggaauacaggaauuaauuuaucuugugaaaaucuagaagaaaugacaccucuuuucucuugaauuuugaagcugcaaaauuuaagagucauguguuguaaucaauuuaugaugauugugugaggauugauucaguacuuucagcucaugucaugaacccugauugauuuuuacccauuaccauccucaaauuaauaagcguuucuuauuuuucauauucuucacagggugaaaaaggcagugagggggaaccaggaauaagaguaagucgaguaaugagcaugcccccuccccuguggcuccugggcugucggcgcucugccaggcaugacggggugcaccaugcgcucggggcccgcacaccgccagucucucauccccuuguccauagcagaacaguauuagcaugcauuuuuacacuguauuuuaagaagucaguucuagaauuucuuccucuuggcaucauaaacacuggcuaaucaucuucugagguuugggaagggagcauggagauggcggaggggcguggcuuccacucaggcgccaccggguucugcccuccguccccucugucacugccuguccucagagcuccagcucucccucgcggucgcuuaccacgugacaugacacaugcaguccuggaugggugacagcccgggaaggcuggcgggucuccuaggaccgugcccugcacugcgccugaguugagcaucgccaggcggucuggacaccaucggggcugagaacacagaguccuggagcagaggaugacacgugggcccuguuggcuggaggggccgccccuggguugcuccuuacgcccccucugcucucuccuagggcauuuccuugaagggagaagaaggaaucaugggcuuuccuggacugaggguaaaccacgccuuuuauaacugcaguugucgguuugguuugguuuuuuucaguaggcuuuccuuuuuagagcuguuucagauucacagcaaaauuuagcagaaaguauagagauuucccguuauuacuccccacccccccccacacacacacacagcagccccccagcacgaacaucuagcacugggggcugcgcuggcuacaauccgugaaccaucuugacacaccgucuucacccagcagcaggugugcagacgcggcccuccccguggaggaggcgcgaguaccgcacaaaaccuuucugguuguguguguucagcucaguuagucuguaguaaccagaaauguagaauaucucaaacacacauugauuuccgacugucccaagagcccaacaaaaaugucccuagucguaagggucgggaaggggucaccguccacggugauucagccaccugggagacagaccucaccuucagagccccagccuggacugaccccacucacuccacgaccacaccuagcugagggcugggacggguggucagagcccugggcccaggaagagaaagcagaauuuugguggcuaucuggcaguugcuaccacucaaaagaccguauuuuacauucuccaaaaauaagaauagagagacacaguagaacauuagaguacaagccuuuuuacauuuuuaguuuuucauuguacuaucuuugugaguuucucuguauuucuuuacgugguagaaaugaugcacguuaugaaaguauugcuaaaaugaugugucucccucaggaaaugagagucuugggguggcucugacgucuuccacagggaagcagcuuugagauuaggauggauucugcuuucuucgagccuuuuuaucauagucauuauuucccauccccaccuccccacaacuuuguaaaggggaaagaauuguauuaauaguugguauugaauuuggcaauuuguugcuauucuucaaaaucuggaccugagacuuguucaaucuguccaucggcauuuugcugugaucacagccaggugccguagucaagcccucuggaaaugucuacugcauauucugagcuguuugcuucuguuuuuuguucauuccaggguuacccuggcuugaguggugaaaaaggaucaccaggacagaagguaaguuggaugcaugaacugcagucugcucugggcccacgacaucccacagagguuaaauaaauaggccuuggcaucucaggaaagaaaauugucuccagaaaaaaacauugaaaaugguucuuguauuugcagucacaaagauaauccugccucacaauacuugaaccgggucauuaccuuggcucucauuuuugcaaacuaucuuuugcuuccucccuuucaaaguguccgucacucgaccccaccagccaugguuucuauaucguccaaccucacaccccuccuccauguccuugucacucauaggaagcuccuggacuuggugacccaggguccaccuaaauuuuuuuauagauugacccauacugugacacuucauuuauguuuaaugacaacccaauuauuuuuaucaugaguucuguggacagauuuuuggcuuuuuuuuaggagaaaaauguuauguaagaaauguauuaugggccaggugcaguggcucaugccuguaaucccaggacuuugggaggccugaggaggguggaucaccugaggucaggaguaugaggccagccugaccaacauggugaaacccugucucuacuaaaaauacaaaauuugccaggcaugguguggguaccuguaaucccagcuacucaggaggcugaggcaggagaaucacuugaaccugggaggcagaggcuacagugagccgagaucgcgccauugcacuccagccugggcaacaagagugaaacuccaucauaaaauaauaauaauaaugauaaaauuuuuaaaaagaaauguauuaugaaucuaggucagauuuagaaccgucugaacucuaggucauacacaauguuauaguucagugguugaugccuuuucacuguucacugugccugcgggucccaccccacagcacacagcacacgccuccuacggcaggcccggcaggcuccccagacaccaccacugacagccccuugggucucacaucacacucaugccaacauacacacaaagacguguagcuucacaugcauguaacggagcaacaaaagaaaugugucugugcugcucugcccagugccccuuagagaauguuccaagucggcagguacacaucugccucguucuuuaaagcugcagagaauggcagucaauaggugcgccauauuuccuuacgcccucgaggugguuuucauauuuccagcaaacaugcagucaccucggugguacacagggcuuggcugccugcccaugggcuaguauguccaucacucaguccuaguaggugcacagagauagaguuuuaucaaaaucacuagccucagaaucacaacuccguugaauccugcucagggcugcacagagaguaguguggcgucuggaggcccaugggcuucaguuagcugguacagaagcucggcaggccugguggggguuccgccaugcuuguuccaggaccacagauggaccugccucccagacucgcuuucugaccuccacuggcucuagacacgggccgucuugacccagcauucugcuuuugaccauucaaacuuaacaccaaucuugaugacuuccugcaaccuccaaugaucauacuguucccauuucuguuauuuuaugcuaaacucagcccagggagccaaugccaggcuuugccguaaucacacccagccuuucauaacaucaguuacugaucggaguacucccaaaggcggcacaccuagaacaagagcuauccaaaugcaccccacccagaggccacauucuaguucauggcuuaggaaaagcaaauauuguaaagggacagaggcuaaagcagacauuaucguucaaaaguaacccguuuccaccuaccccaugugauuaaagugcugcuguuaauuuccuaccaugugcugguaaaauuauaauuaucuuuaguuuuccaucuucaacacaagggacuuguaguauuuaaaagugcauuuccaggugccuguaaucccagcaguuugggaggccaaggugaguggaucauagaggucaggaguucaagaccaaccuggccaacauggugaaacccugucucuacuaaaaauacaaaaaaaaaaaaaauuaccugggugugguucaugccuauaauuccagcuacucaggaggcugaggcacgagaauugcuugaaccugggaggcagagguugcagugagccaagaucgcaccacugcacuccagccugggagagacagugagacucucugucucaaaaaaaaaaaaaaaaaaaaaaaaaaaagggcaguuccacagagcugcucccuggaacuccaaaguuaaugaaagacaagaugcuguguaaacaguggccaccuggcagcuccagggcuggggcccagaugugaggauggugaggcgucaggcuuucauuucccagcuuacuuucugcaguugcaacaacuugcgaagaugcagauauuuccaguuaaguggguuacagggaggcaguuuacucaacuauagaaaugggaaauaggcagacauacacaaaugacgcagccgccgugcuugugagcaccgaucugcaccacagcuauguccgcccucugccaucccacuggccagguggccaucacuccaugacuuucauuuguuccccacccaacaccucccccuagacaccaaaagccccuccaaggagcaacugcucggugacauaaacagugcaucaaaaugggaggaaccagaaaagaaaagauauccuggguaggaacuugcccuccucuacauaaacacagaauugguugccugucauccccacugagauugucagaacuucuauuaguuccagccuuuucuaaaaaggaauggagacguagcauuuaugaauuugguuauauucaauuuucugauaaauuagagaugguuucgucuccucuuucuaggggaaacauaucuuuaguaacugagcaaaugcuguccacaguguuauuuuauaauuuugaaauaacuccacagaguuauuuuauaauuuugaaauaacuccacagaguuauuuuaaaaaguguucguugagaccuagucuccuuugaggaauacaugccacaccaacacgcgucguguugugggaaguccccccucaauaggaccauuguccucuaugaggacuguccaggacuucagggauguugcauuugcacaggcugcagugucgaugacuuggacucaccagaugcagccucaguguucccuguggcuguguguagguuuccucugcaaagcuugaaguggcagacaugaccucagauugaguucuuuuauggaacucucacugucuuuagucuuuuauacuaaaucgcaucucauuugcaggcuggcaggguuucuuugcagaggcgccucuuucaagaggcacaugcguucuauuuagccuaacaggugcucccucggccacugcaaugaaaaggguacaacaggcaaaugaagaacagaaagauaacaggccaguucacaccacgagagacagcagacugcuuuuaagcuuuagaaacaugcaucucccuaaaaaagccuagccauacauucuuuucaucuguuugugucagcuagucccugaggacuucugcccaaggacuuuccuuacuccaguuauuuccacccuugaaaaacauaaaaucaaccuuguacuucuaaaauugcauaaucagaacuuccuaugaaucauauauaugaccucacugaauucaaaugagugauaaguuauuagauuugggggagggccggggagaaaggagguugcaguuucaaagcccuucacaguuauccauucuaaaauagugaucugcaugucagucuccugaccucagcuuucccuaagggugggcucuguggugagcuugcuagcaggaguacagaccuugccuggaagcggggucucagggagcccggcggagccuccacuggguccuucccggggugguugccagccugacucugggagcgccugggugauuccuccuuggccaucccugcgccuccccgacccuguuguguuugccacugagaaacagagaggaaaaaguuuugaucgucauuuugacuuaggguucccgccuaucuggguuucacugccaguggucucagaugaacccugagggugcauuuucuccuuaagucgugcauaacccucagccucccccgagucaguugaccuguugaccugccgcugggaacuccccuggaaaguuuuagcucauugcuuuggcucuugggguuccagcugccucagaggaauccugagugcuucuuaaguugucccccuuccccaauggguuuucuauaaugcccagugcauuucagaugguucaaagugcccaugcugucuuggacccuucagcagagauggcaacacguggugucuggggugcuuguuuuguuugcugaggaugccacagcauaggugugugaugcucguggcccagagugaagcucagauuugacaaauuccagggcacccucugagcuggccagucuguggcugugcucacagcucccacugaguguccagcugccagcuccugucaugccagguacuugaggauuccuagcuuagcuuaugacguggccucuaaacaggaccucauuuuuaaaaucacagaaguuugucuuuacuuuugagucuucagcuccaccuagcgugagagaaaguccggguccaaaccacaggaccacaacaacacacacaaagugaagcccgucucaauucagucuaaacaacaugacuuucagcacaccugcuccugggugucaagauaaccucgaaaguaaucagagaauggaccuuucuuauaccuguggcaucuggcauucugaauuuugagagcugaaccaugcauguucuuuaaaagagggaauacauugcuagauuuuuagagagcuuuacucuucuguccagauaccucaugauaugacucaaugauaaacuuuuucuuucaaaaaauguucaagggaaugagaaaacaaaacuuaguguuauaguuguuuucuauuuuugaaacagggucuugcuguguugcccaggcuggaguauggugguaccaucacagcucacugcaaccucaaacuccuggguucaagcgauccucccaccucagccucccaaguagcugggacugcaggugccugccaccaugcccgguuacauuauguauuuuuuguagaggcaggguuucacuauguuucccaagcuggucucagacuucugggcucaagugauccucccaccuuggcuucccgaagugcugggauuacaggcaugagccaccauacccagcagagauuuuuuuuaaugaagagaaaaaacucuaacuuaagaaaccuuaaugcgucuauuuugguacuaaaugaagauuuucaaaaccuacccugggagagaguuucaacaguugguucagguugucaacaccugaccccacgaucaaucauaaaagcaacccgacacucauaucuucuguaggagaagaggugcccagcauccuccgcaaaugaucccugcugaaaaggggaaccugcaccuagggcagccuccagcccuaaugacucacguggaggaaacgugggguuagaagaacagauuguacaacaccacgggggugagacugacugcagcccaccacaaagaacaucugcagcacagaugacccagugucuucaacaaccacaaaaugauacuaaaaacauagaaaggaagaagggacuauugugaauuaagugagaauucagaggcauagcauccaaguguuauauuuggacuuuuuuggcuccugguucuagcaaagcaaccuuaaaaagacauuuuugagacccaagucagggaaaauugagcacagacuggguuaauacaugacuuuaauaaacuguuguucauuuugugagauauaauaaugccauugcagucccuuuuuggaguuauacaucagagacaaaaauuaaaagcaaauaucuuucuugcagggaagccgaggccuggauggcuaucaagggccugauggaccccggggacccaaggugagcccguuucucaugucuuugccacuuauggugucucgcccacccuggcuggccuuacuccccucuugaugguguccuguggaggcauccccugcccuaaaaaguacaagauccccaaauacacggccucugacacuggacagacgagguggauggugaccuacgagccacgugugcucccugccagggagaagggugccaccugccacucagggccacguaggggugcgcucaggcacagaggaagccagcagcccuggggaaggcaggccuuguaguaacaagagggugcggugccccugguuuccaagggaggauguggcuugugugaguaauuccugggcuugcagggaggggagaccauuagguggaagaccaggugggugcugcuggucuagcugagaggggaacgcacccguggggaaccugggugggggcacaucuggagaggacuucugagccgggugaggcucaaagaggugaagguggugcgcgggaugcugccuuaugacaaaugcugccuuacgacacagauggcgcuccacggggguccugcggccgcaucaucucccagcccacccucgccaggcggcucggcuaucacuacccaaaauguaauagucugaacuacagaaagcacagucuccuggcauucgacaaggauuucaaaaugagaugagccccugccugucuuguucucuuugggcaccuguggcugguggcugggaugccaggcucugccacccuagcauggggaugcugccccaggcacugucugugguuccacugguugaaauagcugcucugccagccugacgguccacgcucggguuucuucuuuggaaauauguguacugucaaaaacuccaaaaggcuauucucacauccuguuuuucucuuuucuuucucuagggagaagccggagacccagggcccccuggacuaccugccuacuccccucacccuucccuagcaaaaggugugugaacaauuucaccugcauaguucagcaucgcauacacauucucuccuguuagggacacagagcuaugaacuuucaagacagauauucuaagcaacccuaaaacuuaaaguauaauaauaauaaaaaaaauaaaaaauaaaccacgaaauuuagaacauaacuucauguacaauuucccucaugcuuaaaugugucacagggagaccuucauguugccugugccugagacaguccucaccaccuacacgugagaaauccccuccguuggggaauucuuucacuucugcuuaacuuguagaguucuaguucugccgucuggacuaucgcugaagauauccagggcagcagccccagccgccuucggauuuuuucuccaaaugcaccaagguucuuaagcccucugcuugccagcccgacaccuggaauugaucauaacucauaaccagugaacagucacaugcuuucaggcuucaaggcaacuaaauucccagauauuuacacauaacaaccacuccccacugucacaguugaccuuggaguguaaacgaaggacuuugcgcaugucgucacuaaugcucaucuuguuauuaaggcucggcuuccaaauuggcgagaucauauggaaaucugauccuaguccugcaacuagagcacuuggcucugaaccuuguagaaugcgcauccuucuagguuaaaaaaaaaauguuucgagaaccuccuccugauaaucgugcguauauaucuuugcggaucauuggcccauguuauagucagcucugugaggacagacauuucagcccaucuuguucacugcuguauucccaaugccuggaacaggacaggcacagaguuggagcucagcaaacgccugacugagugacgacgugcagaaacauaucagacaggcauugugaaggguaggguuuuuuaaauacagacgcucugguguuuaccucuugaacucagcaggucaccuggucucccuguccucuaagccuaggugucaagaauucaccucccugcuucgaagcgagcccucugucaguuuaauaauggcuuugcaugucuucauccaaugcugaucaaaacgcaggacagaacagggccaugggcagugccuccaggagccccugagaugucugucuggggaggcguggagccgugaauggggauauuuugaaauccaugcucagcuuccaugaugcccguaacuacgaagcuggcauuuccugccucauccauggcgcacaccuggcuaccaaaccugagacccacuaaaaagagccaugagcccacuuugacuugacucauuauuaauaauuuugguaaaaaggaaauaugcuguuugagauuuuaagaacauaauuuuuaaguuaaugcuggcgauguuucuuuugcauuuuuuaaaaauguugcugacugagaacccaacucucaccaaccccucccuucucaccguacuauauuccuggaauucacacugcaaaggcgggugcuuucaaaauucacuuuuucccacaagcggauucagaaaugcggagguugccugccgccuuuucuaccggacaacauucccgaguuauuggugagcuggaaugugacugacuugcauuccaggguuucuuaaagucaaagguugacuaaccagcagauucccucagggaaaagaggcaguaaauguaucuuuuucaagguaacauugcaugaacuugucaaaagacaaaaaggauagagggguuuguauuaaaagaaaugauuccaagguaccuagaaauaaaaguaaucuugcuauucuuccaaacaagugagaaggucuguggcuuucaauuuugugucuuuuuauggaaucaacaauggcuaacaggaguguaggucacacugugugccaggcgaugcuccaaguuguccuaguuguacuuuucaguguguuuaccccucugggugacccugugagguggagauggacuuggcugcuuuuacugagggagagauggaagcgcagggcguugaguuccuugcccaggguugccuuuaaguggaggagccagguucaggcccagggccucuggcugcggagcgcagcccccugcacacucggcacgaagcugcccgagcaggagacgccauacacggaagucaggccuucugucccuugcacgugggacuucagugugacgcccagcaaagcccucuccuuauuuuaaggaacuucguaagacgacaugcagagugaaagcuuuccuagaaauuccuaaugccuacaugauaaaaaguccuauuuucuucucauucuucucaucuuucccaauuauagucuagaaaaaaguguguucuacaguaaagcguugcuauuuacacagcaaaggaacauagccaugccacuuugucuuuguuuguucaggggugaaaguuuuuaaaagccaaauuuuguuaugcauccagcagacagggaugagaagagccuaauaggguuaaagcuggggcugaggggcagaguggggugcagggaagugaggccuccucgcucccaggccaccagcagaauuggcaaccacauuaguuccuucuuuauucgagcuuuggacucaccuacuuccucacccgguuuucacuaauccuguuccccugcuggagaaugagccccuuaaaaagagagaccaccccauguauuaaucaucuuaacuccucaucaggccgcauacagcauauggagcauuugguaaauauguagucaaugaaaaagugaacgccagcugcgauccguagaccacggucuuguucuuacugugggacuuguuucccuuccaggugccagaggugacccgggauucccaggggcccaaggggagccaggaagccagggugagccaggagacccgggccucccaggucccccuggccucuccaucggagauggagguaauguggcuucauaauaucaacaccggagacccaaagcaccugcacucagguccuagcacacacaagggagacuucguugacgacguagcuaugucguuguuacuuuuccccacugacuagucuuagcagcucuaaggagccccgcacacaugcuuuggacaccuucacagaacccucgcacauaugacaguaacuccccaacuagguuagauggugccacgauggguaacuggcaugcuuccaccuguggguugggaagagaacggagaaucaucagguguuguugcccaguguugaucacaacuaucaagccauuauuugaggggcaaggagagggguguuuuuaauguugaaaaaggauaaugaacuauaccaauggcuucuacccaucggaguuauugacggggccaugaagcccgcuagugccccagugggccccucuggacacgaacacaaaggcagcggugugguaugggagacucacgcugcaggugaaugcuguuugguuucagaucagaggagaggccugccgggugagaugggacccaagggcuucaucggagaccccggcaucccugcgcucuacgggggcccaccuggaccugauggaaagcgagggccuccaggaccccccgggcucccuggaccaccuggaccugauggugaguggagggaaacaaaagggaggguguagccuaauguucagaugaagcccggucccagccggauguuauuugggauucucugcuaaaugacucugggaacgaauccaguaggccagugauuagggugcaguggauccagguagauuaggguguagugggugcucucugggguccacgcaggagcuggggauggaagcugaagcccuguaagccugugaguaucacagccccguggaugccacacagugagguuuaguugcugcagcuucggugaaauccauccuucagcgaaacaucugagcugcgcagucuggaaacagaugugagcugacauugcugccucugugucggggugauacauuccacaaaccuaauccagggugagggcucacccuugacuggcagccucucuccuguguuacuccaucacguuuaagccaccuugauaaucugccuucucagcccgugcacagccaaagcuacaacugaacaggugagaguagcuggugacaaaaagagauggcugcauuaucugcaaaaauaagugacagccgucccccaaggcccagacaaaugcccaugaaagucaauaaagccggcaggcacaggaguguggacccaccugccacccaguagugcaucccugagucagcaaagaugcucuuucagguuauaacguuaggugacucaacuugaguugagaaugaccugucucaggcagcagggaaacaugcagucccgccuggagcuugcugucagaaaaggcuguucuuucagcuucagcauucagagaguuaugcuuuaaagaccaagcuuguccaacccacgggccacaugcggcccaggacggcuucaaauacagcccaacaaaauucauaagcuuuuuaaaaacauuuuuacaauuuuuuguagcuaaucagcuguauuaguucguucucacgcugcuauaagaacauacccaagacuggguaacuuauuaaaggaaagagguuuaauugacucacaguucugcagggcuugggaggccucgggaaauuuacaaucauggcagaaggggaagcaaacauguccuucuucguggcaucaggaaggagaaguaaggagugaagaggggaaaagccccuuauaaaacuaucagaucucaugagaaacucacucacuaucgugagaacagcaugguggaaacugccuccaugauuccauuaccuccugugaaccagguccccaccaugacaucuggggauuaugggaacuacaacucaagaugagauuucaguggggacacaaaaccuaaccguaucaccagcuaacauuaguguuaguguauuuuauguguggcccaagacaauucuucuuccaauguggcccagagaaggcaaaaaauuggacacuccugcuuucgauguugugaaaugccuaauaggaauauuucauucucucacaagagugaauauaggagacauugggagaaaauaagaggucauagucucuuucugugugacguugaccaaaaguuaacagccucuucuuuccaaaguaguuuacuuuaaauucccugacauugccccuaauaaucucuuacagccuccuaccuucggggaggaaaaacaccauguuugcuaguggacaguguuugguuucaguaacaggucaaagucucuguuuuguuuguuuguuuguuuguuuguuuguuuugagacggagucucgccugucacccaggcuggagugcaguggcaugaccucggcucacugcacgcuccgccucccggguucguuccauucuccugccucagccucccgaguagcugggacccaggcgcccgccaccgcgcagcugggaccacaggcgcccgcccucacgcccggcuaauuuuuuguauuuuuaauagagacgggguuucaccauguuauccaggauggucucgaucuccugaccucaugauccgcccgccucggucucccaaagugcugggauuacaggcaugagccaacgcgcccggcccaaagucucuguuuuaauuguuuguuuuuggaagauuacuucucuuugacauaucuagaaggaaaaucauuagaguuauuagaggcaaugucuucuauuuaaaagguaguagucacuucucugugucuguuuuauauuauaaaguaaaauuuuaacuuaauaugcuuucuacuuucucaauuuuucuucaauuagaaaacccacauauucucacauuauucugaaaauuuuuaggugcagauauuucccuggaucaugaaccugccaaagagucugagcagugugaacuuuauuuuuuuauuuuauuuuauuuuauuuugagacagggucucgcucuguaucccaggcuggagugcagugguaugaucucugcucacugcaaccuccaccucgugggaucaagcgaucuucccaccucagccucuugagcagcugggauuacaggcaugcaccaccaccaugccuggcuaauuuuguaauuuugguagagacggggguuucacuauguugcccaggcuggucuugaacuccugagcucaggugaucugcccaccucggccucccagagugcugggauuacagguaugaaucaccacaccuggccuuuaauuuuuuucauuauccuggacugcugugauaagagcuagguuucuaugagcauuauauuuccuaagcaaaugguaucuuuugaguuuucuuuuucuggagcagaacaugacauguuaaaaacaaaagcauacaaauauuccacuuuaacggccaggcaugguggcucacaccuguaaucccagcgcuuugggaaagccgaggggggccgaucaccugaggucgggaguucgagaccagccugaccaacauggugaaaccccaucucuaccaaaaauacaaaauuagccaagugcgguggugcaugccuguaaucccaguuacucgggaggcugaggcaggagaaucacuugaauccgggaggcggagguugcagugagccaagaccgcaccuuugcacuccagccuggggaacaagagcaaaacuccaucucaauuuaaaaaaaggaaaaaaaaauccacuuuaaagaacggugaucaaaggcuaacguugccauuauuccuguaacuaaauuccauuuugauaaagucacagcauaugccaucuugcuuuucaagucuugcuuaguaaauccgugguuuacuagcauaagucaacugcgaacaauuuaauuucugaucuguagugugggcugaugaggaaaguaauaaaaugaauggcaucagaucaauguuagcagcuaaaaauguuaaaagcauacaacuuaaguccucuaauuauauauauuaccccugugagacacaugguuuccaaaucaacauuuuuaaagcaaguucuuaugcaaaaaguaguccaccauaauggccuuuagaaaaugugugugugguuguaguuuaguaggaaugaccuugauucccauggaguucucugacuuuuccccuggaaugaaauuguuagauuccucucuuguuaacuacauuucauccuguuuuauagguugcuacugaugaaaaccagaguuuuuagucuuuugcagcuccaguaaaaucaaaccacgaagacaguuuucuuucugggugaaauauuuugcuucccccuguucuaguucaguuagcugaauugaguucugggaaguucuguuccacguagaaaaagucaaaauaggccuggcuuguuuggccaggggcucuuuguggaaaucauguugcaaacaucuaagaggcacacugcuauucuauaggacuuauuuaaaaugacuaauauauuagagaaaaggagagcagcagggggcagaggaaggcugucacccucagagagccacugugugccuuuaggacuaaauuugcaaagcauccagugcuuccauuguaaggagcgcccacaaucucuuuguccugaaugaaugacgugucucagauugacaauggugacaucucugaagugugugugguuaaauuucucucuaccugcgacacugcacgucucaucacacagagggagagcuuggagacagagaacaaagcucacaaaaguccacaacugaccggacacgcagcugaccuggucaccggucacccuuuguccccagcagugcggggugcggccgccucuccuccugagacgcugucuucuccccuccacucccgggaaaucccacuggcccccgacaucucuccccugaagucccugccccucccugcacuccccgccggaugaacucguccuccacaugaaaguacaugcagugugugcuggucacucgcucguuuccucucuggcccuguucugugugcugagcuacuaacagaaaccguuaacucgacacagagucaacccuaugcacgugucucacaaaugccucaagcucuccauguccaaaauggagcucugggccuccuccguccccacccccugccaccccacagaccucucccuugguccucacccuccugcacaaacccgggagcuccagcagagcccugggcuacucugccuaccucacccauucuguacuggcucccucacaauccuggcggguccuccacuccagugcugugugugcccuugcuauccaccaccaccgcccgcguagccugcuaggauggcacccguuguuccuucccucuccagccugucguccacacggcagacucacauggcagaccgcguagccucccuccuugaugcccuuuaauggcuuccuacugcccucgggguaaaagccaaguccgguuucuuccccucccuuugugcaaaucugcccuucacucaccacucugcgggcgcuggccuucugccuauuucagggccuuuuagaaacccuguccucacucuggagcauucccucccgcuccccacuucaggggcuccuuuuuauucuuugggcuuuaauugaagcaucacuuccucagaaaggacucagcugacuacccccaaaacauuucacugggccucucccugcugcuuuuccccuguuccccagcacgggccauaauuugaaaauccgcauuaguguguuuccugcauuguguguuuaaugugugucuccacgucuaagcuguaagcuccaugagaguccaucgguuucauuuccaguuguauacacacagcaccucgcacacagccuggcacagcauaggcacgggauaaguguuugaugagcgaaugaaugaaugagcuaugguaaacgugcagugagcaaacuacaugggacgguauccauguccucauucucauagacauuuauccucaccuggcaguucucugacuugcaaacucccgugcucuuuuccaagcagauagcuggguucuuuaaaguuggaguuuucucaccuuccuguguguaacggccucauccccugcuccucucagguuccauguaguguguauagcaacaugccuuuuaauuugcugggggagugccauuugcccauuggagcucuggcccuauuauuuaacagugaggaggacagauagcugcagggcacaccugcagagccugcccccagcagcagcuugugugucuugcagacacacacccuccuccugccacgagauggcacucuucuucuccagugcgauggcgcgcucuuugcuggugugaagagcaccguguuucuugcaccgucaucaucagggaugcccccgccgggaucauugagcccugcaggagcuaguggggagagguuuacaaggggaagguggugggcgaggucauccaacauggcugaccaugcugaauccagauuggccacaacauuuaauuagcauaacaguuauccuaacuccgugugugugcauguaaggcaugaaagaggaaacaguguucuggagggaugcacacgugugcccccauucccauaucagaaaaagaucaaaaugggaaacugaguucaucuuuuuuuuaguuuuuugggggggaaccagaaguguguagcagucuuggaauccaaguuacaugaucaaaaaaucaaaacuuuucuuuggacucaauguuucucaaaaggaauaauuguuaucccuauaguuuaauggaaaaacuaaauuugcagacucuuauauuucuuuccaacccugaaggcuaucgccacaaaauagucuaaguuuucuuuugaaaaaaugugcuuuuguuuaugaaauuggguuuauggaucauuuggggaggcuuggcugaaagccacccugggcugggugggacaccaggcgucucuguggugcccaugcccugugucuggggggacccugggcauccuugaugcuggugccucacaacugggugggaugccgggcacccauggugccgaugcccugcgucugcguggaaccccaggcguccguggggcugaugcccugcgucugcgugggaccccaggcguccguggggcugaugccgugcgucugcgugggaccccaggcguccguggggcugaugcccugcgucugcgugggaccccaggcguccguggggcucaugcccugcgucugcgugggaccccaggcguccguggggcugaugcccugcgucugcgugggaccccaggcguccguggggcugaugcccugcgucugcgugggaccccaggcguccguggggcugaugccgugcaucugcgugggaccccaggcgucguggggcugaugccgugcgucugcgugggaccccaggcguccguggggcugaugcccugcgucugcgugggaccccaggcguccguggggcugaugcccugcgucugcgugggaccccaggcguccguggggcugaugcccugcgucugcgugggaccccaggcguccguggggcucaugcccugcaucugugguugucucucuaggcuuccuguuugggcugaaaggagcaaaaggaagagcaggcuucccugggcuucccggcuccccuggagcccgcggaccaaagggguggaaagguaagaacaucugggagggacgggaugaggacagccuggccuuuccaagucccucaccuuacagaaggugaaauccaucccccacucacguguuuggacaugaaaaugagccugcaugucucucccagccuccuguccccuuggcgguggcacugagagggaggcgcauggagccaguggugcugucugagcacucggcccccaggcucaccgucccugcucuccaucugccauccucgucacugaccuuccuagcagcagugagccugaugcugaguccugugcuggguuaaaagggaaaacaguuauuucuuaggcugcacucagguagugucucaagggcucagcuccaaggcauuguaacagaggucuguagagagcucuguccauagcaaggugcugguauagucaccaucccugguccuacugagacucgguagagugacgugguuugcccgggucucccuucccguugaugaggaggcgaacuuggaacagguggucuuugcaccugacccuuuccagucaccucagggacucugccccuagcucgaggccguccucugugaggcucugugggcccugguguggugcaggcugugcuccugcucaccucuccccucccagaacauggggagcacuuccugggacuuaccacgucuuggccguuuuggcguauguaggaugugcagugcauucagcaccccgcuguggaugggcaugaccugagagcaggcaccgcaggaccuggaggaaguggggccuccccacugggcauccucugugcccugggggagccaaccccugccgccagcauggugcugccuugcugcccaacucccuggguucagcuguggcaaaacagaggaagagaggucaggcaugucuucccugcucaccuaugaccuuucaugaccuuggccucugaggccagggcucuugcccucccugacggcucccuggagccggcuccuccccuuggcccgcaggcccagugguggcaaucuucagcucuaagcacugaauuccuuaaccuccuucacacuccccgcaacucaaccuaugccucugaauguggucccaguuuuuaaguaucuuuaguaaacaucagagucaaauucugaaccccaugagacuaugagugaacacuugagucacuuagucugagccucaguuuucccaucuaagaaaugggggucauagugcccaucagaacaggcaguguccauaaagcaccaagugugccacccagcucuccccgcugccugauaccccucuccccgccacgcuaagaggaaugcggaacaaggaggcccuccucucccuccucugcaggugacgcuggggaaugcagauguacagaaggcgacgaagcuaucaaaggucuuccgggacugccaggacccaagggcuucgcaggcaucaacggggagccggggaggaaaggggacagaggagaccccggccaacacggccucccuggguucccagggcucaaggugaggagcaauuucaucaugaagcuggcaagacacucugaggccuccccaggugucccguucuugccuuuuaucuccuaaguuuacacagcuucagaccggcaacacucauggacccaaggcauggcuaaaccauucuaaaaacccacauaccccaaggcggacuuucuacauguccacuggugagacugagaaggggcgcugcugugggaaccgcagccgacagcucuugaaagaguucaauagggggucaccacgugacccagaaaugccacuccugguguauccccaagagacuugaaagcacguguccacacaaacacacauacaccaauguucacagcagcauucuucaaaauaggcagaaggugaaacuauccaaaugugcgucaccugaugaauggaucagcuaaaucuauacagcaucuauaccacagaauagcccugaccuucacgugggagcaaggugcugagccauaccacacuguggaugaaccuggaacauguuaugccauggggauugagacccacacagaaggacacaugcuaucacauggucucucauucuauucuuaugaaauguccacacaggcaaccuagaaacaggaagucgauugguggcugccacagguggagguggggguggggguggggaguaccugcuuaaugggaaugggguuucuuuuugauauaaugaagauguucugaaauuagauaagagugaugguugcacaaccuugugaaaauacuaaaaaucacugaauuuuaugcuuuaaaacagugaacuuugugcuauaugaauuauaucucaaaaaaaccuaucauuuuuaauguaaaggacauuauuuauuuaucgaacauucgccuucugaaguuuagcaagaacugauucagcauuguuggaaggcuuccuucaccugauaaaaagcaagaccuuuugauuuuuaaacugugcacgugcuuguguggagguguggaccccacacacaucagcucauggccuuuauucugugccuuaugcaaaggucaccugcagcagaccuuucuuccguggcagauuuuagcugaccaaagaguucaaagugaauuucagauguagacaaagaaaguauacuuuuuguugauuuuuuaacuuaaaaagagaacucugggaaauuuauaaagcaaaaaguucauuauuuaacauauucagcaauagaggaaaaacaguuggucaggacacuuggccaaggaaacuuaaaggaucugagcccacagcauggaaggaaccgcagccccgcagagcuguguugcugacggccaugacucccaacugcuucauggcacggagcugugcaggugaaaaugagacccgggcaccucgcugauccaugcccuagguuuucucagaaaacagauaggaaaauucaacaaaaaauagcaggugcucauuuuaucccagcuuaaaaaggaugcgaucucugaaucauggcugucuagcaguaaaaguggcucuaguauucagaaaaagugcguggggugagaacugcacauauaccaauggcaaagcuaguaggauccucaguuguuuaaaacgugaccgaauauuucccagaagccaaauggaccccauucugugccccugaaaugucuaaaaccuuccaagcacacacguccacagaacuuuuguucacacgccucuggcugugccugguguccugcacugaauucuaugauuguguguauggaaaccacacugaagugggaauaccugagaccauuugggaguuuuuugguuaguuuuuguuuguuuguuuuuauuguuguuuuugguuuuuaauaucuguacugguagaguggcagggcgcuugaagugugggagugggucaauaagcccaucccuccauccauauacccaacguguauugaucgauugggucuggucugugugugaggaacucuccuagauucuaaaguaauguugcaaagcacuaaauaaaucaagaaucuguggaauuuucuagaagggaaacucccaauuacuuucaacauugcauuuaauuaaagcaacuccacacauucccauauucuuggaaauagcgucaaccaagauaugucaaaagcuagcacagcucacguuugaaaacacaacgcugauggguacccugcucaucguggaaagagcuagacgcgauuuuccaggcugcgauuugagagucccugcaggcagcuucucucuaaaguaucuuuuucucucaaccuuaaccucagugcaggaaacaaauuucuauuaaauaccauuuauuguucucaauauuaucacaaaauuuuauccuccauaccuggauuaaccugcuuggcuccuaaacgacuguguuuuagaggaagccaccuugacuuuuaauucagugcuucucaaaaggcaccgagcccguggaucccuggggccucuguggacacgaaggcaaugauucagcugccccgggcuggggccugcacaucugcaccauugggcagagcccagggacacugaagaugggccuaggaccuggguuucccuguccaaccaccuguggcuacuuccacugcauuguauuuacuuauuuauuuauuuauuuauuuuuggagacagagucucacuuugucacuuaggcuggaaugcaguggcaagaucucggcucacugcaaccuccaccucccuguuucaagugacucuccugccucagccucccgaguagcugggauuacaggcgugcaccaccacacuccacugccacacucggcuaaguuuuugcauuuuuaguagagacaagguuucaccauguuggccaggcuggucuugaacuccugaccucaagugauccgcccaccucagccucccaaagugcugcgauuacagaagugaaucaccgcgcccggccacauuguaauuauuuaaaauuaaagaaaagguaccauccaguuccucagucccaccauccgcaguuccagugcuccacagccacuguggccaguggccccacacuggacagcuggaugggggcguauccagcaucgcagaaagugcuccuuggguggcgcucgguuuggugacgggugacugccugccagcugugugagaugaaaaagcuugccagccaucuucucagaugcccucacaguacaaagaaggaagauauuuuuuugucuguuuuccacagggagugccuggcaacauuggugcucccggacccaaaggagcaaaaggagauuccagaacaaucacaaccaaaggugaguuccucucuggccacgcggccccuggggcacugagccuuccugugggcaccugccugggcagcuucacaugcaaaucccuuucuaggugagcggggacagcccggcgucccaggugugcccgggaugaaaggugacgauggcagcccaggccgcgaugggcucgauggauuccccggccucccaggcccucccgugaguagccacaaacugcggcagcuccguccucucuucuucauccuucagguucuccaaacaccccagaagcaaacaguauugacaugagcacuaaaccaaccugugcauaggacaggcugcucauucugcucauucuauuucuaaugagcagaaaucagacuuuuuaggaaacggugaauuaaguuagaagccaagcuccaaaugaacauuuaaaagucaacaaucaaagaaauauuccuccugguguaacagacuaagaacccucccccgccaaaaaaaguagacuauucuaaaaugggugguggaacccuauuuuuccaagguaaaucaugaaauauacaauuucauuuuugcaacaaacacacacugguguugaaggaggggcuaccuaguagccugcagagaccccagcaucauuuccucaggggaggcuggggucagaggcgcgggaggcagccauggagggagacaagaccccuuccugugcacccuccagccucugagccucuccugccaccacgccuuucccacugccagcucuggagcauucucuucucagaaggaccuugcaaccuuauuucucacgucuuuuuuucuagauuccauuuuccucccucuagucaccaagccuguaccuccuuaagcucuuuguacugguuuccuggggcugaggucacaaacugccacagacugggcagcuuagacaucagaaauguauggucucacagcucuggaggcugaaagccgacaucaaggugucugcagggcugguuccuucugagacagugcgggaggaucugucccugccucucucccagguucccggagcucuggcauuccuuggcuuauagacggcugucuucucucugucuucucaucaucuguccucucugugugucugucucugggcccaaauuuccccuuuuuauagggagagcggucauauuggaaugggcccauccuaaagaccucaucugaccuugagcacccucaaagaccuuauuuccaaauaaggucacaugucuagguccuggggguuaagacuucagcaucauuggaggacgauugaagucauaauccucuuucuccuccucagagccucacgccugaauucuauucgcagcuuauuugccucauuccauaacccaugucuucucuaguuuuaacgugggucaugucuguaauaacacucuugagugcagugguacaaucaaagcucacugcagccucgaacuucuggacucaagccauccuccugccucaaccucccgaguaccugggaccacaggugcacaccagcacacccaccuaauauuuuuaaaauuuucuguagagaugagaucucucuauguugcccaugcuggucucaaacuccugggcucaagugauucuccugccuuggcuucccaaagcacugguuuuauagacaucagccaccacacccggcccacauuuuuacaauuuaagugcaguuuuuuggggccagagaacacagauaauucuaugauuggguaucuuaaaaaucucaucugggaggcaacaggguuaaauaagaggcaaagucauaauuggucacuuuagccagaagaggaggaugagugaugauuccugugguuggaacagucuuuggccuguucagugucaugugggguggggguggugaguguaugugugguguguggugugcucauguguguaugugugugguccguuugagucuggauuuguuacgguagugguggccuucccuggaguuggugccuugugaaguuggugaccaggaggugcaccuguccagccaugggguucacccaccccugcggcucccaagccuggcugccagucccagcccagcugggggcagguggucggagcaggguuagggguaggggugaggguuagggucagggagaaccuugcagccucagcuucccauucucgggguguagggacuuucccagugcuugugugccuuccuuguuugguggcaucucuaaaccaagaaugucaacuucugccuuuagaaaacucgugauccugccugugccaccuuccaguggcaucauccccacugcuguccacuaaguuuggggcaucugcccugugaucucugcaacagccuugugucccccuccccugugaaaaaaagcuaaaacacagggguacaccacuuaaucaaggucucauaaauagagcuggaccggugucccugccccgcuccgucaugccuuugacaaggaaggggcuguggugucaguggagagcaggguuugauuucuuauaagcagcugccucauugucaugagaacacccagccucgucccguggcucagcagaugagcgggagcuuaugcgcauggcuguuccaccagcacguggggacagcaccgagccgugccguggugugugcgcagaucacaccagcaucacugcugccagccuccccaccccaucccugcaccucccaccagcucccccccgcacccugcagcuggugcuuucauccacagggcagccccucuccauucccaauccuguaaucucuccugacuucugaggcgcacacggcucuuuccuuguccaaauuagcuuccuuuccuuuaacaacguagcaucucuuaaaauaacagccauuuuaccgaugcuaaauuauaacaacaaaaucauguguuucuuucuccacccacaguagaacacaaaagccugugccuucgcuguucuggagaugaaggcccaggcugaugcaggggagcuggcgggugggaagagagaaaugcucaagcauguacaugugccuuccagaaccggcuuccguggcauugcuuagacugcuacacagucugucacuggcuccugugaccuggcugaccauggcacuagguuccuguucaucucuguugucuuucuguucuggauccauagcucagaauuccgggaaaugggaaaggaaacagggaagucgaggcgaucuuuaacauuaguauauauuuuaagaaauaaacugaauuuucacacagggugauggcaucaagggcccuccaggggacccaggcuauccaggaauaccuggaacgaaggguacuccaggagaaaugggccccccaggacugggccuucccggccucaaaggccaacgugguuucccuggagacgccggcuuaccuggaccaccaggcuuccugggcccuccuggccccgcagggaccccaggacaaauagguaugaaggaauccucccuuuuaccuuucacaguccugagacauuccacgcuuuccuuugucaguguagacguuucccaguagagucagaugaggaugcuguuuugccucaucuguucucgcacguacaagggaugacccaacugugagguuucugagcccccaccagccuccccucagcagcugaaacaugcagccucuccuguaggacuacagugacagaggccuugcccggaaguucagagauggcuuucccguucccugcccauuucaaagccuuccugcccccaccagcaacauauacgacacaccuucacacacgugcacgccccagacgagccaguaacucuuaucuguuucaaaauugccucacucuguccuuaugucuuccccccagauugugacacagaugugaaaagggccguuggaggugacagacaggaggccauccagccagguacucugggaagugcagguggcuuuaggacacuagagaacucucauuuggucugcugguuaagcucuugcaguaugcgugggauaagaaauauuaauaauaugugcaagccacguuugauuuccauggcacaacauaguggccuggugagcacuauacauugcaugaaugacaaccugguagagacggagagacauuuaaccaaaccccucuugucagaaauccuuuuucacuggaaagcaccagugcauuccaacucagcuccacaggcacgugugcugccaggaggguccaggcagaggaggcugagcccagcccagacgguggcgaggaugucaggccaagaugggagccugguccagauucccaggcacacagacaaaagaaagcuccaagagugacuguucuugcaagagagccucuuagacaaagggcucucacaauaccccagcuggagugucacugcucccagccacaccaaccagaagugcccacagccuugauuuaauuuugcaagguggcugauugcugugguucacucugaaaguaaacaaagucacaaaggagaagucaaauaauucauuuugaaaucgcaggcuaucuccauugcuggcagaugcuuccagacaaaagaaaagcauccacacugacuugcaggguagcagccagauuaacucgguuugcacccaggcuacugcccugcaggagggaaucaauuguuugccagcacagugccaguuuuuauuugacuagacuggcuuaguuugcauuuuauacgaauauuuugauuucauuacacaaugaaauuaaacuuuuauuuacaucagaaccaagaugaauuaaaucauuaaguuacucugaucccagaaugguagccgguuugcacagcucgugcuuuugcccuuggggauccccaaggccgugggacucaguguuuaggauugcuugggcucaucuuuucuccuuucuguccccagguugcauaggagggcccaagggauugccaggccugccaggacccccaggccccacagguaaugcacggagggaaccuggagugcacccagccuuccucccacaucuucacacugcugugucucccccgcccaucuuuccucugguccugcaucccccaccccagacauggucguguccagcaucucagcacaaacuggucuugcgccuacagggagcccacugucauuugccacuauagaaaaaggagucugguagcugacacuuaguuggggccaggcuagaagagaaaauucagccauggcugcaggggaacgcccccaggggcagagauggaagccucguguuuaggacuggaaagggguugcacuucuauguauuuucuuuuuaugccuuuccaucccaggaucuaggggaagaaccuacaggagaggaugcuuucauuuggguuuugauuaacaggaaacgggaauaaacaaggcuagaguguuuugucucuagcaccugggaggaccugggcuucuaucugcuggcccaggccaucucucagcccaugugagaaagagucugggugcccuucacagagcccaugccuaaggccgccugcguguccaguguuggcggugcaggccuggcuggccaccacugccgucccgccugcgcugcgauucugcugcccugcacuccagggucuccgugggccugugagcaucggggaacacagagccagggcuuccacucaagcaggaggagggcuggacccugagagguggcucuaugccuguguccaucagccugagaaaagcaaguucucugagcaguaggaauuccccuuuggaugucucuuccacucggccugugauggggccggggaagcaugucacuuggguaacucagugucacaagcaccagacacagccagagcuguucucacuuguuucuucuggaacuaaguccccaccuaugcaagaugaauagugcagacagguguucuagaugcuuccugcugcacaaaucaugcccucacugcuucccgugauaaacuguagagagcgacaccaguguaguaugaacagcaaugagaguuaggaaaguggacggacacauucuaugugcccugcaccuuaagggggucuucggagugcaccgugaucacagggccuggggagcacaggacaaaugcagagguaucauuugcacugugagcagagguaaaggcuccuuguguugucuucugagaacugagcuuguaucuuccgcguuccauuagaccugcccccggucuaauuccauccauggauuucaacaccgucacucauacagcaacccccaaaauggugacaacucugcaugucucagguggucagggagaaccagaggccagcacgcucagcacacacccagacuacagccgugugccaaggccggucuccgggaaagcuccagugaugcgaguguggguuucugaggcuccggggcucccccagccauacccaguuauuuccauuucaugcccaggcccccauuacugggagccccuugcuggccucccauccgcuccucccucucacuccugcuguccgcacuccacuuucuaagagugaggguggguuugaucacacacauccccuucccaagaggcgccaggaacggggauaaaaaaguguggcagauggguuuugugacauggcugaggaaccucagcccuucaauuaucagaaaacacuucuggagcccacacacugggccaagcaggauucaaguguuugaaaagagucaccucauaguccucguggcguccucaugaggcaggcgauccuucuccccacuuuacaggugaggaaacugaggcacagaaaguuguccacggucacacagauagaaugguagggccaaaauuuauagccaagcaucugaccccaccuccaaagcccucauuuagagcacuguagaaucuaaauauuggauauuaucauucuuaugguuccaguccguaaacaggauuuuaaacacugaaaaucauucuguaagccuggaggugcuguuucaggcugauauuccccccagccucaucauuucccgguuucaugagauccacauuaagucagaugccaagcaugaccaugcccauuuauccucguggagccugaugugguuugugguuuauuugguuauuuaggugccaaaggccuccgaggaaucccaggcuucgcaggagcugauggaggaccagggcccaggggcuugccaggagacgcaggucgugaaggguucccaggacccccaggugaguugagaucagacccccauucagccccuggguuccagcgggaaccugugugugauucauaagcauccagcucuauuaucuuccacuuuguagaagcuguuuuaacaaauacuugacaacuuuugcauuuguccuugggagauuagaaauucuugauuuuucauaacugauauuguacuggguuuuugcagaagcuaucuacagaucuugcaggaaaaaggagacagguguuucggaauggcuguccuccgcaacaccugucucccagguauguccucaguguuaauaaugauuaauauuaaacauucuaagggcaacacaaaguuauccucuccugaaagaacccuuaaaggcauaaauagcccucucacaauguggcugcaagagcuuaaggcauuaaucuguauguggaggaaaaugagguuucccuuaaccagcucuggugaggaguacccacuugcgugucagcaugcucuggaaugcagccaggcgucugcagacauaggugucuugcaguugugccacaggcgaugugcaugagugugauggcacugccuugauugcaggggcauacacgucuuuuuuuuuuuuuuuuuuuuuuuaaugaaauggaaucucgcucugucacccaggcuggagugcaguggcacaaucucagcucacugcaaccuccgccuucuggguucaagcgacucuccugccucagccuccugaguagcugggauuacaggcaugugccaccacaccuggcugauuuuuguauuuucaguagagacggggauuucaccauguuggccaggcuggucucaaacuccugacauuaggugaucugcccgccucagccugccaaagugcugggaugacaggcgugagccacugugccaggccgcacacaucuucaauaguguuugucuaaugaaaccauggaagccauuguggacaacuuuccacccgagaugaaacauccuuccacaggguccugggcagguuccugcagccucugcuggagucccacuugucaccuagaaccuguggcacauuggaacccucuuguugcuagaaaguuccucccuggaauacagccugccucccagggaguucucaccgggcuguuccugagccacacaguugacuuccucauaaccacacacccugagagaggcggccacaucucccacagacgucucaugaacaggcagaacugaccccgggaacacauacuuucuuuuaaugacaucguuccaugcccuuggaauucugagcaaccuucuaggacccccacuuaucaggauucuuuuccaacugggcucuagaaacugaauaaagcgcuccccaugucuggaauaucacacagaacaucgggacuguugcgcccuuagguugaacaucuugcaaauguucccagugaagacuaauugaacccugccccuccccugaccuccacucagauagcugauuuaagccucaaugcagaagugucuguccgucccugauagaugguaucuuucggaauuuuguguugcagcccguagggauuguuccaaacccugacccuguuuccuuucauaugaugcguuucuccauguuuugcaaaauugggaagcaggcuuccugugucuguaucaaggcccugguaaaaacaacucugcauucgaaugaagcaaaggaagucuccaugccucugccccagggguuggucucugugguuuuguugcccugcuggaagugucuaaauauuuagaaguguaacauugccacucucaugauuucauauauacuaaguuuaagcauucaugauuuugagagaaggauaauaauuccugaacagcuucuugcugugaguaugaaaguucucugguaauugugauuggagugcccagccaugugugcgugaacgccacacggggcuccccuguaggggggaauggaugggaugcacccauuaucaggugauuuggacaguugcccacgugaguugggagccuguuccaccaucaaaugugagcccuuacgucaugaacagggaggcuggggcaggcuggggguggguggugauugaggaacugaucaguuucugaaacgcaugucacuuuuuauggugcugaaauauacugcccuucugucgccacaugcagaagaggauaaaaugcccaauucaaggauugcaaaaaucagagagucuauuccagaucuaagacccacacaugcaaacccaagugcauggcucccuggguacaguuuguaacauugccagugaaagucaugucucuucauugugaguaaaucacaccguuaaaacucugaguacggucuagcugauuaacgucagguuaauccagauccuuuauucuguauuccaguuacucccagcucccaggcagugauggcuuuaccggcccaggagguccccgggcccugcucauuggaucuuuuuggugggauacaccccacagaacacagaaaacauucccuuuuccguauccauacauaggagugccgagccugccguguacuugaucuugucccacagaaucaccugccagucucaucguugcaggcuucucuccugcaugcacagcgggggugguggugaccucagaagccuuuccuucugagcacugcgugacugucagcugugggaguucauucugaggccaugucagggcugacugcaccgaaaaaggaagugaccugaugagaucauuuuauccaguggcacccacaaaagacacaggacagcugccuucccuccauccgcagaugggacuugaugauuuucuuuuuucuuuuuauuuuuuucucuuuugagauggaaucucacucugucgcccaggcuggagugcaguggugcgaucuuggcucacugcaagcuccgccucccggguucacgccauucucccgccucagccuccugaguagcugggacuacaggcauccgccaccacaccuggcuaauuuuuuguauuuuuaguagagacgagguuucaccguguuagccaggauggucucgaucuccugaccucgugauucacccgccucggccucccaaagugcugggauugggacuugaugauuuucauggucaauacaacagaggggugucguuccucuuugaagcguuucccaaccgacagugacggguuucuaccagggagauguuacggcaggcagcguuuuggcucugacggcccuguucguuccugccucccugggauuuuccaucccgaagugcuguuccucacucagcacaaccuagaaggucccacaaaaagcuauucuuuggggcuuauuugcaaagcaggggaacccaugaauuaugcaaaucgagguccaaggaggcguuguuggcuuguccaccuucacucaguuuuagggcuggggggccgaauggcggggcaagcagaagaaacauaaccaacagaacgacauggcgaagguuguagguuccaaaaagggcgacagggacaagggcucgagcugaggaaugccuucugaggaccccauagccaaauuuuugcuguuuccagccucuuuuugacucuucucuuagaacgucaccaugcuaacuugugguuuggggcccacccauguuuccuuuuaggguucauaggaccccgaggauccaaaggugcagugggccucccuggcccagauggauccccaggucccaucggccugccagggccagaugggcccccuggggaaaggggccucccuggagaaguccugggagcucagcccgggccacggggagaugcuggugugccuggacagccugggcuuaaaggccuucccggagacagaggccccccuggauucagaggugagugccccaucggggagccgggggccccaucccagaugcacaguggccuccaagggcgaccccaaucccuuccgggggauuugguaggaagcagcggugcccuauagugcuagccaugcguaccuucucccauggccuuccagcacuccuuuagaaugugucugucacaacacugugacuacccacgguagccagugcgaucuggccaucugagaacuuugacagguguggauucacugauguaaucuguugucaaguugcauaugccuggcugugacaggggccgugacaggcucacuguuugucuuggcagaaucuguacaggugguaugaagaaaagaugggcccuggccaugcuuagucagaggugaagaaggaaaauagaaauaaucuggaaugcaauucuauugguguaaaaauuaauacauuuuuuaaaaugucuuaauguuguuuacaguguuaucaauguaucucuaucaaaguagacagagcaucccugguuucaugagugacaaggcacccgguggcuuuaaggguucaacugaugccaaaucggcuuugggaacccgagccccgagcuuuaaugaaagaugaugccauggacagcaaauguucacacugggugaaccccaggcuggggauugcuagaucauugcaaccugccauucaguguuccaaaucaaaaaugaggcugagcacaguggcuuacaccuguaaucccaacacuuugggaggccaagguaagaggauugauugagccgagggguucaaaaccauccugggcuacauagggagaccccauuucuacaaaaaaaaaauaauaauuaacugggcauggugcugugcaccuguaaucccaacuacaugggaagcugaggugggaggauugcuugagcccaggaauuguagauugcagugagcuaugaucauuccacugcacuccagccugcgugacagagugagacucugucucaaaaagaaaagaaaagaaaagaaaauguggguuaaaacugugacucggugcauucacuguuuaucuguugauggcauugucguuagucccugcugccaaccccagcccgaagaggcuucucuguggugugggaagcaggugucgcuccccugauucugccaucagcccacaucaggcauccuaagcgagauggaggcuaggccuccacuggcaggcgaacccaugaagcucaggagcaugaauugguuuucggaugagccugugagauuccuagcaaggccuggaaggguugggacccaggacaggggaguuuugaugaugaugagacugaucagugcccccagcuguugauacuagggagcgcccaugggugccacaguucacugagagagcaaggaagagccuaagauggccagagugcaugcaugcacacacacacacacacauucacggucacacucaugcacaugcaugcucacacaugaucacauacacacaugcagauaccuacacacgugccuaugcaugcucacacaugaucacacuccuuacacacguacccacacacgugccuguguacacucacaugaucacacacgcacguacccacacacgugccgugcacacucacacaucacacacgcacguacccacacacgugccuguguacacucacacaugaucacacaugcacguacccacacacgugccugugcaugcucaaacaugaucacacacuccauacacacacguacccacacacgugccuaugcacacucacgaucacacacaugcacauacccacacacgugccugugcacacacgaucacacacacguacauacccacacacgugccugugcacacucacacaugaucguacacucauacacacacguacauacccacucgugccuaugcacgcucacacaugaucacacacucacauacacacacgugccuaugcaugcucacacauacacauccaacccugaaccaagccagcuagagcagguuguugggugaaauuacgaggauggggaggccucgugcucggccauccagaucuccccuuuccaguccuacugacucuccaggucauuuauggaagauaagaugcaaaucagcgcugucugcagaaacugaggacucggcgcugagagguggggcucugugugucagccuuccuggaaggcacuuaaaugaguucacagaaggcaaagugaaggacauacguaggugacucgaguguccaccaucgaccuguucugcaacccagcugucaaaauccugccccaagcucuuugacauaaggguacuucugguagaauuuuuuuaaaacuuaauuacuuccugcaggcuucagaauguuugagcaugaaaacaaauggaagcaggcuuacuuucgaugucuuauuaaggucuuuaccaugaucaauguuaccuuuaugacaagcuucauaugccuuguuaggcagaauguuuuggaugguaaaaauccugacucccaaagcaucaacauuccaaguaacuacuucaguuucaguuccgcucaccagugcuacaggagcagcgugcagcggguccugcuuccauucgacuggcugugcaggacggccacaaacacacgcaggugcacccugcgcuucugagcagaacucucggaaugaaguaaugcagacguccacaaaugagaugugauuucacugagggaggcugauuuuuagcaguuguuccuuuuuuaacagauagucuauaaguggaaacugaccugaaacauucagcucuaaagaaauaaucacaaagcaccucggugccugauuuuugcaaggcaguccuugccggaggaucgggcauucgugcacauucacccggagaccgugcuguccacuuccagaaggggaggaagggcagcgcucagaagcacgcccagacugucuccagcccugcugcccccugcugaggccaucucgccugcucagcccccaaguucccccacaguccaugucccuggguuaugaaugucaccuggugucugucagauccccaccccauuguucuugucaaugagcaggagugggguggaccugccaucgcugcgaauccuuuacagccugcagugcugccugccaacucuucacaaccauuagcacccacuaacaauccauuuccccuggagcucuucacucuaaagauagaagaccaaaaaauagaaguguccucauuucucacaguacuacaggaggaggugagaaccgaugcauccgugcaucuuagagaaucucauuucagaccucggcuucgagugcgccuccugcucagucagcccucuuccucgcugcagguugacguggucagacagugcgcagucagcagccugacucucgguucuggguugguccaagacugaccgggucccuuuugucacugcccccuccugugcaccccccuggcuugucugccucccuguccuggaccagcccugcacaccugcaggguggcugugaggcuacgugaguguguggacuguaaagugguggcaggagugugcaccuccgguguuaauaaucggagagcagcugcgacaagcgucaggcucacgaagagagggggaaaugccugaauauaaggagguccagggagcuaguguuaaaaacuagaagaaaacagaugcccuuagugucugaccacugggcaggacaggauauuccaaacuuaaaaugaagagaagaaaucacacaugugcacacacacccacacacacaccauaugaaguuugaauacaaagguuaguauccugcauguggaaagcaaaauuaaacuuugagcagcagaauaaacuuuacaauagauaugaaggaaaauucgucaguguauaugaggaauacuaaaaucuaucaggaaaauauaaaacuccccagaggaaaauaggagcaaagaggccgggcacaguggcucaugccuguaaucccagcacuuugggaggccaaggcgggcagaucgcaugagcucaggaguuugaaaccagccuaggcaacauggcaaaacccugucuccauuuaaaaaagaaagaaagaaagaaaagauaugagcaaagaacuaaaacuucaccaaaaucaauaaccaggagaaagaaacguagaucauaaugaagaacaagcaagcggaucccccgacaccacguuucacugcaucaugacugccaggguuccauuuugcuucagugcuaacgcucagugcuggggaaacacugguagaauaaauggguuuagacuuucugaaucagugcgauguaucuuuuaaacaacauuaaauuaguguuugcuuugauacacgaugucaguuucucaggcaguuuccuaaagaaauuaccuacgacauggacauggauaaacauagcaaaaaaagaaaacuccccaacuauuccugacagugcuguuugcaaaagugaaaaaaauggggaggaugcgauggaauacauucaauguguccagaugauagaguuuuauucauguaguuauuuuaaauguuugcaaagacuauuuuuaaauguggcaaaauguucaaaauauaaugucaagugaagaaaacuagguuaaaacuauacuuauagugccaugucaacucugcaaaugucuaguuauuuauaggaauagacaagggcaggaaggaaauucccagugguagucauuaccgcugggugauggugugccuuaccugauuuuauccuuuauacuucuuuguguuuuccugauucucuagaguccagaaaagcaugaauugcucuuuuuacagaaugaguguguggagggagaugcugucugugaugaacaguccagaguuggcccccacagcucuugucucugauuccugcaggaagccaagggaugccugggaugccagggcugaagggccagccaggccucccaggaccuuccggccagccaggccuguaugggccuccaggacugcauggauucccaggagcuccuggccaagaggggcccuuggggcugccaggaaucccaggccgugaagguaagaccccagcccucccauaaacgagugggguccucacugguccugccaagagaaugagcacugucuucuuguggagcucucaaagucuguuccauggaaccccuuaagaggugcagggguucccaaaccagaacauguauuucaccuaauaaggagacacaaacagccugagacaucggcucauccucuguaccuguuguauauauuaaggaucuagggaaggucucaucgggaaaaaagaaaaagaaagaaauucccccuacaaaaguucagaaucacugcucugauguggagaggagaaaugguuuuaugaaagugcaggguguggguuggaaaggcagguggcuccgucagggaaaccugggguagaugggcuggagcagaggagcggggaggggaggcucggcugcaugcccaccacacaggccaaggcagguggcagagguggcccagaaggcaggcagggcacagcauccaugggcauugcccaccacugcccaggccgcucucccacacucaguacagccaguucccagacuccuacacuucacgguccagggaaacugucagugcugguuggaggaaucaauguacuuuccccccuuuuuguuuuguccagaaaaacagcuuuuuaaggaaguguuguaugucaccaaaggacaccguaacuguaaagugggaaagacgcaguugcuuaauaaggaguugucuccauggaaacucucaaucuuacuauaguucucugguuugccacagucaggcaacagcuuuguccaggaccuuagcagaucuugguagggaacugccacuccacuugaagauacacacuggcuucccccauguggggccucgccuguguccaagagcugggggcuggacucagguagggcccgcuccccuauugccgcacuagccacuggcuuccugggguagcaaaccuggaccggagguucaggcuccuaucucaguaucgacagggccgugcugguucucaacuacugagaaucagcugaacacagcgucguguggugcuuacgagacccaugggaaagccuguccugaacuaaagccuacacuuuagguggggagagagacacacacauuaaaaggcucccacuuggccugggcaagccagcagagugacaaggccacgcgguccccggugacccagaggaggcggggacaggcaggucagagcaagcccaaggggagaaguaccuggugccagcggggagaaggcugggacuggaauguggggugcucucuaggaaagggggaccaccccagcagaggcagaauugcccagggaacacuuuggagccugugauccccaaaccggcuggggaagagagccugauuugagggggcuggggguuuagauaagaagauugagccaaagguugggagcagugaaugcuggagcuaaggaguuggagccccgaggcagagggggccuuugggaguuuuuaacagagaaaugcauuaagaagggauuuuagggacccagcaggcagcccuuggacggcuuggagucgggggaggcgggaggacagcugugggcgggagcugccaagcucacgacaguagcagugaugagaugggagcacggagaccagagagggcagcagcagcaaaugggcagcuggagggucccccgggacuaacuccgggcuggagccagugauguucgcgaggaacaggccagcucuugacuaaccccagugaccaugccccagccagagcuggcaaggcccccacucacaucagcauccacacagcuuugucccuuggcuucugaagacugcagugggaaagccaugcuggcuggcaccccgccagcacagccucaaccuccagauacagaccucuccagaaaggccagccccagggucccgcuccggccacacuuuggaaacucaccccaacauggugguuuuccacuuuccuucuaaggagcuuuucuuacugaacacucaaugccguaaaagcagaagagaaauuuccccuguguguguuuguccacccuguuugauuugcuccucuuccugacaggucugccuggugauagaggggacccuggggacacaggcgcuccuggcccugugggcaugaaaggucucucuggugacagaggagaugcuggcuucacaggggagcaaggccauccaggaagcccuggauuuaaaggaauugauggaaugccugggacccccgggcuaaaagguaauugugugacugugaccagggaucccuuggcggggagguugggucuaaucaacucugaccugagacagcucugcugggcgccucugugggccguggggcuggccucacacuucugcagauuggaggccuugggacucuccugaccuaggagacagcagccucaggacagcugguuaaugcugcuuagacgcgggugggaccaaugugccucacaaagccaguuuaugaauuuaccaagacaaacugcuccugccugggaaacaucgucuuauuguaaauaucaccaucugcacagggaaauuuguggagagguccacucaggggccuagauucagauccagagguuauuuggugaauuugaaaccaaagcaaagcaaagugguugguuacagggauagguuuauuucagcacaagcaggccaaucuagaagcagagcccuccagcccaugaacguugcuggagacacacuguucuuccauugcuggagacacacaguucuguccuuccauugcuggagacacacuguucugucccuccguugcuggagacacacuguucugucccuccguugcuggagacacacaguucuguccuuccauugcuggagacacacuguucuguccuuccguugcuggagacacacaguucugucccuccauugcuggagacacacuguucugucccuccguugcuggagacacacuguucuguccuuccguugcuggagacacacaguucugucccuccauugcuggagacacacuguucugucccuccguugcuggagacacacuguucugucccuccguugcuggagacacacaguucuguccuuccguugcuggagacacacuguucuguccuuccguugcuggagacacacuguucuguccuuccguugcuggagacacacuguucugucccuccauugcuggagacacacuguucugucccuccguugcuggagacacacuguucugucccuccguugcuggagacacacuguucugucccuccauugcuggagacacacuguucugucccuccguugcuggagacacacugcugugucccuccguugcuggagacacacaguucuguccuuccauugcuggagacacacuguucugucccuccguugcuggagacacacugcucuguccuuccauugcuggagacacacuguucugucccuccguugcuggagacacacuguucugucccuccguugcuggagacacacuguucuguccuuccguugcuggagacacacaguucuguccuuccauugcuggagacacacuguucuguccuuccauugcuggagacacacuguucugucccuccguugcuggagacacacaguucugucccuccauugcuggagacacacugcucugucccuccguugcuggagacacacugcucugucccuccguugcuggagacacacugcucugucccuccgugcuggagacacacugcucugucccuccgugcuggagacacacugcucugucccuccgugcuggagacacacugcucugucccuccgugcuggagacacacuguucuguccuuccguugcuggagacacauuggucgguccuuccauugcuggagacacauggguuggucuuuccauuacuagagacauaugagucugucuuucuguugcuggagacaccuugaccucuccuuccggugcuggcgacauuggucugacuuucugcgguccugugucgcaucuccaugccaggugcaguguuacugcugccuuccuuuccagcgugcuccucugccuuugucuugaugggccugugggccagugaaccugcaucaucuucagauuucccuccuagccuuccugccugaucuuuguguguuuccuuguugccaauguccggucugaagacaggcugauucuggaaugcugucuguuaacagcagaggucaacagagagaaguugcuuagaagaugguguccccggaaaucccuauuuuagguucagaaucuucucacuugaguuacauugccgaaauguuacggagacgugagacugaaaugucccaugcauuuuauucaugucuaacccagcacuuuucucuuuuccucugaaggagauagaggcucaccugggauggaugguuuccaaggcaugccuggacucaaagggagacccggguuuccagggagcaaaggcgaggcuggauuuuucggaauacccggucugaagggucuggcuggugagccagguuuuaaagguaugucccucucuuaacauccuccuuaccuggucaugguggcauccuccuuacccuuucuugguggcauaacauugcccagaaugaauuuuugaaaacccaugcauccaggaacccuaaagcuagacaaaacaaacaaaaugagcuaacaaaaacucaaaggcuuuaucccugccucaacacacugaccaugugauaagggaauaauccuaaccaaaggaaacucuugagaaccaaaaugauggcaucgcuaagaaccaaauaugucaugaaacauauuccaccaugauuauaccgugguaaacaugaagagggggcggugaaaagcaggggacaggugaguucccagagaagggaguaccaccaggcacaggaggacacagcuuuccagguggaaggacauaacacggugccagagagaacgugguccacacaugagguggguucaaacccucacgcggacaggcaucucaagaccccccacguaaggccccucguucauugaguuuauuacuaacaagucacauuuucaugacuucuguucagaugcuuuuguucugaaauaaucacaguggucucuaaaaacguaaugacuaagaguguguguuggugaggagguggagaaaugggaaccuucacaggcugccagcaggaguguaaaacgcugcggccagugugccaaacaguuuggcaguucauuaagaaacuaagcauagaguuacccagaaguucuacuccuagaugaagaucauugaaaacauagguacagacaaaaauguggacacaaaucucauggcagcauccuuuauagcagccauaauuggaaacagccugaaaaugcaucgacugaugaauggaugaguaaaauauggcagagcugugcaagggcacauucagugcugaggaaggauggggcucucagacauggcgcgugggcgagccuugagaacacuaugccacgugucgucugacugcauguauaugagauguccccaguaagcaaguuuacagaaaugaaaaguggauucgcaguuuccuacacuugaucuuagccaaaaggccgagaagcgauggauucgcaguuuccuaaagcugaaggguuaggggagaauuagggcauggcugccagcggcuccaggguuucauuuucugggauaaaguguucucaaguuagacggugcugcuugcucacagcucugugaguacacuaaaguuauguaauuguucuguuuacuggagcgaguuguaggguauauaaauuauacaucaauaagcuguuuuggaaaaccuuaauuacucuucagacuuacagcuuuuacaaauuuucagcaaaauaaaaauugcaaucuagggugcucauuuuuuuuaagauuuuuacucacacuugugcuuucaaauagucuuccuguuagcagagauuucaggcuauuucaggcaaaaaaaaaaaaugacauuuuaagauuaaguaauuuucagcuccaugguaauuauuuccucgagccuccuuagggugaaguuaaccaugggggugucugucccuccacuggugggcacgcucuguggggucaggaccaauuuaugauuuugaucccaucagccucuagccuaguacugaauacacaguaaaugcuuagagacugaagcucaauuauuuucacugagccagauuucacuuacuccuccagugagcauggauuccggggcauccccagccugaacuagcacaguuucccgcccggcccgcagcucugggccccuccccuccugcaauuucucagcuccucagaaccccccggagaccucccuuccaugcuucuccucccugugaaggugccuacaggagggcacggagcuggcgccugccucacgggccuuccugcuugugaccgagguccaucauggucucaucagagcacacacaacaaaaugaccuucucacaaagcauccuaugggagucacacuggcuuugaccgcucccucugcaucugcuggcaggcacgucccccuacuguggugcugugugcucagugacaccagccccaggcccaggacccuggagccacccccaacuccaacuacuccgauggacacaggagaggcuucuccggcgcccuuggucucucuccaaggcuucccugcuugggggagacgugcagcccuauggcucagggaccaggccuucaccuguguucuccugcguggucuggagcccccagaaaaugacagcacucuauucccuuccaggcagccgaggggacccugggcccccaggaccaccuccugucauccugccaggaaugaaagacauuaaaggagagaaaggagaugaagggccuauggggcugaaaggauaccugggcgcaaaaggugaggcuucugaccugcagccaggggccccuagucccugccgccccagcccgcaccagcucgugcccuucuccguccccagagacgcccgugcccuccaccuggcuuucuucgugcuuuucaucucugggcgcccuguguguccauagcuggcgcaggguuguucucugaugccugaguaaccucgguuucccaucuuaagauuugcagcacuggccgggcgcgguggcucacgccuguaaucccagcacuuugggaggccgaggcggguggaucacaaggugaggagaucaagaccauccuggcuaacacggugaaaccccgucucuacuaaaaauacaaaaaaauuagccggcaugguggugggcgccuguagucccaacuacuuaggaggcugaggcaggagaauggcgugaaccggggaggcagagcuuguagugagccgagauugcgccacugcacuccagccugggcgacagagcgagacuccgucucaaaaaaaaaaaaaaaaaaaaaaaagauucacagcacguaggacagcaaaaugcauccaggcugcaaaauugaaaacuggagggcgggugcugcguccucaccagaguguuacacaccagggucuuccugcagguauccaaggaaugccaggcaucccagggcugucaggaaucccugggcugccugggaggcccggccacaucaaaggagucaagggagacaucggaguccccggcauccccgguuugccaggauucccugggguggcuggccccccuggaauuacgggauucccaggauucauaggaagccgggugagugggcgucuuuuacuccccuuguucugugagcuccucuccccuuugcuugugaauggacaugcuuuggucuggaauuugcuagggugagagugucaguggcagguucagggcagccucaggcuuggugggguccacacagcccuggaaggagcugcugcacuuggacaccaugcagaugugaugugaguccaaccggcugccguggcccuucugugggcuugugcugggugaagcauguugucugcauuuuucaugguggccuugagagaacaaaacuugaauuuucagggaucagagcucuaaaauugagcacaucagugacaccaggccugagagcccauggccgaaucacagcguagaccugggcccggcagccuggcuucccauccgggccaccguucacucagccuuuguucagcggaugucuguugagcacuugacaugggccagacacgcuguugugaugguaacaauggugagcccugacccugggcagggcucucuucuccacaccuucucccucagcugcagaaugaagguaguagcuaccuugcaguuuucuugagugcuguauagacaguguguauaacauagcacagcguggcuccccauagauuccguuuccuagaauuccauuucuagccucguucauaugaagauaguguauucucacagucccuagcacacggcuggccuucccagggggaugggcacauuuggagcagaucagaaggucugggccccuugauguguuucagucgcguccgugugaaaagaccaccaaacaggcuuugugugagcaaucaagcuguuaauuucaccugggugcaggcaggcugagucugaaaagagagucagcgaagggagauagggguggggccguuuuauaggauuuggguagguaaaggaaaaagggggguuguucucuggcgggcaggagugggggucacaaggugcucaguaggggagcuuuugagccaggcugagccaggagaaggaauuucacaagauaaugucaucaguuaaggcaggaacaggccauuuucacuucuuuugugguggaaugucaucaguuaaggcagaaaccggccaucuggauguguacgugcaggucacaggggauaugauugcuuagcuugggcucagaggccugacagugugaacccuuaguagcaggccagggccugccugugugucugucuggcccaccuugguguacagaauucuucaggggucuuccuccccucacucccaaaaucugcagcugagaguaucuucuagccagucugugugugcuauucaggucacuuuaaaaaagaaagaugccagccaggugcaguggcucuugccuauaaucccagcacuuugggaggccaaggcaggcagaucacuuguggucaggagaucgagacuagccuggccaacagggugaaaccccgucucuaccaaaaauauaaaaaauuaaccggguuuggugcugcgcacucauaaucccagcuacuggggaggccgaggcggaagaaucgcuggaacccaggaggcggagguugcagugagccgagauugcgccguugcacuccagcuugggugacaaagcaagacuccaucucaaaaaaaagacaagaaaaaagaaagaugccuguuucugccaaagacaccuacaacauccaaaggaccuuuauucauaacagcucgaaacuaggaaacagcccaaauguccaucaacagggaaaagaauaaaugaacgugguauauucuaaccagacacagcauuaucugugcauuuuaucuccauacacagcaauaaaugagaauucuugguaaaauccaacaaccuaacuucauuuccaaacuuuauguugaacaaaauaaaccagaaacagaaaaguacacgauucaguuucaucgaugugaaguucaagaacugacaaggcuguuagaugggguaucgggagcacagcugcuuuaggugggguugucauagagugcugacaguguucugugucuuucagugacacacgaguucagaugcauugagcugugcguuuaagaugaguggacauuacuguauuuaaguuuugcuucagaaaaguaagcuuugagaaagaaaaauagagcauuaccuaaacaaaggugcagccuguggauacccucccccuuccucccacaaaggagcuuuuguuuuguuuuguuuuguuuuuugagacagagucucacucugucacccaggcuggagugcaauggcaugaucuuagcucacugcaaccacugccuccugguucaagcgauuccccugccacagccucccaaguagcugggauuacaggcgcacgccaccacgcccagcuaauuuuguauuuuuaguagagacaggguuucaccauguuggccaggcuggucuugaacuccugaccucaggcaguccacccaccucggccucccaaagugcugggauucuaggccugagccaccacccccggccuagcuauauuaauacugcagcgacucauguuaggccaugcuuguacauugaugcuguaguacuaaagucccaguggcacccagguagaccagaacucucaugcucccucuggggaggaagccacucuggaggggaaaacuagggcuuccaggaagccaccgagcaacucaggcaucuucucaauuuccuuaccagccaccugugucuuucuggagaagucucccucugugcacagauggaggcgcacagccccauaucuguguuauaaucugcagagagcaagcucugcagucuggcugcccaaacugaaaucccgguucugccacuugcuggcugagugaccuuaagcaaaaccuuucugugcuucaguuccuuugccugucauugggaaguaacggugccugccuggcaggguuuucaugaggcgugaauacgcucuugagacgggguccaccaugugcacgcgggaaagcaugguggagcgaggauguagucagagucaccgccgccgcugacaucaccacacugucgugauggagaccugggccacugaugcucuucauuaugaugcaguugccaagcuuguuucauuguaucacuucacaguuccauaagaacagcaaggccaggugcaguggcucacgccuguaaucccagcacuuugggaagcagaggagagagaaucacuugaacccaggaguucaagaccagccugggcaacagagcaagagcccaucucuacuaaaaauuuaaaaacuauuagcagccaggcuuaguggcucacaccuguaaucccagcugcacaggaggcugagacggaaggaugacuugagcccaggaaaucaaggcaacauugagcuaugauugugcuucugcacuccagccagggugacagacugcgauccugucucaaagaaauaaauaaauaaauaaacaaaaagaacagcuaagcaaaccgccuaugauacacacuaaaaaacacgaguuuuccacaaaaugacaagaucacaaaccuugaguauugucguuagcauacuggauaguuaaauaagugagcuaacuucagaguuacaacugacuucgcuaacagccuucuaagaugguucaugucugucuuuagggugacaaaggugccccagggagagcaggccuguauggcgagauuggcgcgacuggugauuucggugaguguugcccguccagugaaaacagggaguccacaauucagagcucucugagcaugugagccaauuucagaccugcaagugcuguuagguauuuuaaaacaaauuauucuuguuaggaauauaacaaaauagaaguugcaaaacucacaaagucccaguggaaaguccuguucuuagccgucuuuuuugcauguaacaggugacaucggggacacuauaaauuuaccaggaagaccaggccugaagggggagcggggcaccacuggaauaccagguacgcaaguuauuuuccuugucuucaucuucaacaacagcccugagccuuugucuaggagcccgacuugccaaacagaucaaauucaguaacaaccagaaagcacuugauagugaaugaggucuucaaguccaaugugcaagaaagaccgucguuuuuaauuaaguuaaaucugaagauaaaaucaggaagucuuucucucucucugucucucucuuugauacugaaaaaagccagaauggacccucgguggaugagaaucacugcaguccauaaaguguaacugaugaaaagccagcuagcacccugacucccggaacaccugagggcgugcagcagguggucgcugacccgagcuucucagaaacagcgaaggguccaggaaagggggagugggagucaggccaucgcuugagagagauauggaggcagcugaccagcccgagcgaguugugggggccuggggcggcacagugccucccuucccuucugcacaucacugagguuccacuccuaaauuccugccugcagugacgucucaaggggacugugauaguuuucuucuuucuggggauuuucuuuuggggggaccccacacugcucaaguugcuggagccccaggggcuugcagggcuggcccuggugggagggaaggagucuguccaggguuggccaguggggagacugcugggccaguucuuuaucuagaaauugcucuggaauggaaagacguguucaguugagcacaggaucagagaaccgccgcugggaaauaggcgccucuguuuaccagcccucccgggcuccuuuguuaucugugaccugggcucccgguggcuuccuccugagugacgggagcucuguacugcugagccauccggcgcugggcuggcugugucugccacccuaggccauuaguccggccauuugguuuauaaacacagaaacguggaccaucauuaccacgcgucucuaaugaugccuucacuuguucaacugaaaaugugucagggaagagacgcuacccccacccaagaauuauuuuugcuguuaccuuugaacauuuugguuuuuguuaaacucugggcccagaaaggcuuuggaguggagccuccccugcauccaucaccagaagacgguauuucggagcuguggucccacaauggaaggguggggccagcuguacccaucaucccuggggguguccuguuuucccuaagacagugaggggugcauggguacaugggugcugccuuggaagcuggcuagugcaggcucagagggaggaaguagguuaaaaaucagcuaaggaaggagcacgguuggaugccucucuccauuccugaaggagcagcagugugguucugcacauccuagagccgggguuccagggaacccacaggggcgcggugucuguuuguuccaagcagcaugucugugguugcaggucugaagggauucuuuggagagaagggaacagaaggugacaucggcuucccugggauaacaggcgugacuggaguccaaggcccuccuggacuuaaaggacaaacagguaaaaucucccgcagccacacagccuuccucaggcaggcccuccggagaccccagaacaaaggcggucaacauugucaauuuccuccaaucacacccaacccuggaagcucacucgugccugcugccagcuuaggagcuuuccucagugcugauggcauggagagaaacaaccaccugggcuggggggagaccugagaauuggagagaagcaugggggugaaugagaagugccucuucgguugagccucugucucucauauagaagccgacgguuuguaagggaucccuuugcuugcauugaauaugcagaaaccccuaugaacauccuagguuagagaaggagagcggacagugggcuggcuucccacgcuguugcugcugcugcuuucuguguuuacucagcaccggggaaugccaagaggcucaucucuccaggcacugccucaggguccucuccagacgucuauuuggauaauagggcgacaauuaaaacuacacgcuauuuucucucuggcaaggcugagcaaauccuauugaauuuguauguggggucuaagaccaccugcauccccagcuugagggacaguucuaaucucuccuccaacuggcacugcggcccuuccggcccucggccccucccagagcggcugccccuccugccaggaccucaccacacagcgcccaagguguccugugugcucagacuuaaugcuguguucacccccaggcuuuccagggcugacugggccuccagggucgcagggagagcuggggcggauuggacugccugguggcaaaggagaugauggcuggccgggagcuccgggcuuaccagguaaggucacguaaaacacguggucacccagacccagagucgugggcugugcaggaggcaccgcugagcaggccagccucucucagggcgacuucuaaggcccauacgagagcaaaggcaggucugcuguggcuuacgguggucugcaccaacauagcagcacaggguauacuggcgccccaggcaacugggaaucaagccagaugcacaaaucugcccagggcuucaccucccagaaggaugaaugaaagccucccagagaggcuucaggguccacuugucaucgccacacagggacgcacagcaagaucagggugcaggagcagccucaguguaccacugugcugcacgggccacccccggggccuccuuacagccccgagacgggccacccugccaugcucacugcccauguaacagaaggaauugccaccuguuugcuguguccugcuuuagaaauauuuacccucagaaauccagagggaauggaaaugacaccgggcuauuuguuccaagcagcuuuuacaaaccaaacauacagcaguggcgaggcgucaagaagaggcaugggacaugucacuccccaggccccuucuggccuagugagucuguuaaaaagauucuaugaagacaguguuccaguucaaugguguuccuagguaacauaagagugcuuaguuuacaugucguguaaguugagcguguggcuuagcugcuuccuauuuguggggcuuuagcaggauuguaugggugacaguaucaggugacaguuucagagccaacaaaacacaucugaguuaucuugaggguuucucccacccagaacccccugugcugucccacacaugaaauaacaaugagugacacccccacaggugaaauaacgaugagugacacccccaugggugaaauaacgaugagugacacccccaugggugaaauaacgaugagugacacccccgcaggugaaauaaauaacgaugagugacacccccgcaggugaaauaaauaacgaugagugacacccccgcagguuuuccgggacuccgugggauccgcggcuuacacggcuugccaggcaccaagggcuuuccaggauccccagguacucugugccgucccagccccgagucccacgcagaggugucgaggguggggacucugugcugagucugcccuccagacuucagggaauggagggucucagagagcagggugggcuuccugaagugcuaugcgaucggccgugaggggcggguccgggcccugugguccuguacgcugcuaagaugugaucccuaagaaucgguuucucaaggcaguugcuggguugaauggacucaucaggcuuuuagacggagagagaaauagaguccuugcuuuuucagcagcaccguugggagggugggaugcaccugcgccccucaggugucuggaguguucacucugcccauugccugucugugaucuuucauuuuguuggccuaaggaagccagcgguuuccaccugccccugggcaguucugaugcuggagacagugauagcgcuugggcacccacaggcugggagccaaaaacaaccaaaauggguuuccucccaguucuggaggcugggaucagcaugccagcguggucggguucuggggggggccgcguccuggcugcucgcuguguccucacgagggagagcacccgcucuccccugucacuucuuauaagggcaguaaccccaucuuggggccccacccucaugaccuggccuaacccuaaucaccucccaaaggccccugcuccaaaugccaucacacuggaguuagggcuuccacuuaggaacuuugggguuggggagaaugacacaaucaguccauagcaaggugaaccaagggcuucuuaccacaggaaaaagaaacuaacaacuuucauagcacuuucuggcuuauuuuauaaacuacuguagcacacauuuuucccugaauggggauauaaagacucauuauuuccaaaagccaauggcagaauaagguuuccauccugagcccuuccaggguauaauaacagcaacuggaugauccucaaaaggaucaucagacuuucccacagaaggccucccuuuaacccuguccuccccaagaagcugagauagcauagugcaggaaggcuuggcagcuucuuggaacuucuuuauuuuaaauucagcuauuuucauccuaaauuuuaauguccuugucuuuucauuuaauuuugaaaucuauuauaggacuaauaaaauaacauuugaaggacaucaggcacuaaguggggaaucauuuuauuauuaugucuuuuuuucaaaagauaaccuuguuuucuuuucaauuuauacaaauuauuuauguucaguggagaaaaaaaaauuaacacauuuaaacacauuuaacucgggaggcugaggcagaagaauggcgugaacccgggaggcggagcuugcagugagccgagaucgcgccacugcacuccagccugggcaacagagcgagacuccgucuuaaaaaaaaaaaaaauuaacacauuuaagaggaaaaaaagacccauaauccuaaagcugcuuuuagaaugugcuguuuguagacauuucauauaaccaaauauugcucugucuacaggugaauuuguauguguguauauuacacguaaauucacgcacuccugcgucauuaacacuccauuacaguuccagugggcgaguggcgggaaauccucgucaaguugucuugcuguuuccugccaugauggcgaugagcaccugauaggagaagggggaagacuuuagauaguguuuacuuugaaaaccuaauuaagcauagccugaagagaagcccccaggagccuagaggcccgggaggggucccagcuccuugacccacuguuucugugaauuugaacccucugaugggccucgauccucuuauccauagagccaagggcuuccacugugaucucuguaagaucccuuccaaaucucagcuccugugaccuggaggccauauauugcaaugcaagcugaaaucaccauggcugccucuguuucuuugcuuuugaggcaccccaagcuguucuuucacuuaggaaagucaacuguaugguuggaaacaccgacaucagcugcuguuauaacucuuccacagguucugacauccacggagacccaggcuucccaggcccuccuggggaaagaggugacccaggagaggccaacacccuuccaggcccugugggagucccaggacagaaaggagaccaaggagcuccaggugaggccacacauuccaagccaacauugccgucccaguaaccagaacccacccagagguggggccauggagugucuauggggugggagaggcugugcagaagugcaggaaagagcugguuuuucuggggaggacuaccuguugcaggaccucucagcuagucuuaguuuguuaggcaauuuauuuuaucccaucaguguuagugaggcacugaccacccaucccguggaguaacugauaagcucccuggccuagagaccccaucagauccucugugcgccuggggcacuggcacaggccuugccauaacaagcacucuggguagugaaugugcgaauaaaugcauuaaaccuccuagcagagccacgcugacccauacuuggguaggaaaugcccagaaacuugucuucccaccccauagccucccugcucaccagccaaggugggcucaagucuaaauggcagugagaaacauuccuagauagaaaccaggaccuuccugggagccagucugccaaggguguugcggucucauugugcaugagcccacagccccagagucugcuccugagauccaugggccccucccccaccccgcccaccucaccagccugaccaggggcaucuccuggcucagguacgggagcugggcagcacaccuggauggacagccugggcacccugggcuccaugcuggcaacagaaacucuggcuuccauccacaaaggccugaguuuuucuagugccaauuccccaugaagcuagaaccagacauccacaggagaggaagucaggaccaaggaggccagcaacccuggcuuuugcuggggugcagggaugucucgaggcuugcagaucacaucucacucuccaggaucugcugccugcccucuccccucaccagcagcuggaaacuccagaauccccuagccucagagcuccacagcacugaucugaagauaggagaaagaggaggggcucugccaacaggagccagacuauccugggaggcugcauggugcugccagagcccuagucagggugaggauccaggacaguccaccagcacagccucagccagcggugaggaucuagggucaguccaccagcacagccucagucagaguugaggaucuagggucaguccacgagcacagccucagucaaggaugaggaucuagggucaguccaccagcacagccucagucagaguugaggaucuagggucaguccaccagcacagccucagccagcggugaggaucuaaggucaguccaccagcacagccucagucaaggaugaggaucuagggucaguccaucagcacagccucagccagggaugaggaucuaaggucaguccaccagcacagccucagucaggggugaggaucuagggucaguccaccagcacagccucagucaggggugaggaucuagggucaguccaccagcacagccucagucggggugaagaucuaggguuagcauaccagcacagccucaguuggggugaggaucuagggucaguccaccagcacagccucagucaggggugaggaucuagggucagcacaccagcacaagcuccacugaggagugagaaucuaaggucagucccaccagcacagccucagucagggguaaggaucuaggacagucuaccagcauaaccucagccagggaucuagggucagcgcaccagcagaagcuccacccaggagugaggauccaaggugacuccaccagcacaacgucacucaggggugaagaucuaggucaauccaccagcacagccucacucaggggugaggaucuaggucaauccaccagcacagccucacucaggggugaggaucuaggucaguacaccagcacagcuucagccaggauugagggucuagggucaguccaccagcacaaccuccacucaggacugaggauuuaggucaauccaccagcacaaccuccacucaggacugaggaucuaggucaguccaccagcacaaccuccacucaggacugaggauuuaggucaauccaccagcacaaccuccacucaggacugaggauuuaggucaguccaccagcacaaccuccacucagggcugaggauuuaggucaauccaccagcacaaccuccacucagggcugaggaucuaggucaguccaccagcacaaccuccacucaggacugaggauuuaggucaauccacuagcacaaccuccacucagggcugaggaucuaggucaguccaccagcacagccucagucaggggugaggaucuggggucaguccagcagcacagccucagucaggggugaggaucuggggucaguccagcagcacagccucagucaggggugaggaucuggggucaguccaccagcacagccucagucaggggugaggaucuggggucaguccaccagcacagccucagucaggggugaggaucuggggucaguccaccagcacagccucagucaggggugaggaucuggggucaguccaccagcacagccucagucaggggugaggaucuggggucaguccaccagcauaauccucccaggagcccagcaguagaguugaccaugcccgugaccuuuaaaucagacaccuguuggguucuuguucugcgucucacgugcaccauauuuucaccaugugaccuuggccaugguauugaaugucucuggcuuugucugucaaaugaaaauaaaaaugcacuugugaguauugggaggauacaaugagauacuacagguaaagcucuugcacacaggaggccagcaauaaauguuugcuaucuuuaaaggccuugaaacauagcguuguuuucagagugucaugaugaucaguuuaccagucugucaccugaaaggcaucugggaaugcagcaacggggaagacuuggccaggagauguggagaggagaucccgcacagggaggggcggaggaaacugagaugggauuucgacagggugcacacaguggcccauagaggggggucacagaacacagcugcuagcauuuuguaugaccaugcauuguuaacguuugauucacacagcaugauguucaggcccuguacuugaccacaaaaaagauuuaagauuuccauccccaaggacagagauuuaucucauuuauuuuccacuuaauaccucagcaaaaugcuugucccugaguaagugcucaacaaauacuugcuggagaagaauauugugaaauuguaggauaauuuucugacaucaguggagaguuacguguagcucagaacaccccuaagguaacauugauggccuuauuacacauuugaucugugugggacccauuuaucaaaacucuccgugaccuccuguggcccuccuugcauuccaucccagggaccuggacgguguccccggcuuccaagccaccgugcggcaugcugacuuuugcaagccaugcccccacccucgaccugcaugaacgucacagugggcccaugagcugaugacuucagagcagguccuggaggccagggcagacacugcccagugccauugggccuuggcauaugaggccacugccucuggcuagugaugagggaaagacgaccuuccaugaugacguucacacacugaucauaaugucauucaggacacacacucuucucucaaaauaugggaauaauuugaauccgucaucuuccuucgcaugaguugcaucucauuuguauuaguucguucucaugcugcuaugaagaaauaccagagacuggguaauuuauaaaggaaagagguuuaauugauucacaguucugcauggcuggggaggccucaggaaacuuacaaucauggcggaaggggaagcaaacacauccuucuucacuggcggcaggagagagaagugcugaguaaaggguggggggaggccccuuauaaaacuaucagaucuccugggaacucacuaucacgagaacagcaugaggauagccacccccgugauucaauuacuucccaccaggucccuccuacgacauguagggacuuugggaacuacaagucgagauuuggguggggacacagccaaaccguaucacagcucacugaagcuagagucugcaaccucaccuauuucugcagcugacauucgagcaucaguuccugauuuggccuugagucaugcaacaugggccuucacggaaccccuguuagugagacucuuuuaugucaguacuuaggacgauccaugggggcuacugagaaaucauagcgguuuccgucuagauuccagcaaacugacucauguuugcuaaguguucucauuaacaguccucaucacugcaguuaaguuaauuauguuuucgugggaaucugccagucugcggauugcacuggaucaucuaacucaggagucugccauuauuuacugacacucaccaucuguuucggguacuuugugacaauagcuagaagcaguucaauuggugucauuuuauaucaaacuacagaugguggcucacucaugcccucagggcuaaugaacccacuugcauguugucugugauuugugagacaagccucaccucucuaaauauuuauccugcuguuuguuuuguccuacuuggaagcacgcaugaauggaauccuuuccccugggauggauaauggauaccaggaucuuccaaagggaaaaucucuuccugcugcugaugcguguagauuagucauaaagccagaggggaaacagaaaaccacuguugcuaccuuuucucauuuuuauagauuugcacuguuucgcccagcucacuauuuccugcagagcagaagugaugcccuccuugcccacuuggacauucugacauuuugcaggguucuaauacuaaucuugguccccagcccgagguaaaacaaaaggcugaaggugcuuaggagagaaaguagacuuaauccgcccacucaaguccacacugauuucuacccaccacugcccuacagcacauaaagcuccauuagugucuuguuggcugacagcacagggaggaguggaauuuccacagauuuccuuauguggccauuucccucuuacucuccuacuagugccaaagagcuccagccuuugacccaaaaacuguugguucucauuauucgcaguaguuauguucugaagucaccaagaacacugacuuagugaauacugaaccauugcuccuaggggaaauacaaggcuaaguuccugcaagccucugcucacaagauguuugucaaugaucaguauauaagcugguuuucuguguaacggcaccuuguuuaguguggauugcugauucaggaacagucaacaugcacucacucgugccugaaugcagcuucucuuacauauguguuucuccauaagggacuucacagccuucuugcacuuaccaacaguaggaugcacuucaacacaauacauggggggcauuugaaacagcaaaaucaccagcauaaagcacaaaaauguggaaaacagggcacuacagagaccaagacaaggacacguguguacaguaugagcugcagcaagaaggcaggagcgucaccuugcuggaucucagcugggacucauuuugccucuguguauaucugugaaugccaguguugauuugggggggauuccaagugaguuuuagugaguggacaaauugggaaacacagaaucugugaauaaugaagaccaacucuauccaagcugggauccgaggcacuggaggacagccgcagggaggguugacaauagugaugucaauuguaagccucauuugcaauuuuucaaccuucuguccaucaccugugcugaccacuguccacacauaucaggaucagagucugaccagcugugccucgccuggugcugaggcuccaucuaagcaugaucgggcagcgccuuggggaagucgagcacaggcagacaggaucccaguggagggcuccucacaggagaaaggcuggggugggggagggguucacauagccccugcccccccaaccccgcccugagggccuccccagccccaccaugagauguuccuuggccugagggcaccucccaucacugucucgcucgcuaggcucugguccaccacaggugaugguguggagggaaaauaguagauuugaaaaguugggugcuaacgcugaaaauaauuucuucuguuuucauccuaaggggaacgaggcccaccugggagcccaggacuucagggguucccugguaucacacccccuuccaacaucucuggggcaccuggugacaaaggggcgccagggauauuuggccugaaagguaagcaggacuuauacaucugugcuucgacaucucuaggggcaggagcuggcaauggcccgcuuaauguagggggagaacagacguucauuuccacgcugugcccagacuccggucaaagaggcaggagccaugauggcuccuccugugucauuuccaucaccugcacgaccuggucccugggaagcugagacacaggccaugucauuuacuugcuguaauagcagauauucaaacugcagggggcucagaaaugugcaguaugaacggcuuucuucuuccucacuguauuguguuuagacaaguauuaaauuuaauuugcacuuccuaaucacgaacgagcugaauauuggaaagagauggcguaaagaugaagucacccgucaaacaaguguuugugcgucaagguucacagcagcacuacucacaagcaccgagugcugaaagcaacccgaguguccaucaacagaggaauuaagaagcaaaaugcagucaguauccacccaguacaagaggaguccgucuuuuuuguuggguuguuuucuuguuuuuuguuuuuugagacagccuugcucugucgcccaggcuggagugcaguggcacgaucuuagcucgcugcaaucuccgccucccggguucaaggaauuuuugugccucagccuccugaguagcugggauuacagguguccaccaccaagcccagaugauuuuuguauuuuuaguagagacaggguuucaccauguuggccaggcuggucucaaacucuugaccucaagcaauccucccaccucggcuucccaaagugcugagacgacagguguaagccaccuugcccagccuuuauucggucuuaaaaagaaggaacucuuaucaccugcuaccaccuagaugacccuugagggcauucugcugagugaaagaagccagucacaaaaggucggauucugugauuccacacauacgaggccccugaagucaucaaauucauagaaacagaaaguacaauggcuguugcugaggguuggggggagagggacacggggagugcguguauaacggggacagauuucaguuuaggaugagaaaguucuggagcuggucggcggugaaggugaauauauugaaugccacugagcagugcaccuaaaaaugauuaaaaugguaacuuuuauguucuacguauuuuacgacaauuuuuuaaaaacauagacaaagucauuccaugccacagacuugccagagacugucgccugaaugggugacggugcaccugacugcccccaggggccuuggggcccuguuuaaacccuccuuucuugucccuaaugccaacagguuaucggggcccaccagggccaccagguucugcugcucuuccuggaagcaaaggugacacagggaacccaggagcuccaggaaccccagggaccaaaggaugggccggggacuccgggccccagggcaggccugguguguuuggucucccaggagaaaaagguaacagugcccauggccaugggccagcagcccuggccacagugagaggagcccccuccccacagacuuucgugucccuaacgucuuguuuguguugcagggcccaggggugaacaaggcuucauggggaacacuggacccacuggggcggugggcgacagaggccccaagggacccaagggagacccaggauucccugguaagugaccgucugguaucuucagagcuaguggcucagcccagccucuccaggcuuggggacauccuggaggucaaacggccaggauccucucuggcaugggucacauguuguaaagagcagggaggaaaccaaggcugugccucggauguugucacaggaccuuggggaauggagagcuuaauauucaaacggcaggcgcugagucacggcucaggcccguuagugucuggcucaucucuagaaagcacaguugucugggaagcuccaaaagaagccucccuggugagaaacgcaguagcacucggagcaagagaguggaacgaccuuguguguuuacuggggccucucuguuucccuuccaggugcccccgggacugugggagcccccgggauugcaggaaucccccagaagauugccguccaaccagggacaguggguccccaggggaggcgaggccccccuggggcaccgggggagauggggccccagggcccccccggagaaccagguagagugcugagcuggggccuggagccccucggggcugcccgggcaaggccagggccugcuggcauugcguccucuuguguucucuuuguggaucgccggccgugccaggcguggucaguuuccagccauaacgcuucuuugguggcuugcagguuuccguggggcuccagggaaagcugggccccaaggaagagguggugugucugcuguucccggcuuccggggagaugaaggacccauaggccaccaggggccgauuggccaagaaggugagugacaguggggaaggaccuucccagguccuagugcucuggaucugacucacagacuguggucugcaggaaggggacacacgagagcccagaaaagccagaaaugaggcgcugccccacccuccugcuccuaaucugggcguagcagcuacacuccuaugcccagcagaacaccuggccccgaguccugggacagccucccuccuuuuccugggacaccugcggugcuguggagugggcggcagggaucaguagacuucaagggucaggauuagacaaggagccaaaagaaaccgacuauuaaaauguacaagagccgcacugcgaagcccugucuuacuuuuuuuucuuuuuuggacagagucucgcucugucucacccaggcuggagugcaguggcgcaaucucagcucacugcagcuucugccucccggguucaagcgauucuccugucuuagccucccaaguaguugggacuacaggcaugugcccccauacccagcuaacuuuuuuguauuuguaguagagacgggguuucaccauguuggccaggcuggucucgaacuccugaccucgagcgauccgccagccuuggccucccaaagugcugggauuacagguguaagucaccgugccuggucgucuuauuuuuuaaaauuauuugcacauauacagaaugaaauaggccaggaauaacagcuauucaugaaaaaaaaaaaccucaaaauuugucuuaaucaaccugagcucaguuugagccaauggucugagcauuaaaauuaaaauuaaaauuaaacauaggggccgggcgcgguggcucacgccuguaaucccagcacuuugggaggcugaggugggcggaucacaagggcaggagaucgagaccauccuggcuaacacggugaaaccccgucucuacuaaaaauacaaaaaauuagccgggcgugguggcgggcgccaguagucccagcuacucgggaggcugaggcaggagaauggccucaacccaggagguggagguugcaaugagccaagaucgcgccacugcacuccagccugggggacagagcgagacuccgucucaaaaaaaaaaaagaaaauuaaacauggguaguacuauugguguccaagucaaaggaaauagcaguccccugccccuggggacagauccgcagccggcaaauuauggguaguguggggugcaccugaaaacaaaugccagcaaaugggagcccgcccaggguaggagacaagcuagggaugguggaggggaaguguccugggagaaagggccaugaccaugggugucccuuggaaggggaggggacaaugggagaaagggucacuggggauagcugagaaauauucacagagcugcugugcuggaggcagaugagccacccccgugugcuccucggguaggaguuacaggaggcugcacgcagaaagaacauucuaacccaggcuguggucaagugcgcagucagcauggccugcgaugagccaugucuccuggaaguguccagcggagggaggccacugcugggggugggggcuggccugcgauacuccuccggacacuuccaacgccaggcacguugggcacauccugaggggcacaugccuaccuauggcugacugagucuuuuauggaaaggaccccuccucugugcccagugcccucacugccaucauuucaugcuacugagaacaaaguguggaucaaauccuucccaagagucuccugaucucaacagacugagccccaagaucuggggaaggagagcgaugguucuaggcgcaccuggaaacugcccugcacuccugggucccgagguuucuguggggcggcugucaagggggcugcucucucucucuuucucaggcugcaggugcacuaggccguccacucucucucucucucaggcugcaggugcaccaggccguccacucacucucucucucgggcugcagguacaccaggccguccacucucucucucucucucucucucgggcugcaggugcaccaggccguccacucucucucucucucucaggcuguaggugcaccaggccguccacucucucucuuucucgggcugcaggugcaccaggccguccacucucucucuuucucgggcugcaggugcaccaggccguccagggagcccgggccugccggguaugccaggccgcagcgucagcaucggcuaccuccuggugaagcacagccagacggaccaggagcccaugugcccagugggcaugaacaaacucuggaguggauacagccugcuguacuucgagggccaggagaaggcgcacaaccaggaccuggguagguaccucccacccggcccccguugccugcucagggcuggcccggaaguggccaagaucaaagggccacagcgagacucccaaacccuccacggcugguaaguuccccugacggaaggguccaucuacauuccucgagugcagaaagauuaaaacggccuuugaagcagaagccuuacaaagcccuuaaaccucaggaccuuaacacagggaccugccuuuuaaccugguauugacuuccgcaggcucccaugugacccgucugacccccgaccccucuccaguggagaccaccaauuacuucaccuccuucuuguuuuugacccaaguucuguagacuuggagucaggcaggggccaugaggggcugggguucauguaagacucucccauacagccccccgaggaaaauggacccauggacacgugugcaugcucuuauuuaaggaagccuuugaaaggcauuaacgcgacuucgaauacagaaaaugcaauacacacaaauuacaaguggagguagcuuagucugagguccucuuugagggggugacgggaagggucucugggauacuggcuguguucugccuccucggugcagguuacaucaggcguucugcccccgggaagcauguugcuggcucauggugccuucacauuccugccugugcgccccgccuccacaaugaguuucuaaagaacaacggggcaaaggccgccaaggauaagggccaaaaauagaucuaggaacagggccaaggaggcagccuagcaccgggcauguuugcuaaagguggcugcacuucugggucugagcuuuucagcaauccaugugaagagggaaaccugcuuagcugcagcauucguuguggccaggagauaaaggcuaucuuagucuccagaagcaauaaagcuacauggaagggagaagggccaggacuccuucugggguggcuccuuggggucaaagagcgaccccuuggaggccaucagaguuuucuuggggccagugcuguuaagaccccacuaagguaaggcucacccaaaaugcuauuccaugaagacgccacucccuggugauccaacuuggcccaguaugugugagaacuuguagaagaacagagcuguuccaaaaugccaguggagucugaucaaaaagagaaaaagaaagaaauugggaagccuuagccuggcccuccaguagguggcuaaacuccaccaggugcccuggggcgaguccgugacacacagccuccugggccuggcuggggcuggcaggugcgucuucuagccacacugcacugugaucucaugaccccuccuuccacagggcuggcgggcuccugccuggcgcgguucagcaccaugcccuuccuguacugcaacccuggugaugucugcuacuaugccagccggaacgacaaguccuacuggcucucuaccacugcgccgcugcccaugaugcccguggccgaggacgagaucaagcccuacaucagccgcuguucugugugugaggccccggccaucgccaucgcgguccacagucaggaugucuccaucccacacugcccagcuggguggcggaguuuguggaucggauauuccuuccucaugguaugugguauuugcccaguuccccuccccaaccacacccugcuggggacacagcaagaacagcugccuuugugagaagaaucagacacggcaguccagggugugcacugcacaaggguaguuggcccaggaagcgagcgagagcuggaacacagcuuacacuuggcuaacugagccacaugcugggcacagggcuuccuccacccagaaagggcucauuaauuugccaccaggccuuuguaaggaguguaaccaggacgaacuugccuguuauccgucuuacuagguacaacaccaacaccaaaggugcagcugcuuuggguuuaccagaagucuaaauauaugggagacuuuucucuagaauccugaucuuauuuagaaucuaucuggaaccuagaauacccugaagaaauaccuauuaacuggcuggcuuaaaauggauauauauucgugaggaaaauucuggaauaccuuuggguauaaaauagagagccuguggauacuuugaaagccaggagaaggugcacaaccaggaccugggaaggcaccgcccacccuuccggaucgccuuuggguauaaaauagagaacccucagcuuuggccagauuagguuuagcuuaaccuccaggggagagaccacagcaccauagugucucuugcaauauugccuauuaaagcagaggcuccucaacuuggaauagggucccgucccgauaaauucauuguaagaugaagauacuauaaguugaaagugcguuuucaauuuaugauggguuuaucuggauguaaccccaccaaaaaucaaauagugaauugaauacauauugcuuuugcaccaucgaaaacucaaaaauccuaagucuaaccaugguaaaucagggaccaucuguauacuauuguagggagaaaagaaagucucacugaggacagugggucuuccagugaguuuauuuauaugcauuauaacugucauaacuccagcuauauggauuggaugcccagcauguuaaauauuucauaaauuauauauauauauauauauauauauacacacacacacacacacacacacacaacauaaaauauaaauuacauagugauugcuaaucuuucaaaacaacaggaaaaaaaauccggauucuaggaaaggaaggaaaagauaaacaaguauuggcauuuuaauagguaucguugcuaugauaaguuggagcaacaggaugcuaaauccugggcagggacaggcacaauuucuaccuuuccagaagcuuaucauggaaggugacuuuggagcaaccuucuuuuguuucacagugaccuucagggugccccugugucaggaaguaagcuuugguugcuccuguuuuuuucacucccguuguuaaauucaaaauaaaugagccucucccuugugaagggcaugauuacacaguauccagaaaggucaggcauccccuguuccauuagcaucagguuucaaaugacugucacgagauaagcagacauuauccucugcacacguaacucucugcuuacauaaauggcugacagccccagcaagccuggaacuugacauccccaaaaggcauggguugagacggcuccugggucaggacagaugggccagaaguaccuugacuucugagaacagaaaguccccauugucccugacaauggauaagugagcagacacaucuguguacuggagaugugcccccuccagaugugcccugacugccgucuaggaggcaggaccuaaaccaagacagcugugugccucgucugcacuuuaaauacucuuugaucccuucuguguggugacaagcauaugguaccacuagggcugcuggcaucucagcauaauaagagcugacuuuggagaggagaggacagcuuggcugagagcaacugccccaccguccccaguggguacgcagaaggcgagagcagugcugaggcuagcgccuggcucacccuucuuuuguccgugaggauggguggccccagaggaugcauuuucugcauucccuacaagcgagcgccacgugggagggaggacaagggcagagccccggaugcagacugcagcagcaaaagucauuuuccuccccuccccucgguggccucucucaaagcugcucuggcagaggcuacaaguaucuagccagccguuauuuuaguuccucuuuuuucaauucuggcuacuaucuggagcccucacagccccuucuccaggucagccucucguccaggcaauucucuuaagauacaugagcugcuaugaguaccaagccagagguuuguccacugagagaagcacauuggaaagggugcgugugccuggacugugugcacuuaugcacgugugugcauagggguguguacacaagcaugcacuguguguguguguguguacaugcgugcauuugugugugugcaugaguguacaccaugugugugcaugugugcauguaugcaugugugugugcgcagcaaacucagcucuuaccuggcuggugccagccucuaagacuucucacauugugcucccuucugaccucguucugggagucccaggugucuccuuugggcagcucccagcauggccucagcuccuucagaccaaagugaagccggaggugcccuggaggacgucuccacuucuuauuaccugcucauuagcagacaagagcaggcagcucagggcuggacaggcuucugccuuaugugagcagaacacuuuuuaaagguuuuuggguuuuuuuuuguauuuaaaggaaagcuuaaacuggggccccugcccaaauauaucauagaacagccccuuuuuucccugcaaacugaacugagauauuucuauucuaaguaaacagauuccaaagcccacuuaccacucaaagccugcucagccaagccaaauggcccuuauacaccaacucugggauccaggaggccugccgugcgcuuccauaaaggcuaaacauguugaugcaacagaaaguagaacuuuaaaaugaaaaaaaaaaaaaggcuuccuugaagaccucagccaucucccagccagccucagaaucaacuauuuaacaaccucugauugaaaaaauauauauuuaauuacacaaguaauacauauuuauugugaaaaaucagcaaguacagauuuaaaaaaaaaaauaaaaccacucaucuuuccucccugaucaucagcauuuucagagaaggagcugggaggccuggcugggugauuauuuuuaacuuauuagccucagaugccagccuacaucuuaauuuuauuuuuuucuucuaaaaagaguaaacauuguguuaucucuucugccagguauuuuucuuugaauggaugauuaggcagauguuuuguuuuguuacugaaaugcaguggauuauaucuaccgcucguaucugcugucacggcucuaguucuuaccgaacggccagccuggcugugaauuaguguccaugcagcugccucugcagcacguccuggugccuggggcugccuccugcagggggcccauguguauuucaccagcccccucuugcugaaggcgcauucgcgaggaugccucauguccguauugacacucaugguuugcuguucaguaaaaacaaaugcacagaagagggcuaugcccugaccccgugccaccugcaggcugugauuccuaacccuguccugccccccucucugugcagcacacggcggcgggagacgaaggcgguggccaaucacuggugucaccgggcagcugucuagaggacuuccgcgccacaccauucaucgaaugcaauggaggccgcggcaccugccacuacuacgccaacaaguacagcuucuggcugaccaccauucccgagcagagcuuccagggcucgcccuccgccgacacgcucaaggccggccucauccgcacacacaucagccgcugccaggugugcaugaagaaccugugagccggcgcgugccaggaagggccauuuuggugcuuauucuuaacuuauuaccucaggugccaacccaaaaauugguuuuauuuuuuucuuaaaaaaaaaaaagucuaccaaaggaauuugcauccagcagcagcacuuagaccugccagccacugucaccgagcgggugcaagcacucggggucccuggagggcaagcccugcccacagaaagccaggagcagcccuggcccccaucagcccugcuagacgcaccgccugaaggcacagcuaaccacuucgcacacacccauguaaccacugcacuuuccaaugccacagacaacucacauuguucaacucccuucucggggugggacagacgagacaacagcacacaggcagccagccguggccagaggcucgaggggcucagggccucaggcacccguccccacacgagggccccgugggugggccuggcccugcuuucuacgccaauguuaugccagcuccauguucucccaaauaccguugaugugaauuauuuuaaaggcaaaaccgugcucuuuauuuuaaaaaacacugauaaucacacugcgguaggucauucuuuugccacaucccuauagaccacuggguuuggcaaaacucaggcagaaguggagaccuuucuagacaucauugucagccuugcuacuugaagguacaccccauagggucggaggugcuguccccacugccccacguugucccugagauuuaaccccuccacugcugggggugagcuguacucuucugacugcccccuccuguguaacgacuacaaaauaaaacuugguucugaauau

SEQ ID NO: 15533 - RNA, 29100 nt, Homo sapiens
ccucaugaggguggcggguaucucagccuugguuaauugcauuugcuuucuucauagggagcaagaggcguuucuggauucccuggugccgauggaauuccuguaaguuuuauggaagacuggaauuuuaaaacauugcgugcauccuaggcaauacauuuugugacuuaaagaaacauuuugaaugagaccuccuuuuuuguuuaugacauaaaacacguggggacuauacgugcguauucuccccgcggaauucagucagacagugaacaaauuguuugcuuuguaaacguccuuauagacuuggcuucagaauugagacgauuuugcuaaacugcacauuguuugguaauaaaaagcuagagugcuguccagauacucgcccuaaagagccagucuugugaucucguucgaacuauagagcaaccugcauauaaagucguucagccaagagcaugggcagaaugaagcccugcugagcauuugugcagcuucucaaguucuuuacagcaaccucacauaaaacgaaaaacaaaaggcaugguuuguucaugagaaaaaucucaaaaugcaauaaaauguguuuuuauaaccuaguuuacuuuacuucucguggcauaaaaaaauaaacaaaacagccugacucacagccuucuucacagggacccacgagcagauuucccaggguuggcuuccuggccagaccugaccucagggaucaauguguuuaucgcacguucugacccaccucccauccggcuacugcugugguucugagacaucugcuucacaaaccucacacauauacacagaugugugugcccguguccugcagaggcagguucuguaucaccacacacgcacacgcacagggagagagacuccauucccaggcugcacgaguagggccaugccuugcagaagagaaggagggaaugagugaguggagggcagugccagagaacucaugcguuuccaugagaucuuuagucccaccgucgaggagacauccgcagagcagaaggagacagucagggcaaaauaaaggaagucacauuugccaagacaagagcugcaagccagugaucucggggcuaccugaaugguaggcucaaacaggcacuuggguuuaccacauggcccugaacaaauaaggaaauaauguucacaucagucagaaucuugagaaauggacagaaaugaagaaucugcacaacccaaagauuaaacaaauuaggaaaguauuuucauacuaauggccugaaucuaaaucacccauuuuuaaacuacucuuuugaacucuuuggagugucuuucaguuuugucuccagcugaaaucugaguuaaaauggaaugacauuauggaaagcaauugcaacucaucuguaccaaguuuccuucauguuuccacuuuacacucacuuaauaucagaggcagaugucucacaaacuagggaagaaguaaucauaauuuggaggaaugauuguggugagcaggugaagaccauuuucuacugaaccugcugcucaaaggauccagucucuuaaccgcagaacucugauacuacaaauuaaguuaacauaaauaucaccugccauaaguaaucaguuaacaaauguagaguuugaaggaccuggaucauuuuagcugauuagaaguuauauauaagaagcgauaugcaguaaaaucuuagaggaguggucucauauagcagugaaucuaauuugaugcugagcagagacagacauuuagcucaauauaacugaaauuuuucuuugaagcacaauuucagacucagauuagauugacaugcaauuucaaauagaucaguucuaagcaaguaagaaagaccaacggcagacaaauaauagagaaaaauuuaaacauuacaguucauuuuaagcaaaagcaucacagaauacuaaaaaucuggagcagaacauguggagagcuguuuucucaagcugaagugcaagggccccuuaugucuuuauuugaaaggccacuagagugccagcucugcaaacagaucgagaagcugccaacaaacagggauuccucuggcucaccagagaguuugacugagccuguuggaucucucaucugacggcaccaguucaaccaauggcuguggacaucugaagcaaagaaaugugcaaauaaaaguucuacuuuuuuauuuuauuucuuaauaucauucagguuacggagaacuauauguaggauuuguuguguggggguuuugagguuuguuuguuuuguguuguuuuguuuugagacagagucuuguucgcccaggcuggagugcaguggugcgaucuuagcucacugcaaccucugccaccugugcucaagcaauucucauggcuuauccucccgaguagcugggauuacaggugccugccaccaugucuggcuaauuuuuguauuuuuaguagagacaggguuucaccauguuggccaggcuggucucgaacuccuggccucaagugauccaccugccucagccucccaaagugcugggauuacagguaugagccacugcgcccagccaaguuuguuucuuuaucuugaaauuuuccaaauuucucaaaguaacuguaaaagacaucccaaugcucucaaaaaucacucuggaauauauguuugguuuauuaucaagaaaacuaaaguuuaaaaguaacuacacaauaacaaagcauauagcuaaauaucuauuguuuaaagaaacagcaaaacaggcuguggccagguacugcauaaauuauagauuauuaacccagccccugugugucuccuggaaccagcuuaaugcagugaagaugcccacaaauuuagccugagucccucuagucauugcagacacuuggcuguguugccuuuccccacccccagacauuucagaaaaccugacuugcuuuauauucauguuuaaaaucuaaaaggucauguuuccuaagaaagcaaacaagaggcaaucagcucuucuaaacaugacaaggccauugauaaaaucacguugcgggugugucuucucuguuuaggauguggaucugugaaacucacuaucuaaaaugcaguuggguacaacugauaaggaccucccuguuuucccugagaaggagguagcugcuucuaaaaucuuuccuagaauuuuuaaaauguaccuuuacuuguuuucuacagggauaaggaccuuccuguuaucccugagaaggagguagcugcuucuaaaaucuuuccuagaauuuuugaaauguaauuuuacuugucccugcugauagacagucacucaacuaguaagacagaagaaaccccgacaguguacuucuuacccaagcccaggugaagcagaacuuugcuucgaaaucuuuucccugcuuagaacgauaccuuaugccuucacuuauuuaaucuuucauucauucauuuguucacuuuugaggugucuuuuccuuggauucaugccgggaacauggcuuaugagaauauaagacuguuuuaucucacaguuacaugacaacuagaagccugcugguuggcugauucucucacugcucucuuucccagggacacccggggcaaggugggcccaggggaaggccgggcuacgauggcugcaacggaacccagggagacucagguccacaggggccccccggcucugagggguucaccgggccucccgugaguauccccacagcgccugugcuccagggacgggcagaccccugcuaagcccugccuuuauaaccugggggagccucccgcucacuguggccagaacggaagcauaacuguauguugacgcccaagacaugacguuucuggauucaaguaacuucauuuuucguauucuuuaaauguuagauagaaaaucauuguugugguugauguuguucacucucagucucccaagugucacuucauuuucucccaaauucucaugcguaauaguggaaucguaaacgcaaauuaaaaagcugaaaccuugacaaaauucuguccaucaccaucuuuaucagauuaugaaauacuuugugacgugggagugcaguuauucuccagcagauacgaugcaggaguuuguuuuuuaauggaggaacuuuuauauaaucaucuguuuuguggccucauuuauuuuuuaaggucuugguaaaacauccugaaaugugucuucaguaguacguugcuaccuuauuuccaaggaaaucuugcaaauucagguuuagacuaaaauuuuguuuggugagacuuuuuauuuaaaaacaaaaacuuuaaaguggggagggaagaacagucauuaaucaccuucaucacguuuucaccugaagcaaauggaguucuccuacucaguuccaccuccaccugcuaguucaccuuuccucggcuguuucuguuuuaugugguucaauuuuucaauaaacuacgucaucuucuacucuauauaucaucaauuucauuaucaagaaacauaucuauuacuuuaagugauucuuauaguagauguugaaagauauuuacacaugcacauauguauuauguauaugccuacuguuuauauuugacacaauuccaauuuuaaagaaugacccaguaucuauucugcaaaugggugcuuguguuaauauguucaguacacuaaugccaaagaaagcacguaauaguauuaucagaaauaaaaauaacauuggcauacuagaggguugguugacagagcauucauuuggguuuugaaaauaauuuaaauccuaaaguauuucuguuuuaacucuaggaaagauaugauugggucaauaggaaauuaaaggucuuacccuuguugcugaauauaggguugguguucagaauaacccccaucagccauaagaacaauuagaccuugcccacaaaagucaauguucagucauccacauuaccauagcugcaccgaauguuaauggacucuuuuuguuguuuuuucuuuuuacaauauaucugcuaauuaggggccccaaggaccaaaagggcagaaaggugagccuuaugcacugccuaaagaggagcgcgacagauaucggguacguuugcaagagaugggagggguaaugaagggacccaguguaaauucucaacuaacaaaguuaauugccaagugaacuuugcauguaagaaugaauguacugaaggcaugccuagaauggcggcauaaucuaaaagucaucuuacuuccgaucaggauguuuucaaucuuauuuuuaauuguguguuuaucucuuucccauauucacaauacuccaagccaaauuaguacuuguaguuaauauuaguaaauauuaauauuacuaaaauauauucugacuaaauaacaauauuaguaaaaauuaauauuaguaaauuaacauuacuagguccugauagggcugaucuguuugauaugcuuauuuccaacucugcaauaaaagguaaguaaaucuaaagaugguuaaaagcuaucacucuuaaaauuauuucuucuccauuagggugaaccuggagagccuggauuggucgguuuccagguaaguuuauuuuuauuggacgauauuccaaacaaaaguuuaagagcuucagaacuccaaguaccaguuuaccucucuuaaaaacauucucccgcugccuauccauagggaccucccggccgcccugggcaugugggacagauggguccaguuggagcuccagggagaccaguaaguaccuggacacaggugcccacucugggaccaucguccggucaucccuuccagaugccacuucuucaaugguugacuccagaugagagcuuuaagaacaacuaugaugcuuauaggcguagcagagaacaucaagacaaaacggaccauuccuugcacacuuugcugcuguuaagguugaagaauaagggcuuaaaauuauggucaccagcucucugccaguuaugucaaauuuugacuugguuccggcagggugcccuuccauccccaccccauaccuacccagugacagacagcccaucaucccugggcaaggcaaaccaaagucccacagguucauaaggaggaaauggaggucugccugugccacacccaugcuagcaggcauaucacaccugggcucauuacagcaggugagauacuggccacuguuuaacacaauggcccuagagggcucauugcaaguagggaagagcagaaaaaggcacuugcugaggcuuguguagcucucuggccacucccaccacugcacaaugagcuggaagguggauuggccacugcgagagcuccugacucgcucauuccccacauauguuaguaaucagauaaauaggccuuaacuuacacaaggagcgauuugggcugcaggugagagagaucuucucacaggaagccauugcucaagacugagacaagcuaucaagggacacuaacaccaguuccuugacagauacugagaaaaaaaugaagucauauaugucuggggagacucagucaaacuaacaguugggggguacucauaauucucuucagauuauaauaaaugacaauaauaauaauagauuuuguuucuacaaagcaaauuuccccggugcugugaaagucauucuugcaaguagccccgucugugaaagaccuggucaagguggcugaaaucagggucauacgaggcgcuguugcuguuucacuccauaggguuauuggcuuagucacggcacacaugccacaugguuggauuucauacuuuaaaugcaccacucggagaaguccggcacaacagauuguacuugcuagguccucagcugcucugacagcuuuugguucuucacaugagccaugcaaucauccacaacccccucccuauccacuccuuuguauccacuuauuuguacuuaaacacucuuccccugcaucugaaaugcuuuaauccuaagcacaguguugacacugaaugcucugcagaaagacacaccaugauacugcagauggacuuuccgcucugcagugccagcuuguagauucauucuguccaugaaaguuggccaagcuaccaggaagaaguccugcauggagucucguggggacucccagaggaagucagggaagcugucgcugcagucacagggccugggaccuugcaaagggaucagaacaaacacagagaggacaugggugaagucaaaagcccaaacacacaaaagcaaagcagaaacagcuguccguagacagccggcagauucugagaacuggagcugacccgagucccucucccccagcaugucaucucugccaagccaaaugcaucagaaaccuccaugcauccuacacuguguccuaaauauacagucaauggcuuucccagagcuuuccaccagauguuaucuggguccugggguaaagaaaaccauuuacacauuucuuuguauuuguacagggaccaccuggacccccuggaccaaaaggacagcaaguaaguugguuuuggggggugaggaugagggaaggggguacuuagguguuuguggguuuguuuguuuuuuaccauaaaacuucuugguuggcaacuauuuauuguuuauauuaugaugaaaacaguuuuggagguuuuuaagacuuaauguuaaacuccaaggauagauccauggugccucuggacauuaaaaaaguaaacagguggaaugauuuguuguuugcaaauuaauuaccacaugccuguugguauaugaaaaccacacugaggaacauuugauugaaacgaagauuagaacaauuuagggacaguucacauuuauucacaugcauugauuuacgagaauggacaaaauguaacucuaucuguuguagggaggccaaugucauucuucuuaucuggcuagaauuagguucuacaggagucuaaugucagccucuagggauauauucagugauaaucaaguuaggcuagagcccaaagcuguauacuguuuucaucccagaaagguuauuaaguugauuggaacacagcaaaguaggugguuuguuagaaacucggaggacagaacuaggguuccuuauuaucugagaaagcuggauaaauguccaagacaaacgaaugcaguugacaagggaaguauuugaucaaaaugcaacauaauucagaaaugcugggcugccagcgggaagcaucuaggaacguuuccuuugcccugugucccgauggaggacgugccaagcccacacguugccaugccugcccauugcugugaccccuggugacuacagcugccaccgcccaugcccccaggcuccuguccccucugacacagcuuccgguuggcuggagggcuugcgcuggacgccccaccgccuggcagccuggagcaggaugagaugggccccaggccaagagcagcagaaauaggaccaggcggccgggcugaggaggcagcagccaagcccugagcccaggcgugagccucagaucuccccuugcugcggcaaacaucaacagcccuccucaccccugaccaagucacuuccuggugacuuugacgaccagcucaggaggcagagagggacugugggggacucacacaaauugcauucuaauccagccuggccgcguuucugugcuuugauuucagcuccccaccagguggggaagaagcaaaaggcaaaaauucauugaaggcuuuguuuuuauuuucagaaaauaucuggacauuggagggggcggacgguagacugcagagaaagagagaucagauagggcuuaugugaccccgcugucacugugggaacacacagaaacccugggaaagaagcaaagcuguugggaguagaagaggacagugcccgugaugugcacaaauuugucaucuugcuuuuucuaugcacgaaucuuagaggucagcguugucaguccucccacacguggcuacuacguucgugaaauuauuaaauccuuacuaugauacugggccuagcuuugcuucuuagguaaaaaaggaagacaaaaaguuuggauaaagcccagagaaucacguaaaaucauuacauucugauugauuuuaaauuuccaaagauuauuaaaaagauagguaaaguuuauaugaaaugaggauuauuuugccaaaaugagagaagacugagccagaagaaaagacgaaucaugaucuucaaaugcagaguccagggagugaaauggggcugcuucuuccaucugcaggggccagaacccagggacaugcucuuagacuacagucugcagagaccauauacucacgaucgagggccagcaccaccugggguccaaucucagcucccacucauucacucugaggccuuggucaacugacaugacaaacugucaauuaguuucuacaaugcaaagcaagaauauuaugcaaauauaguugcucaguaaaguugccgauaaauaggccuuggguuucuuuuucuaagaaaaauaauuuuauuucucucugauuauuggcuuuuuaaaacuuacagaaauuauuuaucuuuucagggcaacagaggacuugguuucuacggaguuaagggugaaaagguaaaggaagccuggucaauuccagcagaggcaugcagcauuucucagccaggaaauaaaucauuuuaauuacuaaguucugugcuguaaaacuuuuaccuugaguugaucugcagacagaccauuugcauagggaaauaaucauugcaaagugcuagguugucaccuacauaccagugauaauucugcaucaacaagacgguaaacauagaccaucuaggcuagccgagacucugacacagagacauaagcucagcucaucuucagaagguggaggugaggacaugucacugagugcaucuucuccuguguggagcccagaggugauggaggggacugagacuacagccagaggcugacauggagccaucucagggaccaggggaucucagggaccagcccugguagggcacaaaggcagccguaaggaccauguggcuuuucuccuuccuuagagugcuaagauccaaagaccucauggccuuugagaggaacgugugagaucacgugcaugacaggcuuaacgcagcgccacaccccgcaagcaaaaccucaccaacacagucccauugcguucaccacaaaagccaugagcccacuguaaaguagaccugacccuuggccucaugauuggaacauuucuauuuuguuuucccuucugcuuuuugauggaacagcacaguaaguugaaucaaguccugcucaugugugaagaagaaacucuuccuucuuuacauuaaugccauagaagaagucaaaaaaggacaauuagcaagcagugggcuucugggaaaaaaaagaaagaaaaacauugaagauccaaacacauaaaaauuuauagccccauacaaugaaauauaacaaaauaauaaaaacaagaaaaaucugggaagaaaucauuggugggagaagagaauagucccguuagauauaauggagaugaaguuagagucuacagucuacaaaggacuuaugcaaauaaugaauaaaaaacaucaggggcccaacagguacaagggaggagaacaaacaguuuggguauuuuaagauauucuauuaguggacacucagcguacacuauggaguaucacuuucugcagcugacccaucaucuccauuuacugcuguccguguuaugugauaucugggcucagacuuguaugauacaguuuaauguggaaagaaaggaaaagacaaugauguucuuuugugucaaucaguuucugggagguaaacccagaauauuaugcaaggauaacgguccaguaauguucuagauagaucgguuucaccaucugugcaccacaucaaaaaguguuuucugcuaaugauaaaaaugcaaauuaaagcaaucuugggauauuauaguuacuuaagauuuuuuuuauuauauaaaaacaucuuuagcuggggaaguagucuuucauuucuucagcauuucguuuaucucggugcccaucuuggcaaccaguagaguaauaccugucaaaaaccauaaagacauucagcccucauaccuaauaauucccauauauagaaauucauuguaaggaaacaaccccacagaaacaaaugcaguccagaauuguaaacaaccuacauggcuuuuaugcauaaauucuaaaugauugcuaaugaaaggaggauauaaaaaacuuacauuaggauuacucuauuuugugguuauuauacuguaaauagguauacauaugguaaguaauaugcaaacauuaaaacugcaguauuuuggccagguuguauuuguauucgaguuuuguaguuuccuuucgauuuaaagacaacugcuuuugcuuaacaauaugcagggugacguagggcagccgggacccaacgggauuccaucagacacccuccaccccaucaucgcgcccacaggagucaccuuccacccagaucaguacaagguaaagagcaaaauugacucuuuucauaguugaaauaaaaaaaggagaguaaaaguacauuucuucaauuguauucaaccacauuccaaguagaaaaagccucaccaccaacuuggcacauuacccaugaaaacauaaccggguccucccagaauguuuucaacucuuccagacgguuacuagauucacagugcgaucccgucgucaguccaucaucucaauucugaugaaucugaagcaacaagagaauucauuuaaaaaaaaacuuauaucuauccuuacauucaguguagguggaggcuaauggucauaccguaauucaaagccagaaucauggaacugucuagcaaaauguguucagcaaaauaaaaccuacuucuuugcugacaugaagcaccuuuuuggagguucaaagucaguuuuugacaguuucugaaucauucaauuaacauuuugcuuaauugaaaucaugcucuuagucugaaauaggaauugccgcguccacucucucuacguuuggaggcugcugugccacccacccacucggaggucccacagccuuucuagggcuuccuguucccccugucaaauggggauggcgacacugaccuccuggagcugacgaggagguugcaggcgacugugaaacacucaguaccaugucgggcacgcagaauaucugggaacuaaaauagaaaccccaaacggggagaucuuaacuuuccaaauagaaucugguucccaacucuugagcaggguggggcuuggguccuguguccuggguccugcauccuggggcggauuuggcaggcaggaccacugccuugugggggaaaucaacccagguggcugaggcucgaguuaugagugaccguugacaaaaauguccugggagacggcagggagggccucuguccagcuucuggacuggagcccagagcagguuugauccacguggaggugcucaaucuuccgagucaaguuucccaccuuuucuacaacccaggccagggugggauccggggcugggaauggccaacccgcaggggcaguuguguccugcaggaauccaagguacccucagaaaugacggggacaaaggacccgccaauugcuguuucuuucaccauuuuagacgaagagaaaugggaaaaacguagaucauguuuuugaucuaugauauugacauggcuuucaacagccacuuuugcuucaaguuucaauauguuccauguguaucuuuuucucagagggccuccuaguaauguuuucuuccgaagaguauuuucauuaaggcuuuuccuugggcacguucucccaccauacggauguaaacaucugccuggaacggugugggggauaaaggaaaacagagagaaggaaagacagacuuucacuuguaccaagaggaauacaggaauuaauuuaucuugugaaaaucuagaagaaaugacaccucuuuucucuugaauuuugaagcugcaaaauuuaagagucauguguuguaaucaauuuaugaugauugugugaggauugauucaguacuuucagcucaugucaugaacccugauugauuuuuacccauuaccauccucaaauuaauaagcguuucuuauuuuucauauucuucacagggugaaaaaggcagugagggggaaccaggaauaagaguaagucgaguaaugagcaugcccccuccccuguggcuccugggcugucggcgcucugccaggcaugacggggugcaccaugcgcucggggcccgcacaccgccagucucucauccccuuguccauagcagaacaguauuagcaugcauuuuuacacuguauuuuaagaagucaguucuagaauuucuuccucuuggcaucauaaacacuggcuaaucaucuucugagguuugggaagggagcauggagauggcggaggggcguggcuuccacucaggcgccaccggguucugcccuccguccccucugucacugccuguccucagagcuccagcucucccucgcggucgcuuaccacgugacaugacacaugcaguccuggaugggugacagcccgggaaggcuggcgggucuccuaggaccgugcccugcacugcgccugaguugagcaucgccaggcggucuggacaccaucggggcugagaacacagaguccuggagcagaggaugacacgugggcccuguuggcuggaggggccgccccuggguugcuccuuacgcccccucugcucucuccuagggcauuuccuugaagggagaagaaggaaucaugggcuuuccuggacugaggguaaaccacgccuuuuauaacugcaguugucgguuugguuugguuuuuuucaguaggcuuuccuuuuuagagcuguuucagauucacagcaaaauuuagcagaaaguauagagauuucccguuauuacuccccacccccccccacacacacacacagcagccccccagcacgaacaucuagcacugggggcugcgcuggcuacaauccgugaaccaucuugacacaccgucuucacccagcagcaggugugcagacgcggcccuccccguggaggaggcgcgaguaccgcacaaaaccuuucugguuguguguguucagcucaguuagucuguaguaaccagaaauguagaauaucucaaacacacauugauuuccgacugucccaagagcccaacaaaaaugucccuagucguaagggucgggaaggggucaccguccacggugauucagccaccugggagacagaccucaccuucagagccccagccuggacugaccccacucacuccacgaccacaccuagcugagggcugggacggguggucagagcccugggcccaggaagagaaagcagaauuuugguggcuaucuggcaguugcuaccacucaaaagaccguauuuuacauucuccaaaaauaagaauagagagacacaguagaacauuagaguacaagccuuuuuacauuuuuaguuuuucauuguacuaucuuugugaguuucucuguauuucuuuacgugguagaaaugaugcacguuaugaaaguauugcuaaaaugaugugucucccucaggaaaugagagucuugggguggcucugacgucuuccacagggaagcagcuuugagauuaggauggauucugcuuucuucgagccuuuuuaucauagucauuauuucccauccccaccuccccacaacuuuguaaaggggaaagaauuguauuaauaguugguauugaauuuggcaauuuguugcuauucuucaaaaucuggaccugagacuuguucaaucuguccaucggcauuuugcugugaucacagccaggugccguagucaagcccucuggaaaugucuacugcauauucugagcuguuugcuucuguuuuuuguucauuccaggguuacccuggcuugaguggugaaaaaggaucaccaggacagaagguaaguuggaugcaugaacugcagucugcucugggcccacgacaucccacagagguuaaauaaauaggccuuggcaucucaggaaagaaaauugucuccagaaaaaaacauugaaaaugguucuuguauuugcagucacaaagauaauccugccucacaauacuugaaccgggucauuaccuuggcucucauuuuugcaaacuaucuuuugcuuccucccuuucaaaguguccgucacucgaccccaccagccaugguuucuauaucguccaaccucacaccccuccuccauguccuugucacucauaggaagcuccuggacuuggugacccaggguccaccuaaauuuuuuuauagauugacccauacugugacacuucauuuauguuuaaugacaacccaauuauuuuuaucaugaguucuguggacagauuuuuggcuuuuuuuuaggagaaaaauguuauguaagaaauguauuaugggccaggugcaguggcucaugccuguaaucccaggacuuugggaggccugaggaggguggaucaccugaggucaggaguaugaggccagccugaccaacauggugaaacccugucucuacuaaaaauacaaaauuugccaggcaugguguggguaccuguaaucccagcuacucaggaggcugaggcaggagaaucacuugaaccugggaggcagaggcuacagugagccgagaucgcgccauugcacuccagccugggcaacaagagugaaacuccaucauaaaauaauaauaauaaugauaaaauuuuuaaaaagaaauguauuaugaaucuaggucagauuuagaaccgucugaacucuaggucauacacaauguuauaguucagugguugaugccuuuucacuguucacugugccugcgggucccaccccacagcacacagcacacgccuccuacggcaggcccggcaggcuccccagacaccaccacugacagccccuugggucucacaucacacucaugccaacauacacacaaagacguguagcuucacaugcauguaacggagcaacaaaagaaaugugucugugcugcucugcccagugccccuuagagaauguuccaagucggcagguacacaucugccucguucuuuaaagcugcagagaauggcagucaauaggugcgccauauuuccuuacgcccucgaggugguuuucauauuuccagcaaacaugcagucaccucggugguacacagggcuuggcugccugcccaugggcuaguauguccaucacucaguccuaguaggugcacagagauagaguuuuaucaaaaucacuagccucagaaucacaacuccguugaauccugcucagggcugcacagagaguaguguggcgucuggaggcccaugggcuucaguuagcugguacagaagcucggcaggccugguggggguuccgccaugcuuguuccaggaccacagauggaccugccucccagacucgcuuucugaccuccacuggcucuagacacgggccgucuugacccagcauucugcuuuugaccauucaaacuuaacaccaaucuugaugacuuccugcaaccuccaaugaucauacuguucccauuucuguuauuuuaugcuaaacucagcccagggagccaaugccaggcuuugccguaaucacacccagccuuucauaacaucaguuacugaucggaguacucccaaaggcggcacaccuagaacaagagcuauccaaaugcaccccacccagaggccacauucuaguucauggcuuaggaaaagcaaauauuguaaagggacagaggcuaaagcagacauuaucguucaaaaguaacccguuuccaccuaccccaugugauuaaagugcugcuguuaauuuccuaccaugugcugguaaaauuauaauuaucuuuaguuuuccaucuucaacacaagggacuuguaguauuuaaaagugcauuuccaggugccuguaaucccagcaguuugggaggccaaggugaguggaucauagaggucaggaguucaagaccaaccuggccaacauggugaaacccugucucuacuaaaaauacaaaaaaaaaaaaaauuaccugggugugguucaugccuauaauuccagcuacucaggaggcugaggcacgagaauugcuugaaccugggaggcagagguugcagugagccaagaucgcaccacugcacuccagccugggagagacagugagacucucugucucaaaaaaaaaaaaaaaaaaaaaaaaaaaagggcaguuccacagagcugcucccuggaacuccaaaguuaaugaaagacaagaugcuguguaaacaguggccaccuggcagcuccagggcuggggcccagaugugaggauggugaggcgucaggcuuucauuucccagcuuacuuucugcaguugcaacaacuugcgaagaugcagauauuuccaguuaaguggguuacagggaggcaguuuacucaacuauagaaaugggaaauaggcagacauacacaaaugacgcagccgccgugcuugugagcaccgaucugcaccacagcuauguccgcccucugccaucccacuggccagguggccaucacuccaugacuuucauuuguuccccacccaacaccucccccuagacaccaaaagccccuccaaggagcaacugcucggugacauaaacagugcaucaaaaugggaggaaccagaaaagaaaagauauccuggguaggaacuugcccuccucuacauaaacacagaauugguugccugucauccccacugagauugucagaacuucuauuaguuccagccuuuucuaaaaaggaauggagacguagcauuuaugaauuugguuauauucaauuuucugauaaauuagagaugguuucgucuccucuuucuaggggaaacauaucuuuaguaacugagcaaaugcuguccacaguguuauuuuauaauuuugaaauaacuccacagaguuauuuuauaauuuugaaauaacuccacagaguuauuuuaaaaaguguucguugagaccuagucuccuuugaggaauacaugccacaccaacacgcgucguguugugggaaguccccccucaauaggaccauuguccucuaugaggacuguccaggacuucagggauguugcauuugcacaggcugcagugucgaugacuuggacucaccagaugcagccucaguguucccuguggcuguguguagguuuccucugcaaagcuugaaguggcagacaugaccucagauugaguucuuuuauggaacucucacugucuuuagucuuuuauacuaaaucgcaucucauuugcaggcuggcaggguuucuuugcagaggcgccucuuucaagaggcacaugcguucuauuuagccuaacaggugcucccucggccacugcaaugaaaaggguacaacaggcaaaugaagaacagaaagauaacaggccaguucacaccacgagagacagcagacugcuuuuaagcuuuagaaacaugcaucucccuaaaaaagccuagccauacauucuuuucaucuguuugugucagcuagucccugaggacuucugcccaaggacuuuccuuacuccaguuauuuccacccuugaaaaacauaaaaucaaccuuguacuucuaaaauugcauaaucagaacuuccuaugaaucauauauaugaccucacugaauucaaaugagugauaaguuauuagauuugggggagggccggggagaaaggagguugcaguuucaaagcccuucacaguuauccauucuaaaauagugaucugcaugucagucuccugaccucagcuuucccuaagggugggcucuguggugagcuugcuagcaggaguacagaccuugccuggaagcggggucucagggagcccggcggagccuccacuggguccuucccggggugguugccagccugacucugggagcgccugggugauuccuccuuggccaucccugcgccuccccgacccuguuguguuugccacugagaaacagagaggaaaaaguuuugaucgucauuuugacuuaggguucccgccuaucuggguuucacugccaguggucucagaugaacccugagggugcauuuucuccuuaagucgugcauaacccucagccucccccgagucaguugaccuguugaccugccgcugggaacuccccuggaaaguuuuagcucauugcuuuggcucuugggguuccagcugccucagaggaauccugagugcuucuuaaguugucccccuuccccaauggguuuucuauaaugcccagugcauuucagaugguucaaagugcccaugcugucuuggacccuucagcagagauggcaacacguggugucuggggugcuuguuuuguuugcugaggaugccacagcauaggugugugaugcucguggcccagagugaagcucagauuugacaaauuccagggcacccucugagcuggccagucuguggcugugcucacagcucccacugaguguccagcugccagcuccugucaugccagguacuugaggauuccuagcuuagcuuaugacguggccucuaaacaggaccucauuuuuaaaaucacagaaguuugucuuuacuuuugagucuucagcuccaccuagcgugagagaaaguccggguccaaaccacaggaccacaacaacacacacaaagugaagcccgucucaauucagucuaaacaacaugacuuucagcacaccugcuccugggugucaagauaaccucgaaaguaaucagagaauggaccuuucuuauaccuguggcaucuggcauucugaauuuugagagcugaaccaugcauguucuuuaaaagagggaauacauugcuagauuuuuagagagcuuuacucuucuguccagauaccucaugauaugacucaaugauaaacuuuuucuuucaaaaaauguucaagggaaugagaaaacaaaacuuaguguuauaguuguuuucuauuuuugaaacagggucuugcuguguugcccaggcuggaguauggugguaccaucacagcucacugcaaccucaaacuccuggguucaagcgauccucccaccucagccucccaaguagcugggacugcaggugccugccaccaugcccgguuacauuauguauuuuuuguagaggcaggguuucacuauguuucccaagcuggucucagacuucugggcucaagugauccucccaccuuggcuucccgaagugcugggauuacaggcaugagccaccauacccagcagagauuuuuuuuaaugaagagaaaaaacucuaacuuaagaaaccuuaaugcgucuauuuugguacuaaaugaagauuuucaaaaccuacccugggagagaguuucaacaguugguucagguugucaacaccugaccccacgaucaaucauaaaagcaacccgacacucauaucuucuguaggagaagaggugcccagcauccuccgcaaaugaucccugcugaaaaggggaaccugcaccuagggcagccuccagcccuaaugacucacguggaggaaacgugggguuagaagaacagauuguacaacaccacgggggugagacugacugcagcccaccacaaagaacaucugcagcacagaugacccagugucuucaacaaccacaaaaugauacuaaaaacauagaaaggaagaagggacuauugugaauuaagugagaauucagaggcauagcauccaaguguuauauuuggacuuuuuuggcuccugguucuagcaaagcaaccuuaaaaagacauuuuugagacccaagucagggaaaauugagcacagacuggguuaauacaugacuuuaauaaacuguuguucauuuugugagauauaauaaugccauugcagucccuuuuuggaguuauacaucagagacaaaaauuaaaagcaaauaucuuucuugcagggaagccgaggccuggauggcuaucaagggccugauggaccccggggacccaaggugagcccguuucucaugucuuugccacuuauggugucucgcccacccuggcuggccuuacuccccucuugaugguguccuguggaggcauccccugcccuaaaaaguacaagauccccaaauacacggccucugacacuggacagacgagguggauggugaccuacgagccacgugugcucccugccagggagaagggugccaccugccacucagggccacguaggggugcgcucaggcacagaggaagccagcagcccuggggaaggcaggccuuguaguaacaagagggugcggugccccugguuuccaagggaggauguggcuugugugaguaauuccugggcuugcagggaggggagaccauuagguggaagaccaggugggugcugcuggucuagcugagaggggaacgcacccguggggaaccugggugggggcacaucuggagaggacuucugagccgggugaggcucaaagaggugaagguggugcgcgggaugcugccuuaugacaaaugcugccuuacgacacagauggcgcuccacggggguccugcggccgcaucaucucccagcccacccucgccaggcggcucggcuaucacuacccaaaauguaauagucugaacuacagaaagcacagucuccuggcauucgacaaggauuucaaaaugagaugagccccugccugucuuguucucuuugggcaccuguggcugguggcugggaugccaggcucugccacccuagcauggggaugcugccccaggcacugucugugguuccacugguugaaauagcugcucugccagccugacgguccacgcucggguuucuucuuuggaaauauguguacugucaaaaacuccaaaaggcuauucucacauccuguuuuucucuuuucuuucucuagggagaagccggagacccagggcccccuggacuaccugccuacuccccucacccuucccuagcaaaaggugugugaacaauuucaccugcauaguucagcaucgcauacacauucucuccuguuagggacacagagcuaugaacuuucaagacagauauucuaagcaacccuaaaacuuaaaguauaauaauaauaaaaaaaauaaaaaauaaaccacgaaauuuagaacauaacuucauguacaauuucccucaugcuuaaaugugucacagggagaccuucauguugccugugccugagacaguccucaccaccuacacgugagaaauccccuccguuggggaauucuuucacuucugcuuaacuuguagaguucuaguucugccgucuggacuaucgcugaagauauccagggcagcagccccagccgccuucggauuuuuucuccaaaugcaccaagguucuuaagcccucugcuugccagcccgacaccuggaauugaucauaacucauaaccagugaacagucacaugcuuucaggcuucaaggcaacuaaauucccagauauuuacacauaacaaccacuccccacugucacaguugaccuuggaguguaaacgaaggacuuugcgcaugucgucacuaaugcucaucuuguuauuaaggcucggcuuccaaauuggcgagaucauauggaaaucugauccuaguccugcaacuagagcacuuggcucugaaccuuguagaaugcgcauccuucuagguuaaaaaaaaaauguuucgagaaccuccuccugauaaucgugcguauauaucuuugcggaucauuggcccauguuauagucagcucugugaggacagacauuucagcccaucuuguucacugcuguauucccaaugccuggaacaggacaggcacagaguuggagcucagcaaacgccugacugagugacgacgugcagaaacauaucagacaggcauugugaaggguaggguuuuuuaaauacagacgcucugguguuuaccucuugaacucagcaggucaccuggucucccuguccucuaagccuaggugucaagaauucaccucccugcuucgaagcgagcccucugucaguuuaauaauggcuuugcaugucuucauccaaugcugaucaaaacgcaggacagaacagggccaugggcagugccuccaggagccccugagaugucugucuggggaggcguggagccgugaauggggauauuuugaaauccaugcucagcuuccaugaugcccguaacuacgaagcuggcauuuccugccucauccauggcgcacaccuggcuaccaaaccugagacccacuaaaaagagccaugagcccacuuugacuugacucauuauuaauaauuuugguaaaaaggaaauaugcuguuugagauuuuaagaacauaauuuuuaaguuaaugcuggcgauguuucuuuugcauuuuuuaaaaauguugcugacugagaacccaacucucaccaaccccucccuucucaccguacuauauuccuggaauucacacugcaaaggcgggugcuuucaaaauucacuuuuucccacaagcggauucagaaaugcggagguugccugccgccuuuucuaccggacaacauucccgaguuauuggugagcuggaaugugacugacuugcauuccaggguuucuuaaagucaaagguugacuaaccagcagauucccucagggaaaagaggcaguaaauguaucuuuuucaagguaacauugcaugaacuugucaaaagacaaaaaggauagagggguuuguauuaaaagaaaugauuccaagguaccuagaaauaaaaguaaucuugcuauucuuccaaacaagugagaaggucuguggcuuucaauuuugugucuuuuuauggaaucaacaauggcuaacaggaguguaggucacacugugugccaggcgaugcuccaaguuguccuaguuguacuuuucaguguguuuaccccucugggugacccugugagguggagauggacuuggcugcuuuuacugagggagagauggaagcgcagggcguugaguuccuugcccaggguugccuuuaaguggaggagccagguucaggcccagggccucuggcugcggagcgcagcccccugcacacucggcacgaagcugcccgagcaggagacgccauacacggaagucaggccuucugucccuugcacgugggacuucagugugacgcccagcaaagcccucuccuuauuuuaaggaacuucguaagacgacaugcagagugaaagcuuuccuagaaauuccuaaugccuacaugauaaaaaguccuauuuucuucucauucuucucaucuuucccaauuauagucuagaaaaaaguguguucuacaguaaagcguugcuauuuacacagcaaaggaacauagccaugccacuuugucuuuguuuguucaggggugaaaguuuuuaaaagccaaauuuuguuaugcauccagcagacagggaugagaagagccuaauaggguuaaagcuggggcugaggggcagaguggggugcagggaagugaggccuccucgcucccaggccaccagcagaauuggcaaccacauuaguuccuucuuuauucgagcuuuggacucaccuacuuccucacccgguuuucacuaauccuguuccccugcuggagaaugagccccuuaaaaagagagaccaccccauguauuaaucaucuuaacuccucaucaggccgcauacagcauauggagcauuugguaaauauguagucaaugaaaaagugaacgccagcugcgauccguagaccacggucuuguucuuacugugggacuuguuucccuuccaggugccagaggugacccgggauucccaggggcccaaggggagccaggaagccagggugagccaggagacccgggccucccaggucccccuggccucuccaucggagauggagguaauguggcuucauaauaucaacaccggagacccaaagcaccugcacucagguccuagcacacacaagggagacuucguugacgacguagcuaugucguuguuacuuuuccccacugacuagucuuagcagcucuaaggagccccgcacacaugcuuuggacaccuucacagaacccucgcacauaugacaguaacuccccaacuagguuagauggugccacgauggguaacuggcaugcuuccaccuguggguugggaagagaacggagaaucaucagguguuguugcccaguguugaucacaacuaucaagccauuauuugaggggcaaggagagggguguuuuuaauguugaaaaaggauaaugaacuauaccaauggcuucuacccaucggaguuauugacggggccaugaagcccgcuagugccccagugggccccucuggacacgaacacaaaggcagcggugugguaugggagacucacgcugcaggugaaugcuguuugguuucagaucagaggagaggccugccgggugagaugggacccaagggcuucaucggagaccccggcaucccugcgcucuacgggggcccaccuggaccugauggaaagcgagggccuccaggaccccccgggcucccuggaccaccuggaccugauggugaguggagggaaacaaaagggaggguguagccuaauguucagaugaagcccggucccagccggauguuauuugggauucucugcuaaaugacucugggaacgaauccaguaggccagugauuagggugcaguggauccagguagauuaggguguagugggugcucucugggguccacgcaggagcuggggauggaagcugaagcccuguaagccugugaguaucacagccccguggaugccacacagugagguuuaguugcugcagcuucggugaaauccauccuucagcgaaacaucugagcugcgcagucuggaaacagaugugagcugacauugcugccucugugucggggugauacauuccacaaaccuaauccagggugagggcucacccuugacuggcagccucucuccuguguuacuccaucacguuuaagccaccuugauaaucugccuucucagcccgugcacagccaaagcuacaacugaacaggugagaguagcuggugacaaaaagagauggcugcauuaucugcaaaaauaagugacagccgucccccaaggcccagacaaaugcccaugaaagucaauaaagccggcaggcacaggaguguggacccaccugccacccaguagugcaucccugagucagcaaagaugcucuuucagguuauaacguuaggugacucaacuugaguugagaaugaccugucucaggcagcagggaaacaugcagucccgccuggagcuugcugucagaaaaggcuguucuuucagcuucagcauucagagaguuaugcuuuaaagaccaagcuuguccaacccacgggccacaugcggcccaggacggcuucaaauacagcccaacaaaauucauaagcuuuuuaaaaacauuuuuacaauuuuuuguagcuaaucagcuguauuaguucguucucacgcugcuauaagaacauacccaagacuggguaacuuauuaaaggaaagagguuuaauugacucacaguucugcagggcuugggaggccucgggaaauuuacaaucauggcagaaggggaagcaaacauguccuucuucguggcaucaggaaggagaaguaaggagugaagaggggaaaagccccuuauaaaacuaucagaucucaugagaaacucacucacuaucgugagaacagcaugguggaaacugccuccaugauuccauuaccuccugugaaccagguccccaccaugacaucuggggauuaugggaacuacaacucaagaugagauuucaguggggacacaaaaccuaaccguaucaccagcuaacauuaguguuaguguauuuuauguguggcccaagacaauucuucuuccaauguggcccagagaaggcaaaaaauuggacacuccugcuuucgauguugugaaaugccuaauaggaauauuucauucucucacaagagugaauauaggagacauugggagaaaauaagaggucauagucucuuucugugugacguugaccaaaaguuaacagccucuucuuuccaaaguaguuuacuuuaaauucccugacauugccccuaauaaucucuuacagccuccuaccuucggggaggaaaaacaccauguuugcuaguggacaguguuugguuucaguaacaggucaaagucucuguuuuguuuguuuguuuguuuguuuguuuguuuugagacggagucucgccugucacccaggcuggagugcaguggcaugaccucggcucacugcacgcuccgccucccggguucguuccauucuccugccucagccucccgaguagcugggacccaggcgcccgccaccgcgcagcugggaccacaggcgcccgcccucacgcccggcuaauuuuuuguauuuuuaauagagacgggguuucaccauguuauccaggauggucucgaucuccugaccucaugauccgcccgccucggucucccaaagugcugggauuacaggcaugagccaacgcgcccggcccaaagucucuguuuuaauuguuuguuuuuggaagauuacuucucuuugacauaucuagaaggaaaaucauuagaguuauuagaggcaaugucuucuauuuaaaagguaguagucacuucucugugucuguuuuauauuauaaaguaaaauuuuaacuuaauaugcuuucuacuuucucaauuuuucuucaauuagaaaacccacauauucucacauuauucugaaaauuuuuaggugcagauauuucccuggaucaugaaccugccaaagagucugagcagugugaacuuuauuuuuuuauuuuauuuuauuuuauuuugagacagggucucgcucuguaucccaggcuggagugcagugguaugaucucugcucacugcaaccuccaccucgugggaucaagcgaucuucccaccucagccucuugagcagcugggauuacaggcaugcaccaccaccaugccuggcuaauuuuguaauuuugguagagacggggguuucacuauguugcccaggcuggucuugaacuccugagcucaggugaucugcccaccucggccucccagagugcugggauuacagguaugaaucaccacaccuggccuuuaauuuuuuucauuauccuggacugcugugauaagagcuagguuucuaugagcauuauauuuccuaagcaaaugguaucuuuugaguuuucuuuuucuggagcagaacaugacauguuaaaaacaaaagcauacaaauauuccacuuuaacggccaggcaugguggcucacaccuguaaucccagcgcuuugggaaagccgaggggggccgaucaccugaggucgggaguucgagaccagccugaccaacauggugaaaccccaucucuaccaaaaauacaaaauuagccaagugcgguggugcaugccuguaaucccaguuacucgggaggcugaggcaggagaaucacuugaauccgggaggcggagguugcagugagccaagaccgcaccuuugcacuccagccuggggaacaagagcaaaacuccaucucaauuuaaaaaaaggaaaaaaaaauccacuuuaaagaacggugaucaaaggcuaacguugccauuauuccuguaacuaaauuccauuuugauaaagucacagcauaugccaucuugcuuuucaagucuugcuuaguaaauccgugguuuacuagcauaagucaacugcgaacaauuuaauuucugaucuguagugugggcugaugaggaaaguaauaaaaugaauggcaucagaucaauguuagcagcuaaaaauguuaaaagcauacaacuuaaguccucuaauuauauauauuaccccugugagacacaugguuuccaaaucaacauuuuuaaagcaaguucuuaugcaaaaaguaguccaccauaauggccuuuagaaaaugugugugugguuguaguuuaguaggaaugaccuugauucccauggaguucucugacuuuuccccuggaaugaaauuguuagauuccucucuuguuaacuacauuucauccu

SEQ ID NO: 15534 - RNA, 2610 nt, Homo sapiens
uaaaaacucacacucauugaaaaugugucacacuauuuccaguuucuucauucacuuacaauaucuuauucuuuuguaaggagaaggaaauauauuccauugcaaugcuacaaucaccaguguuauuuuccaaaguuaaacagaaagccugaauugagauccucuaaguuguacuuuugaaaagucacaaauacuacacaauaaaaauaacucauuaccuaucuuaaaaaugcuuccaccggaagucacuccaacccaaacccauaugacguaucugagccaagaucaagcagaagauuaacuguaaaaggcagauaugcuccgggcuaagagguccggaggcuccaguuuuauuuccucucuccugacuaaacccaacaggggggaacacucugugccucauuuuacuuuuucuuagaaaggggcuaauaacaccagcucugcucaccccucaagugaaucucaaaggauaucauguuccuacggguacgugaaaacugaaaauaccuaacaaagcagccacagaggagcgucucugguucccagggcggcagagcaggaacgcggggcucgggagcaaaggcagcuuagguacacaaaugaccagcggguucucugcaacuuggguugucccugaggucacugaguggcugagaggcagcgcucagcccaaccagcaagggaggacgagugggaaaccccgagaaggaggcauuugcuguccgaggccgggacccugugcgcggccgggugcccugcuggaagccccgcgccccccguccccggcggagccccagggcgguguggcucaugcggcgccggccucaccugcggugucccagauggagauguuguaggagcgccacugcuucagguagaaggcgccgcccaccgugcugaccguguccgggaagcgccgcuccauauaccgcugcagcagcgacgucuuccccacguucaugucccccaggagcacgaucuugcugucgggcuuccucaucuucccguaagaacccccagcgcccccgcgcccucuccccgaggcuggccggcucgugcgcccugggcgcagcuggaggagcggaccccggacucgccgggacccggauucucgugaacgcuccgggaccuucgccuccggacgcccgggagcucaagagaggaagcgcgugugcgcgcccgggaaggagcugggugcagagcacggagcccacgucgggggcccggaccgcggcggccucgccucgccccgcccccgcccccgcccccgggcccuuucaccgccgcggccccgcccuauccuccuccgcccaccgcccccgucccgccccugcuggaccucgccguuucgcaagcauccgaguucuccagccgaggcucgggacugcugcaggguggaaaaugaaaguucugagagcaccuuccgccccuccgcuucugcacagccggggcugcggugcgaggagcuuggccgcggggcccgaacgaggcgaaggggccggggcccuuggggaacccccuucucucuuccacucucccuuagguaaaacccguguuccucucacgcucgacccagcgccuuuccagcugcggucgauuugcuucuccgcguguaaguacagccacccucaaggucauugaaaaaguuugcuuuaaaugagcgucugcggaacucguccugaggcucucacuguuacagauuagagaugggggcgcuuucuaguggaggauuuugcuuuugcucuucuacuuuugcaagaagcuuuuuguccugaaaaguggacagucaucuccauuuauagcuuggaaugaaaauuugacuauggaaguugcagucgcuacuugagaaauauuuccuccuucuuuuuuuuuuuuuuuuuuuauuuuugacacggaguuuugcuguuguugcccaagcuggagagcagugcgcgaucucggcucacugcaaccuccgccuuccgguuucaagcgauucuccugccucagccucccgaguaggcgggauuacagguaugugccaccaugcccggcuaauuuuuguauuuuuaguagacacgggguuucaccauguuggccaggcuggucucgaacuccugaccucgugauccacccgcuucggccucccagguccuccuuccguuuuaaaggauaaaccuugaaaugcuuuuaaaauaugcagcguguagaauuugguuaguugguugguugggguuuuuuagagaaaaugagagguagaauggacucuaaguuaaacccugggggacagugucacucuggccgcuggccuggcugggaaaggcgaugagacccugagcagguuaaaacccguguccugaagguguccuguaaagggaaauaggcccguugccuccuucguaggugcccugagacuccgacaaggcaggaaugccaagguauuucguaccugcucagcccuggcaugucagguugcugagaccgagcaguguggggcugagguggaagcggaccuucuggggcguggaaagcgcaccaggagaccccggcuccuucucagccagcacugccucauccucagaacaaauuuaagucaauucagcauuuauucaaugccuguugcaugcaagu

SEQ ID NO: 15535 - RNA, 2610 nt, Homo sapiens
acuugcaugcaacaggcauugaauaaaugcugaauugacuuaaauuuguucugaggaugaggcagugcuggcugagaaggagccggggucuccuggugcgcuuuccacgccccagaagguccgcuuccaccucagccccacacugcucggucucagcaaccugacaugccagggcugagcagguacgaaauaccuuggcauuccugccuugucggagucucagggcaccuacgaaggaggcaacgggccuauuucccuuuacaggacaccuucaggacacggguuuuaaccugcucagggucucaucgccuuucccagccaggccagcggccagagugacacugucccccaggguuuaacuuagaguccauucuaccucucauuuucucuaaaaaaccccaaccaaccaacuaaccaaauucuacacgcugcauauuuuaaaagcauuucaagguuuauccuuuaaaacggaaggaggaccugggaggccgaagcggguggaucacgaggucaggaguucgagaccagccuggccaacauggugaaaccccgugucuacuaaaaauacaaaaauuagccgggcaugguggcacauaccuguaaucccgccuacucgggaggcugaggcaggagaaucgcuugaaaccggaaggcggagguugcagugagccgagaucgcgcacugcucuccagcuugggcaacaacagcaaaacuccgugucaaaaauaaaaaaaaaaaaaaaaaaagaaggaggaaauauuucucaaguagcgacugcaacuuccauagucaaauuuucauuccaagcuauaaauggagaugacuguccacuuuucaggacaaaaagcuucuugcaaaaguagaagagcaaaagcaaaauccuccacuagaaagcgcccccaucucuaaucuguaacagugagagccucaggacgaguuccgcagacgcucauuuaaagcaaacuuuuucaaugaccuugaggguggcuguacuuacacgcggagaagcaaaucgaccgcagcuggaaaggcgcugggucgagcgugagaggaacacggguuuuaccuaagggagaguggaagagagaaggggguuccccaagggccccggccccuucgccucguucgggccccgcggccaagcuccucgcaccgcagccccggcugugcagaagcggaggggcggaaggugcucucagaacuuucauuuuccacccugcagcagucccgagccucggcuggagaacucggaugcuugcgaaacggcgagguccagcaggggcgggacgggggcggugggcggaggaggauagggcggggccgcggcggugaaagggcccgggggcgggggcgggggcggggcgaggcgaggccgccgcgguccgggcccccgacgugggcuccgugcucugcacccagcuccuucccgggcgcgcacacgcgcuuccucucuugagcucccgggcguccggaggcgaaggucccggagcguucacgagaauccgggucccggcgaguccgggguccgcuccuccagcugcgcccagggcgcacgagccggccagccucggggagagggcgcgggggcgcuggggguucuuacgggaagaugaggaagcccgacagcaagaucgugcuccugggggacaugaacguggggaagacgucgcugcugcagcgguauauggagcggcgcuucccggacacggucagcacggugggcggcgccuucuaccugaagcaguggcgcuccuacaacaucuccaucugggacaccgcaggugaggccggcgccgcaugagccacaccgcccuggggcuccgccggggacggggggcgcggggcuuccagcagggcacccggccgcgcacagggucccggccucggacagcaaaugccuccuucucgggguuucccacucguccucccuugcugguugggcugagcgcugccucucagccacucagugaccucagggacaacccaaguugcagagaacccgcuggucauuuguguaccuaagcugccuuugcucccgagccccgcguuccugcucugccgcccugggaaccagagacgcuccucuguggcugcuuuguuagguauuuucaguuuucacguacccguaggaacaugauauccuuugagauucacuugaggggugagcagagcugguguuauuagccccuuucuaagaaaaaguaaaaugaggcacagaguguuccccccuguuggguuuagucaggagagaggaaauaaaacuggagccuccggaccucuuagcccggagcauaucugccuuuuacaguuaaucuucugcuugaucuuggcucagauacgucauauggguuuggguuggagugacuuccgguggaagcauuuuuaagauagguaaugaguuauuuuuauuguguaguauuugugacuuuucaaaaguacaacuuagaggaucucaauucaggcuuucuguuuaacuuuggaaaauaacacuggugauuguagcauugcaauggaauauauuuccuucuccuuacaaaagaauaagauauuguaagugaaugaagaaacuggaaauagugugacacauuuucaaugagugugaguuuuua

SEQ ID NO: 15536 - RNA, 8335 nt, Homo sapiens
gagaacgguguccaugacacagggcgggaagagauaaggccuagggaaggcgccccucgggccuauccaccucuucuggggcucggcacuaggaagcagcuucccucucaggccccuuugucuccaagccguuccaaacugaguaccgggagacgacacaaagggagggcggugacggauggcgcaggcgcgggagccgccuaggcugcugggaguggugguccggccgcggaauggguaggucucccgcgcacucugcggccgcagcucaaaggacaccgagagggugccagugcgcaugcgccgccacuuccgcccgugcccggcccuccccuuccuuccgccucccggaggacuuggguuucuaguaguaagaguccggggggcauuacucacggucuccccgccuccucuucaucgugauugggcugucaaagugauguuggcaaguagauuggcuacugcgguugccaguucuguuucgggcccuacuuauacugcucuguggggcggggacgaagagucaggggcugaggagcgaguugcgguaguugcuguguaccauggucucggagguuucugucccgcggcccguuagguccuggucggguuuucagcgaagcaggccgcuccccugcguuucccagcgggcgugcugugccgcccaacaggcucugccuccaagugccaaaaacuccuaguaaaguuugcgccucgcccgccguccacaccccagcggcccugacgcuguccccuccgcgacccucgccucuggaaaaagugacaggcaaggccacgcccccgcgagggccggccuggagcccgcagcccccagggccugggacggugaggggcgugaaugcggcggggggcggggccguugccgggggagggggccggggcgcaugcgcgcugcgcagcggggcugaauguuucccaaguguuugaaacugguauuuggguuuuccacguuggacaagugcggcucggcggccagcggagcgcgccccuucccgcugcccgcuccgcuccucucuucuacccagcccagugggcgagugggcagcggcggccgcggcgcugggcccucucccgccggugugugcgcgcucguacgcgcggcccccggcgccagccccgccgccugagagggggccugcgccgccggccggggcgugcgcccgggagccaccgccaccgcggcccgcgcccucaggcgcugggguccccgcggacccggaggcggcggacgggcucggcagauguagccgccgggccgaagcaggagccggcgggggggcgccgggagagcgagggcuuugcauuuugcagugcuauuuuuugaggggggcgggggguggaggaagcggaaagccgcgccgagucgccggggaccuccggggugaaccauguugaguccugccaacggggagcagcuccaccuggugaacuauguggaggacuaccuggacuccaucgagucccugccuuucgacuugcagagaaaugucucgcugaugcgggagaucgacgcgaaauaccaagguacggccgggugauggaugggcgggggcggccgccuccuucccggcggguccgggcgcgccgcggagccgggccgguccugccguggaccggaggaagcggccggcuccgcagcggcggcccucggcaggggcaggaacaaaaggucuggagcgccuuugauucgccaagguccuugugugcaaagcccgggacacggaggaggaaggaggcgcgagaggucucgcugcaaggcugcgcgaccaaagcgcucuuuguagugaagugaugaggcgggugcugcgggggagggggcggcggguccaagccgcguccucuaggagggggugcagauuacggcgcgagauggagggaugugccggcgccuggggcuauagggcgccgagacggggcugcaggaggagggcggcugugggccgggguucccgcggacccggugccucggucccgggcaacgccguuccucuggcccuucuucgucgccccccacucagucccgaaucugaguguuacauaaaguaccggguaguacuccgcucgggguaggucggccgcccccgcccagcccccuccggcccucacuuggagcuggacaccgaguaggggccgacugcgaggggcgacgccgccgguuguaguuugcggaggacgagggcuuuucucugugugccguagggaagggaagggaaggggaggagcggaggcggggaaggcgcccaucugcgcugcgcucgggggggcgcgggcagaucgcuggcuuggagaggacuguggcaggugagaggaccugugcgucguucucugcagaccuggccgccccgggugucagagagagguggcgaguucguguccgccgggaauuguuggcuguuggggaaacuuuccugcgaggucagucaaggcuuugggggcucuguuuugaauguggaucaccacucggaguuuacuaauguuuacaaggcugcgcaguagggaaacggaagaguugggugggggcaaaaaaaaaaauugaccgcuauccccgaaaguacuagacgccucugccgggaaggcgccccugcgcguucuauccgagacguagcuucgcagcgaauuuuauaggaacuucauuagcauauuauggaacgucccgccucagccccccaguaguuggcugugauguccuucguggaauguccuuaucauuccccugcggaacgauuggucgcugaggcggaugaaggcgggccuagcgcaauaacugguaugggucuguguuuccgcugucuucuuuuuucuuuuucggggaggagcgggguggaggguggacgaguugauuugaacgucuucgggucgcucggccuccagccuuggauugguucuucucgcugcuggggcgggccgugcucuuccgcccugcggugugguugguucuccuccuggccuccgcccuccaaaucggcgauucccauaggcggcggcucucggggugcggggcgagucucccgcuggccuccuccccauuggcuggaggccuggcgggugucgccccugccccucuccccgcucagcccggccacuuucgggcgcggauuuauagcaguagcagugaucccgggccugugggcucggggccggggcugcaguucggaccgccucccgcgacccgcggggccggcucggagacaguuucaggccgcaucucugcugacccgaggguggggccgcgcguggccguggaaacgugagugacuggggcugcguccacgagggggacccucggcgcagaaacuuuucuggaaggugcuguccucgggccggacgggccccguggggugacccuggggcuccggacggaaggaaggcaggggcugagaccacuuugaucguucgacgauagaaaaaaguagcgcggggcggggugcaggguuccagcuguccagacagcaaaguucauggagccacuuuguccuccugucguugcuggggagagccuggcuugcugcuugcuucauguucaccuagggugaugaacuuuuuggcuucaggaaagaucacaguccugcccccccgggaguacuggagcggcgcagcugggagcgccgagaagcgagcgaaucugucgcaagggucacagcuccuuggacuucgguguaaaugcugagcucugccgcguaguucugaaagacuuccacagaccuacucuguaggaagucaaacgucuuuugcuuaguaggcaucaguuguauguuaauucauaaacuuggauuauaauuaguuugucgauuuaaaaugguguuugagguugcuugaauuauuuuucaaacauuaucauaaaaauacccacccacccccugggaaguucgcuucauaaagaacuucagugcaacccguauguaaaauuaaaauacauuuaaaauaauuggacaaaccaauuuaaauguugcuacaaccccauuuaaucuguaaauugcaugugcugcugcuuuccaugguaauguugguguggaauauguuuggaaaaaaggcaguagugucugaagcugaguugcuggcauugaaaaagcagagugucuggaaggauggcuuccuauuuagcagugguguuguuccuguuuauaaauauuuguacuuaguggcuuuguugauaaaauacuuugcuuggaguaucaaagaaauauuagguaacagaaauacuucuugguaauuuugcgaugggauaucuguuucucuugcccacaaauuaggcuucaccuggauggaagcuugcuugugauguaaaauaacuucuguguuauuaaauuuuaaauuuauaugauacaguuuucugugaaaugacaauauugucuuuagaacuuugauuacugaugaaaagaagugauaccauuuuguaacccuaaauccauuuaaaaauaaaugguacacauauuuuaacauuaugauaaauaaguugaauaaauugguauuacuuggauacguugaacacagcuauuuauuuuuauaauuaauuacuauaugagacuagggcuuuccuccugguggcaggcagccugcauuguuccucuaggagucuucaaagcugucuuuaguuugagaauauacucuggaaaauauuaccauuuagagaagcuucagcguuggccugaguucuuauguuuacucuaguguuagguauaugucuuauaacuauuuggagauaagaucuggaaaggaaggggguaacauuuuagacaaucccucccacucucagccccuccccuaguuuacaaguaguauuguuggccaggcacgguggcucacuccuguaaucccagcaccaugggagaccgaggcgggcggaucaccugaggucgagaguugggagaccagccuguccaacauggagacacccugucucuacugaaaauacagaauuagccgggcgugguauuacaugccuguaaucccagcuacucgggaggcugaggcaggagaaucgcuugaaccugggaggcagguugcagugagcugagaucgcgccauugcacuccagccugggcaacaagagugaaacuccguuucaacaacaacaaaaaaagguaguauuguugccuuguuuaaagagacugcaaaaagguuuuaggagaauaaucugguacuguuuaauuuaaugguuacuguuugaggaaaaagaacucuggaauuucuguguauuuaaguagccuuuuuagcaaggcuguuuacuucaacuagauuuuuuaauagcuuuuguuucuugagaaauugccuaauuacacuugccaaauuacacuuuaaaaucauauacacuguccucuaacaugcccaggaagguuuacauuuaaauacugaagagguuuucuuuuguuuuugauaacauuuuaaaguccauugacuuuaacagaugugaagauguuuuuguuuaagcaguagaugcaaaaguaaaaccuaccagcuucgcuuuaaagcaaggcuagugcauucacugcaguuaaaaaauaauaauaauagcccaucacaguggugcuucuguagucccagcuacucaggaggcugaggugggagggucccuugaaccugggaggucgaggcugcagugagccgagauugcaccacugcacuccagccugggcgacagagacggaccuugucuccaaaauaauaacaagucguaauaauaauaaagcaaagcuagguuuucuggauuauuguggcagaacuguucuugcugucacuaauacagagggauaacaugcuagaauaaauguggggacugaaacugaggaccuaagucacaaaguauccuggaccuuuacuguuaacccgguucuuuaaaucauagagagcuauuauauaaauuuauacacauucucucauuuaacaggguauucuagauguugguauauuaaaauaaagaaaauaaagaccuuuuuuauuugaaauauucaaauaauuuauaauauauuuuauuaauguuuguauauuguguauaaauguaauaaauaccauguuuauauaauguuauauguauauuaauaauuguauucaaauagaaacauuugaguaaaaaugauggcaguauagacauagucauuaauagaaaguauuaauaaauguugggucccgagcacugcaccucauuuaaacguuuccucuuaauggcuucgggcguugucacccgugcgugccugggaacuguucucagguucccugggguggcuggagcggcuccugccgcuguggaagcugggccggcauuuguguuguguuguguuguguuguguuguguugugguuagcacaggaacagauaggcccgggagagccuguggcuggugggcuuuguucugggcaagccgugcgcuggccccuaggcucccugccagcccucuccguagacccguccggggccguguggguugucccgguguccugcucgcgagugacgccuguccuucuugcccccagagauccugaaggagcuagacgagugcuacgagcgcuucagucgcgagacagacggggcgcagaagcggcggaugcugcacugugugcagcgcgcgcugauccgcagccaggagcugggcgacgagaagauccagaucgugagccagaugguggagcugguggagaaccgcacgcggcagguggacagccacguggagcuguucgaggcgcagcaggagcugggcgacacagcgggcaacagcggcaaggcuggcgcggacaggcccaaaggcgaggcggcagcgcaggcugacaagcccaacagcaagcgcucacggcggcagcgcaacaacgagaaccgugagaacgcguccagcaaccacgaccacgacgacggcgccucgggcacacccaaggagaagaaggccaagaccuccaagaagaagaagcgcuccaaggccaaggcggagcgagaggcguccccugccgaccuccccaucgaccccaacgaacccacguacugucugugcaaccaggucuccuauggggagaugaucggcugcgacaacgacgagugccccaucgagugguuccacuucucgugcguggggcucaaucauaaacccaagggcaagugguacugucccaagugccggggggagaacgagaagaccauggacaaagcccuggagaaauccaaaaaagagagggcuuacaacagguaguuuguggacaggcgccuggugugaggaggacaaaauaaaccguguauuuauuacauugcugccuuuguugaggugcaaggaguguaaaauguauauuuuuaaagaauguuaguaaaggaaccauuccuuucauagggauggcagugauucuguuugccuuuuguuuucauugguacacguguaacaagaaaguggucuguggaucagcauuuuagaaacuacaaauauagguuugauucaacacuuaagucucagacugauuucuugcgggaggagggggacuaaacucaaccuaacacauuaaauguggaaggaaaauauuucauuuagcuuuuuuauuuuaauacaaguaauauuauuacuuuaugaacaauuuuuuuuaauuggccaugucgccaaaaauacagccuauaguaaauguguuucuugcugccaugauguauauccauauaacaauucaguaacaaagguuuaaaguuugaagauuauuuuuuaaaaagguaaaugguuaaauuuuacaugacagauauuuuaucuauuggccuguuccccaaauggccauuuuaaaaugcuuggguacacuucucuuaaguggucuagucaaggaaccucaagucaugcuuuugcuaucaccaaucauaguguacccaucuuuaauuuauaucagguguauaaauguacauuuccaaaugaacuugcacuuguuauauuauaauuggaagugcagucagcagaugcuguugugaagcuaaugucacaauuaugugcaaaggugugcuuccugcuguaugugagcuguaaaaauguuacgugaagaaauaaaugaaacuuggccaguuuguuccucuaguaguauauuuaauuuugacauaaguaacuuuuaaaauuugucuuaaaaauuuauacaccagcaauuuagacaaagccuuaagcaaauuuuguauuauuguucucacuuauuauuaauaaugaaguagaaguuacuuaauugccagcaaauaaauacgugucaaaaaagaaucuguauucagacccugggucaggaaauuacugcccacuugucaaguucagcccaccaucuguuugaagauuauaugaaguuuaaauucuaguguccauaaauaaaguuucagcggaacacag

SEQ ID NO: 15537 - RNA, 8335 nt, Homo sapiens
cuguguuccgcugaaacuuuauuuauggacacuagaauuuaaacuucauauaaucuucaaacagauggugggcugaacuugacaagugggcaguaauuuccugacccagggucugaauacagauucuuuuuugacacguauuuauuugcuggcaauuaaguaacuucuacuucauuauuaauaauaagugagaacaauaauacaaaauuugcuuaaggcuuugucuaaauugcugguguauaaauuuuuaagacaaauuuuaaaaguuacuuaugucaaaauuaaauauacuacuagaggaacaaacuggccaaguuucauuuauuucuucacguaacauuuuuacagcucacauacagcaggaagcacaccuuugcacauaauugugacauuagcuucacaacagcaucugcugacugcacuuccaauuauaauauaacaagugcaaguucauuuggaaauguacauuuauacaccugauauaaauuaaagauggguacacuaugauuggugauagcaaaagcaugacuugagguuccuugacuagaccacuuaagagaaguguacccaagcauuuuaaaauggccauuuggggaacaggccaauagauaaaauaucugucauguaaaauuuaaccauuuaccuuuuuaaaaaauaaucuucaaacuuuaaaccuuuguuacugaauuguuauauggauauacaucauggcagcaagaaacacauuuacuauaggcuguauuuuuggcgacauggccaauuaaaaaaaauuguucauaaaguaauaauauuacuuguauuaaaauaaaaaagcuaaaugaaauauuuuccuuccacauuuaauguguuagguugaguuuagucccccuccucccgcaagaaaucagucugagacuuaaguguugaaucaaaccuauauuuguaguuucuaaaaugcugauccacagaccacuuucuuguuacacguguaccaaugaaaacaaaaggcaaacagaaucacugccaucccuaugaaaggaaugguuccuuuacuaacauucuuuaaaaauauacauuuuacacuccuugcaccucaacaaaggcagcaauguaauaaauacacgguuuauuuuguccuccucacaccaggcgccuguccacaaacuaccuguuguaagcccucucuuuuuuggauuucuccagggcuuuguccauggucuucucguucuccccccggcacuugggacaguaccacuugcccuuggguuuaugauugagccccacgcacgagaaguggaaccacucgauggggcacucgucguugucgcagccgaucaucuccccauaggagaccugguugcacagacaguacguggguucguuggggucgauggggaggucggcaggggacgccucucgcuccgccuuggccuuggagcgcuucuucuucuuggaggucuuggccuucuucuccuugggugugcccgaggcgccgucgucguggucgugguugcuggacgcguucucacgguucucguuguugcgcugccgccgugagcgcuugcuguugggcuugucagccugcgcugccgccucgccuuugggccuguccgcgccagccuugccgcuguugcccgcugugucgcccagcuccugcugcgccucgaacagcuccacguggcuguccaccugccgcgugcgguucuccaccagcuccaccaucuggcucacgaucuggaucuucucgucgcccagcuccuggcugcggaucagcgcgcgcugcacacagugcagcauccgccgcuucugcgccccgucugucucgcgacugaagcgcucguagcacucgucuagcuccuucaggaucucugggggcaagaaggacaggcgucacucgcgagcaggacaccgggacaacccacacggccccggacgggucuacggagagggcuggcagggagccuaggggccagcgcacggcuugcccagaacaaagcccaccagccacaggcucucccgggccuaucuguuccugugcuaaccacaacacaacacaacacaacacaacacaacacaaaugccggcccagcuuccacagcggcaggagccgcuccagccaccccagggaaccugagaacaguucccaggcacgcacgggugacaacgcccgaagccauuaagaggaaacguuuaaaugaggugcagugcucgggacccaacauuuauuaauacuuucuauuaaugacuaugucuauacugccaucauuuuuacucaaauguuucuauuugaauacaauuauuaauauacauauaacauuauauaaacaugguauuuauuacauuuauacacaauauacaaacauuaauaaaauauauuauaaauuauuugaauauuucaaauaaaaaaggucuuuauuuucuuuauuuuaauauaccaacaucuagaauacccuguuaaaugagagaauguguauaaauuuauauaauagcucucuaugauuuaaagaaccggguuaacaguaaagguccaggauacuuugugacuuagguccucaguuucaguccccacauuuauucuagcauguuaucccucuguauuagugacagcaagaacaguucugccacaauaauccagaaaaccuagcuuugcuuuauuauuauuacgacuuguuauuauuuuggagacaagguccgucucugucgcccaggcuggagugcaguggugcaaucucggcucacugcagccucgaccucccagguucaagggacccucccaccucagccuccugaguagcugggacuacagaagcaccacugugaugggcuauuauuauuauuuuuuaacugcagugaaugcacuagccuugcuuuaaagcgaagcugguagguuuuacuuuugcaucuacugcuuaaacaaaaacaucuucacaucuguuaaagucaauggacuuuaaaauguuaucaaaaacaaaagaaaaccucuucaguauuuaaauguaaaccuuccugggcauguuagaggacaguguauaugauuuuaaaguguaauuuggcaaguguaauuaggcaauuucucaagaaacaaaagcuauuaaaaaaucuaguugaaguaaacagccuugcuaaaaaggcuacuuaaauacacagaaauuccagaguucuuuuuccucaaacaguaaccauuaaauuaaacaguaccagauuauucuccuaaaaccuuuuugcagucucuuuaaacaaggcaacaauacuaccuuuuuuuguuguuguugaaacggaguuucacucuuguugcccaggcuggagugcaauggcgcgaucucagcucacugcaaccugccucccagguucaagcgauucuccugccucagccucccgaguagcugggauuacaggcauguaauaccacgcccggcuaauucuguauuuucaguagagacagggugucuccauguuggacaggcuggucucccaacucucgaccucaggugauccgcccgccucggucucccauggugcugggauuacaggagugagccaccgugccuggccaacaauacuacuuguaaacuaggggaggggcugagagugggagggauugucuaaaauguuacccccuuccuuuccagaucuuaucuccaaauaguuauaagacauauaccuaacacuagaguaaacauaagaacucaggccaacgcugaagcuucucuaaaugguaauauuuuccagaguauauucucaaacuaaagacagcuuugaagacuccuagaggaacaaugcaggcugccugccaccaggaggaaagcccuagucucauauaguaauuaauuauaaaaauaaauagcuguguucaacguauccaaguaauaccaauuuauucaacuuauuuaucauaauguuaaaauauguguaccauuuauuuuuaaauggauuuaggguuacaaaaugguaucacuucuuuucaucaguaaucaaaguucuaaagacaauauugucauuucacagaaaacuguaucauauaaauuuaaaauuuaauaacacagaaguuauuuuacaucacaagcaagcuuccauccaggugaagccuaauuugugggcaagagaaacagauaucccaucgcaaaauuaccaagaaguauuucuguuaccuaauauuucuuugauacuccaagcaaaguauuuuaucaacaaagccacuaaguacaaauauuuauaaacaggaacaacaccacugcuaaauaggaagccauccuuccagacacucugcuuuuucaaugccagcaacucagcuucagacacuacugccuuuuuuccaaacauauuccacaccaacauuaccauggaaagcagcagcacaugcaauuuacagauuaaaugggguuguagcaacauuuaaauugguuuguccaauuauuuuaaauguauuuuaauuuuacauacggguugcacugaaguucuuuaugaagcgaacuucccaggggguggguggguauuuuuaugauaauguuugaaaaauaauucaagcaaccucaaacaccauuuuaaaucgacaaacuaauuauaauccaaguuuaugaauuaacauacaacugaugccuacuaagcaaaagacguuugacuuccuacagaguaggucuguggaagucuuucagaacuacgcggcagagcucagcauuuacaccgaaguccaaggagcugugacccuugcgacagauucgcucgcuucucggcgcucccagcugcgccgcuccaguacucccgggggggcaggacugugaucuuuccugaagccaaaaaguucaucacccuaggugaacaugaagcaagcagcaagccaggcucuccccagcaacgacaggaggacaaaguggcuccaugaacuuugcugucuggacagcuggaacccugcaccccgccccgcgcuacuuuuuucuaucgucgaacgaucaaaguggucucagccccugccuuccuuccguccggagccccagggucaccccacggggcccguccggcccgaggacagcaccuuccagaaaaguuucugcgccgagggucccccucguggacgcagccccagucacucacguuuccacggccacgcgcggccccacccucgggucagcagagaugcggccugaaacugucuccgagccggccccgcgggucgcgggaggcgguccgaacugcagccccggccccgagcccacaggcccgggaucacugcuacugcuauaaauccgcgcccgaaaguggccgggcugagcggggagaggggcaggggcgacacccgccaggccuccagccaauggggaggaggccagcgggagacucgccccgcaccccgagagccgccgccuaugggaaucgccgauuuggagggcggaggccaggaggagaaccaaccacaccgcagggcggaagagcacggcccgccccagcagcgagaagaaccaauccaaggcuggaggccgagcgacccgaagacguucaaaucaacucguccacccuccaccccgcuccuccccgaaaaagaaaaaagaagacagcggaaacacagacccauaccaguuauugcgcuaggcccgccuucauccgccucagcgaccaaucguuccgcaggggaaugauaaggacauuccacgaaggacaucacagccaacuacuggggggcugaggcgggacguuccauaauaugcuaaugaaguuccuauaaaauucgcugcgaagcuacgucucggauagaacgcgcaggggcgccuucccggcagaggcgucuaguacuuucggggauagcggucaauuuuuuuuuuugcccccacccaacucuuccguuucccuacugcgcagccuuguaaacauuaguaaacuccgaguggugauccacauucaaaacagagcccccaaagccuugacugaccucgcaggaaaguuuccccaacagccaacaauucccggcggacacgaacucgccaccucucucugacacccggggcggccaggucugcagagaacgacgcacagguccucucaccugccacaguccucuccaagccagcgaucugcccgcgcccccccgagcgcagcgcagaugggcgccuuccccgccuccgcuccuccccuucccuucccuucccuacggcacacagagaaaagcccucguccuccgcaaacuacaaccggcggcgucgccccucgcagucggccccuacucgguguccagcuccaagugagggccggagggggcugggcgggggcggccgaccuaccccgagcggaguacuacccgguacuuuauguaacacucagauucgggacugaguggggggcgacgaagaagggccagaggaacggcguugcccgggaccgaggcaccggguccgcgggaaccccggcccacagccgcccuccuccugcagccccgucucggcgcccuauagccccaggcgccggcacaucccuccaucucgcgccguaaucugcacccccuccuagaggacgcggcuuggacccgccgcccccucccccgcagcacccgccucaucacuucacuacaaagagcgcuuuggucgcgcagccuugcagcgagaccucucgcgccuccuuccuccuccgugucccgggcuuugcacacaaggaccuuggcgaaucaaaggcgcuccagaccuuuuguuccugccccugccgagggccgccgcugcggagccggccgcuuccuccgguccacggcaggaccggcccggcuccgcggcgcgcccggacccgccgggaaggaggcggccgcccccgcccauccaucacccggccguaccuugguauuucgcgucgaucucccgcaucagcgagacauuucucugcaagucgaaaggcagggacucgauggaguccagguaguccuccacauaguucaccagguggagcugcuccccguuggcaggacucaacaugguucaccccggagguccccggcgacucggcgcggcuuuccgcuuccuccaccccccgccccccucaaaaaauagcacugcaaaaugcaaagcccucgcucucccggcgcccccccgccggcuccugcuucggcccggcggcuacaucugccgagcccguccgccgccuccggguccgcggggaccccagcgccugagggcgcgggccgcgguggcgguggcucccgggcgcacgccccggccggcggcgcaggcccccucucaggcggcggggcuggcgccgggggccgcgcguacgagcgcgcacacaccggcgggagagggcccagcgccgcggccgccgcugcccacucgcccacugggcuggguagaagagaggagcggagcgggcagcgggaaggggcgcgcuccgcuggccgccgagccgcacuuguccaacguggaaaacccaaauaccaguuucaaacacuugggaaacauucagccccgcugcgcagcgcgcaugcgccccggcccccucccccggcaacggccccgccccccgccgcauucacgccccucaccgucccaggcccugggggcugcgggcuccaggccggcccucgcgggggcguggccuugccugucacuuuuuccagaggcgagggucgcggaggggacagcgucagggccgcugggguguggacggcgggcgaggcgcaaacuuuacuaggaguuuuuggcacuuggaggcagagccuguugggcggcacagcacgcccgcugggaaacgcaggggagcggccugcuucgcugaaaacccgaccaggaccuaacgggccgcgggacagaaaccuccgagaccaugguacacagcaacuaccgcaacucgcuccucagccccugacucuucguccccgccccacagagcaguauaaguagggcccgaaacagaacuggcaaccgcaguagccaaucuacuugccaacaucacuuugacagcccaaucacgaugaagaggaggcggggagaccgugaguaaugccccccggacucuuacuacuagaaacccaaguccuccgggaggcggaaggaaggggagggccgggcacgggcggaaguggcggcgcaugcgcacuggcacccucucgguguccuuugagcugcggccgcagagugcgcgggagaccuacccauuccgcggccggaccaccacucccagcagccuaggcggcucccgcgccugcgccauccgucaccgcccucccuuugugucgucucccgguacucaguuuggaacggcuuggagacaaaggggccugagagggaagcugcuuccuagugccgagccccagaagagguggauaggcccgaggggcgccuucccuaggccuuaucucuucccgcccugugucauggacaccguucuc

SEQ ID NO: 15538 - RNA, 36616 nt, Homo sapiens
ccccugcccggcugcacaaggcguccucugggccaggccccgcccccagcccggccgcuccaggccccgccccgcccccucugugcgcgcuccgcucggcagccugugggacgcgaccgcggcgcuagucucguuccuuugugcugcggcggcggcuucucgaguccuccccgacgcguccucuaggccagcgagccccgcgcucuccggugacggaccaugucggcggcgggagcgggcgcgggcguagaggcgggcuucuccagcgaggagcugcucucgcuccguuucccgcugcaccgcgccugccgcgacggggaccuggccacgcucugcucgcugcugcagcagacaccccacgcccaccuggccucugaggacuccuucuauggcuggacgcccgugcacugggccgcgcauuucggcaaggugggugcgaacgcuuuaaggcgccauuuuccccggcuguccagugggagucggggaaagcgggucugaggugcgggggacguggggcgugccgggaucgcggggcggaagcgggaucgacggcgccugugccccgaggggccuagggcgccugugcggcagcgcucgcggcccggagucgcggcggggcagccggggggcgcggggcggaagcgaggucgguggcgccugcguccggaggggccuagggcgcaugugcggcggcgcgcguagcaaguuucuaacaaggcgggcuccaagggucccggcgccuguuggccggauccugugcgagcgcgcgcgcgcgcggauggugcggggcccuccaggccgggccggaggcgcgagcgauuucgcagagccggguauuaggccgcgaagucgcccaggcggcuuccggggagccgagcuggggucagaggcgcgcggggaaugcccgggcgcggucgaccuucugguuccgcacagccucgccaguagccgagggccgcgcugcggacgagcucagccgaggagcaagcgccccggcgggacuggaaggccccggcagcugugugggauggaggccggcucuccagcuucuggguuugcuuuaaggcuuguagcuggccccgcuucagcaaaauuagugacggcuguguuuaucuuggaucuaaauuacugcagaagugguuaaauuaagcagaauucucuucccguggaggcuuuacguuccccucuuuuuucuuaaacugaaaauucugggggaacacagugcugcuuuaagguuuuaaaagguuggauagcuaccguuuccucaucugugaagucguugggguacuugcucucagaaaucuuaaauaagauuucaccgugcauuucagaagugacugguuuuaauuaauauuucuuaauucacugaaauucagggauguguauaguguuuuucucguaagugaugagaugggguuaaaugguuuugcagaaauaugugagagguaaugugaaauaaguuacuuuaagaaggccuggcccugguaaugucguuaccagcugaugaaguugcgguuuaccuugcugccccuggugcuacauucacaaagcagcugugucuuuuggaaagcaguuucugauucuuuuaaaguggaaaagucacuuuucuuucaauaaaagaaaugaaaaggaguuuugacgaucggggugggacaagcaaguuaaucaguccucaagggcuguuagguuccuguggcacugucucugaaguugugcaaccguaguaccugcuggagaaaacaggugcccaggggaaaugaguuucuuaacaaacaaaaguaauaaagccuccucccugcgcuucugcgugcagccuuaaauagauuucccgaggcagucaguaaucugaggauuuccucccuccagagugucucuugcugugguuuauuuuuacacuaaacuuuaggauucuguccuuucuacccugguugagaacgacacaauacugggugauagucagugaacaacgaucuguagaaugcuuaaagccucauuacagauggucacuuagaaaauuuaauccaguggugccuccacuugucucuggggauuaaaauaguuacuuuaaaaugguaauuuuuaauguguauuuuaucacaguuuuuuaaaaaacaccgacugaaaucacuuuucaaaagucuacuuccaugggacuuugaguaguagcuuuaccuuggucaucaaauguuguaacaagaagcaguuacuucauuguuuccagcugucugaaucauagggcucuuuggucuuagauacggaaggggccuuagaaagccccuguccaguguccaaacauucccuucugagaagaagccguuaggacagaaaucaggccaggacucagggcuaccgcuugcgaaguccaggcuuucuccccagcccugcuaacggcugcccucuuacacagguuucaggcucguguucuuagaaaugugcuaguggugcacaagauccccuaaccguugguaagacucguuuguugccagaggacuaaacgaguuguuuaaaaucucuguuguagcuuuuauaccauauugaacaguaucuuuccagaauuccaaauccaaguuucuaaauugaacccaaggguaacagguuuaaagccagcgagcccugaauagcugauuuuugguacgccaagugauuuucauccguuuuauuuuuauuggauuugcaaccuguucaucuuaucgcuaauuaauacuuucauuuucacccagugaauuaauaaaggcaauaaauagacaucagccuuuacucccagguccaaguugguugaagaggguguuuugaaucuguguacucuucaucucacaggaguguuuacugaaagccugaaagugcuaagagaaauggaaaaagaaaccuugaguugagaugguagugucagguguuuugucuucaggugaggucucuccucuugaagagaauugcuugcagucaggcauagcuuguucccuaacugcauugugauuggagugagggaaaaugagcaguccaggaucagagaacguggguugaacaguugcuuggcacaugguaggcacuugguaaauuuguugaaugcgcuaaauuauuuuagccagaggcuaucaugguauuggugcuuggccacaaagucuuaacuugccauguuagucacccacuaggugcauugcucaguuaugcuguaggcuuuuuucccccauaggguuuugaaaagaguaaaaaaauguggagaauggggccucuauugauuauucaaugaguauucagugcuggcuuguguaaaagugcacaguugugcacacuauagaaaauagucuuugacuaugacgaguuuacuauggcuacacaaaguuugugggguuuuuuguuguuguuuuuuguuuuuuugagacagggucuugcucuguugcccacgcuggagugcagcggcgugaucucugcucacugcaaccuccaccuccuagguucaagugauucuccugucucagccuucugaguagcugggauucuagguaugcacuaccacacccagguaauuuuuguaauuuuguauuuuugaaaccccaguaugggguuucgccguguuggccaggcuggucuugaaccccugaccucaggugauccacccgccuuggccucccaaagugcuggaauuacaggcaugaggcacugcgccuggcauuacacaaaguggugguggugguguugguguuugagauggagacuugcucuguugcccagguuggagugcaguggcgugaucucagcccucugcaaccuccgccuucuggguucaagcaauucuccugccucagccucccaaguagcugggauuacaggugcccgccaccacgcccggcuaauuuuuuuguauuuuuaguagagaugggguuucaccauguuggccaggcugguuucgaauuccugaccucaagugauccacccgccuuggccucccaaagugcuaggauuacaggcaugagccacugcgcccggccuacacaaaguuuuuuaacccaccaaucccuuuaacguuuuuguuuagaauagucugugcaacaaacaguuuugauagaagucuuggaacagcgcaguccaauauuuucugauuuuggcuuauucaauuguagggaaacaaauauuuaaaucuguauaguguuagucgucuuuuugcauuuuucuauuucuaucuaccgucuuuuucauaaggacaagggaauauguuaucuuaaauguccuuuaaaauuugcauggcauugggaaagagugacuuaaucuguuaaaaaacugguaacaaugccauuugucaccauuauagaauuucgauuauucauguaauauugaauaguguacugacaugucugcguguuuucauuaccccucuuguuuucgaaguuggagugcuuagugcaguuggugagagcgggagccacacucaacgucuccaccacacgguacgcgcagacgccagcccacauugcagccuuugggggacauccucagugccuggucuggcugauucaagcaggagccaacauuaacaaaccgguaagagugcuggugauggacuugguuugcuuuugcuuuuucuuuuugcaguuauaauuauacacgguauugcuuuaaaucgaggccuuaauuagaguuugauaucuuuaccugagggcagacuggaauuuauguuucuucaguuguuuguggaggauaguaggcccuuuccauaggaaugcuuucuguucauagagugcuuucaccuguugugugauaaacugauccagggugaugugcccaagguuauagcugguaauuaaaggagccuggccuugagcccagguuuccuggcuuucuacucauagcugccuuagccucauuuccacagauaauuaugaaaacauuuucauccugggaaaagcauggcuauuaagucagcuccaaagugagcuucagauacaaguugaugccuugaugcagauaagugcuaaguaucauuuacuaagugggaagaguaagugacuugaggacuugguauuuaaacauacugacaggaacauaaucgugccagauuuuucuucaugguguguuuucaguaucauuucaccuaaaccaaacacacacgcauucagauuguuagguacuuaguugugugagacaagcagcaucuaauaaccauuagguugucugacugggagcagucccuagacucagcguccuuugcugcagauggauuaguccuuagacuaauugauaauuuucaucucuuaagaccugggcaugggcucugggagcugguuuuuaugccuuuuuuacuccuaucuuuaaaugcuuuauagucaucaaggucuuggaugcaaagucgucuuucuacuuuucuuucccaagauucaguccuucaugauaaccaggcauaagguuguugcuagucccucuucuaaaaacccagcuacccaccugagcaguaaguaauugagaaagaagguguuuuuagccaugauuuaaaacaaggaucaaugggaaagugggguaaguuauaaggcaguuuguccccuuaaaagaugugaaguagaaaagaaaauggaagguggccaagaguugaggccuguuuguuacuaaacugaaaugugggauaugggacaaguuuuaagguugugcugccacuucucuccuuccaucuccacacgugugccuuuacauaauguauauuucucugcugcucuguugcuugucuucauaaauucgagaguuaugaauuaccuacucaauacccuuaugugcugggcagcgccuuguguuuuuccuucuucccuaccccuguccccugguagaaagggcagugugggcuugauuccuugggcaagucauuaacuuuguggcucaaucucuuuaucaguaaaauacaguuaauaauuccaugaauggcaguaauuaauaguauggaauuuaaguauaucauuuuuguagguuaauuuucaucaaauuguuacauagcaucuuauuuagagaggacuagagaaauugucuaacacugcuuuccagaccuuuuuaaaucaagaagcccccuuuucaaagugucuuauggcaguucaguauuuucaguagauaaagggagugaggcagaaagugugcugcugggucucccaccuuccucucagaugccucuagauaacaccuccuggaaacuucuaccgcacucugcuucuucccaggcaggauccuaaaaucuuuuucuuuucagcccucccuguauuugaaguauccggguagacauuuccaaguccucacaugugccuagugcauaucauuuggcauuguaaagcauccuggaauuucuccuuaguguaucuuagguaguuguggucugcuggcauguggaguuuacauccgaaucugaggcaucaucucacucuauuauguagugggugaauuucaacaccucuuguuaugggcacccagugacucuagaggacacaauagcccuuuuguuagcuccccaccccgccuaccugcugacucaucuccagguagacaguuucucucauuucucauauaaacucaggaugccaaauccaauccagguuuuucuccuuuguuguguccauuuaauuuuuugaaccuguugaugcaguguuuuaagccaauuucuagucuguuaaucuuuuggcauguuagcuacuaacaguucuaaguucauuuuccucaaaguuaauaccacagacuuuuuuggcagucucugaggugagauuaccaaagcucguaugcugccuagaggccuguguucucgauuuccccaagaggaaaugaagccagcuuuccugugauuuguuuuuagugaaucuauauugacuagccuuggugcguaauuagcaaaccuucucuuucauaugccucuucuagaauuuuggcauuugauguugucuuuaauuuuucauaucuagauuggaaaugaaauuuuucuuuaugaaaacccagggugcccagccugucuugagcauucuggcacugcucccaguucccuguagaucacucaauuugcuguggcugcgaugugacugggcugagcuggaggcccgggcaccuucaccuggcucuuuagucuuacguaucuuuucucuuggcuaccuucucucaggauguccgggccuuucucuaguguuugcucugccccuaaagauugucccugcagagcuugguaguuuugcuuuuucauugucaucuguuaauaucccaccgugacagacccuuacuuuuuugucuuguuccaaggauagcuuuaaagaccuuuuuuccuuuuuagccuuuuucuuuuuuggcaaaacuuuaucuaaaucucagcuccaguuuuccugggaauguuuuuauguaauuuuuauuugucuuuauuuuguacuacuucucuccccuccucaccucucuuuuggggaggauagggcuagguuuucgcuuuuuaaaaaauccgaguugacuggauaguuuauagccgcaugguuuucuguguuucugucuucaaaaauggauuuuucuguuuagaacuuuacauugcuuuauagucucuuuagaccuuuguuuaaauaaaugugcacacuuuucccucuaccaagcacucgagccuuucauacucuuauuuuucuguaaauuaaucuaccacuguuuuuuuuaacuuuggguggcccucaccucauguuuauuccugugaguaugaguuggugaaggagcuuagcuauuuagugaguuuaggaaugaacuguuuucuaagugacccacaguugcugcacuccuuuuuaucuuggucucuuaauugugugguagucugcgcaguucagcuuccagugagguugcagugugaguauucaagaaguguugcugaucgagaccauccuggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaagaaguguugcuguggagcccccaggauuucccagucuucauuuuccaccggaaagcacuuucuucucuugauugcugugucugauugccuuuccccucucuugcuuagcugauagccuaugaagauggucuuucagguuguuucauucaugcaguguagaccuggguugacugcugauguucacaguggcuuuccugggucugcucacuuuucucugccucugugugugcuucaccuccccaccgccgccaccccacccccucugcacuuucugaaccaggaauuucauucuuaugaagcuugguuugcuuuaccuuuguguucuucucccuuuccucuaauaaauacugaaaauagauugggaauauuuaguaaauauucccucuaguaaauacugaaaaauagaucaacuguugaaccucaagccaucuugucuaaguuguggucccacuucaaguucaaagcagaagauucaagaucggcauugaugauguugacucggguuagcauugggguaggcacagaggaaaguggguagcugagaccauaugucagcuauuaugugcuauuucuuggccuugaugaccguuuuaaugugugugugugguugguugguuggcuuguuuguuugguuacuuauucuggguuuauauaaaacacacgugcuaagauccaguguaaagugauuuauaaaucacuguugagagcaaucacgcugucacuacuggagaggccccaagauauuuggucaacgaccaaauaucuuggccccuccugguucguucucauccuccauucacguauagauuucuuuguguucugcuucagaucuugcucaacauguuuuacuucaaaaaaggaugagaaggucucugaucuguguuaaugacauuacuuccaaaaugucagaaguuuuguucuaaguauguguauauuuugcuuuuuguuguuucaggauugugagggugaaacucccauucacaaggcagcucgcucugggagccuagaaugcaucagugcccuuguggcgaauggggcucacgucgaguaagugucuuucguuuauucuuuccagcuaaagauguaguugaggauguuuuguuuaaaggcaguacauaagcaggcaaaaguccuaaaacuuuguuuucaaaauuaguaauguaauuuugccuuuuagaacaguugguguuagugaggaaaauuguguggauuaaauugaucucuagaggaggggguuuaauuucacagcagccucaauauucuugucgagagaguguauuugaacugaaagaacaguuaacuaauuagauuuggaacuuggcaucauuacuuugccaccauuacuuugccacuaacuaguugugucacuguggucuuuaaacuuuucuuugccuaauuuugauuucaaaacaagaagcuuggauuggauuaaaauaucuuuucagaccucucuggcucagaagguuucugaagaaaauucacuuuucuagguuuugauuuccacgucuuagcagaugugagaaaguuauguuuuaaagcccauuguaacuuaaugguugauaguuccuuguaaaauaugacuauuuacauuaaagaccucaagcuugcuguaagcuucugguacugguggcauuauuuuuaaauaucuuucguuuuagcccagcuuacaucaguuagcuuauuuaugcuuugauaggacaaucuuaauguuuacguguagucuuuuagaaaugagaucuuauaugcaaaucauuagccauggcauuauacauuuauuuuaguuguuacauuuauuuguauuaacuuuuucuuaaaaauuuauauuauaaaaauuuuucuucugcaguucacagcauuaacaaaauggaugcgguuuucacccuuaaauguugaguguaagcuauagagcuauaauaaccaaaauaaccaauaucagcuuuuuuguuuuaccuuaaguguuaugaauaauucaugaaaauuaauuauaaaccacauuauucuaaucagaaaugugaacauuuagacuucggaggaaauaaaacccacaaaacuaguuuaacccuuugguuuccauuucauugcuuugacucuguauuauauugaaaauagauccuagacagcaaaaccauacaggcuaaugcacgacguguguagguaccggaggcugucaaucaucugugaauagcuuagcuucuguuuuguuaaguuuauuggcaagauucgccauuaguuugggcugugauccuuauauagugaucugguauuauaaacauggccucuguuuacuguuacauugcagggacucucgcgacuucauguauaguugugacuaaagguaauguagaaacaauugauaguauguuuuauauacuaguagaacauugagaugauucucaguggauugcuuuaaagcaaaguuauuugugcauuuuucuuagcuguaguuagauuuaaaacucuaauuuuuauaacaaacuuucauuauaaaauacggagucauaacaugauuaaauugcuugucauuuauucaaacaguggauaauuagaaguugauauuuuuaaugacuuucuaaauaauacucuaauugguccugaacauuuuauuacaaagauguuuuauucauuuuauggauagcuuaaucuuuucagccaauaaauaucacgauguccuuuuuuuuuaguaggugucuuuuaaaaaaugagaaucuuuuauuuacaauucuguccuugguuacagggcccucaagugucucuuuuccaccagguguggcugagaugggcucaggugccagucuguuuuuccuucucaguauaagagccaccacucaagacccugcauuauggugacuucccuggacugagcuuucauauuuuuuuuagaagaaguauuuagccugagcuaccuagccaaaaacaauuauaagccuuuggccuggagauagagcacaaguaaucauuauucauugcuauuguauaugugguuauuuaguuuuaacaucgagauaaaaugucaguuuugucaguaaguuaauuuguaaguugcuucuugauuucugcacauuuuaauaauuuaccccauuuaguccaccaacguguaacaguuugaaucuccaaaauaaugguacuaggucuauuuuauucccuguaacgcugcucauaugguaaaguguaguccuagcaaaucauaaccguuucuuuuuuuuaagacguucaaggagcauagaauuaacuuauuuaaaguuaguuuuuuucauucagaauggacgagauuauuaacucuucauauuacaugcuauaauauuuaggagauaauauaaauuuuuccuuuuccugugaauagauuaaaagcugccuuauaucaguauuauuaaauucauuugcucuuaauuccugcuuugcuuuuuauauaucugcuacauaaagugcccaaagucuuaaauuguugugcuuuuuuggacaucagguacauaauaauaagggcaaguacacuaagugucuguggcuagaaugguuuguuauauaacuuacuuguuaauguagguugcaucuguaagauaacgcauuucagcugcugugcaucguauuaaauuuucuagcaccacacgugaguauguuaauggacuuucuuuuucuuuucuuauuuuaaaucuugaguuuuggugccaaguuuucugugugugaggcucuguuucuggcuuauauguuggucauuauuauuugccauuguuuacaucuaaaaauuaaaacgcacaggauuaaaucuaacuugugaccaaacuaaauguuuguguacuuuaaaggaccuaaaucucuguguauggaguuuucagcaagcacgugaaguugucaccauccuuaaucuugcuuauaugguaguuccauuuuuccacugcccccaauauuugagugcugcuugcuugguacucagguauugacuggaagaagaggauauacuauuacaaaaagauugucaucucauuuuucuuuugaacgauggaacaaauaacagcauaacauuaagucuuaaugugauuuuggaaaaagacuugaaaacuugcugucugcugauaauuaagaagaccuuuucacuacuagcauuguaaauagaauucgggccuuggaauagcuguacuuucaguaauuugguaccaauuacuuuuggcugauuuguguuuauuuucuugagagauaaguggaggauguuuccauaucaaccagcuaguaaaauagcuuuuugccacugaguagaaauaaaaagauuuagaaugaaaccagcaugacuugcaucucaggcagauuuguagguccguuuuaauacugcauuauacggaugccaguguuuaauggcagagucucagaacuuuucuacaggagaggauuucuugagaagccauuuauucugugguaaccagauuuucagcugggcuacauguauuuuaacuuaauuauuuuuaucuuaacugggaucaucagauagcuugagaagcaucgauagccuuauauaagcaaauucagugacucacucuagaaaagucucucuugccuaguuuaggaaguaggcacaguuggcuauaacaaagccuagaaugugauguuaguagacuauucuaaugccacaaagaauacugcuucacuuuaauuaaaagaaauuuuaauuaaaauggaauugucuuaguuuggaucauaauugaccauuuaugacccaccuuuguuuaccauagagcccugucuagaaaccagauuuucauuaggucaaauacaggugaugagcauauuuaauauuaguguuaaauucauuugugacuuuugcccuuagcaaaauguaaccuagauuuacuuuuagcuauucauuuugaaauucgugguuucuuuauauuuguucauuuuuuugcccaucagaauaauauuucaguuacaaaaucuaccagaauuaugacucugaauucauauuuucugauuuuagguccucugaauucuagucauccucacauccuacuuuugccuccucuuuuuuuuuuuuuuuuuuuuuucuaaaaagagacagagucucccuuugucguccaggcuaaaguacaguggcaugauuauaguucacugcaacuucaaacuccugggcuccagugauccuccugccucagauucuugaguagccaggacuauaggcacauaccaccaugcccaacuaauuuuuaaaaauguuuaguagagauggggucuugcuguguuacccaggcuggucucaaacuccugggcucaagcaguccuuccaccuuggccucccagagcacuggguuuacaggugugagccacugugcagccuccuuuuaucuaauuguccccacagcagacuugucuggucuuggcuauuuuccgguuguuaagguguuucaggauggaggaaucaguuccugagauaguuauuaaguucugccugcuagaaagggacaguaaguggguugauaucauucuagacuuguuaagaaauuguucagaauuuugauuguuuuucauagcagcuugauuaaaauacagauuuuaauaauuuccuuacuacuuuuauagguagugcuuucaaauaaaaccaguguuugcuaaauccaaaugucuuucucccuugcuaaauuauagcaggagcaugcuaaauauuucaucagacuacuggaaugaugguuuuacauuuuaauguuugaaaacauaauuuugguucaauugcaguguaaaacuauucucaguaacuuuaaacuugaaaacuuggcaccaaauuuauuuagguagaaacucuuuaaaaauaguuucuuccuauuauuaacugaagaauauauuuaagaaagucuucauaauuaaauaagaguuuggauaccaaaggguuaaaaauacacauguauuucuuuugcugaagauaucuuagauguuugcuaauguuuuaucuuuacaaauggacaauuuaguaauguuuuuuaucuuuuuuuaaugauuccauguauuugcuuauuuccaucuaggaauaguuacuaauguauuugagauacagcauaccaaauuuuaaaguaaccagaaucgugaguugaugguuuuuaguccauacuguuaaacuuauguugaaauauugacauauuuaaauuggcuucaugcuaaaaaauuaccaaagguaauuuaaaaggcaguguuuuagagcaguagcucauggucaagguggucacaugacaauggcuuaagcucagugugcuucugcaccuuauguugucuauguauuuuuaauccaaauguugccugcaaauaugugaucccuuauuauuuaaguuuccuguauuaugaaccauugcccguuuuaaaucacacagaagauucugaaucuguaaaaacuacacaugucaauguuuuacagcuacguaauucgaauugacuugauuuuuucaaguaauccuagaaagggggagcauuccauauagaaacugcugaaacugccacaggugcuucuccgaaaaccuuacaguuguggcauugaauguucaguaucgcuuccuuucugcacacgaggcauacuguugagguauuuguugcggugauugguuuuaacgcuaaucuaggaauucagauagagaugcuuuagauuugcaugcuuugcuuaccuaauuuaugauaucuaccuuucuauuuguaaacuaacaauagcuaaguugagaucagaauuuuaacagaaauauuauuuauauaaaaauuguuaucuuuuauugucacauggcauuaacaauaagaaaacauccugaaggugaugugacaacucggauucuaaaaauuauacuucagguauuuccugauccgugguuuuucaaaauugaaacaaagucguucucaucagaauggcuucuccuuuguucuggaauuguggcacuauaaguggaaacuggugggacccuggcuggcuucagaguggagccuaauuuuuaaaguucuuuaggggagaauucuuagauauaaauuuuagugaaaguucuuugggggagaauucuuagauauaaauuugaguguuugaagagacagggucuuccuguguugccuaggcuggucucaaacuucuggccucaagugauccuccugcuucugccucccaaagcgccaggauuauaggguugagccacugugcuuggcuuagagguaauaaauuuuaauauucuauucagaauaagaaaauauagcauauaagcauuuguaucuuuaguaaaguuacugccaguuugauuuuuuuuuuuugcaaguuacuuagcagaacauguaauucacaguaaagaugauucuguguuguaccacauuuuaauauuccuguuuugaaagaauaguagagagaaaauggguggccugcucagugauugcuuuucguagucuuggugaauguuacaggagauugaauuuauagauaaaagcacagucaucguaguuuccacaguacauugcagcacauuuagcuugcuagccuaaaaaucugaucaugcugaguuucuuuuaaagaaaguuaauuuuagaacuucaaacuagaaccaguuugaaccucaaguugaccguugucugaguuuuaaaaaucucuucccauuuucaaagauuuuucaaauggauguaggagaggaccaaggagguaggcuauagcuguagaacaacacaguccuauuuucagaaacgaacagacacacguuuuaggucaggcacagcccauguauccaggugcaucaaacuggggaugcuaaguucaaaagugcgucuguuuugaagauuucaucugaaaauaauguguacacuuucauuacuaccaguuugcauucaaaauaguuuuugagacucuuuaaacucuucuggauacuuuaauuuucccuuuggaauaguguguaaacacaguccggaugaacuuuacuacugauaccucacuugagguugacaggaguggccagcaguuagugccuauggucauguaauacacuaagucaauaccuguggagugaaauccggucucuauaaaaaauacaaaaaaaauggcuggacgcaguggcucucgccuguaaucccagcacuuugggaggcugaggugggugggucaucugaggucaggaguucaagaccagccuggccaacauggugaaaccccgucucuacuaaaaauacaaaaaauuagcugggugugguggugggcgcuuguaauaccagcuacucgggaggcugaagcaggagaaucucuugaaccugggaggcagagguugcggugagccgagaucacgccauugcacuccagccuaggcaacaagagugaaacuccgucucaaaaaaaaaaaaaaaaaaaaaagaaaagaaaaacuaguuggguaugguguuguguaccuguggucccagcuacucaggaggcugaagugggaggagcaccugagcccaggagguagacgaggcuacagugagcugugauugcaccacugcacuccagccugggugaugggagugagacccuguuuaaaacaaacagacaaaaaaaccuguggauugaaggguaaaggauggaguauuuaaaaaguacugugacagaacaaaguacuguaaguacuagaguugaguguggauggaaacacagaaccuguaaaucaaguguuucauuuacgugcucaacuccuacugaauuuuagcaauuaaaacaugaaaacugaaauauugguuaacaaaugaaaauagaauuuaaagaccugaacuucuuuuaugaucuuuaaugauuauuuguucuaaucuuugacuuggaaacccaaauuauuuucagucuaacguacuugaaauuuaacuauuaaaaaaguuggaggaacucaaacuuugaaguuagggcucccuuucuccagauaaagcacauugccugguuuauuguaaggcacuuagaacauguaaccaaaaacacucaauuuaggaauaggaaugauuguuuuacagcuaagugcgcucucagagucuuuuguuuuacaccccucucaaguuuaccuuuagauauuuuucuuguuguuuaauauuuugugacagauuuggcaacuuuuaaaaaguuguuugaauugaauagugcauaaaauuaauagauguuuuucagaaaauccauuauuaagaguagaggaaugaggagaaauauucguucuaaagagaaucaaaaccacaaugagagauugucuuacccccguuagaaugacaguuaccaaaagacaguaacaaaugcugacgagaaugcagaggcaaaggaacguuuaaacacuguuagugggaauguagacuuguacaaccguuauggagaagaguauggagguuccugaacaaacuaaaaauagaacuaccauaugauucagcagucccacuacuggguauauauccaaaagaaaauccauauauggagacaucugcaccugccaugcucguuccagcacuauucacaguacccaagauuggaaucaaccugugucuaucagcaaaugaacagauaaaaugugguauauauaccccguggaauacuauuuggccauuaaaaaaacaaaauucuguuauucucagcaacauguaugaucuuagaagacauuauguuaaguaagccaggcacagaaagauaaauacuccauguacuguacuuauguggaagguaaaaaagaucucauagaaguagagaguggcucaugccucuaaucucggugcuuuaggagucugaggugggaggaucacuugaggccuggaguuugagaccagccugagcaacaucucucaaaauuaaaaaaaaaaaaaaaaaaguagccaggcaugguagcacaugccuguauaccuagcuacuugggaggcugaggcuaaggaggaucccuuagcccaggaguuccaggguguggugaacuaugauugugccacugcacuccagcuggggcaacagggagauacucugucucuuuaaaaaacagugguuacuagauggaaagauaaauucuaguguuaccuugcacuguagggugacuaacaguaauuuuuuauuuuuuuuguauggcuaauucaguacaaauggaaaguguuugaggugaugcauaugcaauuaugcugguuuuuuuuaaucccuauacauuguauuggaauuuacaauguaccccauaauaaaggauagaggaauauuuacaguaucaucuauuugguuaaauguuauucagcaguucuggccugcugccuuuuuuuguauaaccuauggcccaagaaugguuucuacauuuuuuaauaguugagcaaaaaucaauagaauaauauuuucuaauacauaaaauuagaugaaauuucaguuucaguguucauaaauaaagcuuuaugagagccaugcucaauugccuugaggcugcuuucagccuacaacaaaagaauugaguaguuaggacugagaauguauggucuccaaagucuaaaauaauuacuacauaguccuuuuuagaaaagugccuucuggauuagaugauccuuaaugaucauuucaggccaauuucuauaaugugcacuacacaguugagugaccacuugcaagauuuuuaaugugagcagggauaguagagaugaugaauguagguaaggagaggaaaugagaaugaggacuuucaggggcaagagaugguggugucauuuuguguuguguuccugagucagguaccaacagauuuccucugaguagaauauaaaugcuaacaaauuaaacuguauguuguauacauucagcccuugguaacaaggaaaaugauagaauugaaauguucuuguaccucacuagaagcagagaaagggugcuggauauuucuguuuccgauaaugcugcauagauagugccacuuaaauguagagcaaaauuacagucuccucuaaguaauuccuccaguuaccauguguccuagauuccgauaccuguccaauacaauuucuagaacuuuuucaccuccccaucaugucugccuucuagugccccaaaauuaugugagaugcuagaaguuguuugaccugugauuguucuugcuuccuugguccuuacguacgaguacauagcaugauugggccagaauccgucuuuugagcucuucuaguaaaguaaguuuugagauaauaccuaagaccacauggaaauuugguuggucuaaguagaggacaagcacguauuuaacuaccuuuggcaggggaaaaagugaagugggagagcuuaccagugcuaccuauguguaggcugacacucugaaacuucagucuccaggaaucuccauauguuggcacuauuuuguugauuauuuuucuauaagguuauauuucuuuggaagaucaguaaacuugcuguucuaacccaaauucaguguagucuucagcuucugaauaaggaauaaaggaaucgaaugugcuuuggauguucuuuuaacaauuucagaauguuggcaugcccuuugagcaucuaaacuucccucagcgaauugguauuuauuuauuuauuuagagauagaaucuugcucuguugcccaggcuggagugcaguggugugaucucggcucacugcagccucugccucccagguucaagcgauucuccugccucagccucccaaguagcagggacuauaggcaugugccaccaccacacuccgcuaauuuuuuguauuuuuaguagagccaggguuucaucauguaagccaagcuggucucaaagcuccugaccucaggugauccacccgcuuuggccucccaaagugcugggauuacaggcgugagccaccgugcccagcaugguauuuaugauucuaagugccauuucaaaaaucuguuugcucuuuuuuauucucugguccacuaaagaguaaucuuuacugugggcuuuauuucauauuuuuauuuguccuaauacuaagugguagcuucucauuucucuguuucuugauuuuggagagcaagucuaugcuuaucuauagaaauaaucaguuuguaaacuuauguucuccuugaagaguuuuugaauuuucauguggcaacuuauuuuucuguucacauucuugacagaauagacccucccaggucaucugcacuucugauaucuuuugaaagugaaauauaccauuaaaaaaaaguccagcuauaugaugaagcugucacguaauauuaguauauuuucuauuucaauaacaaggugaucugauuuuguacaaaguauaauuaauguaauacaaucugcccaaacuuuggugcuuccuuuucauuuaauucauauaucaaaauaaaaauauuaugcaauacuagaaaauacucauggccauucauagccaugcagucuuaauaaggcuaauaaaaauagugacuuuagucuguaauaguccugcacauagccgccuuauauuuuuaagaauuuuguugguuucugagauucucaauucucuuuuaucucugaucagauaggauuugggucuuuuuucaaaagguguaaugcauuuaucuuaugcuuuaaaaaguagagacgcuuagcuaguguccaugcacacuucucauuuccaaggucagagcucuaugaugucugcaaauaacgaauacaaggcuauugucaguccuuauaaauaagaaaauauuauuugucccuaauucuguaguuuucacucucaaaugcgggguuuuuuuuuuuuuuuuuuuuuuuugcauuaacaguaaccccaagaaaggcaucaggguucuggagugguuguuugagugacacagcacaaggccuugauuucaucaugcuuuugcuguggauguaguguagcuugcugaacagguauggaagcugucuuugcuguuaaguacuucucccguuuguuuaucaaccugcagcuaacaggaugucugcuuuuuuacagguuuauuucacagagcaguguacauucuugucuuccaggggaacuucaacauggaguuacuuuugaucccucaguuuuaauucagugucuaaagguuuacaaguucaacuuacucuauuuuauucagcucuuucacuuacucugccaucacuuccuacuugaaucugaguuuuagcuacuguagaggucucagaccuuuccuuuuuaguacuauuagccagguaaaacuuugguucuugugagugguagggaugaguuuuuaggacaguauucaaagccuuuuuaaaggaaccaacuacucaaaugcucuacaaugccaaaaauacaauacuccugcagguuuucccaagcaaggccaaaacaaucaaaaucugacagaaaaacacagcuguucagcucuggaaucugaugauaggcuacuuuuuaaugucaggacauccuucuaaacuuccacuuacagugucacauguaagcaugaaggcuggcucguuggugagccauugcuuuguuuuuaggaagacaguuaugaaugccauggacaaucucaguacauguuguuuguuaugauuuuauucacgcuaaaggaauggguauuaaaauuaagugcauauaauauagaauucaguuucaagucugaaguuagcguaaauuuagauucuucagacuaacauaaaacaugauuuugagaaguuaaauaggaagaugccuuuuuuagaaguuuagcauauuuaguuuaucucccaaaucuugcuuagaaaucaaauguauauaagagaaguuaguuacagagcuagauugauuaacuacuucuuuaaugaagauuugcuaugaauuuguuuacucuuucauaccaccuucagauagcuagucaguucagcaggagcagagaccagguuagcacgcggaugggguguaauucaguguuuuuguguuguacagccugagaaaugccaguggccugacagcagcagacauugcacaaacccaggguuuccaagagugugcccaguuucucuugaaccuccagaauugucaucugaaccauuucuauaacaauggcaucuuaaaugggggucaucagaauguauuuccuaaucauauuagugugggaacaaaucgaaagagaugcuuggaagacucagaagacuuuggaguaaagaaagcuagaacugaaggugagaccgcuuugcgggugggaagagcacacuuauuuuuccuuucuguaauauguuuucuuuuuauggcugagcgcaccuucgagaugagaccuucacuucaggugguaaugcgccugguggauugugcggugacgguggagauuucuccuguacugccacugcgaagaugggacuuaacaaaagggaaugugagggaaauacugauggcccaaguguaaaugucuauguggaacuuuuugagcacccauguuuaccugccaugaauuagauuuuuuaauuuguuguaucuguuugaaauauaucuauuaaagaaaaucugccacugugccugaauuuuuuuuuuuuuuuaauuugcuucuuguaaauguuccugggcuuauaaaaauugcugauggucuggcaguaaaacauuuucacauucgggaaggugaauguuuucuguacuauuucuguacuaugauuugaccucaguggucucuguaccucacauguguguugacuuaucacagcaagaucugguguauaauuugaucuugaggauuuaagucccuaagguaaguuauuuucguuguaaguauucucccaccauuuuuuuuuuuuuuuuuuuugcucugucacccaggcuggagugcaaugcugugaucucggcucacugcaaccuccggcucccaaguuaaagcaauucuccugucucagccucccaaguagcugggauuacaggugcaugcuaucacacugggcuaauuuguauuuuuaguagagaaggggcuucaccauguuggccaggcuggucuugaacuccuggccuccaguaagccaccugccucggccucccaaagugcugggauuacaggcaugagccacugugccuagccguuuuuuggguuuuuuguuuuuuguuuuuaagguagguuugaguuugcaaauaagcagucagccagucacucuugaaguugaaaacaucucccuuuccuauaggaaaaucaucuauaucuauauauaagaugucuuaggccaguugucauggcucauaccuguaaucccagcacuuugggaggcugaggcaggaggauuacuugagcucaggaguucgagaccagccugggcaacauagugagaccuugucucuauuuaaaaaaaaaaaaaaaaaaaagucuuaauaagaagguaaaugugauagcuuggcaggcauauuuagugaacuuagggggagaggugggagugugaaguaaugaagcagauuaugagcucagauuugcugaguauaagcacaaaguuuugcccguugguuuaaaaaaaucaaccgugcaaguuacagcauaaggaaaacugagugacuaucaguuaaucacuuaaaaaucuagagauuuugguuaaauuucaugaaccaacaucaucuuuucuaccuuauuuaaugaguguguccaagugaaacauuuuuucccuauaaaguugauaaaaugucaguauuauguacuucacaacuauaucuugucaccauaaaaauuccugugauaagacuuuuuauaguaauguaugaacuuaacaguuuuaucaaauucaagauuuuuaugaguuaagcauuucuggaaagaugcuaaaaucauaagcaugacaugaagaucugcauaaaauucaaaauggucuuuuuuaauggugauguauucagcauugucauuuauuuguaccauguuuuaauauauuuuuucuaauguaguuucaacgccuuuuuaagagcauccacuuuuuaaaaaaauccuuugucauuuccuuuaauuaaagccugguuaguauuguagaguggccucaugcccucaugcacgaauuguacaugucugucccuguaugucacuguauagucuaaauguccuugaaaaaugauuuaugcuucauuuucucuuauugcugauaaaucuuaaauucuguuuaguauuuuuaaaaagagaucacuuaacaugcuaauuggacucaaaaugcaccuagaagaguucguaaaacuagucucagaguuucuaaggucaguugaauuggccaauaccacauugcuuaauuacccugaaaagcauuucugaggauuccuuguuuccuaauccucguuaacuacauaaauuugguuuaaagaguccugcugacuuuggggguuuuauuuucuuccuuuagaaggaggauuuguuuugguugaccagugauuagaaguucacauuuugcacauuaaacucaccaugcagccuucccaaacuauacauuccuggucccaagcccgagggugcuaauuuagacaaaaauaugguuggagccggcacuucugcuuaaguguugcagguaauacguagaccuaacagguugagccacuguugcagguacacaguacaugacugauguuucugugauuaucacaguugaaauauuucagccaagaugcacauuacuucaaagcugcucauccuugguuuuccuaauuuguauacugaccaugacuuuacuaauuuccuggaacuucugaugguucugucuuuuauguaguugacaguccuuagauuugccacacucgucacaagaguguguuuauauuuuuuugugucugugugagcauagaugggcaucuuuagcucaccugcacucccaccacucguuucccuaugggaaaaggugauuuuuugccccccuuuuaccauuacauacugagagugcugaugucggguauugggagucauucuuggucauuaaaacaggauuuuuuuuucugccaauuaccugaauguucuacaugaaauuguucuugguuucaauagauauauaauuauuuccauauuaacugaccaguuuuuuaguuuugaauuaaagauauguugcuuuaguuuucguuguaauuucuggcaucuuguuuugauuuuguuuaaauguguguuuuaaguuuugcuuaaucugaauuauuuuauuagguuuuugguucucaugccagaguaaaagaaaugauaaauucuuuuuuccucauuuaacacauguauauaaaauacuuugaguaacuucacauauaaaaauauuuagaagaguuuaagcuggguuuuuuguuuuguuuggcuuuaaaaacaaaaaaaguuacaggugccagggauaauaucuuggcugcguaacuuguaucuuaccaauaaaacuuagugcguucuguuuuccuagaauuuaagaguuacaaauauugaugcuuuuaguguggaauuuauauuuacaaaaguaauuacuuccagaaaguuuucuggcuaagucaccucuuaaggagaucccuguaaaauucacccuuuaaaaaagaaaaagaaaaagccaaaacacuuuggaauccugagucugaauguuaaccauucuuccccacaaaaaguagugucugcuuuuaguaaacuacuuucaaguauuuuaaauuggaggaauuuucuuuuggaagcuguugauguaaaagaucuuaagugaagaagaaagacuuggccuuuuguauugcuugaauauuaacugucuuggaaggaaguuaugcuacaagaagucauacuuucauaaaauuauuugcaucugugucaaaugcaguuuagucagaacguaagacauaauagguguggacaugaacucuggagugugaaauaaaauccacaguuacuuaagcagucuguuuugauggaaaguaucuugggauaauacuuuccucagugugggauuuuguucauuuuagauggugcaaggaaguaucagucuuuaauuuuuuuguuguuguuuuuaucaaucauuugcucugaugguaugaugcaugggcuucaggacuccagcugcaccacuguauaaaacucaguucagguuugcuagcguucuugguuaaucuucaggaauaacccaauacaauuauuuuuauauguacuccuuggaaacuguggucguuuuucaaugaucuugguuagaaaagaaugccagucccuuccaugagugaaaacuugauuuugcugauugauaauuguuuuggauggagcucuagagucguggggaagaagcaggggaacacagugaguuuaaaaacugacccaauaacuucaauuucacaauugggacauuugccccagaaguaggcuguggugacagcagaucucaagugucaaacugacuucacagcucggucuuaaucacauaggcauauuacugaucuuagaaucucauucauacugugaagguauugaauauaaaaacaccuuacagaaaaaaguaucuacaacaugaugauuuaaagguaaaauuaccgguggaaaguuuuaacacuuucccagaguggauuuaaccuggauaaaggaucucugccuuuuguccuuagcuguucguguugagcaggguuaaagacuugguaaaggagggcagauaugaccagcugguuuguuaaaugauagauguuuauugcuugaaacuugagaggaaauaaaaugccucccaggaguaaauuuguaauuuaguuccuucuaguuuaguuacauauuauagcacuuuaacuccugacguccucacuguuuucaaauuugcaguauauuuguuuauaaaaauguggccaggaugauagaacacaccuaccuaauuguguucaaauaaggagugauuguuuuuucuugaucccugaagaugugacgucuugaaauacagucugaauuacacuuccaguccagacagugucugcguuuuccacuguuaaaagucuccauuugagcaaaccucaugggccugaguuguccucagcacaguuguggacacuccagugggaagcaaaacgaagacuggcacacuugaucacaagccgcuuuuguauuauuugagccaaacccccagucccccccggucuuuccagagcacucaguucccuucucuguccuuugucgcugcugcuuccugcugccuggagucaucccaacccucugcacugcuggaaucugggcccuggcgggucccgcgaaaggucaccucauaauagaaaaacaauuugguuuuaacaggaccuuaaaaaguugaguaaaaugugcucuacagcagaacaaagaauaguuccagguaauggcuggugggaaaccaggaaggcagagugucuuuccuugcugccuuaaugagaggacauugaggcuuccccaguggaagcagcagcaggaugcacucaguucaguggaaaggccacaggcgggagggguccugggccauuuggccaccucucaaggguuaugggucaacaccugggacccuuccacacagcaccuagaggcacaguaaaagguagaugacuaaucuaggucaggaucucaagcuuugccuaaguucauugggugaaacuacuuggcaguuucugacuuguaaaaugucuccugauuuagucuuggggaauauaaccaguauggcuugggucuugggaguaauguccugcuggcugauuggagcacuucauaucccaaaguaugacuuuauagagugcuuuuugguuuuuuauguaaagauuaaaguugugaucaggcauuuuuccuaagccuuacauguaucugcaggcaugccuggcaauuacaguccuguuuuccugugugucaguaugaguggugcacuggagugucuucacuccaccuggucagcacucccauaagccucuguaguggcacgaccuugguguccaauugcauuacuucuguaaugcagcagaccuucccggacuugaaacuaagacuuuuuucaugguuucaagcugcuugauccugaauagcucauacaguuacagaguuacugggaacuggcuuuagggguuuugugcaacccccaaauuucagaugaaaauacaaaugcagaccguuuaguugcccugggcaucagccccaaguggagcaucucugugugucccccagggucaggaauguggguuucucagccagaggcgugcucuacuggcucuaguucucacuuaggagggcaggcagugaccacaccuggcuuguggcuguaucucugagcagggaggcuggagguuuugagcuaguccuagauagguuuccauccugaacguugugucucagguguacuagaagccugucuucccaacagacaccugacaccugcuuuuacagucagcaggugaagacccuuugaaaaaaguggucauacuaacauuuucagaagcauucaaucauuguguaacuuuaagaaucaauauuaagauaggaaaguauagugcuuccuuucccaaacugaguaaacugaugaccuuggaagacauguuuuucugaaaugucuguacaggccacccuucucaaaugcaagguguaauuaaaugauuccuucagcaauggcaacaggugugggggaaaaugccacaggugguagggucuuacagguccaaauccaauguucuuaaaauuuugagaggccaguuuuaauuucauggcuuacaacauaauuaaaagagauaauugcgggcuuaauaucucuaccagccaauuaacuuauguauagcuacuaggaaugaagaagguggcacucgugaaacagcauuauccaaggcucugugacagcugguugugggaacuacaccguauagagaggcuguaucuauggagauggaaugaaauucuaagguucuguuggaaugauucccacaauagaaucuugauugguaaaauauggaagccuuucauucuuauccugcuuuauuagagaaaccaucugcauuaacaaaagaugcaucuacucaauggagcaguuucugagaggucccuggucacugugagccuuauaguuacaggauuaauuguugcugggagacuaguguguuucccgcugccucuucccugggcugcccuuaacgcggcucuuccggccccuaguggcaccucugccuucagggugcaugucccugcaccucgcauggccaggccugccuggaugguugugacuccucagguuguauuacaggcuaugccagcuacugaucauuuguuuuuguuuaccuuguguuuuuguuucuccuggcuagugggugggcuucaucugcugaugugaguacuauucuagguacugggccuagugaaggagaagacaaacaccccagcuuucgugaagcucuucucuguugcgguuuucuaaccugcuuuucagaggugugaaauugcagguaaccccuaguugccacuuuauccggggaacauuggcaucugaacgccaauugaguguguagguauuuuaagcugucugcauuguauucccaucaaaguccacucuuuuguacaaaccguguucguguguggcuuugcaggauugcagccugugggaggagcaaacguugacccgcucuuggcugcagguucucugugucugcgugccaugaaggcuccuggagguugagacgacuuuggcacacuugggggaucugcucuuccaccaccccccucucccauucuuuuuucuuuuucuuucuuucuuuuuuucuuuuuuuuuagauggagucucgcucugucaccaggcuggagggcaguggcgcaaucucuguucaaugcaaccuccgccuccuggguucuagugauucuccugccucagccuccccaguagcugggacuacaggcacucgccaccacgccuggcuaauguuuguauuuuuaguaguauuuauucagcauguuggccaggacggucucgaucucuugaccucgugauccacccgccucggccucccaaagugcugggauuacaggcaugagccaccaugcccagcccuuuuuuuuuucucucucuuuuuuucaaaagaugcccugcuuacacacugaucucuuaaaagugcaugccugagucauagugaaaguggagccuggccuguggaagauuuuuuaaagcuuugaauggauaagacuaaaauccaccauugaaugccucuggucuuaaagcacuuguauuugaagaaugcuuuuggccuccuaccuaaucagacuucugacuaccccccauccccccaacuacacaaaucacacuguucuguuucucucccccauacuaauuucagaaaucggguuucucauucuguacauuagcaucuuuguagaauaauccagauaucauauauacaguauaaucaaaaaugacucgugggccucuaaaacuagagcuaauucaagcugcaaaguuccauucucccuauuuuuaaauguuuauaugaaggagguauuuagcacugaaaguugcuauuugugguguauauucuuuggcccagaaauaauucuaaguaucugaguuaaccagaaauacacauaaaaaugcauuuaugaguauguuaauugugguauucaugauaggaaggaaaagggaagcagcccagacagcugcagggaauuugguuaggcgaaucguaauacagccauagggcagaggaaagauuguuuugaaauuaacugauaggacauuuaugccaugguaaaugaauaaagcaagguguaacagugauuuguuagaauccuuuuugguaaaaacauucuuaaacacgagaagccguucagacacauggagcugcuuguuguaagaagugagucuugcuaggauucagaggcggaggugcuugugcagcguggguaugacauggggcauucgcaucuccacaguacagagaauggucaucuuggaagugaagugcccguguagcuuuagcuucacauuucuaacgcuuucuguauuuugguguaauuauuuuacuguauuuuggugcucagaucaaaugccacucugggacagugcugacagacuagucuugagucucuuagccuuuacauuauuuuuuuuguuaauggaaauaguggauuuuuuuaaaaaaucaggauuguuuuaauuguauguaaauuuaagaauugucuuaguauuaaaaaaaaaucugcugaauuugaaaauggaguuuggaauuguuuccagguuauauaaccacuucaugucuucuaaauguccagaaaauuagaauuuuugccaucaaguaaaucuauaauaggcaucugaaauuccaugaccuuaaaaucugcacaugucaagaaaucuuuuugauuguggaaaaguuuuucaguugugugcuaagcucauuagugaccugucgauuuuuuuuuaugugauuguuuaaaguguucagugcucacacaaaauaauguaaacugugugucugaacacuuaucuuguuacagacaaaggaaucugaaauagucuuuguuuucugugcagcucaaagcuuggauucugccgugccacucacgaauggcgacacagaagacgaugcugacaaaaugcacguugauagggaguuugcuguuguaacaggugggaguggacaguuuccuguuagcugcaacaacaauccaaugguugaagacaccaaacagcaggagagugguucuguuggaccaaaagaaauagaaauauauacugugucagcaaugcagacccccugucguugcaggaaucaguaugcauauuauuucuaacauaaguuuuucucagauguuuugcacuuuguuguccagugucuuuuuaaaaauguuauacuauaauuugcauaucuugggcaaguuuguagauacaagaaguguuuuggguauauucuguggacaugaaaaauguaagugcaaucuuuauucugauuugaagcuauugcuuaaugugccuugcuuauuuuuaaugagguuugcauuuuuaauuuucugacauauggccuuugggugaauauaccgaacaugcuacaguuaauauuuucaaaccaauauaccacaaagaggacgacuagcaguaaacacugagaaacuaguaaaugugguucugacucagcccagucacuccagcauggaaucuuuuacccaggacuugguugcucugguuucuguggucuucauucugagucuguuaaaaugguaaacacuguguuucacaacacacauuuuauacauuaauguuuuuaguauauuaaaacaguauuccuguuuccaauuuuuaagaagcagaagcagcucaguucuuauagcauuuagaauaucuaaaaugauuuguccauuuagcuauugcuuuuuuauucaggugacuacaaaaacauuuuuagccauucucuuaacauguaugaauauuuagaaguagauuuuuuuuaaguuuauuaugucuuuaugcaaauucuucacuggggaugaaaaaaagaagaguauguauauuguuucccaaacccacaugaaaaaaaucauuuguguucacuaaacuuaaaagaaaauguguucaucuuucuggaagcuacagaauugcuguggucaccuucuucccaguagagaaauucagaucaguuaguauauuuaaaauaauagguuuucuguagucaggggcuauuugaccuuagcuaaagauccauaacaaaacucaaauccugcuuuuuuuaaaagugaccuugcuaccuucuuuugaauaggcagaaguggccaccuuuuauuccucagacauuaguuauuuguuaaacuuuauccaagcuggaacauacuuuugaaaaacccagcccaucccgucuaccagaugccgaguccauacacccuguguuucccaucauuugauuuaugacacucugacugaguaagcaauguguuaaaucacuagagauuacucgaggcuuuccuugugggacauggcacuccacguccacuggaagcuugagggagcugccuucacaguccuuugagaaucagaccaaaagucaggcugcucuccuuuaaacacuugaguaacuucaaauuuuuguucugccaaaauuauuuccaagaauucuacauuuuugaacaacuguguacagcuaucuuugcauuuuaaaugccccuaguuugagacucgggagggucaaguguccccaccccuggaaagggcucggauaggagggugcuugcuucuaaauccugaucuucucuaugggguuggcuggaagagaaguaggaucuugucugaaaccucauccccagcauuguguuuggauguucgugggauccgagggcuggccgggcagacagaagggaagugcgggucuuggcuggcagcugggagcagaggaagggagagcguuggaggucgugaugugcgugcucugccucaguaggucugaggugcccacuguuguuaugcuuaguuuuauuagauucucuguaacaacaugagcuuaccaaccagccuugauuuugagauuaaauaauugaacagauuaacugggcacugaaguaaaauucuaccuacuuuauucucuuaguaaaaacuauacacacaauaaacaacugucaagguugccaucauauuugaguuuugucaccuaggaaaacauuguuuauacuuuguuuuugaaaaaauucauaugaauuuccccugggaauaacuuguuuuauuucaguuuuuauuuucuauugaaacacuuguuuucuagucuaggauuuuagccaaauagaaaagcuaucauuuaauuugggggaaaaaaaaucuauuguccugugaagaauuuauagcaauuauuaaacuauguugcuuaaauauaaaaaaaaaggaugauuaauggaauauuuagauaauguuuccauucacugaagaagccgugauccuuuauuggcaggaagacuugcaggacauaucagaagccucugucagagguuuacaggaggugagauggaggggaagcccucuaugggaagagucccauggugugugacauguuaggguaaucggauguauuuaagcugcguccucauucuaaaaguuauuagaacugagcucuucuagauuuaauaacaugcuuugcuuugguagugaagaacauugagauaaaaucuaguauuaccgaguuagagauaauuuuagaucaucccuuauacuguuacgugaauuccugugaacaugaauauuacugauucucaaguuccaguauacagaagaauaacuugucauugccuguccugguguacccagauguuccaugauggacguuuuaucccauaagacgucucccuccugauagaugucuguauaugcagauuaaacuaccaacauuuuuuccagcaaaggugguuuuugaaaguaaccuaaugaaacccuggcugccauggucauuuuaauugcuggacugagaagaagcgacucugcguugugcuguuggcccaggccugcaugccugaggacuguuggccguuacaguuccuugcuguggucgccggucucucuguauucugccacugcucucauguggcauuuggcagaaguacuacguagauuucugugcuacugaaaaaaauaaaaacagugguuccuuuuaauagcccugauuugagacuuaggagagggucaagagucccuaccugauuuaugaggagagaagauuuuuuaaaaaccucaugugaugcugucauacauaguucaaagagcuuccuuaauucacuucauuuaccuuuuuuuccauuuucgcuugagaacuagagaaguuuguguucuguuggaacccucuguagaacacuuuacacucaguucugauggaccuuuucaggggcgauuuuuuaaaaaccgcucucgaaaguagucuuaaaaugagagcacuuuauugauggcuuuucaggacuguguugguauuuuucaugcaguguauuugucagcuuacauuuuucaguugagcuaccugaugcuacugacacacacaugauuuuccuaucuuaccaggcaaauacuacuguuaacguuuuaauaguaagucuacuuaugcacauugauuuuacuuugaaaaaagaacugguuuaaaaggaaaaaaaagaaacuaaaauucuuuaaaauuguaauggcagugaagcauuuuauaguuucuccucccucauugguucugaauuuuggugacagguguauuucuuaaugcagauaugaaaaacaguagcuccguaucgaauacauugacaaauggaugugucaucaauggacauuuggacuuccccuccacgaccccgcucagugggauggaaagcaggaauggccagugcuugacaggaacuaacggaauuagcaguggauuagccccaggacagccguuuccgaguagccaggguucucucugcauuagugggacugaggagccagagaagacccugagagcuaacccugaguugugcgguucucugcaccugaacgggaguccaaguagcugcauagccaguaggccuuccuggguggaagacauuggggauaaccuguacuauggacacuaccacggguuuggggacacugcugaaagcaucccagaacugaacaguguggucgagcauuccaaguccgugaaggugcaggagcgguacgacagugccgugcugggcaccaugcaccugcaccacggcuccuagagacgcugaccuggcucucggaaacgcaggaguccuuccugguagccagcucagaauacccauguagcagcaacuugaacgaaugucacaacuuguacguuuuuuauauacuucaacuuucugaaaaaguaaacuucgacaaguucccagcaacugcuuguuugugcaugaguagggcuuacuaagugcauagauguuucuacagugagguguccuuuuuauaaggugcacuuuuggaguuuuucugaugccaaucucaacauugucuuuuuaauacugucaccagauauugccauuuuucuuuuuguuaaaagauuauaugaucaagauaaauuggggugguaaaucaggugccugguaauuuaucucuuugcacaugggcaucauuuuaaaaagcuugcuuccacucuuuucuguagaauuugacggaacacagcuauuucccuaugcaagguacagccuuacaaagauuucugcagugauuugugugaagaagagaacguuugucuuuuucaaugaagcuuugcagaucaccaugugguugaagguuuuaguuguggacacaguggucccuccuuaaugaugaagaucacugccuugggcuucauggaaaacaggcccagccuggggcugcguuuggauuuauuguuuuuauuccacacuuccuacuuggucucuggaaguuuuaccacauguaacagauuccuuuauauguaguggaaaucacuauuuguagaaacugucaggucaaaauauuuaacugacuguugacauguauuuucuuuuuuccuuguuuuuguuuuuugggguuuucugcuuuaagauauauaccacuauguauauccaguuaacugagagaauuuugacucucuuaauaaaacugcauuaaguuuuugauuuuguagaaauuagcuuuugucuaggcaacuagugguuauacucugcaaauauuguaaugaauuuuuacuuuuuugauuuuuguaauaaaaauuggugcagauaaaaugucaaaugaacaaaccaguguucuaagaguguuacuaacauuuuguucuaaaacuguccuucacaaauugaauaaaaaacucucacacucagu

SEQ ID NO: 15539 - RNA, 861 nt, Homo sapiens
cuuuuuaaaucauguauuuuauuucauuuguauauauaguuuuucgcuguguaaacuuccuuuuugcaaaauucuacgucacaaauugaacaaggcaauuagaugucuagggaaguacugaugcacgagaaagcauauugcagcauugguuaauaaaacgaaaaaauagaaaccuaagauuuaacaaagggaaguuguuaacuagugguguaaacacucaacacagacaugucuucauacagcaaacauuuguugaguacaaugcugaaugaaacacauugagaaacacucuauaguggggaaguagcaaauauuucaauucagugagcaauugcuaaugaauggaaaauaugacacauagaaucuaucuucucccagggaguuuguaaucuguuagugaagcaggaaagaauaaucaagcaauacuuuuuuguuuggaccaaaagggugagaauagacuauaaacucauuucagguuuuguuuacucuagaacguaaucauuuuucuucucacaugccauguugauuuuaaucuaaucucuuuaaaauauaucccccugauuuccaucuuucuuaggagagaggugucccauuuugcgaaaggacgugaguguaucuuguccuccauguaaugaaagggagggauuacuugcuaggcugcauucugggaauggugaaacagagauggugguaagucaaggaauuuguccaagggcaaacugcaugccuguggcagagcuuagaauaauauccagaccuagguuccaacccacuguuagauuuuuuuuaacuuuggaauuuauuuugcauagaguauuaagggcuaggaagauaaaauagguuauagugauaggguacuuc

SEQ ID NO: 15540 - RNA, 7971 nt, Homo sapiens
aaggauuaugcaauugcugguuuaacuaauuucccauuuaguuuuuggccuagggaaaagccuguuaacuaaguaaauguuccauuuucuaucaacaggaaaacaaucagcuacaaaaucaccagugucuccuggauuccaauccuuggucaacagugcuagaucuacagaagcaaaacuaaaauuuuuuuucuuucacagaguaguuuuaagccuccaagcguuugaaucuuuaaaaugucauucagggacuuuaaaugaaguagugaaggcugggcacgguggcucacaccuguaaucccagcacuuugggaggccaaggcggguggauuacuugaggccaggaauuugagaacagccuggccaacguggugaaaccccaucucuacuaaaaauacaaaaaauuagccgggugugguggcgagcaccuauagucccagcuacucaggaggcugaggcacaaaaaucgcuuaaacccaggagguggagguuccaacgagccaaguucgcgcugcugcacuccagccugcgugacacagugagacugucuccauaaauaaauaaaugggaaaaaagcagacgaagcauacugguuucucuuuuuaaccuuuauuuacaaagaacacaacuccucuugacacaaacacacacacauuucaaggaggagcccauuaagaacaacaacagacuggcgagaaugacggggccuuauugaacacugucaauaaggaacacuggucuguguaccccagacuaggggucacugcaaacauuuucucagauaugacuuuucaccuccaagacaggaaaagagaucuugacguggaggcccgcccaccuacaaggcagaaagcuccacacucaaucuucagcaucgucaaacuguccuguuucaaagaccaucuuggaauaauaggguaucaguggaggcggauggugccagcuggggucauagaucaugucuccuuguggggcacagcacacccaagguuuaagcucuugagaaaugcucuccuggaugucgucagcaucugcaggcaguuuuaaaagacagauuaagggaaggaaggagggaaggaaggaagguaaaaacggacagccaaaaagguaugucuaggggacagauccuugcacuuauuuuguuuaaaaacacacacaguucuccuuuccugaagaauuguaaaugcguucauucggaacagcugagaagcuaugcuucucagacaaggguucuuagcagugaagaagcaaacuggauaacacagcacuucuaucugcagcugcucaauucauagcagagauuuuuggagagaguaacaguuuugacuuuaaaacagugauacauuauggagucaaaugcaaaauuuggauuuuuucaauauaaaagagaaggugucacagaaauuggagaccuguaacagauaccagccuaagcucauagauguggaccccuguuccaaacugccuucagggcuggucugacaggugugucugagaaggccuaguucaggacccccagagacuccacaccuaccauauggauucccuugaucugcuuucaacuccgagucccaguccucauuaaaaagaucgccaggcuguuccuuggguggacaguuugucccuucugacagcucccagguauucaguucuccaucagaguccuccucauccauggcaaagccuuccucuucagaaugggugcccucaccccgggcaggacugucauuaggaaugcucuguguuccacgggcuaaauugacaaagagaagauggccuuagugacaaaccaaagaggaccugcucugugcucaguaaauuuugggcagacuuacuacgaagguaguaaaacaagugcacagagucuucuuuagccaccgagcacuuuuuuaaaaaugcacuucuuuguauguuuuuaaaagagcugauaauuuauuuucaauaagacguuuugucuuauacaaggcauuaauugucagguccuuuaauuuacaaagagggcuagggacaguuaacauuuucaggugguuuguaugucacugaggcaaagggccucugauaaauaauacacuuucacaauacaagccugaauuaaguuuuugcucuuuuuuuuuuuuuuuugagacagagucucgcucugucgcccaggcuggaaugcaauggcaccaucucggcucacugcaaccucuaccucccagguucaagcaauucucugccucagccuccugagcagcugggauuacaagcgcccgccaccacgcccagcuaauuuuuuuguauuuuuaguagagacgggguuucaccaucuuggccaggcuggucuugaaccccugaccuugugauccacccgccucggccucccaaagugcugggauuacaggcguaagccacugugcccgguuguuuuugcucuuuuauuccucccuucagccucaaagagcauguuagaggugagcacagggacaaaggggagcaggggcacugcaggcagaagaccagaacccaucuaaucacaaugggcagcaccuagugccucccucugacaucagggaggccggaagguacauuuucaaaaggccucacaauaacggaggaaagacuggggaaagauaauggauuuccgagcacauagugcuuuggugaugccaggucccaggagagaaggcaaucagccuaaaacagccaugcucuuaauacuggaacaacaguaacagugauaagcaauaaagugauaguucagagcaaggggucuaaagccagacugucugauuucaaauccguguuuugucaauuaccaaacaucggacugggccgggcacgguagcucacccuuguaaaccuagcacuuugggaggccaagguggguggacugcuugagcucaggaguucaaggccagccugaacaaugucgcaaacccugucucuacaaaaaauucaaaaaauuuagcugggugcaguggcaugcaccuguaaucccagcuacucaagaggcugaggugggaggaucgcuugaaccugggagguggaggcugcagugagccaagaucgugccauugcacagagugagacccugucuccaaaaaaaaaaaaaaaaaaaaaaaaaaaagugugauugagcugaaauuuacuuaacuaguuccauaacauaaauauagaauuaccauaugacccagcaaucccaguccuaaacauauacccaaaagaacugaaaacagcuguucaaauaaaacaaggauacucacagcagcacuauuuacaaucaccaaaagguagacacaacaucaaauguccaucaauggaugaauggaaaaacaaaaugugguauaugcauaugauggaauuauucagccauaaaaaggaaugcagugcugauacaugcuacggcauggaugcaccuugaaaauacgcuaaguggaagaagccagacacaaaaggccacauauuguuaugauucccuuuacaggcaacucacauuugccuauccagaacagauaaacccacagagacagaaagcaaauuagugguugccaagagcucagagaaggaaggaauggagaaugacuacuuggugagcacaggguuuccuuuuagggugaugaaaagauucuggaacuagguaguggugaugguugcacaacacugccauugugcuaaaaggcuacugaauuauaugcguuaaaaugguuacaugguaaauuuagguuaugcaucuuuuaccacaauuuuuaaauuguuuuuauuuaacuguucugugccucaacuuccacaucuguaaaaugaagauaggguuguugugagaguuaaaagaaaaaaaaaggccaggcacgguggcucaugccuguaaucccagcacuuugggaggccgaggugggcggaucaccugaggucaggaguuugagaccagccuggccaacauggugaaagccccucuccacuaaaaauacaaaaauuaggccgggagcaguggcucacgccuguaaucccagcacuuuggguggccaaggagggcagaucacgaggucaggagaucgagaccauccuaacaagguaaaauccuaucucuacuaaaaacacaaaaaauuagccaggcgugguggcgggugccuguggucccagcuacucgggaggcugaggcaggagaauggugugaacccagggggcagaguuugcagugagccgagauagugccacugccugggagacagagcgagacuccgucucaaaaaauaaauaaauaaauaaauaaauaaauacaaaaauuagccaggcgauauggugcacgccuguaaucccagcuacucaggaggcugaggcacgagaaucacuugaacccgggagacagagguugcagugagccaagauugcgacacugcacuccagccugggugacagagugagacuccaucucaaaaaaaaaaaagaaaaagaaaaaaaggggccaagcgugguagcucacaccuguaaucccagcacucugagaggcugaggcagauggaucaggugaggucaggaguucgagaccagccuggcuaacauggugaaaccccaucucuacuaaaaauacaaaaauuagcugggcaugguggcauaugccuguaauccagcuacuugggaggcugagguaggagaaugcuugaauccaggaggcagagguugcagugagccaagauugugccauugcacuccagccugggcaacaagagcaaaacucccucucaaaaaaaaaaaaaaacggcagggggcugggcacaguggcucaugccuuuguaaucccagcacuuugggagcgugggcucacaguaaucccagcacuuugggaggccuaggugggcagaucacuugagaucaggaguucgagaccagccuggccaacauaguaaaaccccauagcuacuaaaaauacaaaaguuagcugggugugguggcgcgugccuguaguuccagcuacucgggaggcugaggcaggagaauugcuuuaaccugggaagcggagguugcggugagcugacaucgugccacuguacuccagccuggugacacagcgagacuccguuucaaaaaaaaaagauauuuugagagagaacacauucacguaacuuucaguauacuggcauaauuguucuauauuacuauuguuauuaaucacauaugcauaauuuauaaguuaaaccauaucagaaauaguauauauaggaggaaaaaaaagcaguuucaggcauccauuggggcgggggggucuuagaauguauccccuaggaauaaggugagacugcuguacuauuuucaccguuucaagcuguuucucucgguagaaggauggauuugaacauaagaaaaguucaggacuucccuuaaggaagcuccaagcaaggcuuccaaaggagguuacuguucaacugggcagagaaggccacuaagcagcagagaggacuggcuaaaagagaagguaaaugagacagagggacuauuccucuccucacauccuuggucuccccaacuuccgucucugccaucuacuugccuagucgauccauagccuucucagucucucucuccugacuggaguggucagcuguagcaaagccagccugcaggaagaagaaaugauuaccaaggacuuggguaucugggguaugcccaguauucagcuauugcaucucaaccccacccacucuuccauacuccccuuggugaugcagggcugggacucugccacccacauuucuacuuugcccuguuaaacugagcaaggcuggagggagaugggccuuguuccuuccuauucauguaggcaucaccucaugacacuucaccguggcagcaggaaugccuuccuauaguggccacagaauccaguauacaguucugcgaacucuugcagagccagucuuaucacugcaccuucucuuuagaggucugggucucaggacucuccuccaagcucagagacccccuaccaucagcuggggcagugccuucuccuuaaagguuggaauuucagcucugcagagccuuuucccuaagcuuuuaaauuuuaaucaacuucaucucuuuguuccuucagccauagguugguagcuguucccugcgguugccacccccagguacacguuuuaccuuuucaguuacuuaacaacuuuauagcuaguaaacaacucuaucaaauucucuguuuccucaccaacacacugaggugggggaagcuuuauaauuccucugcaaugcugagcacugaaggcaguauuucuaaucuaacugaaaaucuucccgcacagccaaccaaaugcuucucugcucccaucacucagaaguuccugaaacccuaugaccuccaagaccucuuucuaaugaaucacgaaauguucccugccugcauaaaagaccugauuuugaucccagcucugccauccauucagagugugaccuugaacacaucacuucaauuacugugccugaguuuucuucuccagaaauuaggggugacuguucugacccugcaggggacuuaugauuagacaccauuuaugaaaacaccuggcauguggcaagaauguaacauuucuugaauuuaaauucaucuuuucugcuacaucuaaacuguacucggcaccugcuccaaucagcauucauuaucuagucaugucuggguuuaauaauucaguuccacucccuguaguuagugacaaccucuggucacugccgcccaaggagaagucagaccucucaccuaaaccacugccacggccuccuaaccaccuucccauccagccaucuggcccagccuuacagaauuaaucacuacucugcucaaaaccuucaacagcccuccacugagagagcacaaaauuagccauggcauucgcacguccccucuucucccacucccaucaaccuguugagcauaguucucugcaugcucugagacccaacuccaggccaugugcccugcacuuucucaucuccacgccucugcagacaccaccagccucucaccuugauccuuuccugcuaugcccugacaaaauuagucccauucuauucugcacuccaaaguaauuuucuuuguaagugucgcugcauuuuucauaucuuacuuuggcuaaguaccaucuuugaggcaucauucauccagucgguaugucuaucuccugugccaggcacuaugcuaggcugugcaaacagcccuaacagaggguuccuaccuucaagccgcucagcaccuagccgguacagacuguaaacaaggacagguaagaacuguaauaacggucuguaacguucucgggaaaaccaggagcugucuagcuuacaugaaaacaaguuucuggaaacccugcgucaaacagggccuuucugguuucaguaaggagaagggggagcgcgcaugugacaucuggggcucaggguuagcuggcauccccaccaacggacagagguccacaggucuguaaagucaagucccucuccucgccgcccucaccuggcccucgcccaggcuccuggcagcgggccccggcucucggucaccagcgucaccucccauuuaccaaauccgcagcggcgcccagcgggcggacagccgucucugcugacccagagcgcccacccacgcccucggcuuuccccgccccgcagccccgcggccccgcggccuggccguuuucagcucgagcgcgagcccaaacagcgcuccgugucgcggggcggcccgaggccggccagaggcgcuuccccggccccgcggcccccgcccagcccggccccgcgacuucccgccccaggcugcggcuggcuguugcuccuggcccccacgcggcgcucaccuccgggcuggggggcgccccccgcgcgcuaggcagcggcgggccccgagacggcuccgcggcccccugcgccugggccccggcggccugaagguccaugcccugcggcccgcggcuggucgcccuggacgccgugggccacgugacg

SEQ ID NO: 15541 - RNA, 1288 nt, Homo sapiens
caccaauuuacaaacagcaggaaauagaaacuuaagagaaauacacacuucugagaaacugaaacgacaggggaaaggaggucucacugagcaccgucccagcauccggacaccacagcggcccuucgcuccacgcagaaaaccacacuucucaaaccuucacucaacacuuccuuccccaaagccagaagaugcacaaggaggaacaugagguggcugugcuggggccaccccccagcaccauccuuccaagguccaccgugaucaacauccacagcgagaccuccgugcccgaccaugucgucuggucccuguucaacacccucuucuugaacuggugcugucugggcuucauagcauucgccuacuccgugaaggugcguauggcccuggcggaaauccagggggugccggugagccuggggcuccaccugcccacaugcugccugggguggggacuugugugucccugugacugugaguuugugugcaccucugccccgugugugcucacgucaguagcuuugucugugugaucuguguguguguguggcuuuggggaaucugcccagugcaggucuaggaggaggcuccaggaggcuggcuggcuggcucagagucugucccuggcuauccauuagcccagagcaauucucccuauagcccaguaagaaauuacacccucaccuuccagacuggcacccaggcucucccagaaagugagaagggaacucacaggugacuucaccccaugguggggagaacagccugugcuggggccaaggcagaaggaggaugagccccgaggcuccuggagagucugagcccgggugaggaaggggaggagguggucccugaucucagggcggggaggagacggagccauagcacgcggcucucagcugggggauccugguccccucaccaucuccucucccccagucuagggacaggaagaugguuggcgacgugaccggggcccaggccuaugccuccaccgccaagugccugaacaucugggcccugauucugggcauccucaugaccauuggauucauccuguuacugguauucggcucugugacagucuaccauauuauguuacagauaauacaggaaaaacgggguuacuaguagccgcccauagccugcaaccuuugcacuccacugugcaaugcuggcccugcacgcuggggcuguugccccugcccccuugguccugccccuagauacagcaguuuauacccacacaccugucuacagugucauucaauaaagugcacgugcu

SEQ ID NO: 15542 - RNA, 1288 nt, Homo sapiens
agcacgugcacuuuauugaaugacacuguagacagguguguggguauaaacugcuguaucuaggggcaggaccaagggggcaggggcaacagccccagcgugcagggccagcauugcacaguggagugcaaagguugcaggcuaugggcggcuacuaguaaccccguuuuuccuguauuaucuguaacauaauaugguagacugucacagagccgaauaccaguaacaggaugaauccaauggucaugaggaugcccagaaucagggcccagauguucaggcacuuggcgguggaggcauaggccugggccccggucacgucgccaaccaucuuccugucccuagacugggggagaggagauggugaggggaccaggaucccccagcugagagccgcgugcuauggcuccgucuccuccccgcccugagaucagggaccaccuccuccccuuccucacccgggcucagacucuccaggagccucggggcucauccuccuucugccuuggccccagcacaggcuguucuccccaccauggggugaagucaccugugaguucccuucucacuuucugggagagccugggugccagucuggaaggugaggguguaauuucuuacugggcuauagggagaauugcucugggcuaauggauagccagggacagacucugagccagccagccagccuccuggagccuccuccuagaccugcacugggcagauuccccaaagccacacacacacacagaucacacagacaaagcuacugacgugagcacacacggggcagaggugcacacaaacucacagucacagggacacacaaguccccaccccaggcagcaugugggcagguggagccccaggcucaccggcacccccuggauuuccgccagggccauacgcaccuucacggaguaggcgaaugcuaugaagcccagacagcaccaguucaagaagaggguguugaacagggaccagacgacauggucgggcacggaggucucgcuguggauguugaucacgguggaccuuggaaggauggugcugggggguggccccagcacagccaccucauguuccuccuugugcaucuucuggcuuuggggaaggaaguguugagugaagguuugagaagugugguuuucugcguggagcgaagggccgcugugguguccggaugcugggacggugcucagugagaccuccuuuccccugucguuucaguuucucagaaguguguauuucucuuaaguuucuauuuccugcuguuuguaaauuggug

SEQ ID NO: 15543 - RNA, 12898 nt, Homo sapiens
ccaucagaauuuaucuuuacauaugauaugaaguaucuuugaaauaagcucuuuuuucuuuauaaauuuaaagugcuaccuucauuagagaaugacccagagacauucaaaauuauuagagcuuugacuuucuaauugaacuaagcagaaaaaaaagcaaaggccuccaaaugaaauuauuuggucuaccuuucaucacaaucagaauugaauuaguuauucaaguauuucaaauguuaauauauaagcaaguccaguaucucaaucacuaauacauaagcuaauuuagaaaugcaguaaauuggauucaguaggacuuggaauuugcauuucaauuaguugauaauaauucuaaguggugcucugcacgugggcagggucugacccacagacggggccaucagcccugggaaucugaccuucccgaucggggacacaaggccgagggucuguacaccagggcaugagacaggugggacaggauuucugcuuguuuuuauuuuuauuuuugagagcaaaaggccuucuauuaucuugcacuauguuagagaacauagcaggguauaagugaaaacgcuuauauauauaauuaggaugugcauauuaagugauuaacgagaagacugauuuuuucucaguuuuacagcaggaagauaagaugguuuuuaacagaauaauucuggcauuguuccaagagguggaacauuuugaagcagaauuccugcagucuuugcaggagugcucugcucugugguuuagaaggagggcugauaacagccaauuaaagacccaaccuucuuccagucccguaccaggcagucaaaaaagaacugcugacacguuccaucucacgggacggcacagucaacgcaggugcccagagccucccaaggacuuggugugcccgauaacuuccgggguaagaaccugaacccauaccuaucacauuaaaauuaaauacaauuagcaagucgaucuucccauaacauuugcauucuuaacuauuguucaggugaagagaaguuguucauguacaccaagaggagaauaaaagccucauggagacaagcaaacauucauuaucauuuuuaucauuugaaucacuuggaaacguaaaagauuuugucagucagcuccugcugggaagcucuuuugugcaaaaaagagaaaaacacucagugcacuguauccaauuacuuucaauucuguuuaaaauacaauuauagaaucaccaauuuuguuuaaagcagacuuuggguauaagauaaacuuaguauaagagugucuacguaauuuaccaacaaaacguuaucagauuacauuaaugcagauuuccacaccuugccucuggcagcuaugagcacucgcgcuggugccaguggcaccucggaggcaccgggcggggcucaggacuugcggggccaggggcagguugaggaggaaggucagugcugaccacgcugagugcugcccguuccccagcaugcugugugccccugugggaauccgagguugcugcuccuuccuggguccugcaggcuccucucacuccccuggccccgggcugcucuugacaccugucccugcugcagggacaccaggcugcagccuccagcagggaugccuuuccucuuccauuucucacaauaaaccucuuguuggauauccuguggcauuuacuugcuuuaaauuuuuuuuuuuuuuuuuuuuuuugagagagaguguaauucuguggcccaggcuggagggcaauggcacgaucuuggcucacugcaaccuccgccucccggguucaagugauucuccugccucagccucucgaguagcugggauuacaggcaugugccacuacaccagcuaauuuuugaauuuuuaguaaagaugggguuuugccauguuggccaggcuggucucgaacuccugaccucaguugaucugcccaccuuggccucccaaagugcugggauuacaggcaugagccaccgcgcccagccccuuaaaaaauuuuuaucguauauugacaaaguauguguauuuacgggguuaaaaaguguguugugauuuuaaguacaauguagaaaaaugaagugaauuaacacagcuaucagcugaaauauuucacauuuuuugugaugagaacauuagaaauucacucagugauacugaaaugugcaguacucauuuacuugcaguauucagugugcuacugaucuaaaaacaugaagaauauccuccugucucgguuacuguagccuguaguauaguuugaagucagguagugugaugccuccagcuuuguucuuuuggcuuaggauugucuuggcgaugugggcucuuuuuuguuuccauaagaacuuuaaaguaguuuuuuccaauucugugaagaaaggcauugguagcuugauggggauggcacugaaucuauaaauuaccuuguacugguaccaaaacagagauauagaccaauggaacagaacagagcccucagaaauaauaccacacaucuacaaccaucuuaucuuugacaaaccugacaaaaacaagaaauggagaaaggacucccuauuuaauaaauggugcugggaaaacuggcuagccauacguagcugaaacuggaucccuuccuuacaccuuauacuaaaauuaauucaagauggauuaaagacuuacauguuagaccuaaaaccauaaaaauccuagaagaaaaccuaggcauuaucauucaggacauacgcaugggcaaggacuucauguguagaacaccaaaagcaauggcaacaaaagcaaaaauugacaaaugggaucuaauuaaacuaaagagcuucugaacagcaaaagaaacuacuaucagagcgaacaggcaaccuacagaaugggagaaaauuuuugcaaucuacucaucugacaaagggcuaauauccagaaucuacaaagaacucaaauaaauuuacaagaaaaaaauaaacaaccccaucaacaagugggcgaaggacaugaacagacacuucucaaaagaagacauuuaugcagccaacagacacaugaaaaaaugcucaucaucacuggccaucagagaaaugcaaaucaaaaccacaaugagacaccaucgcacaccaguuagaauggcgaucauuaaaaagucaggaaacaacaggugcuggagaggauguggagaaauaggaacacuuuuacacuguuggugggacuguaaacuaguucaaccauuguggaagacaguguggcgauuccucaaggaucuagaacuagaaauaccauuugacccagccaucccauuacuggguauauaccggaaggacuauaaaucaugcugcuauaaaggcacaugcacauguauguuuauuacagcacuauucacaauagcaaagacuuggaaccaacccaaauguccaucaaugauagacuggauuaagaaaauguggcacauauacaccauggaaaacuacgcagccauaaaaaggacaaguucauguccuuuguagggacauggaugaagcuagaaaccaucauucugagcaaacuaucacaagaacaaaaaaccaaacaccacauguucucacucauaggugggaauugaacaaugagaagacuuggacacaggaaggggaacaucacacacuagggccuguuaugggguggggggaggggggagggaaagcauuaggagauauaucuaauguaaaugacgaguuaauggguacagcacaccaacauggcacauguauacauauguagcaaaccugcacauugugcacauguacccuagaacuuaaauaauaauaauaauaauaauaauaauaauaauaaagaauauccuccugucucacggagggugguucuuuugacccucaacucuccauuuuccgcacccccagcuucuguaaccuccauuccacugucugcaccugugaguuccauuguuuuagguccuguauuuagguggggauuugcgguguuuguuuuucuguauuuuggcuuauuucauguaaccuaaugcccucugcuuccauucacgucugccuucccacguuugccacagcacugcucacaaucgccaagucacagagucaaccucugucaucaaagggugaguggaugaaaaugcagcagauacgguguggaauacuagucacuccuaaagaggaagaaacucugucgucugugaugauuuuuuguauuguucauagucucuuguugugcguuauuaugaccuaacauugcguuucucccucgcuugccucucucugucccuguguagugagugugugcacacguguguguuuguggaagauacucagucacuagcaggaagcacaacaguggauuccaaauacaauucuuaggcgaagaaacaucuucaagacucauuagguauuuucucaaugcuugcaaaaucucaugagucacauauuuaugcagagugagaugccugucacacguauguucguggguuuccuuucuuguguccggaaugaucagguugaaccauauacaauuucugcuuuuaaauauuggcugauuauuggcaguuuaaugugggucaaccaacuuuaucaacucagcacaguaaaggugcuuagcucagccuaaguggaagcuuuuauuugcaguaacacaugauuugggucauaacaaaauggaaaugucaacuaacuguuuaauaaaugugcuugcucgaugguauugaggcucuggugggaagaccacacacaggacucaucaccgagggaggugacucaucaccgaggggagauucugcugccuccgggggcagggggcagcaugguuuagccgcguaaaacugagagaccuagaguugacuuccgguggugugacucgcugagacagggucuucaucucuaaggcuugggucaugguguuggcuucagcacaguuaccagagcggcgagggcugggauggcuguuguucuugguguauuacaaguccugcaauuauugccggugcugugccuaguucauugcucuccugucucacguuaccccccauacacuaaaaucuggugacgcagaaccuguuuccauuuucugauugcaccugagugauucaacagaguuggcauucaacaugaaauaguguuacuauaaaauauuauuucccucucccguaaauaugcugucuuugggaacuugguccugcucugugcagggcugaugcucuccuacccaccgcuuacccuaaugcucuaggguggaccccucaaugcaaaugugagucugcagggagacaagccuggagcucccagaauggguuaggaguccugucucacgcauuuagagagcaccucacuuuacacuuguaaguuaccuacgccacuuaugacuacucacugaagugcacugggucuguuagauucuaaggggucagcucacaccuucuguaaaggcccagauguaaguauucuagggucugccggcugucggggugccucacaccugcucagcccugccugaagcugggagguacccacagcaacaugaugaccagugagcgggccacauuccaauaaaacuuuauucacaaaaaaggcccuuggcaggcccuugcuugccagcaucuggacugaaagcuccauucucugguguuaguuuaccugcauuugggcaccagaacagcacgugauguuuccugcauacuucccgaauaaacgagcuguuauuauugaugacuaaauauaacuuaagcaagaauaugcuccccaagcugugaaacccacggauggcagucaggggucuaaaggacuuuucucucagacacucuucacccuuucugucuucucaaucccauuagaugcccccacaguucaccuucucuccucuccaucucaucagacgcccccacaguucaccccucucuccccuccaucucaucagacgcccccacaguucaccccucucuccccuccaucucaucagaugcccccacaguucacccucucuccucuccaucucaucagacacccccacaguccacccucucuccucuccaucccagaagacgccccuccaguucacccucucuccucuccaucucaucagaugccccugacacuucacccucucucaucuccaucucaucagauuaccccuccaguucaccaucucuccucuccaucucaucagaugcccccacaguucaccccucucuccucuccaucucaucagaugcccccacaguucacccucucuccucuccaucucaucagacacccccacaguccacccucucuccucuccaucccagaagacgccccuccaguucacccucucuccucuccaucucaucagaugcccccaauacuucacccucucucaucuccaucucaucagacaccccuccaguucaccaucucuccucuccaucucaucagaugcccccacaguucaacccucucuccucuccaucucaucagaugcccccacaguucaccccucucuccucuccaucucaucagaugcccccacaguucaccccucucuccucuccaucucaucagacgcccccacaguucacccucucuccucuccaucucaucagacacccccacaguccacccucucuccucuccaucccagaagaugccccuccaguucacccucucuccucuccaucccaucagucgcccccacaguucacccucuccucuccauaccagcagacgcccccacaguucacccucucuccucuccaucucaucagacgcccccacaguucacccucucuccucuccaucccagaagaugcccccacaguucacccuucucuccucuccaucucaucagacgccccacaguucaccucucucgucucuauuccagcagaugcccccacaguucaccccucucuccucuccaucucaucagacaacccacaguucacccucucuccucuccaucccagaagacgcccccacaguucacuccuuucuccucuccaucucaucagaugcccccacaguucaccucucuccucucuauuccagcagaugcccccauaguucacccccucuccucuccaucucaucagaugcccccacaguucacccucucuccucuccaucucaucagacacccccacaguucacccucucuccucuccaucccagaagaugccccuccaguucacccucucuccucuccaucucaucagacgcccccacaguucacccucucuccucuccaucucaucagacauccccacaguucacccucucuccucuccgucucaucagacgcccccacaguucacccucucuccucuccaucucaucagacgcccccacaguucacccucucuccucuccaucccagcagacgcccccacaguuuacccucucuccucuccaucucauuagacgcccccacaguucacccugucuccucuccaucccagcagacgcccccacaguuuacccucucuccucuccaucucaucagacgccccauaguucaccccgucuccucuccaucccagaagacgcccccacaguucacccucucuccucuccaucucaucagacgcccccacaguucacccucucuccucuccaucccagaagaugcccccacaguucacccuucucucucuccaucucaucagaugcccccauaguucacccccucucuccucuccgucccagaagaugccccuccaguucaccccucuccccucuccaucucaucagacaccccacaguucacuccucucuccucuccaucccagaagacaacccuccaguucaccccuuucuccucuccaucucaucagacaccccacaguucaccccucucuccucuccaucucaucagacaccccacaauucacccucucuccucuccaucucaucagaugcccccacaguucaccccucucuccucuccaucucaucagaugcccccacaguucacccucucuccuccccaucucaucagaugcccgcacaguucaccucucuccucuccaucccagaagacaccccuccaguucaccccucucucuucuccaucucaucagacacccccagaguucacccucuccccucuccaucucaucagaugcccccacaguucacccucucuccucuccaucccagaagaugcccccacaguucaccccuuucuccucuccaucucaucagauguccccacaguucacccucucuccuccccaucucaucagaugcccccacaguucaccucucuccucuccaucccagaagaugccccuccaguucaccgcucucucuucuccaucucaucagacgccccacaguucaccccucucuccucuccaucucaucagacacccccacaguucacccucucuccucuccaucccagaagacgccccuccaguucaccccucucucuucuccaucucaucagacauccccacaguucacccucucuccucuccaucucaucagacauccccacaguucacccucucuccucuccaucucaucagacacccccgcaguucaccccucuccucuccaucccagaagaugucccuccaguuuaccccucucuccucuccaucucaucagacacccccacaguucaccccucccuccaucccagcagauguguccucucuucauccuucucuccucuccaucccagcagacgccuccacagccagccucuugggcauuacagcgucugcaccuacacuguggugaacaugugaaauccaacugagccuucucaaagcuuaggugggaauggucaacucagaaaucaauuuuaaaacuaagacaaaugaggaauuggauuaggagaacauguuugggauaugaauauucaccugcuacacguuaaaaaugcugauauuuaaaugugccuagauugaaagagcccccaggagugaacauuaugaaagggcugugcguaauggaacaggaugcagagacgacaucauggugccagccacagucauagggggugcugggcguucacgugggugaaacccaagucguucccagcacaguuaacaugacccuggaggccagcagaaugaagacggcacauggauguguaugugccuccccggucuugucuuuccuguuuaaucugaggucccuaugaugugcuucugacaucuccacuguuaaaaucuuucaagagaauuuuguccacacucacuacagcucagcgugcccuuguuuccuggaaacacaggguuacagagugacaacuaugggaauucucccaguccuggccguuuucuuccuuucucuccucuccccacaguaucuacccuggccuccgccacugcccuccacagagcagugccauggggugaagaucuacccugcccuccacagagcagugccauggggugaagaucuaccugcccuccacagagcagugccauggggugaagaucuauccugcccuccgcagaacagugccacagggugaagaucuacccugcccuccacagagcagugccaugggcugaaggccacggggcuuggggcugagcuaccuucagcugagagccuugguggcuugugcagccuccagcaccucauuucccugagucauguuucuguccauaaaacaggcaucaugagagcuucccugaguuacaaagcugagcuucagcaaugucaucuaaaauggaaauaaaugaauuacguuggaauccauaaaacgugaaggaauauaagauaaacuaagaugcgaauaggcaacagcaaaaauguguugauaccuccugguaacauaauauuuuuuuuuugcagaaacuuucauuacauuaacccccaaagagugacucagaggaguuucgaggacuuucaaguuagcaggucccuggcaggcaggucgcuguccagacccaucacauggcugcuuucucugcuuuauuaucuacaacacggcgucagauuuagggaaaaagaaugauuggggcacguauaaaucgaguuuggcagaaugccugacauuuguuggacucaucaauggagugauaaauccuggauaaauggaagaauggacccaacuguugcaccaucucugcuaaguggacaauggcaugggggccauaggcagaguggauuugugucugcugagugggcaguggcaugggggccacgggcagaguggauuugugucuggugagugggcaguggcaugggggccacgggcagagacggauuugugucugcugagugggcaguggcaugggggcugcaggcagaguggauuugugucugcugaguggacaguggcaugggggccacaggcagagauggauuugugucugcugaguggacaguggcauggaggccacgggcagaguggauuugugucugcugagugggcaguggcaugggggccgcaggcagagauggauuugugucugcugaguggacaguggcaugggggccauaggcagagacggauuugugucugcugaguggacaguggcaugggggccacgggcagagacggauuugugucugcugaguggacaguggcaugggggccacgggcagagcggaauugugucugcugagugggcaguggcaugggggccacgggcagagacggauuugugucugcugaguggacaguggcaugggggccacgggcagagacggauuugugucugcugagugaacaguggcaugggggccacgggcagagacggauuugugucugcugaguagacaguggaaugggggccacgggcagaguggauuugugucugcugaguggacaguggcaugggggccacgggcagagacggauuugugucugcugaguggacaguggcacgggggccacgggcagaguggauuugugucugcugaguggacaauggcaucggggccacgggcagaguggauuugugugugcugaguggacaguggcaugggggccacgggcagaguggauuugugucugcugaguggacaguggcauggaggccacaggcaaagacggauuugugucugcugaguggacaguggcacgggggccaugggcagaguggauuugugucuacugaguggacaguggcaugggggccacaggcagagacagauuugugucugcugaguggacaguggcaugggggccacgggcagaguggauuugugucugcugaauggacaguggcaugggggccacaggcagagacggauuugugucugcugagugggcaguggcaugggggccaugggcagaguggauuuguguuugcugaguggacaguggcauggggguccacgggcagaguggauuuguguuuagaacaggaguaacguaggcagcacaucucacccauuuuccucacaucugaucagauuugaggccauggaaugcuuucuggucagguguuaagggcuguuggugagugaacucccagaggguuucccacuugggcagggaagggucuggccaguguuuaggugaugcugucagggggccucaggcucacauccuuccgcugguuuuuugaagaguuucaacuacauugggugauggugugaguuuugccaguguaaaguucugagaguguccuuugaacauuguuaguacuggagccucguacaggacucugggccagucccugaugugaagaaaggaaugagacacugucucugccacugaagaaugaggugauaaugauccugggggacccguggcagugauggugaaugaguggaagaaggaacccgucaacaggaaaacgccguucguaauucuuaaaacacuuagucccugcccauggucuaaaaaaggcuuugguuuuuucauguuuugcuuucaaacauauagaauuaugcaaugaaucacaaacauuuaaagugggaaguuaaccaauggcuguuuaccuggggguccaaaaccccaggacugaggcuggccuuggagcccuggacccacgaagcauagcuucugcaugugugugcuuuuccccagaagacguuucagauaauucauaauucuccuaaugucuuuaagugugccaaauaaaaggugggugagagcugacauccaguccaauccuucacuuuccugcuggagcagaugggucagacaacuuggcucugcucccagcucuguccagcuccccaaccccuuccugguaaucaucuuuccugguuauuuccuggcuuacaaacaccugcuccccauuuccuuccaacaagucuaagagcuuccccagggcaacauuuuggcuuuguucucagccacucgucccacaagcuggcacugaccacccucuguggagggagaggagauggaugggccugggcugggcagacaugcggcccggucucagggcaugacuugucuggcauuccuacaccauagcucuugaauuuagcugaacuaggcaacaaugauagaguucggauuugugaaguucuaauuuguaagauuugguuucaauuuaaaauuucacuuuuucaucuuguaagccaacagcgaugaauaacuagauguauuggaagagguuauauggucacuggcucaucacugggugcacucggcguggauagagacaauacagggagggcccuguggcccagggcucccugucugaugugugggucauaauuaauaacucuuauguggcacuggccaaggcugagaagcaguuccgcccugccuauccacuugcccaggaccucacagccggccgcagaaggcagggguagcuuccaggcaguucuuggcauuaccacccaaacuaacuugugggacucaagauacacagcagcguggcuguugacaguaacagucauauuuucaugguucauaggaauugcugauuucccaaagaguuuuaucugucuauauuuucaaaauuaaauuuauuaauaauaaauuuugggca

SEQ ID NO: 15544 - RNA, 728 nt, Homo sapiens
uccuuuaguuauuuugguuaaaaaugucuuuguuucucguuuuuuuuuuucuuuaauaguaauuauaacgauaaucuguuuccuuuuuaaaaguauaagacaaauaaaugcucaaaguaaacaauuccaauaacucagaaggggccauucccuggaaaggucccgggaaaaacgagcgcuuccuggcaagaagcaagcuucaaaaacugccucggaaacguggcugaagucaucgcauuuccaaacgcccaagccuuggcugguccagggcagcuggcgcggaagacccggaacgcccugugggcagggccagcugcggacggagggacgggggcucaagggcgggucggguggggucccgacgcccccuccucggcugggcgcaccccggguguccgcagggaggggcgauguucugggggggggagcgucugcccgacgcccccucccucaggugagcucagcccguggggguccgcagaaagggcggugcucugggagaggguuagggucugcccggcgcacccuccccaaggggcgcagcucugagccgggagcaggcucugcggggaggauccagauguugggggcggggagggcacucggucugcccagcgaccccucccgaagugagcgcggcccgggguccgcggggcaggagaugauccgggggcgggagccucugccgcgcgcccccucccacgcgugcgcagccugggccgggcguu

SEQ ID NO: 15545 - RNA, 24766 nt, Homo sapiens
cgugcaggggaaggggcgggcgcaggcugcggggucggcacggaagaugcacgcgaggcuccuggggcucucggcccugcugcaggcggccgagcagagcgcgcgugagugcggcagcccgaggcugugcucaccccugcagccccuaaccccaccccggcgccgggagccgcacaggcugccuaugcccgggcgggcacugccccagccugcgcccagcacugcgcgccggugacgcacggugguggccaucccaccugcagagcacguccucccguccuuaguagaugcccacgcaugcaccauccccccaaggaugcaugauuuuccuccacccaugcucgguuccccccccucccgacuggugcuugacuuccucccgcccaugcacgauccccccgccccacgcaugcaagauccccucgcagaagcaggggagauguauccgcccuuccuuccaucacaagcuuugcaaagugcugcgaugccaagaugugcugagcgcaagucugggggcgcccgggcucucccccgacccccggccguccagggggacccugcgacuuggaggccgcucgcagaagggguggcggggggagggggacagggcuccgcauccacgcggcccuguaggacggcgacuccgcuucgggguuuaggacggggcgggacgcggcccuucgaggccaccuccgucgcagggggaacccagagcccgccagccgcggcggagcaagauggccccauuuuucgcgcccuucugguuugaacgcguaacuccuucagugccgggaggagcgucuccgcccacuuccgccgggcucccugcggaagcuuuuucccgggcagagucccugggguggaagaggggguacccugggaacgccgccuugggacuuuucccugaguucgcgggcguccccgcaggucccgcugcuuccgaggcgcgccgagcaggacgcacacggaggacgcgcaagcgcccuggcuccgcgccccggacuggaagggcugagacaggaccugcgggggucggcacccaccccagguguccucccuugcccuccagcugggcacggacugggugucagcauuccccagcccugcagcaccgaaggcuuuucgugcaagggaggcugccgcaggacgcucgggguggugacagccggacccagccugggcgcuaagggcugccugagcccggaccccgcggucuagagcugcagcgucugcagcuguaccucagggcaguuuucccaguuucccuaaaauccgcggcuuguguucauucauccacuuagaacuuuacuauuggaaaaccuaaguaacaguugugugaaacgaugccugugugcggugccucuaccagcgcaccgccuccaagaucagccucagacaacccugaggaggccgugcuaggaguauuggggaggcccagaguuccaggccagggaguuccccaugugaaaguaggagaaaagggaccccacagagagagcugugaccccacagggacuaacgguuucguagugcggaguuacugacugcggagugcacauucucucuccacugcguaaccaccaucaaaaacaaacaagcaaacaaaccagagaggagguuucaucguucucgaggaugcacaagaugcuaggcgcuucacacaugucguauauugcccaacagcucuggaaagcccugacaaugucauuuagugaaugccugucccuguugccagaggcucugcuggcucccagccugcuccuaggagacucuugcuggugauggggacacuguguugguugguuacuguuuuguuuuguuuugagacaagagucuugcucuguggcccaggcuggaaugcaguggcccaaucucgacucacugcaaacuccgccuccugaguugaagccauucuggugccucauccaucccgaguagcugguauuacaggcacgcagccagcaaacuugcucauuuuuguauuuuuaguagagaggcccagacuggucuugaacuccugacgucgagcaaucugcccaccucggccucccaaagugcuuugguuuuguuuuuaaugagauaauuagguguggccacaagaugagacacaggagagacucuggaaagcaaaguuugcuguacucacagguccuaggacaggagacauggcacaccaugccgggccacaggggaaugucaccaggguggucaggaggcaggagacaggaaccaggggaaguugaggccagacgcuuugcuagggcagagcaccagcuucagauuagcccuuugaauaauuucuguggcuuugggguauaaggguggucccuaguuuccuggcacugggcccugggaugauuaaggcaaaagaagauugccuucugcggggguaugggccagguaggggaggucuggcucuggcuagauuuaguucgcaugucaaaggcaagcuccuggcugggcccuuugcuagcugaaauaauugcuagccuugggagggacagucacuccccagccagaaagauuuuaagaggucagaacaucauaacauccagaaaauguucaguuguuuaaaaugcagguacccagucucacuccagccuuccaacaaccugcuugccuuuccccuucucacccaggccuuuacaccguggcuuacuacuucaccacaggacggcuucuguggggguggcuggcccuugcuguccuccugcccggguucuugguccaggcccugagcuaccugugguuccgagcagacgggcauccagggcauugcuccuugaugaugcugcaccuccuacagcuugguguuuggaagcgguaagaacagcugccucuuucaccucuggagcacaauugcacaagugcagugagaggaaucuucucuccauguggauucuguccucaagcucauaaaaguucagcauugggaagagguucaaagcggccacagcaaaccccugcucugauauuggcaugcccggguccagccugcacuuuuuugagcaucuccaaccucaggggcucuuucucugugaagcugugaccuuacgaaaggcuuuuucuugucuucagaugaagcccugucuugcuguuuugauuuguugguugagccguuaguuccauauaaagcaacuuacuuaaggcaguuccaucugcacaccugucaccuuagaacaggaagguggcauaguuuagugaaccacagacuagacaaugaagccagccuguugacauuugcuucaagacuucgucucaggaaaaagucauuuggaugccagggcuaguuuuuucucuaaagaaguagccagggauaguucuggggccuggugggcuuauccgugauccauagaccaucacgacaggugagggcugauuuuuuucuacuuugagaaccuggauucaaggagcuaugagaagagaugugucagugaguuuauaucaagggcacauuucagcuggcagcugcugccucauaauuccauuggguuguuagguuuguuuuuuuuuuuuuuuuuuuuugagauggagucucacucugucacccaggcuggagugcaguggugugaucuuggcucacugcaaccuccgccuccuggguucaagcgauucuccugcuucagccuguugaguaggcgggacuacaggcacgugccaccaugcccggcuaauuuuuuguauuuuuagucgaaacaggguuucacuggguuagccagcaucgucucggucuccugaccucgugauccgcccaccuuggccucccaaagugcugggauuacaggcgugagccacugcaccuggccacaggauuuuuuuuaagggagaaaaauucagggaucagagcggugaagcccugcagcucaaguguucauuaaaucauaggcacugaggguuggaaagguguucaaggggucguggccaaugcugcuguguguccuagggguuuaugccugcaagcuauucccaagacuuucuccggaggcacugaaaugagugaugagccccacauagagcaucacugugagcagggaauggugccgucccgcccagaguagaaucucagcuaggagguagagggugcuucugagaaagacuucaagcacccacucucaguuucacuggacccucagaguuggacccuaaaccucuaacagcaccgaaagcauauuugcagccacaggcauuuugccaaaagcucggccuugguguucaagcagugccguuccccugaaaagacagggcccuuccuuccauggcggagaaggcagagaaggaucuuucggagggccucauagggucagagccucuccugugcccuagcugccauugucgucuccuucccugaucggcccagcccaguaaucaauccuuaagggcucugggucuuacuuggcuuugaccaucacagucguaaggcaugagcccucgaggacagaggccuguugagugagucagcuaccaugagcccauguuuggcagcccaaagagagagguaagcccagguggucacuuagagaagcuuccuggguaaugaacgguuagacaaaucugccuucugaggcuguguggacccucaggccucauggaauccacugccuuccucagagaugagggcugccaggggaccacgguguguccaaauucaugcugcugguauuucacaguggaccccacacugucuuucccaugcacucuuaauuuucuuaagugaugccaugauuuucugguguauauaaaaaaacgaacuugaauaaucugguauauacuagugaaaucauauagauaagugaagagauacaugaaaauuauaaauuaggaaaaaccauuagucauauauauuuauucuuguuuugaaaaagaaguuaagaugacuuuaaaaauacacauccuuaaaagaacaaaaaagaaaagaaaagaaaugagaaaggccagguaucgagaugaaauguuagaaaacaagauagagccagaaugcacagcuaucggaagcgggucacaauuuggcccuaagguuuauaacagccagugcaagcauaaaggccgcaagauuugcaguguuucucagguuaaacaugaaccaaaaaacagaaauuuacuuccauagaggaaagcuuugaaaguuaaaauagacagcaguggauccauuccucauccugaaacuagcacauaggguucaaagacaacacugagugaagcaguauuuuuagugaggcaauccagcuuuccaaauugcaauucuagaaaaggaccuguagggggagccaaaacaauugcguuuggcacaauuuugaauugccuaagaauaggucacuuugaguguccucaucacaaaauacaaaagaaucugcuaacugagaauccaguaaaacacaaaguugcuuauaaaaaugcaaggauugaggccuggcgcgguggcucacgccuguaaucccagcacuuugagaggccgaggcaggcggaucacgaggucaggagauccagaccauccuggcuaacacggugaaaccccgucucuacuaaaaauacaaaaaauuagccgggcgugguggcgggcgccuguagucccagcuacuugggaggcugaggcaggagaauggcaugaacccguuaggcggaacuugcagugagccgagauugcaucacuggacuccagcuugggugacagagcgagacuccgucucaaaaaaaaaaaaaaaaaaaaaaaaaaaaagcaagaauuuggccuggcgugacggcucacaccuguaaucucagugcuuuaggagguggaggcaggcugaucucuugaggccaggaguucuaaaccagccuggccaacacugucgaaaccccaucuccacuaaaaauagacaaauuagccaggcguggucacgcacaccuguaaugccaccuacucaggagacugaagcaugagaaucgcuugaaccugggaaguagagguuacagugagcugagaucacgccacugcacuccaaccuaggcaacagaaugagacucaaucucaaauaaauaaauaaauauaaaaaggcaaggauuuaagccauaaguguauucuuuuuaacguucccaauaauacauacuauguucauuuuaagucugacucuguucaagagaaccugacauuggugaccacuuauuuaaacaaagaccauuacuuucuucuacuuagguuuuuuacuuacacuuuaauacuguauguuaccaacaucuuuuucaucuuucuuuuuaagcccacaaauccacuuguaaaugcagcaugagaugacagaagaaggccuaucucauccuuagcaugcaccuugguuuagcaauuuuucuuuagugaaaguucaagguugucaaaaggaaaguuaagguaaacucuaaagguauguaagacagguucagcauaaauggguggagauuuaauauuuaaaaguauauaaaauauagcccuagcccuggagggcccaguccugccucaggaucccucgagugaggcuugaaggcuguugcgauuuccaucaauguagggagggaacaggcguuuccgacacagcaagcugcagccgcuggugcaaagacauagaugcgugccagaagugguguauaugggaaauuaggaugagguucuugagacuaaaggguaagaauuuccuagauggcaggaauguggcaggagauaaaugggcuggaccaugaagaaacuuuucuacuggauuaaggaguuuggauuuuauccucaggcauuggagaccuguuggaaggguuugagcaaaggaauaauaugggcaaaugagccuguagacagauggcaccagggacaauaaaaugcaacagaguugggagggacgggguccaugcaggcagccagaaauccaggcaagugcugauaaggaccuggaaugaugcagcgacugugaggacagaugucggacaccaucucauaggaccuagugaccaaauccccacgcucuccaucccgccucagcuuccuccccggcuucccuaguggcuguccaggggucucagccugaauuucucccucugcaauggguucgagacagcucguuucagaaaaccgggcuagucaccuucccacugguccucuguuucuuacaagaguagccccacaacucagccucuccuggcccccgccuuaccaagcaccagauauucgcuauucccagacauggaccuucauuucagugccuuguacccugugccacugaccccagacacuccuuuaggcucuuccuaccaucuaccuguccagaguuugccuguccuccucuuccaggaagcauucccugaccaccuuauucucucugccugugacucugauuccaccacuacccaagccacucauguugauacuuauauuucuuccucuugaagcuuuucgcauuuguauguuuucuuuccacacugaaucuuagguuucuaaaagacaucuuucauuucacuuccccccuuuucuuuuuuuucacgagagucuucugccucugucacccaggcuggagugcaguggcauaauuauggcucacuugcagccuugaacuucugggcucaagugauccucccaucucagccuccugaguagcugggacuacaggcacccaccacuaucccagcucuuuguuuuguuuuguuuuguagacauggagucucauuauguugccagggcuggucucaaacucccaagcucaagcaauccuccugccuuggccucccaaaaagcugggauucauuucucuuacuucgccuguggucuguagcaggugggccucucaaagcccaagaaaaaugcauguugaacaaacaaagcuuucuggaagagcaagaagaggaaacuaccccaugucaggaacaaaugauuugagagugaaaagaaaacuacugccugcccucaugguuacauuuuuuagugucauauguuuuucuuaacauuaaguuuaugucaggaaucaagacacaguaagaaauggguucacuccaggauuccaaaucaugaaaaaggaaaguuguuuuucuuagacaucuguccugggaucucagcaccaugaauaaagccauuucaaagaggaguccccgaaucuucugcucuggacauagaaauguuugccacccaucaggguccagcuugucaccugccagucagagccuuaggggucucuacagggaguuuugcaggugaccuucgagaugcauccagcuuggcuucaggaguugcuaaauugaagugaccucuaguucuuaaauugaacaagacagggaagcagaauccaguggguuugcugggcagcaggcucgugugcaggcggcuguggucaucuccuuauugcugcugcuagguagacccagagaggaauuggugggugguggcgaaaucugaccuccaggugagacucgaagccugagagcccgcuggugugguggggaguggcuucguggucauggguucuauguggaucuucagguuguaaggaagguggucugugccacuuucuacuuaugagaugaaguuuccaguaaaggugccuggcauaggcucaugggaaacagacugaagcaaggacauguucugacuucuuucuuguugcuugauuccuuuuccgagagccucggaggaccacccaggcugggugagcagauguguccccguggcccugggccaccccauccuguaauccacagugcagagaucagcagcucucuccgcugccugguucucggcuuccacccacccuugcuggugucccuuucguauccaggccccuuagugggaacaguccccagggugcuguccuuggucuaugcugucuucacacagucucuucuggccacuuccagucccucaaccacaacuggucauccagaucucuccuuaugggggcuccacccauccucacauuccucacugcugaagaaauucauaucguggccaauccagcacuccucaccuggcuuauuuccgucgguagcaccaccauuuccaagucauuuaggccugaaaccucaaagccacugcaacuucccucaucuccccuguucagucaucaaauccugaucuccaacuccacuauuuccugcaccugcucccuacuuuccauuccuaggacucccuucaccaauuacugcuggaaguauucuauuagcucuguuuccuccugauguuccuauccccuguucauacacccacacuacaugcgugcacacacacacacucacacugcacacacuacagauacacacugcacacauacaugaauauacacacauauaccuucaugcacacacauauauaaacauacacacuauauauaugcaagcacauaaugccuauauacauaugcauauguuuugcacacuugcacacacacaugcauacaugcacaugcagauacauacacacacacacaagcacauguacaccacauguguguucacccauauacacgcacaugcacauacacauacauagacacacaaauccauacacauucaucucauaccccagacaguacauauuaccucugccaaauucauuuuuccagagcaaaauccaaaccccauagccugaaguucagggcccugaucuacuucaccgggaccacaucagccuccaagcuccgcauggugcuccagccaccuggaccucuggccacuccccagcaaagccuccagauccuucuucccugucugcucuucaugugccccaguuuucgcagcacagaguucuacauucugugaggaugaagacaaggguuuuuucuacuuuuuguccuucaaagagaugauaacacacaguaccuugcaacagacaucugucgauaaaugaauucccaucccaagaggauccggggugggacucaggucggggugauugccgagcuucacagagcuggcagucuggguucccuugccaugcagccgcuccagcucaaagagcccccaggucagguacugggguaccagacguggggagaguguggccuggcugagcaccacaggacucggggaacuuacauagaagugacgucuucugcuugcagucagaggcuggcaacagccuaacuaguaacucuaggugacuaguaagggcauaggauauugcuuagcauguaguaugucucuaaaugaaagcucguccuauugaaucucgccacagccuggcuccgugucacgugcccucugcuguucccuaggcacugggacgcugcacugaccagucugcagaaggaacuggaggcuccccaccgaggcuggcugcagcugcaggaggccgaccugucggcccuucgacucuuggaggcccugcugcagacugggccccaccugcugcuucagacauauguuuuucuagccucagacuucacagauauugugccaggugaguaacugucaccacagagcacagacugucugacugccgaagggggacaggaaugugagccuguuuagcaaaacccucccuucgagauuuccucugcuuaggagcauuagggcaccuugagcucacuggcacagaugaugcuuaaaacuggcuuuugcuggugcauugaguuuacagagaguuggcucccuucuuucuuaagggucauguucuaaagucagcccauaagauagaaauugcccauaaucaaaauuauccucaaaaugccuuggaaagacugccucuccauaaacucacugcacauguuuuucuugugucuuuaaucauuagaauaauucuuggccgggcacaagucucacaccuguagucccagcacuuugggaagcugagguggguggauugcuugagcccaggagcucaagaccagccaggcaaaaacccaucucuaccaaaaaauacaaaaauuagccaggcaugguggcaugcaguugcagugccagcuauucaagaggcugaggugguagcaucacuugaggccaggaguuugaggcugcagugagucaugauugcaucacugcauuccaguccaggugacagagugagacccugucucaaaauaauaauaauaauaauaauucuuaacaaagccagaggcuuauaccuucaaagccauguggaaacugagaacaacucaggccccagcaacauuugucuccagcucccacucauuucaggccauucacauucucauuaugucucucccuguuucucucaguugcuucuuguuucccucucccucucccuccugcuauccccuuuucuccccuccccuucacccccuucucucccuccccaccucuccccuuccaucuucaucucucccuuccucuuugcugaguguccacaauugcauaugcacaaauuaaaugcuucacauauaugccugcacuguccuuccauccaucuuuaucaaagagccugacaccauuugauguuuucguucuuuuauuaaaccuccuucauauggauaaaacagcaaaguacauuugggguggaaccauguucagagccuuguagaaucagcuuuguuauauacagaggacuuagaggaucaggagcugggacguuuuucuuaaagggcguagaaaggaagaguccagcccauuugcugggaagagcauuuaguacauugagcaguggaaauauuuccugcauauccccauuucuuccugaauauagacagguguauuuggacauagaguuguuauguuaccuacuggucaaagugguggguuaguaauacucucugugcagccaggcuuuaacaagagguuacacaucccauuaaagaaaugccaugagugaaucuucacaagguacuguuacuucggaaucuucagagcauaccacaucuuucugcuucccuuucaggggugagcacccuguuuuccugguccucacucuccugggcacugguguccuacacucgcuucaugggcuucaugaagccaggccaccuggccaugccaugggccgcccucuucugccagcagcucuggaggaugggcauguugggaacccgcgugcugagucugguucuguucuacaaagccuaccacuuuuggguuuuugugguugcaggugagcugagcuaaugaucuggucaucuguugcugcauaaccaaucaacccagaaaugaaggucucaagaauaaccacauaugauccucaaucccaggccugaaggcugacugggcucucugcugaauggaucuugcuuggguggccucagagauggcaaugggguagcagauguucagauucauaaagagccuugacaggaauuagcagcugagaauugcaauggcaaggaacuggaaacugcuagucuucuauaaaaacaggcucagaacuggcucagcauugcuucugcuguauucugccagucaaagcaagcacaaccagcccagauucaagagcauggaggacuagacugcagcucccgaugaguacacauccagggcaggaaggaacgcgugcuggcugucuugggagauacucugccauagcuuagacaucccagcccucaacacucccagcuaaaucuggagcagagaacuucucaggagacuguucuguguuacaggccaaaaucuuuuauguagaaaaacugucacugaaacaggagggagguacaaggucccacuugccucaccugauauaaaaauauacagucuauaugucauacugcacauagcuuccaaaagugcaccauuuccuuugaaugcugaaucuuggacaucuccucuguugcaaauaggacagcuccacuaaauccaagcccucccuccucccucagucuaggcacacgcaauaugaauggcaaugacagagagucuaucuggcucuggagauucccugaauagggccugugugucccugccgaggagagcugucaucucuggucaucagugaauauacucugcaagaaggaacaguuuacucuuguuuuaagagaauuggagacauuaagaaauauuugccccuugggccuagagcaaacauugaauacaguuauuggccaaaaagauaauuuuuuugaaaaaaagaacugugcuucuaaagagagauuagcuauuuuguuauucuuuuuuuaaaaaaaaucagcuugaaauccaaaaugauuuauucgucuuaaaauaugggcauaaaaauuaaagcugcaccacauagaguucuuuccuuugcauguggagguuuuuugcucuuguaacaauuuuaaaauaauuggcagucaguuuuauaacugccccuuuaaacacuuucuggaauaaaaaggucauagguauacaauauuuggcaaguguuauugaagcuacucuuucuugugucauauucaaauuaggucagauacccuuuauaaggauaaaaugggauaauacaugcaaagauaaacuguguugguuuucugucccccucaaaucucuucuggguuuugauaucucuucuuggaugcugagucaaauguggucggagagccuuccagccccuggucucuguguccuugccuguccccccaucuccuugcauggacccugacgucugcacccggcuucucugcaggugcccacuggcuggugaugacauucuggcuugucgcccagcagagugacaucaucgacagcaccugccacuggaggcuguucaaccugcucgugggggccguguacauccucugcuaccucagcuucugggacagcccuucuagaaauaggauggucacguucuacauggcaaguggcacuuuucuuuauccuaacuuuuacaguguauacagcaagugggguguguguggguguguguggggggugugugugugugugcaccaaugcacaccuaucuauugaaaaggaauagcuuaguuuaagaaaaauucuuaaagaaaugauagucuugaacagagaugacaggcuuugaaaauaguaacccaaccuccagcuguggcccugcauucaauguggcaacaacugaggcauauuuggugaugucuucucuacaucagcccaccugcugaauaucauuacaguucaacuguauaauaucauauacucaaugucucuguuaaucaacuccauuuuuauuagggguuuaugaauaagauccaggcauggcccuagagaguaucagaaacacaaaaguggccuaauacuucuucagauugcuuugagucccguagagauuucuucauauuugaagaacuuauaauauuugguaaguaaguagacacccaaauaaccaaaaucagacagaacguagcuagaugccaggagagaaaaaaaugucugggacucauaggaguagcugccagcaucaccucucgucaggaugaccacagacacuuuuggcaggacaguggagguugagcuggauuauaaugggcaaaggagagaaaauacaaucacauugguggggcauggguuuuagagucagaaaaaacuugcacuggagcccagcucugcugacugcuaccaccagcuggcuucagccaagaauuuaaacugucugaaccuacuuuuucaugcacacgcuaggaauaagucaccccccucucaguguuccugugaagauuaaauaagaucuacauacucuucaggguuccuguaaagaccaaauaaaauaauauacauaaguagcuggcacaaaauaacccauaaauuguggccauuauucauaugaaaaggagagacuucugugggaggagucaggcauuccaggguagagaccugggugaagguaaaggcaggaugcagcuccuguccaggaaagggaagcguccuagacaccugcugauuuuaggacccauauagcacagugaccccacaggcuauagagccaggcagagcucacaggacuugcaauguuggacacauuacugagccucaccaaccucagcguccacaucugaacaccgagcauaacagcgugcguguuguagauagguucacuuguggcagggcccaggucaugcaugagcagccucccaaccaacaugauccccaagugaacaaagaaguggaauauugauuuucucauccaauuugcugaaguggcuuauucauagguggacaccccgccugccaaugcccagauaagcaggagcucaauaaggaggaguuugacaccugccaccuuguuugcuugcauuugucacacucacaugucaguugccgugucaucucccaggaguuugagggcuguuagagaaggaaagaaagcaaauccuucauucuucccaaccaucucauacagucacuagaucacugagucaagagcgauuaaauaggaaaagcagaaaucagacaccauuacauuuggagugagaucuaccacaguggcacgaguguccuuaucucucucgcugugcacagacccauccaggccgggcaguccuagcccgggggcuuggaucccuacagcaugugauggggaacaugggcuuuaggccuugcugcccgaccagcuaaggcuugauaccaggauccuucgguucugaacuguaugagagucaccggggcucccccugcccccacacccaguuuuugcaucucugaaaugguuguugcuaggauugauaaggugauggauagaaagccaagagccuggugccuggcacagguagauagauguagaugcucugaaagauaaauaaauaauuuacaauaaaugaaacagacaucgggggcaagagagcagagaaagaaggaaaggaggaaggaaggaaggaaggagggagggaaggaaggaaggaaaggaagguagggaagaggaaggaagguagggaagaggaaggaaguggaggguaaagauagccaauaucaccauaaagaggugaaauaacacauaacuccgaggauaaccuauuaaacuccugacauuucaagagugccugccagucacauucugagguggggcugcaaccaugaaacugaagaaaaggcggagaugacagguggacaugcucaccucgcacuucaccaugcacacugcccagaccugagucugggccccucccugugccaggcagugcugggcagcccuggcuccguggcacgggccauucagagugugaggcagccucucccacuguuccucaacacccccagcuaaacuccauugauccaauguggcugaguggccagcaccugaaaccagugccucugggcagguuagaaaugcccagacugugaucuuggaagccugaggccacagugcaguggacagacuggggcgccacucccugagaugugcacccugcuggcacagacccgugcugccauccgaaagcauuaccuucugcggagggugccgggacccacgcagccccagcccucgagacagcagcucacacaggaaagaggcugccagaccccaggcccuggaugggccccagaagaagcugcaauuccugucuggaagccccagacuugggcagcguagcccagggccaacccaagcaucgcucagcuauguugagccuauuccugggccacuggagaguguaccacccccacaucccuucaagaaggaacauaagguguuuuguauuugcuuuuguuuuucugagacagagcuugcccuguugcccaggcuggaaugcagcagugugaucacagcucacugcagccucgacuuucuaggcucaagugauccucccaccucagccucccgagucacugggaucacgggugcauaccaccauaccugguuaauuuuuauacuuuuucguagggccuuuaaccaacaggccaccgccuggcagugguucagagguuucugcuggaacggucuggcaggggcugggggcugggggccuccagugcagcugggccucagcccugcugguugucaguggcacucaggggagcuuuuauaaaguggcgauucccaggcucccccucagagauucugucucaguaggugugacugcaaccugggaauccacgucuggagacagccacaggugacacuaugacuggccuagcucaggaucuacucaacuguccucaccuccugcucagaggcggaagccugccuguugaucacuucugaauguaauauaagaccccgucucacuucuuucacccguuauggguuuauucacaucagcacacauugagcuuccuccugugcugaaaauggaguuagacaccacagugugagagggucaugucucagugccacaaagacauaagcaaauccaugcagccacugugaucagagaagugacgcuaucaaaacccuacaggacacaagaggcagagcuugggaaagucagggaaggguuuacagaggggaccugcacgaugugcuauguggugagcaagguucaccugaagaaaagguguggacggcgcuagaacguuucaggcaaagcugcggaaguaauggaaagacccuggagugucuggaaauccacaggaaagugagugcgcacagcguccgagggaaaaaaagcccugcgcuaguuaaaagcaaugaaaacagauugcacugaguguaucgccauagggaagagcccugcaugaacugaacccaccuucaaguugugcagaggugacagggcuuaaaagggagaaaaagggaggaaggaggaggaacauccgggggcuuggccagagacagggaaguggaaauuuacaaaaagcaggaaagugggaucguaaaugugagugugccaucuguguuuguucauuggcgcuugucacuugcugggagcagaaacaaauuucucauuucuuuaugacaggaggcaggagucaguccuguuagggcaaugcacccaccaggcuuggaguuuguauuugaauagauggcucuuggguacuugaggagacaguucuggguaauagaggauguauaucucagagcgcagcgaaaugauuugcaacugcaagcuuucuaaaggaacugcucggaaaggaaguccaggguccuauccacccagcaccaaguuuuggcuggaacaaacaguaccuucuccuggcagcacugcgcuuucucaggcaggaacuuaaaggagacugaggucagcaucguaggggugaggccuugagcugcuggaaacucggucaguguuuguucaagucucucgguguggggagguaaggggaaucauaugugcugagucuggaguucucguuggccaggguugaagacucauggaaaagaaggcucagagaaggcugacuggaguuugguugaggaaagacuguuugucaguggaaugucguuugggaagagcaugcuggaagaugaccccagaaaggaaaacuugcgcuaaguggcaaacaggaccaucugcucuguugagaaguagggacuggauccugaaguuaagguggggcuguuucaaggugcaucggggaggaauggcaagaugcaaucucugggugaagugggucacccugacauugguguggaggagagauuucagagagagaaugaagauagggguugccuagacaggaggcauggggccagaaccacggaaauggcgggaaagacaggaggcaggugacggaguugggacaaacuuaagaaucugaaccaccagaaccacacagcugaggaguggggagagaaagaugccuucuguacuggcugcuggccaaggcauuuagggcagaaacccugcccauugcacacagagggacugggagaauggauguucauaggauuacgaagcagcuccucauaauuuuuuuuauuucucuccuuauuugaauuuuugagagugaaaaacgaagccaaugaauaaccuggcaaaucuuuugaagaguuuuagcaaaucaguauauaauuuaaguguuauuuuuaaauaaauaaaauacacaguauuuaauauaaauauauauuaaauauauuaaaauauauauuaauuauauuuuaauuaaauaaaauuaaauuauuuuuaauuaaauuaaauaauuauuuaauuaaauaaaaauaaauuaaaauauauauuaaauauaaaacacacaguauuuaaauauaucgucuuugaauuaugucauuuguuuacuuauuuuaaugaagacguaucuuuuuauauuuaaaaauuggaaagcaaaguuaauaagcugacccagaugggcguacaaagagccuucuggaccaucugccauuuugaccagcugcagccacggggccaggcuccuuugucagccugcgagcucccgucuccggcugccaccugguggccgcaaagcaauuauuuuaaggaaacaaaauccuaaaguuguuagaaaguuugugacccuagcucccuggaauucaguggcaucaugagcucugcagcuaucuuucauuuuaacacuaaugagugccugcaguuagugugaggauggagaaauaugcaaaguagaaaauaaaaguccccucucagcccauaaugacucucuaaaggcagccccacagccauuugagggaugcccuuacauuuccugggccuuuaugauucugcagacacuuuaaugagccacccugagaacaggguggcucucucuuugccagagaaggucucagugggacauagcccugcuccuggguacuccucagcagccuggagucuccagugggcacucaggauggaggggagggggagccgcugcagacucacgggacgggggucccuaggcagugugcaccugacgagguguggugccucuguccugggucccgcaggucaugcuguuggagaacaucauccuguugcuguuggccaccgacuuucuccagggggcaucuguggaccagccugcagaccauagcugggguccugucuggauuucugauugguaagucccaaugucaccuucuucucugcauccccuccccaacguauuuuuuuuuuuuacaaugggcucaaaggguaggaaacugaguucagaugugguuaacuggagaccaaggaaccaggcucacugcgauguggggggcagagccaugcccaucagagcaugagauacugagcucagccucaucugccuugcuugacugugcucggaaccucaagcaaagcuggggcuaucccucucuaccccaaagcccccguccuccccggagcuuccugcaggguugaggacgugacuucucucuccccucccaccuaggggagcuccucacaucuuccugacauggcacccccugcagcccauagacaagcaccccgggaagugggugcccuagcagaggaggagaggaaggugaggcacagaggagguugaguccccgaaagauccaaugguuuguaacagauagagcugagauucaagcccagcuccagugcaggccugagcacaggccuggcacugucaucagccguguuuuaugaaugcauggccccaaggucugugucacacccacggugaugaccucgcuucccagauuggcaugaguuccgcagggauuccgccccccacuugaaaggugcgaacaccagccuccucucccagcacagcaggcuuccaccacugucacucucaggccugcggugggaccgucaaagccagcaccugcaccucucacguggggccucgugcuucugcaacaugggccaggacagagauuccccaguccucugcaacaacuccugcccucccuccagagccugcucucugucacccacacccugaagaggugccuggaaguggccucggguucuuuucuugcucacagcagccggggguuggauguggccugugugaguggccuggaccugggaaaggaaugaccuggacacaaacacuuagugagaugcaggggcuguucacgggucagagaaaugucacacacuguggcuucguaacaagcauuugagagccacaggccacccuggguuucagcucuguucuucuucaugagacgucacggguccucacuucuuccagcuucagguagcugagacaaccccuucuuuuucaaaucaaacuuuuuagauaauuguaguuuuaagaaauaauacagagcuccccguacccauuaccagguuuucccccagugguaauaucucgcaaaacgguggcacaacaucacagccaggaucucaaaguaguacgucgaggugcagggagaacccuuccaucaccacgaggacccuucauguggcccccuuccucucgccccugccaccuccuucccuccuggcaaccauuauucuguucucuguuucuauuauucuaucacuuggagaaugcguugugaaaguaccacacagugugugcacccuggggaucggucuuguucacuuggcagagcucuccggagagccucccggguugcuccuugcuuuugauggcugagucgcaucccaugguuuggacggaccacagcuuguuucaucgucgacccauggacgggcaucugguucauccuuuuuaaaauaaucauuugaaucgcagagcauugauuucuaagcuguguguguggauaaauggccuaugggaaacugaggacaucgcgcugcccgggugagaagcaccacucucaccacauugcaucguggucuggguguuccuggcauauuucaagcaauccuuccuucagggaggggccaugugauacuuggaaugaaggggccuugccggccgggaggucuaacaacucaucuggauuuuccaguucacgggagguauagcugaguccugggggcaguguggugggagggaaaauguccccucaucuacuuucuggauuuuaacacugacucagaaaagauguccuacaccacuccgaaaaccugucacacuccugagaguggaugccugguuuccuuccaguuccacuccagugagaagacauuuucacagccaguaugcuggcccacggcacagcuggagggcagugaguagggaguccauagccacgggcagugaguagggagcccauagccacgggcagcacucagcacccagguggccaccggcucagagccuugucugccgcuccuccuccggccucugauggagcugccaaaccccugacucccagccgacccuugggaauccuaggcaggaagauugaacccaaauuguaguccaaggagcacaagcuugcauccaggcuccuccccuuuuccuuccauccugggaccaauauucacugaguaccaacugcgugccagccuggggaugccaccaagaacccucaaaccacauggccucuggaaagauuguguucacugaauaagugugcccaggacuucugugaucaggggccuuuguucaucuuuccuggccuuggguggcugcuuguaaaagaagggugacaauaugucccucaccaggcaauugugagaauucaaaacagugcagaaacuggcugagcaggaccuacugcagagguggcacugaacauggagaaaguccaccucccuuuccaagguuggagccuggccacuaaccagcugcuugaucugggucucccagucccccaagacacaagagaggauuuggggcuggggauguccuucaggcagucuuucuagcucugucaugcugcaaucuccuggccuucucaggcauuacuucagguuuugugcuguuuauaaugagcacccugaaaccaggcacuuuauccaguacaacaggaaacuggaaauaacgugggaggcuuacuggaaugcucuguuaaagaaauuauugcagcagucaacacuucugaucaaaauaaauuaaacugacaacaaugugauuaagauguuuaugcacaaaggaaguguuguuguuguucauggaaauuccuugauaugggguuuuugaugaaucugauuaaccucuguuuaggucuuacuuguuuuugagguuauuucuuaaugcccucccuucccccagcuuuguaacccaucaaccacuguauugacagucgaauuugcaguguaugguccaguuacuugaaaguagaaugcuuauuucugccaaacauuuuguaccuguguguacacacgcacacacacaugcaugaaugcacacucacacacacacacguagaugacugaacuggagcugcccucaagacaaaagcauagaaucaaucggauuuaagccuuguuauucauguuuaacuuuagaaacauuuacagcuuacagaagcuggaaccuacuuaaauucccccgaaauauccaguucugaggcuccaacaagaguccuauuuuggaucccaaauuaucuuccucuacacaaaagggccagaaccugaaacugcacaccagagggaggaugcagacuucaaagaacauaaccuuguggucuuuuuguucuuuuucaggcagugucucacugguaauuuauuacagccugcugcauccaaaauccacagacaucuggcagggcugccuaaggaaguccuguggcauugcaggaggugauaaaacagagagaagagauucuccccgggccacagaucuagcugggaagagaaccgagagcucaggcucaugccaaggggcaaguuaugaaccaaccauuuuagggaagcccccuaccccugagcagguccccccagaggcugggcuggggacccagguugcuguggaggacucuuuccucagucaucaccacuggcugugggugaaacuugcccuaaaaacaggaaaugugucuaagaucaaugccgccuuuggagauaacaguccugccuauuguccaccugcauggggguugagucaacaggacuaccugcagagaaaggccuugucugcccagcaagagcucccauccucaucccgugaccccucaaccuuagagaacagcucugcguuugaaggugucccuaaagcagaggccgacccauuggaaaccucaaguuacguaucuuuugccagcgaucagcaggaugaagcaccuacccagaacccagcagccacgcagggggagggcaccccaaaggaaggagcugacgcuguuucugggacacaggggaaggggacaggugggcagcagagaggaggggaaggacagcagaguuccacguuguacuucagcgccacugcagaaguggccacauccucacaacaagaaggcagcccagcuacucugcaaacggcccacucuggaaggaggcugggaaagagcagcccugcccagccugcaucgccccacccagugggcuuggcgcccuuccccgacaccauggccgacauuagccccauccuaggcacaggcccauguagaggcuucugccccagugcaggcuucccuggaagaacccucaguaucucagagcuagaggagccgcuggagcccaaaagggagcuaagucaccaugcagcuguuggugugugggugucauugccacagcugaggacugcccaugagcccugccucacguccaccccuaagucugagucuauccaaacggacugcagcugcagggaacagaugaagcaagagccgaguuuuuucaucugaccacagucauggugggauaagacaacaggcugacaaaccaagcuggccauuugguaccgugagaaaggaaaucccacuucugacaccuguguccuugggcacaucacugucaccucugaaucuccaucugcaucccugaaaaaugaagaaacagggcuggaugauuuugcagguccaaugcaaacaucacagaccccacccaugcauaggagagacucuaacauacuuuagaggaggagaaagagauuccagucaaaauugucugcuaccuuuuaugagcuguagguucccuuauuuuaucuuuuugcuguggcuucuaggaaacacaaagguaaaacccagauuccuauuuuauuugagguucuuguuacaauuagcuuugccucacauuuagcgguuaugaaucucauuuuaauauauucu

SEQ ID NO: 15546 - RNA, 711 nt, Homo sapiens
uuuuuuuuuuugcaagcagauaaaggcuuauuuuacuuuaauggcugaucuauguaaucacggaggccaguauguacacacaaaggggcagcuuuuauuucuuggucucuuccuccuuggacaaagucuugaugaucuccuccuucuuggccuggaggugcucuucauagcucuugugugcuuccuuggucuuagaucugcgggccucagccugaucagccaggagcuucuugcgggccuugucugccuucagcuuguggauguguuccaugagaaucugcuuguuuuuuaacacauuccucuucaccuucagguacaggcugugauacaugcggcgaucaaucuucuuagauucacgguaucuucugagcagccggugcagaauccucauucuccucauccacgugaccuucucuggcauucgggcauuggcuguacccuuccgcuuaccuaugcccauaugccugcccuuccggcaggccaagguguuuuuccggcaucaagcgggggaauggaccaucacaggcuugcggaugaucagcccaucuuugaucagcuuccggaucugcugacgggaguuggcauuggugauuucauuggucucauuggggucuaaccagauauucuucuugccacagcagaggacacuagaggcaagccucuucugaagccugagcauacucaaggcugcagccacagcagcgaaaggaa

SEQ ID NO: 15547 - RNA, 342 nt, Homo sapiens
caagguugagaauuacugucuuugaccacagcagggggcaaaaauccagcaaaauaaaccuacaaaacagauauaguuuuucuaauucuuuuguuugauucaacaagucagaugguaaauauuuacugagcaugcauugugugccaggaauuggggucagcacuggaggaagaaaaacgaagcagaccacagacaucaccauaguaaauugcggugugggggugggggcaguguguugugggggacauuguuaguugcaggagauacuuucagaauuaaaugucuaacauaccuguauauaucaucacauaauuugagcucauccauucuuaacgaaccccu

SEQ ID NO: 15548 - RNA, 17274 nt, Homo sapiens
guguuucauaguccguugugauuucaaacgauuccauaccaucuccaucaacaauauuguaugugacuaagccauuuucuccaaugucuggaucuuuagcuuucacucuuccuacuuccuccccagggacggcugcuucugacacagacaucugguauacgccuagaagaagaagacaucuauuuuuauuuucucuuuuauuuggcagcuguaagacuauagauuucauugaaucccaauaaauuucucaaaggauuugaaauugaacuuucuauugacugaaaacaugaaagaagugaguggauguggggaggaggaucccacauggccugcuugucaaaagaauguguucuacgaagggugauaaaacaauaucuggguccaggugaaaugcuggggucaccugccacauguaagggagaaaaacaaugcucuguuacauuucccaucagguaaugauggagaaccaugcaugucuucauuuagcaaaauagcugaagcuucuuuucaugucuucaggaugguccaugaguuaacuccaaggcucacuuaugguauugcgaagagcccagaaaaaaaaaauucucuguuuaaaagccuuccuucaacagcuccauaguuacuuuaaaaaugcaaacuuuaacaucccucccugucuaacucuauauucgacacuccccuuauuucaccuccuucgcaacuugccugcuucacaaguuggucaugcguuaccuucuccagaaggcuuuccugcagugugacccuccuauauauuuauuuaauguuuauugggagccuaauacuguacauggagguacuguccuagugccaggacacuguuuuguuugcuuguuuuguuuacuacuaaacaaaacagucaagauuccucucuuaaugaggccgacuaaagagaaaaaauaaaaacaaauguaaacacacucugaugucacugcaaugaaaaaggaaaauaaaguaggguaaaagggugaggguucugagagugggugugugguuguggguguguaagugcaugauugugugugagggugaggggguaaaugugugaguggccaugagugauugugugggcaugaaucuguuguguaagagugugaguguguguaugaaugugagcuauuugugagugaguuuguguauguguaugagugugauugaacacgcaugcuuguguuaauaaugugugggugauaagcagaaagagggagagauugguuuugcguagugugguaggagaagacauucuuuagaaaaaggaaucuaaaaugacugaggaagacaaugacgugcauaucugcaggauaaaaacuaccagccaggugauuagcaaauggcaaaaacccuaaggugagaagauccugaauacuugcagaggagcaagaggaggagagugacuacagccuucuggugagagagaagggcuguaaggaaguggaggccaaauugcguaaaauagaccauuguggggaauggaaaagacuucagguuuuguuuaaacuuggggaaaucacuggaagguuugcacuaaguagcuaagauucaacauuaucuuauuugcuuuucacauuuaauacucugugcaacacacaauauagggaagccaggguugaaaaucuuuccucuaucauuuccaagcaaaguggucuugggcaaguuacuucagcucauuauguuuuaauuuccccuuacagagauuucaucaguucuaauacuuugucuauauuuaucaauaguauuuugcuuugcaacuuucuuuuggauucauaaucuauuuaaucucaccaugcccucuauauuaaaggaugagugggaagugggagucccuuguagauaauuaccaauuaaugugaagguuuaaaaaaaaauguccuauguggauuuuguccaaaucucauucaaguucacggcagugaaaccaguaaaaccaguacaguagcaauguaacuuuacuauaugauugucuaugaccaagggcaguaaaggcugccugcuaauaauucugcuugaccuuucuuuuccagcucaccagacaaucguacaguguggauaauggagcaugcagcucuuugaauguuauaugagccucaggcuuauugaggaugcugaacuugugcccggccaggcaaaagagucuuguguagauucuugcuuuugaauuccuuugaguaaccacagugccuuccuggggccacauuuaguagccuuccuuguuaucucauuugcaaaauguuccauuucucugauaguaagcucacaggcucuaacugaaaaagacacuuucaugaugaacccccccaugcauuagcagcaccagcagcaccacagucauacuguccauucauacacaucuguacauacauagacagacuuguguucaaacucugacuuugccacauuucuagggcaacuuaugcacuuuuuacggaaaccaguuuuaucuguaaaauguaggcuccugcagagauuuacaauaguagugacuauucauuaaaugaugguaguugcuauaauuacaauuauuaauaauaaccuuucaaaaucauuguuuuucauuuaauucccucugcaauuuuauaaauuuuguagaacagccauaaucccccagauaacaauggcuagaauuuguugacgacuuauagacaguugucauuauaagauuuuacacuagcuccuuuaguucaaacaguaauccuauuaauuagguacuguggaagacuguauuuuccaaaacauggccaaaacaauaucucccaucccacaugcuuuuccuucaacaugacuuugacaggucuuccauugaaagguggggucuacaugaacuccccuuagauuugugagccuuaugacuccaguggaaacauuugguggcuuaugacuccaguuuccaguggaaacuucugaagcuaguuaacaaaaggcaagacaauuucugccuggugcccuuggggaucacacuuuccaaaaccagcccacgcagaaaggaagcagcaaucaacacaaacuugccagccaugcaaguaagcugguuuggaaguggauccuccaaccccaguggagcuauccccaguuguugcuauggagaacagaggcaugcugucuccuccaagccuugcccaaauuccagacacaugauaaaaacaaauuauuguuauuauuuuuauuguuuuaaaccacuaaguuuuccagcaauuuguuacacaguaauugauaacugauucagggacuguuauauccagguuagaaaugaggacacugaggcagaaaaggguuaauuaauuacuagauugcaucacuacuaccaagcaaaauacuuagcaaaaacgauauuuuguuuccaggguuguagaacuuuuuacaucuuuucauucuccuacuaccucuacuccccgacauuguuguuguuguuguugucuuguuuuuguguuuuguuuuuguaagaaugauaugaauugcccuuaguuuucuagauuuucuuuuugauaccucaguaaagcaggaauagguuagaggagggagagagcuggcugugucaccauggaaaagugaaagccaaguccaccuacuuacucugcggaaacuuugguggguugucauugacaucggucagugugaucgucacuuugguugucccugagaguccgcccauauguccacccauguccuuggccuggaucaccacgugguacuccuccuuggccucccuguccauguuggguagggcuguucugaugauaccuggacagguaagcaggcaacaucacagauauucguuuauaacauuaugacaacaagaaaguucugagcacugaggaagcaaugcugaauaaaauaucccaugcccucagcaagaaucauuucaacaugguaauuacaaccaaaggcagccauacugaagcaucauuaugucuuuucaagcaaaucauaaaaauuacuauacagcauuuguauuuauguuuuguuguacauucaaguaauaacccuauucuucucagauauaaacacccuaaagacugaaauacuugaguggucauugcaugaauauccaugacuaaacucauacuuuuugacuuccagcacaaucuucuguaagucuauugcuacauacaauucauggaaauguuuugauggugcauauuaaguuuaaagcaggaggugcauauuucaugcaauacauuaaaguguaaauauuaauuuuuaaaagagugaaccaaaucgguuaaaauauauacaaugcucauauaagcacauacugucuauuaucaccugucacggaaaacaaugauaaauuaauaacugaauucugcaugauugcuggauauuggcacaugagugccaugcucacuuaaaucuuuaggagaccuuuggaagcuuuuucucucuguagauauggcaacaguuaugugaggaauauagagagcacuguggaagacuuaguccuuauugcucucuuacuucugauauuaaaguugaguuuuuagauuauaguuguuauugggucaucgugaaauaugggaaaaccaacaauaaauguuucaugguguacuaacugugugauaggcacaggccaaguaucuaauccucacacuaacccuauaggguagcccucuguauuccuuuuucauauuugagaaaacagaguauuaaauaaguucuggucaggccugggacuucuuauucaccaugugucacaaaucacagugacauuccacaguaccugucugugcuuccaccgaaaaauaggguuguccuucgaggauacuguacacuaacuuggcgcuauuuccauaaguggggucaucugcaucugaagcugucaccuggauuacugacguuccuuaaaagugaaauaaauuaauuagcaacaucuccucagauuuucaaauuauguucuuguuuacaaaguuuuauucuaaaauuaacccugaagaaggcaccacaauuauucaacauucucucauuuuccuggaguugagaugcaaaauaaccagccaaccaaccuuccuuccuuccuuccuuccuuccuuccuuccuuccugcucuauaaaaauggccacaguuuaaaaaugaacuuucuguauuuauaguacauccuacauugguuggugauuaaaauaauauuauaaauauuauugcaaaaauaucuuacaacucaugcacuugaaauguucaguauaucaaauaauuacauuaaaaucuucccagaguauaauaaaugauaauuaacgauaaauugcuuucaggaaaggacagagugcaaucuuccaucuguagcagaacaauaaauacaucauuuuauuguugcuuugcauguaauaaaauugcugcuaauucuacaauuuaauuaauuuauggccauaaauacugagcagaaugcuguucccuacuggcaugaaaauugcaucuucccaccuguagcuggucugguagccauauaacagaaaucaccaguaaacaucuggugagagguaagggaagcauucaugggucagaacgaagggaaaccaggaaauugaagaaagaugggguucugcuuuuccuaaaaacaaccuuuguuccuggcuggucacaaauagcaaguaucuggggcauggcauguugggcuucagaguggggagagaggagcuggaagaagaaaaccaguaauuaucgaauuucucugugccagcaugaucugggggcacauuccauguauuuugccagcauuccucugcugggcauuuuuuacaucuacuguauuagugagaaauugaacuugagauauaugaagcuuuguaaucuauuucacaaaguugguaauugccaaagucuaaccccaauccagcacacaacaaaacucaaguuauuucuguaacauuuucagcagaggggcaagguucuaugugggaggcaagggagccaguuuacacagccuaucacuaccuuuaauuuauaggauugucagugauuuuugugugguguacaucucacuuuuuucuaguuacucuucuauaauucauuauuucauagaaacaaucucuuuggagcucuucccauuugucagucacuauucuaggcaggauagauuuauaaaggaaaauaccaucaugguguggcuagggaaauuauuaauuuuaaaugcuuaauuuccuucuagaacucugcuacauccuuuacaaugguuuuguauuucacaucuauuucauuuaaccuucaacauaguuuauauuauccucauuuuauagauggcaaaauaaaaacuuagaaagguauaauagguugccuggguucguaaggcugauuaggaguacagccaugauucauaguacugucugacaacaacgacuguacugucauaugccauaauacaaugucugaguucucaaaauaauaagagcaauccaugacaaagccacauccagcaucacacugaaugagcaaaagcuggaagcauucuccuucagagcaggaauaagacaaggaugcccacucucaccaguccuauucaacauaguacuggaaguccuaaucagagcaaugaggcaagagcaagaaauaaaagacaucgaaauaggaaaagaagaagucaaauuauuucucuucacuaaugauaugauucuauaccuagaaaacucuaaagacucugccaaaaggcucuuagaacugaucaacaacuucagugaagcuucagaauacaaaaucaagguacaaaagucaacggcauuucuauacaucaauaacacucaagcugaggaccaaaucaagaauacagugcgauucacaagggccacaaaacaauaaaauccuaggaauacaucuaaccaaggagguaaaugaucuguacaaggagaauuucgaaacacugcugaaagaaaucauagaugacacaaacaaauggaauauugauccuuucaaugauauugauucuuucaacccaugagcauagaauguuuucccauuugauaucauuaaaauggcuacacugcccaaagcaaucuacugauucaaugcuauuucuaucaaacuagcaacaucauuuuuucacagaauuagaaaaaaaaacuguucuaagacucauauggaaccaaaaaagagcccgaauagucaaagcaauccuaagcaaaaagaaaaaaguuggaggagucaccuuacccaacuucaagcuauacuacaaggcuacaguaaccaaaauagcauguugcuggugcaaaaacagacacauagaccaguggaacagaauagagaacccagaaauaaagccacacaccuacagccaucugaucaucaacaaaguugacaaaauuaagcaaugaggaaaguacuccuuaaucaauaaauaaugcugggauagcuggcuagccucaugcagaagagugaaacuggaccccuaccuuuccccauauacaaaaauuaacucaggaugaauuaaagauuuaaauguaagaccucaaacuauaaaugcccuagagaaaaaaacccaggaaacaccauucuggacauuggccuugggagagaauuuaugacuagguccucaaaagaaauugcaacaaaaauaaaaauugacaagcaggaccuaauuacacuaaagagcuucugcacaacaaagggaaacuauaaacagaguaaagagacaaccuacagaaugggagaaaauauucacaaacuacacacccaacaaaggucuaguauccagaaucuauaaggaauuuaaacaauucaacaaguaaaaaaacaaugugggcaaaagugggcaaaagacauggauggacacuuagcaaaagaagauaugcaaauggcuuacaaauauaaaaaaauuggucgucauuaaacaucagagaaauguaaaugaaacccauaaugagaaaccaucucccacuaguuagaauagcuaugauuaaaaagucaaaaaauaacaugcuggugaggauguggagaaaagggaacacauauacacugcugguuggaauguacauuaggucacucugaaaagcaauuuggagaagucucaaaaaaaacagaauuacaauucaaggcugggcacgguggcuuaugccuguaauccuagcacuuugggaggacgaggugagcagaucaccugaggucuggaguuccagaucagccuggccaacauggcaaaaccccuguguacuaaaaauacaaaaaaauuagccagugugguggcaggcgccuguaaucccagcuacucaggaggcugaggcaggagaaucguuugaacccaggaggcagagauugcagugagccgagaucgugccacugcacugcagccugggcaacagagcgagacucugucucagaaaaaaaaaaaaaaaaguauuacaauucaacccagcaaucccauuacucuuuauagacccaaaggaaaauaaaucguucuacaagaaaaacgccugcacuuguauauuuauugcagcacuauucacaauagcgaagacauggagucaaccaaggugcccaucaacaguggauuggauaaagaauaugugguguauauguaccauggaauacuaugcaugguggcaugaauaauaucaugccuuugcaucaacacggaugcagcuggaggccauuauccugagcaaauugacacaggaacagaaaaccaaauaccacaugcuuucauuuauaacuggagguauaaaugaacccaauguuuacccagugggaauaauaaacacaggauuacuagaguggagccagaggacaagugccgaaaucuguugguuacucuguucacuaccugagugauggggucauucauaccacaaaccucaguguuacacaguauauucauguauauucacucaauaaaccugcacaugggccgggcacgguggcucacgucuguaaucucagcacuuugggaggcugagguggguggaucacuugaggucaggaguucaagaccagccugaacaacaugugaaaccccguccguaauaaaaauacaaagaaauuagccgggcgugguggcgcgcuccuguaaucccaguuacucagaaggcugaggcaggagaauugcuugaagccgggagacagagguuguagugagccaagauggcauuacggcacuccagccugaguaacagagggagacucugucucaaaauaaauaaauaaauaaauaaauaaauaaauaaauaaacaaaccugcacauguacccccugaaucuaaaauaaaaguugaaacuaaaaaaaaaaaaaaagccugaauuuuaucccuaaacaucaaugagcccgcaaaggugagaauaaugaaaauuuuccuggauuauauauuuugaugauuugccuuuccaccccauccccacccuugacacucaguugcugacacugcuguuuccucuguauggauuuauuugauauuuguuguuucucauuauaauacacaggcuaaacaccaagaggcugaaggacugggcagggaaaauggaagagacaaaggugggaaaugguucaggcuggcuuuugauaaguacuugacuuuuccugguggagaaggaauauaccauuuucuggcauaaaaagcucuguaugcacaguggaaggaucuuagcguucuagagucaaaccuaucuuucuuaaguagguugauuccuauacuugcuggauuuucucaucuguaaaauguuccugaauucauuugagcucuaaaacucuuuuaagcagacucacucccugauuagaacaguucuacucacuguuugaaagacaaaccuuucuuaauaugaggaauguuucucaaaagaaacauuaugcaaauguuucauuaugugcauguuauaaagaaggcuauugccagaagguggcuaauucuuugaauaaauccuuuaaaaaauuauccuuuagcaacuuaaugugucuucaagcauguugaaaagauauacguacuucugaacauagugacauagugcugugguuaaaugugcauuuuagauccauuuaauagcucaaaugucccuacagaaauuaguuagcuuguuucuggcauggguuuccuaucugugaaauacggugaguuggaauuaccucauuguaaagauuaaucauugcaaaagcuaaauaaaauagugcauguaagucauuaauuagcacaaugucuacaggcaacagauauuaccagugucauuaccuauuagacaucaauacgcacuagcgacuggauguauauuaucucuauuccuacaagacuagaaauuguuauucccauuuuacagaggaacaaaagaauuuuuguuccuuuuguuauuuugccauaaaagauaaagaagaagcucuacuuccugauuugggagaacgggcuucagcccacccaccacagagacaccaggccuggaagcagagcaggccucccacaccguacgcacccacauuggaccucucaggcacguuggcaugauaggucucgugcaggaacuccggaggguugucauuaauguccuggaccuugacaaugaauuccgacgguggcuccaguggccgauuggugucccuguccaccgccugagccaucaacguguacugggcucucucuucucgauccaacgucuugguggcaugaauguucccugauuugucaucaaucacaaaaaugguuccagcuccuuccccugagagaauguauuuaauguucccaucaccagagucaauaucugaaugaagcuggaagaaagagaaauugagauuuuuaauuccaugaggaaagcaguggggaaacucacuuacaagugauugcaacaaucugcugcgcacacacacacgucaugaaagggagauguucucaucuccauuuuacaacaggagaaaggcaaucuuagagaauaucauagccuuggccaaggucacacugcagaacagugaagccagaguucaaauauauauauuuuuaauucuaagauucaugcucuccuuucaccucucuccauauauaugcgcauaugcaaaauauaaaaaccuaaacguaucugucaauaguuugaaauaaauguauguuuauuuuuaaaaauauauaagcaaacauucaugcaauaaguaagucuuccucucagcucugacucccauuccuucauuuucuccucuguucagagacaaucacuguaaccaguuucuugugaauccuauaagagauauucuauucuaugcauaugcaaggaaaucuacacagauacauauguacccuaguuuauuguuauacaauaaaguuccagaguacacacaucauucuucacuucauccuuuuccucuaacaauaaauucaggugacuauuccacauuuauaacuauagaucuuccucaucuacuguauggagguuauuauuuuuuaaaaaauuuuuuguuuuggguuuuucuuuuuuuuugagguggagucucacucuguugcccaggcuggagcgcaauggcaugaucucggcucacugcagccucugccucccauguucaagcgauuucuccuaaaucagccucccaaguagcugggauuacaggcacaugcuaccauacccagcucauuuuuguauuuuuaguagagacaggguuuuaccauguuucccaggcuggucucgaaccccugaccucaagugaucugccugccuuggccucccaaagugcugggauuacacacaugagccaccaugccuggccaauguuuuuguuuguuuguuguucguuuuagcaguccuuucuaaagaacacuuagcuuguuuccuggcuuuuguuacuacaaacaauucaacuuaucagaccuuuccagaagaccugcuuugcgguacacaggguaugaggaucuggggauguggccugccuggaagaaguguccauucuaaugcuaaagguagguaggacuaguggcauggguugauauguauacaauuucuuaggugucagaaagaaucuuaaacauccccaaguuuuucuucuuugacagagcuuagagauaagaugauauuugccuaaauucacacuugucagguccaagaaaucaacuaggucucuuaacuaccaaucaucuucuguucugcccucacucugcucuguguuuucaaacaugaaagucucccaaaaaucacaucugguuuuccuguagcaaaaaacuccucaccccgccuuguuguucaaucucaauuucugcagcugucuuuuaauccgaguuccuugguccucauucugcccuuugugggaaaaaguaagcauuauuuuuacuguucuagugggcuucaagagcagucaaguagagaaaaagaccuugguucuaccuacuaaauaagaaaacccuuuguaaacuagagagcuuuauucaaaugacauuuaaaauaauaaaaagaggccaggcacauuggcucaugccuguaaucucagcacuuugggacgcugaggcaggcagaucacuugaggucggggguucgagaccagccuggccaacaugcuggccaagaugcugaaaccucaucucuagaagaaauacaaaaauuaaccaggcaugauagcuugcaccuguaaucccagcuacuugggaggccgaggcaggagaaucgcuugaaaccaggagguggagguugcagcgagcugagaucuuaccacuguacuccagccuggcagacagagugagacuuugucucaaaaauaaauaaauuaauuaauuaaauaaaauaauaaaaacuaugauuauuaucaaugccauuuaauauuaacaauauuaauaguauuauuuauuacuaaugccauuuucauauuuuuguuaaaauugguauuuauuauuuugauuuaaauuauuauuaugagacuaaggccuagagaccuuaacucaugauuauuauuaugagacuaaggccuagagaccuugcuuauaaagcaagguugaauacauagauuuuaaaaaauuuuguauuguuucaauauccccaaagauaucuaauugauuugcagcgcuucagugaaaccccaauuauuucagcucggggguuaccuguagguaugaauuacaaagaccauuuuguuuucaguccucuuuguuucuagggggaaaaaauaaacagacuuuucuucagcauuuguuauucauaacaauguguugucgugaaauuauggcuaacacauuucugaugaauaaguccauuugacaguaaaauacaaagcuguuugauggccuaugacggaugaacagaauugccccaaucuucauucagccaaguuuccuuaaugaaggcaaaauuucugccccacaccgccaucuuaggggaggcuuaccuuuguucuucuauuuacccugcugcacaccuggcagaaguuaagggcaaggacauacgaaugaggaacaagaaaguauaaauaaaaugcugacuuuaaugggaaugcccagacauugaaucuuucuagaggccuucauauauuacaugugaauuuggcaaguuucuugaaaauuaaauggaucuauuucaugaucagccaaauaacuaaaaauuuaacaaaacauuuccuauuauuuuucuacuuuguuuucagguuggaaaguaggacauaacuucccuuuuuugugucuaacaaagaugauuuauacaacugacauggauacuuacuaggcuccacacacacacagacacacacacacauuaaaaaaaaaaacaaaaacccaguuucagaaaccauucagugcuaucaagggauccaguugcugaggcauacgcagccaauuccuaacuccaaagaugaauggcuucccucucugcauagcacagcaugacacaggcuguauuuccacaagaaaucugaaaguccaugguuuaccaaauuucacuuuuucagggcaucuuaagcacucaaccuugaaugucaucaaaucaaagguuguuaggaaauaaaccaucuauuccaucccuccuauuuccagggaacugucucagcacauuucaaaagaaagauucacaggaccaaccacuuuauuuauuuuuccccuauccaaccggacaucagauucauucucauguaccuagcuuuugaaggucacacaccaugaauaauacuaguuuuccuuuccccucuuuuuuuucuauauuuucuucuaguaggcaugacaauugcuuacuccagagaugcugaaaugacucuccagauccuguuucuucugcaacccccaaucugaacacacacacugcuucccauugagaaaguccccaaagcagaagguucuauucauaucucagaaugauucaugcacagcccuucacaacauuuaagcuccacaucccuugucauggcugaaaucucuuuuuccucucuggcacacagcccaucuccucuacuuagggaauuccauaugccaauuauuuccauuuccauuucucacgucaacuuccacauauuuccauuugggauauaaaugaaugaaauuccuuugguacaucucuucaagaagaaauuuuuccaaacuuacacaaugucauugagauucuaacauuaaucuccuucaaguaugucaauuaugugaacaugaagugcuguucucauguaaaagaacaauuaagauaacuucguagaaaucaguaggguucagaaaccccucaaaccuauucucuuuccccuuuaccuuccacuggauaauuccuguucaucuuuuagguuacagguuauucccauguuguccuugaaaccuuccuuugacaucccucccaaauauuaccauguaaauucauaaucauuuacauugaauguccucauuauucuauuauucauuuucuuuuuuucuuuuuuuuuuuuuaauugcuuagguaacugucucuuuuccacuagaccucuuugagguuaggagcuaucuuaaucuaguuuacauuuugccuagcacggcagcugcuccacaugauaggauuucaguucuuauguaucuaaggaucuaucuuuguuuuuuuuuuuuuugagauggaggccuuugucucauaauaauaauuuaaacuuaaauaauaaaaauacuuuaacaaaaaugagaaaauggcauuaguaauaaauaauacuauuaauauuguuaauauuaacuggcauuguuaauaaucaucuuuuuuauuauuuauuuauuuauuuauucauucauuuuuugagacagagucucacucugucucccaggcuggaguacaguggcacaucuuggcuuacugcaacaacuccuucccauguucaagcgauuccccugccucagccucuggaguaguugggauuacaggcacucaccaccacgccuggcuaauauuuguguuguuaguagagacgggguuucaccauacugggcaggcuggucuugaacuccugacaucccgugauucaccugccucagccucccagagaacuaggauuacaggugugagccacugugcuggccgcacauaucuuuuugcaguuuuaaugucacuaucaucugaaagauaacuguacauuuuacucaaaugcuaguggguagguaauuuuccaaacucucuugaauuuguauuuuggacccucuuucuacacuugcacuuuucuggaagggauacacagagaccacagagccuggaaugggaagucaucucacuggguuuuaccaugccuguggaaacagggauaaaaccacacccaagcuucugguacauauucauucagcucuucaaagcugggucuagcaucaggacauaaguacacaaggaugacacugcccuugacacaaaguagcuugaagucuagugaaguagacagauuaauaaguagauacacugaauacaaaaagcaaagcuaugauaaaggguccaaaggaggagcauucaaguugggauuaggguguggucagggaaaugccuccagcuggaaaaugguuaaauaaauuauggcuaugugcauuuaaugggcuauuaugcagccauucaaaauggaguuugagccuggcguaguggcucaggccugcagucccagcacuuugggaggcugaugagggaggaucacuuaggucagagguuugaagccaaccugggcaacacagcaagaccuuuucucuaaaaaaaugaaauaaaauacagauuagccaggcaugguggcaugaaccuguagucccagcuacucaggaggcuaaagcaggaggaucccuugagcccaggaguuugagauuacagugagcuaugaucacacuacugcaugccagucugggcaacagagagagaccccauaucuaaauaauaugguaaaugaguuuuaugauauaacucccuaaaacuaaauggaaaaaccuaagaaguauucucaacauggauaagucuauuauuuuuuuuaaaagucuggaauaacauauuauguacaauauuugggugguuuuacuggcucuucaagccauugguguuuucucucuuagaugccugugggccuuuugcuucuuucuggccacagacgacuauuccaaugguggguuggaaagcucaggauugagggaaggcagccuuacccugcccacaagcacggggucaggcccgguguacuccucuaucacgaagaacugguuccagacccagccacgcuuggagcgcuguagcaccugccccuccuugcccuucucauggugcccauggaaggagggccgcaggugcccccgccgcucuggggcaaaggcauggcuguggcacagcaugcccaggcacaccagggcggcuuguaaacaguaguucuccuucauuuuugguuacgugguaggcacaggagaaugcagcugucaccccuuccaccaacuguacgguggucuugcugaggguggccucccggacgcgucacgcagaccucucuugggauggaaugucucugcugguugagcucaucacgucagggcugcccacguccccaguuagcuucugcaagcagagagagguuggauuaacugcaggccaaauccccacuucauuuccauuccuuucaguaagccuucaggacugggcaugaguuuaucacgugggagcuacgggcuuuggggaagcucacugacugcuuugagcucagcuugcucauuuaugaaguggggauaagaguguacccaguacaaagcugucacugggauucacugaguaaugcauauaagucucuuagcacaaugccugguacauaguaagcacuccauauuuaucuguuauaauugaucaaaauugugcuuagauaugauuuuguaauaagaaaacggggaauuaaaggaguccagaugaggaacauauaauccacacugggguucaguuuagggagaggacagauggcuggacucaauccuuuagugag

SEQ ID NO: 15549 - RNA, 2642 nt, Homo sapiens
guguuucauaguccguugugauuucaaacgauuccauaccaucuccaucaacaauauuguaugugacuaagccauuuucuccaaugucuggaucuuuagcuuucacucuuccuacuuccuccccagggacggcugcuucugacacagacaucugguauacgccuagaagaagaagacaucuauuuuuauuuucucuuuuauuuggcagcuguaagacuauagauuucauugaaucccaauaaauuucucaaaggauuugaaauugaacuuucuauugacugaaaacaugaaagaagugaguggauguggggaggaggaucccacauggccugcuugucaaaagaauguguucuacgaagggugauaaaacaauaucuggguccaggugaaaugcuggggucaccugccacauguaagggagaaaaacaaugcucuguuacauuucccaucagguaaugauggagaaccaugcaugucuucauuuagcaaaauagcugaagcuucuuuucaugucuucaggaugguccaugaguuaacuccaaggcucacuuaugguauugcgaagagcccagaaaaaaaaaauucucuguuuaaaagccuuccuucaacagcuccauaguuacuuuaaaaaugcaaacuuuaacaucccucccugucuaacucuauauucgacacuccccuuauuucaccuccuucgcaacuugccugcuucacaaguuggucaugcguuaccuucuccagaaggcuuuccugcagugugacccuccuauauauuuauuuaauguuuauugggagccuaauacuguacauggagguacuguccuagugccaggacacuguuuuguuugcuuguuuuguuuacuacuaaacaaaacagucaagauuccucucuuaaugaggccgacuaaagagaaaaaauaaaaacaaauguaaacacacucugaugucacugcaaugaaaaaggaaaauaaaguaggguaaaagggugaggguucugagagugggugugugguuguggguguguaagugcaugauugugugugagggugaggggguaaaugugugaguggccaugagugauugugugggcaugaaucuguuguguaagagugugaguguguguaugaaugugagcuauuugugagugaguuuguguauguguaugagugugauugaacacgcaugcuuguguuaauaaugugugggugauaagcagaaagagggagagauugguuuugcguagugugguaggagaagacauucuuuagaaaaaggaaucuaaaaugacugaggaagacaaugacgugcauaucugcaggauaaaaacuaccagccaggugauuagcaaauggcaaaaacccuaaggugagaagauccugaauacuugcagaggagcaagaggaggagagugacuacagccuucuggugagagagaagggcuguaaggaaguggaggccaaauugcguaaaauagaccauuguggggaauggaaaagacuucagguuuuguuuaaacuuggggaaaucacuggaagguuugcacuaaguagcuaagauucaacauuaucuuauuugcuuuucacauuuaauacucugugcaacacacaauauagggaagccaggguugaaaaucuuuccucuaucauuuccaagcaaaguggucuugggcaaguuacuucagcucauuauguuuuaauuuccccuuacagagauuucaucaguucuaauacuuugucuauauuuaucaauaguauuuugcuuugcaacuuucuuuuggauucauaaucuauuuaaucucaccaugcccucuauauuaaaggaugagugggaagugggagucccuuguagauaauuaccaauuaaugugaagguuuaaaaaaaaauguccuauguggauuuuguccaaaucucauucaaguucacggcagugaaaccaguaaaaccaguacaguagcaauguaacuuuacuauaugauugucuaugaccaagggcaguaaaggcugccugcuaauaauucugcuugaccuuucuuuuccagcucaccagacaaucguacaguguggauaauggagcaugcagcucuuugaauguuauaugagccucaggcuuauugaggaugcugaacuugugcccggccaggcaaaagagucuuguguagauucuugcuuuugaauuccuuugaguaaccacagugccuuccuggggccacauuuaguagccuuccuuguuaucucauuugcaaaauguuccauuucucugauaguaagcucacaggcucuaacugaaaaagacacuuucaugaugaacccccccaugcauuagcagcaccagcagcaccacagucauacuguccauucauacacaucuguacauacauagacagacuuguguucaaacucugacuuugccacauuucuagggcaacuuaugcacuuuuuacggaaaccaguuuuaucuguaaaauguaggcuccugcagagauuuacaauaguagugacuauucauuaaaugaugguaguugcuauaauuacaauuauuaauaauaaccuuucaaaaucauuguuuuucauuuaauucccucugcaauuuuauaaauuuuguagaacagccauaaucccccagauaacaauggcuagaauuu

SEQ ID NO: 15550 - RNA, 623 nt, Homo sapiens
uacugugaauauauacuuuuuauuuagucauuuuuguuuacaauugaaacucugggaauucaaaauuaacauccuugcccgugagcuucuuauagacaccagaaaaaguuucaaccuuguguuccacauuguucugcugugcuuuguccaaaugagccuuuaugagccggcugccaucuaguuugacgcggauucucuugaccacaauuucgcuugggaagaccaaguccucgaggauggcaucgugcacagcugucagaguacggcuccugggacgcuuuugcuuauuuuuuguacggcuuuuucgaguuggcuuaggcagaauucuccucugagcgauaaagacgacaugcuucccacugaacuuuuucuccaauucgcguacuagccggacuuggauuuucuggaaagauuucaguugaggaacgggaacaaagauuaugauagcuuucugaccaccaccaacuucaauuuccuuagcugccguaauauucagcucccugagcugagccuugagguccgaguucaucuccagcuccagaagagccugggagaugccggacucgaacucguccggcuucucgccauugggcuucacaaucuuggcgcucgaacugaacaug

SEQ ID NO: 15551 - RNA, 623 nt, Homo sapiens
cauguucaguucgagcgccaagauugugaagcccaauggcgagaagccggacgaguucgaguccggcaucucccaggcucuucuggagcuggagaugaacucggaccucaaggcucagcucagggagcugaauauuacggcagcuaaggaaauugaaguuggugguggucagaaagcuaucauaaucuuuguucccguuccucaacugaaaucuuuccagaaaauccaaguccggcuaguacgcgaauuggagaaaaaguucagugggaagcaugucgucuuuaucgcucagaggagaauucugccuaagccaacucgaaaaagccguacaaaaaauaagcaaaagcgucccaggagccguacucugacagcugugcacgaugccauccucgaggacuuggucuucccaagcgaaauuguggucaagagaauccgcgucaaacuagauggcagccggcucauaaaggcucauuuggacaaagcacagcagaacaauguggaacacaagguugaaacuuuuucuggugucuauaagaagcucacgggcaaggauguuaauuuugaauucccagaguuucaauuguaaacaaaaaugacuaaauaaaaaguauauauucacagua

SEQ ID NO: 15552 - RNA, 2642 nt, Homo sapiens
aaauucuagccauuguuaucugggggauuauggcuguucuacaaaauuuauaaaauugcagagggaauuaaaugaaaaacaaugauuuugaaagguuauuauuaauaauuguaauuauagcaacuaccaucauuuaaugaauagucacuacuauuguaaaucucugcaggagccuacauuuuacagauaaaacugguuuccguaaaaagugcauaaguugcccuagaaauguggcaaagucagaguuugaacacaagucugucuauguauguacagauguguaugaauggacaguaugacuguggugcugcuggugcugcuaaugcauggggggguucaucaugaaagugucuuuuucaguuagagccugugagcuuacuaucagagaaauggaacauuuugcaaaugagauaacaaggaaggcuacuaaauguggccccaggaaggcacugugguuacucaaaggaauucaaaagcaagaaucuacacaagacucuuuugccuggccgggcacaaguucagcauccucaauaagccugaggcucauauaacauucaaagagcugcaugcuccauuauccacacuguacgauugucuggugagcuggaaaagaaaggucaagcagaauuauuagcaggcagccuuuacugcccuuggucauagacaaucauauaguaaaguuacauugcuacuguacugguuuuacugguuucacugccgugaacuugaaugagauuuggacaaaauccacauaggacauuuuuuuuuaaaccuucacauuaauugguaauuaucuacaagggacucccacuucccacucauccuuuaauauagagggcauggugagauuaaauagauuaugaauccaaaagaaaguugcaaagcaaaauacuauugauaaauauagacaaaguauuagaacugaugaaaucucuguaaggggaaauuaaaacauaaugagcugaaguaacuugcccaagaccacuuugcuuggaaaugauagaggaaagauuuucaacccuggcuucccuauauuguguguugcacagaguauuaaaugugaaaagcaaauaagauaauguugaaucuuagcuacuuagugcaaaccuuccagugauuuccccaaguuuaaacaaaaccugaagucuuuuccauuccccacaauggucuauuuuacgcaauuuggccuccacuuccuuacagcccuucucucucaccagaaggcuguagucacucuccuccucuugcuccucugcaaguauucaggaucuucucaccuuaggguuuuugccauuugcuaaucaccuggcugguaguuuuuauccugcagauaugcacgucauugucuuccucagucauuuuagauuccuuuuucuaaagaaugucuucuccuaccacacuacgcaaaaccaaucucucccucuuucugcuuaucacccacacauuauuaacacaagcaugcguguucaaucacacucauacacauacacaaacucacucacaaauagcucacauucauacacacacucacacucuuacacaacagauucaugcccacacaaucacucauggccacucacacauuuacccccucacccucacacacaaucaugcacuuacacacccacaaccacacacccacucucagaacccucacccuuuuacccuacuuuauuuuccuuuuucauugcagugacaucagaguguguuuacauuuguuuuuauuuuuucucuuuagucggccucauuaagagaggaaucuugacuguuuuguuuaguaguaaacaaaacaagcaaacaaaacaguguccuggcacuaggacaguaccuccauguacaguauuaggcucccaauaaacauuaaauaaauauauaggagggucacacugcaggaaagccuucuggagaagguaacgcaugaccaacuugugaagcaggcaaguugcgaaggaggugaaauaaggggagugucgaauauagaguuagacagggagggauguuaaaguuugcauuuuuaaaguaacuauggagcuguugaaggaaggcuuuuaaacagagaauuuuuuuuuucugggcucuucgcaauaccauaagugagccuuggaguuaacucauggaccauccugaagacaugaaaagaagcuucagcuauuuugcuaaaugaagacaugcaugguucuccaucauuaccugaugggaaauguaacagagcauuguuuuucucccuuacauguggcaggugaccccagcauuucaccuggacccagauauuguuuuaucacccuucguagaacacauucuuuugacaagcaggccaugugggauccuccuccccacauccacucacuucuuucauguuuucagucaauagaaaguucaauuucaaauccuuugagaaauuuauugggauucaaugaaaucuauagucuuacagcugccaaauaaaagagaaaauaaaaauagaugucuucuucuucuaggcguauaccagaugucugugucagaagcagccgucccuggggaggaaguaggaagagugaaagcuaaagauccagacauuggagaaaauggcuuagucacauacaauauuguugauggagaugguauggaaucguuugaaaucacaacggacuaugaaacac

SEQ ID NO: 15553 - RNA, 1007 nt, Homo sapiens
gcuacaaggacuuuacgagagaugaggaaaggaagcuggagaccaaguacaguaguaaugaaaguuaucuucuaugucugaaagcuaguuaugaacuuacuuucuucuguuccacaagcucagaggaagcagaauuuguagugaaucucaccggaggugcagguuccauaguugcguucuugaagaugauaaucucuuauucugcaagagcaucucaagaggguucuugggccuggggauacagagagcaucaggcauuaggacuggggucagaugugggugguagacagaauccccgugcaguuaccugcugggcugauugcguuaaucacaguggccacaucagagcagcagcaagaucagcugaaucaguaggaaucaauguacacagcagugcugcucacaggcaggauuagagacgcauucucauuugcucaccuuuuuguaguccugcuccaucaccaaggcaucugaucacacucauaggccucuugcuaguuucuaaaacucuucuaauagacaaagugaaacauguuucuucaagagugggcucucaucaaugaugcagggaagauggcccaguauguuucugcagagcauaaaauaagugugcuucucagaauugucauagacucaaaaaucuucggagaaaagucaucccuggaguaucaucugguucuuuccuuuuagucuacacaugaggaaauugaggccuagggaggugaucaccuaagagaaagagccagcuguugggucugauucuagaggugccugguuuuccucucuagacuccuagcucugcaaugcuggcggcucucaccugaagcucuaaaaccugagcuuguguccccagugaaggagaugguaaaguccuggucgucugccccaagcuguuccugggcugcagccuagucagcucuugccuggaguggcucagacagggccuggaggggcaccaggagaauggcagugaggagggugaggguccucauggcuggggucaucug

SEQ ID NO: 15554 - RNA, 13641 nt, Homo sapiens
uguugaggccacggucaucuccgauugguacagcuccgagaccccgaguccugauuggaggucgaagacagugcgugcugcucggccccacucauccagucacaaagggcuggggcggucgccgcgcucgcguguuugcggagugcgccuggagggggcgcuggaguaugugugugccggggcgggguggcuuccgggcacgaguugcugacagcgccucgcgguugauaaauccugagggcggcggcuacccugcacuccaucggugccuuugggaagcgccgccuucucuguuguacccggccgugggucaggucggcgcggcuggcgguggagucucggacaccgagcccuggaccccgacucuggaagcccccagccccacugggccgcggcagggcgcccacccuccacaaucucaguucccagccggggagugaggggcugggcgggucucuccaccgcuuuggagaccucaggacuuggauacgcuuuugaguggucccagucguccugauccacgaaggcguggaguggaagucaggaccaggggucgccccagugacgcaggaagucaagcccagaugcggugaggcgucgccagccuuggacccagcagugggcgcuggugacaguggcgaccucgccgaugagagguucgcccucccuagcauuaguugucacuuuggugaaauggagcguggguggcagcuccuccacacacaagcccuuugcugagguggugcgggggguucucuccacgcuugcuaagggcagguaguuggcugacuuugaacuaugaagaaaagccagaaacaaaauggcagaaugguaugacucugggugggcuuagggacgcuggugccagaggacuuggcuugaacccgcuccaacacuuacaaccugagugaccgugagaaagaacuguaacuccucuaaacuucaaguuccucacuucucaaauaagaacgugaauaguaccucccuccuagaguugugaggauugaguuagaaaaugcuagcaauuguuaugcccuaaggaacagcacaagauacaauaacacgugauaaugugugucgaaggugcagaaaugcagucgcugccgugagaauuucucauucauucacugaauuaacauuugccgaaaacccccacguaucgaccugugcuggaugcuggagaugcugcaaugacugcugucacaggcauugucccugugguuacagggcccagcaggaaagacaaaugagaagcaagggauugcaaugcagugugaugaauaaggaacgcauagggggugggaggagugcuguagagauggcugaccuagagucagggaagacccucuaccuugaaaccugaaaaugagaaaggaucccucaaaugcagggauagauggacagagaaaaaaguacauaaggaaggcucugcagaugagcaaguuaaguauagcugagcuggaaugguaggaagagcgcagggagaucaggcuggaaagguaaguagggagccuagugguugugaaccuuggaaauguuaauauuuauaaaacacugugugccauacacuguguuuuauaauuuguaaguaccauuccauaaauauuuagugagcccuaccaugcgccaggcacuguuccagugcuuggauacauaacaccaguaaacaaaagacaaaaaucucuuggagcugggcgcgguggcuuacgccuguaaucccaacacuuugggaggcugaggugggcggaucacuugacgucaggaguucaagaccagccuggccaacaugaugaaccccugucucuacuaaaauuaaaaaauuagccaggcgugauggcacguaccuguggucccagcuacucaggaggcugagacgggagaaucgcuugaacccaggaggcagagguugcagugagcuaagaucgcacgacugcacuccaaccugggcgacagagugagacucugucucaaaaaaaaaaaaaaaaaaaaaaaaaaacccuguccuagugaggcuuauauucuaguggggaaaagacagauaauaaucaauauacauaaguaaaguauauaguagguuauaagauggcaugugcaauaaaaaaaaacuaccaggaguguuaugggauuggagggcaaauuacaguuuuuaagagaguagugagaacaagccucauugagaagagacauuagugcaaagauuugaagaaggcagaagaguuaacuauagggagaucuugggggagagcauuccagcaaagggaacaggcacugcaaagccuguaaggccagaaugcuccuggggaguuucuggagcaggaagggugacaguguggcuggagugaaaugagcgcaggguaaaggaggagacaagguuacaggguggguggccugaucacacaggggcuagaaagcucuuuuaaagauuaugguugugaaagagagagcccauggaggguuuggacaaaggggugauaggaucugauuuaucagucaucuggguugagaagacugugcaagaagacuagugagaccgcugcagugacccaggcgagaggugauggagcucagaccaggcuguagccauggagguggugaggaggagguggacugugcguguagucuccaggaggagccagcuggauuuccagauggaugggaugcagggagugagaacaagagagaagggagggccacugagcuucagcauggagaaggauaguuucaucagcugagacuagaaagacuauggguaggccaagcacgguggcucaugccuguaauuccagcacuuugggaggcugaggcagguggaucaccugaggucaggaguucgagaccagccuggccaacauggugaaacccugucucuacuaaaaauacaaaaauuagccgggugugguggcgaacaccuguaaucccagcuacucggaaggcugagacaaaagaauugcuugaaccugggagguggaaguugcagugagccaagauugugccacugcacuccagccugggcaauaaggcaagacuccgucucaaaaaaaaaaaaaaagcaaucacaaaucugauaauguuuuaagagaguuuaugaguuuguguugggcugcauucagagcuauccugggccgcaugcagccuaugggccuugggcuggacaagcuugcuauaaaggaauaccugagacucgguaauuuauaauauuaaaaaaaaagagguuuauuuggcucaugguucuguaggcuaugcaagcguggcaccagcaucugcucagcuucuggugaggccucaggaagcuuuuacucauggcagaaggugaaaggggagcgggcaguugcauggugaaagcaggagugagagagaggaggugccaggcuccuuuaaacaaccagcucucucauaaaccaacagagugagaacucacucauuaccauggggagggcaccaagccauucacgagggauccaaccccaugacaccugcuagacccaccuccaaaacuggggaucacauuucaacaugagauuuggaggggacaaacauccaaaguauaucaauauaucugugagcuccauuaacuauccaaguggagauguugagaaggcagcuggacauauaaguccaggguucaggagagugggcugagcuugagauauaaauuuggguguuuucaguauauggauauuuaaaguaguaggaccuguugagaugaccgagggaaggaguguggagagauaagagaaccagauuccagggacacuccaaauuuaagaguucacauaagagaggaggaucugaaaucauuuaauccccccaacuacucuaaaaugaauuaccguugugauccccuuuucguagaugaggaagcugcaaagacagcuuaaauaacugcccaaggucgaacagcaaagcugugauucaaggacguuggaagaucugagcagaauggcucagauuccacacuuccuaccucuaagcccaggaacccauugaagaaaugugaagcaggagaguggcacacuuucagauuuccauuucagaaagacuaugugugcaggauggacuguaacaggcugagccuggaggcugggagguuauuuagacaauugcaguaaucccuaggagagagcuagugccuggagccaugaggcagggauuagagagaaguggacaccuuccagagaagauagggauuagggauuaauggaaugucaguggugaggcagaguagguuucugauucgggcaaugacauggauggaagcaucauguguugagauggggaucacuggaagagaggccccuugcggggagggcgcaugaauccaguauauagcaaugccugggggcaugaaccaaguugacacucaaguguuuguugaauugaaucaaguaacauagaaucugagagcucauguaauacuuucccaugacuuuaagagaggccacaggaaaucauugacaaaugauaagucagucuauuuugugcauaaaaaucucuagggaaagauuuccuaaagcugccacucacaaaccauucuaauguuuaacagcucucacugcugagaaauuuuucuaccauaaaaaguuaauccuagcuaucaggauucacugggaaccauuuauuuauuuauuuauuuauauuucauuuuuggucugagacaagagaggccuugcccacccagaaagacauuuuuuucagagcugcaacaucauuucugcgucuuugccacuuccucccuguucacacguaugcucuccuugcaacacaccucacuaccggucaugcacugaagcaauggaaugccuucuccucaugccucccuucucacggagcccucuaccuggcacauguuugucuuuuacucauccuauuuuggaaauucgcuccagcccgcaaggcccagccauauguuuccuccuccacaaagucuguuugaagcuucuugcccccacacugggaguaauguuucccuccucugugaucaaagagcauuucccagcucuuucauguaaccuacagagcgggcacacucugccaugcaucaacaugugcaucugcugaccaaaucuggauucuaagcucuuugggaaaccacagugugucucacaaugucuagugaacaaucaccuauuaaacuaacagugauggagugcuuacaaccuccuggacacugcggguacaaagaugcgguacucuauguuacuucaaggaacauacagucaaguggaggggggauuuaaaguguagacugcuccccuuaucaaaaccaggccgggcgccguggcucacaccuguaaucccagcacuuugggaggccaaggcggguggaucaccugaagucaagaguucgagaccagccuggccaacauggugaaaccuugucucuacuaaaaauagaaaaaaaaaaaauuagcccagugugguggcaugcaccuauagucccagcuacucggggaggcugaggcaggagaaucacuugaacccaggaggcagaaguugcagugagccaagaucacgccacugcacuccagccugggccacagagggagacuccaucucaaaaaaaaaaaaaaaaaaaaaccagcuccuuuaagccuggccaugaaaggagccuguccauguggagaggagagacugaaccugacgcccuacucuagaaaaagagauccgcuuuccccuuagggaccucucacugcuggcugcagcucccaccaccauacugguuuugggagggucaguaucccuuuaacucuucaauggcauuuaagacacacuauuuuuuguuguuuguuuaauuuccuauagcagagcagagaccaggauggacauuuauccaaagcuugucuaaagacuugaagauaggccgagcacaguggcucacgccuguaaucccaacauuuugggagacagaggugggcggaucacuugaggucaggaguucgagaccagccuggccaacccauuucuacuaaaaauacaaaaauuagcugggcaugguggcggccaccuguaaucccagcuacucgggaggccgaggcaugagaauggcuugaaccuggaaggcagaguuugcagugagccaagaucgugccauugcacuccagccugggugauagaacgagacucagucucaaaaaaaaaaaaaaaaaagacuugaagauaacagaaaggaagugagcagaaagaguaacaugcaacuaaaaauguagcucacaaaugugauccaauccgggcaucuuagaugucucuaugggaugcacaccugcuuccaggggacagggaugcuguguaccuccucucaccuaggagccccggcaagccaucuggaguuccugaaauccaaaccuugucugacaaggagacagcagccucccucuccugguggccucaggcuggccuccugguuccagucuccugagggacauaauuauugcaccaaauggucccuuccccagaugauuagccacaagaauauccaaucaugaggccacacccucaccucaggggcauggcauuauucuguggcuuguuaguagacgcuccgcgguucuuucucugcacucucccuagauggcuucaugaguguaauacccuuuuaaugaugacagcucucgauguaucuccaaccucaacuguuuuccccagcuuaguaaacaauaccaccauccauccagcuacucaaacccaugagucauccucaaguccuccauuacccucauccccucauguaaucagaagcauacccuguggauucuaucuucaauguacaucaggaauucagaaucucuccaaugcaaugucaucacuuuaguccaggccacaaucaccacuucccugaaagaugauaaccgcugccauacuggucucccauuucuacucucaccccuccaauccauuuucuauacagcagcaaaagugagcuuuuaaaacuguaaacaguuaugugcagcuuggaacccaucaaugcauucccauggcauuaaaucaaaaaugccuuuacuacuucuuuuuuuuccccgcuuagagucagggucucacuguguugcccaggcuggagugcagugaugugaucauaacucauugcagccuugaacuccuggacucaagcaauacucccgcuucagccuccugaguaaaugggacuacaggcaugccaccacaccugacuaccuuuaacacuuaucuguccucucgaucucuccaguugaaucucuugccacaccccuccaccacucacccccacucucagcucugggccuagaauaugcucuuuccucuguuuggaagcuccuguucuuccuuuaagucuuccuuuaugguaccuucucagggagucuuccauuaagcaccuugucuaaaucuaccccccaucuuugucuuccucuaccacccuaaguauucugucucuauucuuuauaauacccaucgaagcuuguaauuacuguguuuauuuaucuguggucuuuucuucuuugucagucuuccccacuagaguaugugcccccugaggucaggcacugugucuguccugcucaccuuuguagccauugccuagcacaauaucuggcauucaggagguuucaguaaauguuuguugcccugugaaaagcaguuuggggaucucucaaagaacuuaauauagcacuaccaugcaauccagcaaucccauuacugggcauauacccaaaggaaauaaauuguucuaccaaaaagacauaugcacuuguauguucaucacugugcuauucacaauagcaaagacauggaaucaaccuaggugcccaucaaugguggauuggauaaagaaaaugugguacauauacaccguggaauacuauguagccauaaaacagagugaaaucauguccuuuguagcaacaugaaugcagcuggaggccguuauccuaagcaaauuaaugcagaaacagaaaagcaaauacugcauguuuucacuuguaagugggagcuaaauguuagguacacacagacacaaagaugggaacaauaaacacugggaucccaaaagcaggggaaagggaggaagucaagggucaaaaaacuaccuauggguacugugcucacuacuuggcugacgggaucauuaaagccucagcaucaugcaauauacucauguaacaaaccugcaccuguaccccugaaucuaaaauuuuaaauaaauaaauguuuguggcuuacaugggcuguucugaucaccuuccacuguuggugaaugagggguaucccugcccuaaaaaguacaagauagccaaacacaugacaccuggcccuggacggaugagguugauagcaguuuauucacaauguaaacucacagcugcaggaggaggagauuguggauggugggggcugcauucuggaguagagcaaacccccagagaggcagccuugguagagacaagagggcaggauggcccuugguucccauuggagcaugugauugguuuguuugaauuauuucgcgggcuaauaggaaggugaagcucauuagguugagaacugcauggggugcagcuuguccugcugacagaauuagccagggaugucugcuaagaugaggggaauucacaagcauucaggcccugugaucuucaagaaugucaagguugcacuugaaaguuuaguucuuaccauacauggaucuauaauagcaucuggacaagagacauacacauauaguagccagaggcaggggguaaggggaagagauuauuuuauuauaagacuaagugaaugaauuacuauacuacagcccugugauuuguauguacaggcuacuagaugaguagcuaguaaguuuuccuuaaaaaacugaauuccuaauccuaccuuuuuuuuuuuuuuuuuuuugagacauggucucacucucacccaggcuggaguacaguggcgcaaucuuggcucacuacugcagccuucaccucccgggcuuaagugauccucccaccucagccucugggcugggugggacuacagguguguggucaccaugcccagcuaauuuuucuauuuuuuuuguagagacaggguuucacaacauugcccaggcuggucucgaacuggacucaagcaauuugccugccucgaccucccaaagugcuaggguugcaggggugagccacugugccaggcccccuaauucuccuuuauucuuauccuaaauuggagcccauggggauuaugcuuagcuacauguaacagaaaagccaaauaacacuggcuuaaacaagauagggguuuaguuuucucuccacaucaugagaugucaagaaguucauaaauccagagcuggaauggcagcuuccaucauggacucaggcaucucuuagcuugucauccuacccuuccuggggguggagcuuucauccucaugugcauaacauuguugccguggcuccaggcaucaagcuauauuccaggcaaaaaaagauaaagagcaaaugggugugagccaacugcauaggcucccuuuaagggacuuuuccugaaucccacugguacucucuuguucagauaauauuauguuaaaggagguccugggauuguucuuagcugggcacauuacugcccccacucccacuuccaaaauggauucugugaauaaggaagacaggagaauggauauccaauaggcaacuaacaaagugaagugugauuacaaucaaugaauagacugaauauuuuaauuaaagucuagaauuggagggcuuagguaagguggacuggaaaacaggaagguuccacaaaacagacuuuacuuaauuuuuuuuuuuuugagacagggucuugcucugcugcugacacuggccuugagcugcuggucucaagcgauccuccagccucagccuccugaguugggauuacaggcacaagccacagugcucgacuuuuuauuuaaucuuguuagaagacaagacagaaacauguccguugugaaaacaagguacaguacgugaugucaggguaagagucaugucugaaagcauuguggggaugauaagcaaucacagggucaucugcguggugacagggucaccacaaacuggcggugugaccucaggagguuaccuagggagguccuugggucucaugggucguaaaaugagaggauugaacuaaauuaucuuuaagaucuuucccaacgcuacaauucuaguggucauuuuuuuuuuuuuuaagagagggucuggcucuguugaccaggcuuaaaguacaguggugugaucucuggucacugcaaccucugcguccuugacucaagccauccuccaaccucagccuucagaguagcugggaccacaggugugcaccaccaugccuggcuaauuuuuuuuauuuuaaaagaugaggguuucacuauauugcccaggcuggugcugaacuccugggcucaagagauccuuccgccucggccucccaaagugcugggauuacaggugugagccaccacaccagggcaacuuuuauuuuaauuaagugaaauauuuuagacaaauggaagguuucauagaaaacagaugaagagcugggugagacagcacacaccuguauucucaacuacucaggaagcugcgggcagaucgauugaccccaggaguucaagaccauucugggcaacauagcaagacucuaucucugaagacaaaaccagccaaccaaccaaccaaccaaucaaccaacaaaaaagaucaagcagaggugcuccagaggacgcagcaauagaauuccggagcaaugucugcuuggccucggucuucauucccaugguggccccugaguuccguggagcucacuucuacauaguuccaugugugacuucaacaaaauaaaaugacgcauuuauugguuaaaaaucagagauuaccaucagauauggaaaauugcuuuuacuugguaauaacaaucuuacgcacuuuuuaccaaacccaucgcauuaaauaacuagcguuucaaauuuugacacugcauaauaaacccucauuugaaaugacuggagaaauacucaucaaaucucauggaagaaugacagaauuuucuccagaauuuaucggaaaggaaaagagguuggacugucaggaaacguuuucaggguaacauacuuacuauuuucuagacaguuacucagauaacacuuguacgcagagggaaacacaccccugggcuuugcaaacacuuguuuccugugugucagacucgccugcauccuguuuaucaaauggaacggauaguuauugaaagcaaagaccagaacaacuuaccucuugucagucaccugcuuuucuuuacuugucauacuuuuagcauuuacaaaguuuuaaaaauguguuuaucauuugguaauuauuuuuaaacuuuauuugaaaauauagacugaguucugaacaaauuauccuuaaauuucuuccucuaguaguuacacuuuucaguaucagugaaguuuuaugacgccucuauuuuuccuacccacacagcaucucaaguuugucuuuacagaauaacuggaaguccuagcuuuauccucucucugcguuucucucucacagcccccuccucuuggacucugcucuuccucucagcaccguaaccuuuuuaauuuccagauagguuuugaaaacaccaucuguuccccucuuaggaucccuggggcagaugauaggugaaccccacaucccagacacauggccaccaaagauauucuugcuuuuuuaauguuuaucaaguuccuccgcagacaacagaaaguaaguuuuauuuagguauuuaugaaagguaacacgcaucuuuaaaaauaugaucaugauacauuucgaaugagaacuguguguaaaacauacagguccuauuguuucccucgucguuuugucuuuucuucagccagaaagugauccgcugccagcgacagggagacacacaacugguccuuauucuaaagacccgacccagccuggaauggggcccggcgaggaguucuugcgccggccgcggggacugggcgguaaugagccgcuagucucggaagguggugcuguugggugugaggggagauccggcuugcgcugaaacagcgagcggcgugcaaggaggaagccgcgauuuccaaggcggauucccuucgcugggacacaacucuugagaauaagacuuauaaggacucugagaguuugaggcagaggcagaacggcucugggcugagugauggggaggauaccagcacucagcgcggguggcgggcgcggggccgagcgcgcgcauccagggacgccuuggggacgggacgcggagaaaaguugccgggcggagagaaaggguggcgcuggaaaccaaauggcuuucauccccuggagacaaagaggugccuucuuuugacaacagcugccagugacacacacaccauacggcggggccggcgggggaggggagcccgggaggagagcgucuaaggcggggaccggcacugacuuucaauaauggggugguugccauggugacgggccaggcaucuaaaggggcggcugaaagcacccauuguucuggggcccggcugcucggguugugccuguuccuaagagacaccuuuagacaccucccuccgugcaggggcgagcugcggcccggggcugggagcgucuccgcgggaguuucacaccagggccccaggccgcagaucgcagcgccgccuuggcugcacgcgcgcugcauacggagggcagcgccgccucccacgcacuauccgcccgaaauccgagcgcgacgcgcgcccgccugggcccagacgcgcaggccgggacacgcagcuccgccugcuccccgcugucccggggagacuucgaauaacaaugcggagcaggacccggugacuccacaaauaacucgcugaggucuggggcgagggcacucgggaaaaccccgcagucacuuugcagucgugcuggaaggaaaagcagaacggaaucacaggauaaagaagauuaaaaguaacagggcagcguugcaauguugcuuguaagagcaagcagcuggaaacaaccuaaaagcccgucccugggggcugggugaaugauauggggcgcaucccucugagggaacacuaagcugccauuaaagaguacagggcagcuguauuugcugagacguggaaauuuuccgguguauucuaaguaauaaagugcagaagagugugaguagggcuguguguaugugguauguguguuugcaucucuggaagugguugcuucuuaggauggucacugugggacuaggaguggaggagagaaagaaaacuugcuuuucaccguacuagaaucuucugcaccuuuugaauuuugccguuuauacuaugucuuuaccuguaaagaaaaaagaacuuugaaauaaaguugcauuugcuugaacacugucuaaugagaugugccacucuccauaaagcaucugaacucauuuuuagugcuuuaauaaauauuaauuuuuaaaauauauaugcacaaaugcuauuagcccacagauauguaaagguagugacaguggcaaguuagagaugaaaagauacacuucuuuccugccuuccuguggugccgagacggacggagccagcugucauucaaggagccugcuguauaacccaucuau

SEQ ID NO: 15555 - RNA, 11222 nt, Homo sapiens
guccaggcucuccgccuccgacucuacucucaccggccaugcgguccggggagcccccuggcucgccucuccaagaggccacaggggcugggcagaggggaggcacugaggcaggacagggaacagccucgagccuggcaccugcacccaggguccccagccugcaggcugccuggacuuagagcaccaaguucacucugggagacccugggugguccugacuucuaagaccuggcagauacauucacuagcccuacuccuuuccuuccucuuucacugaaagacaggccacagcuccuucuccugcagccgcagaaguccucaggagcugcgcugucaggcucuguacguacugcuaaauguuucuauugguuugcauaguauuuauuguuuuucauauacacaaggcugauuacuguacaguuuacacuuugaacacggacuaugauauagugcuugaagacauagaaaaccucuucucuauggacaugcuggugcaauccugggucagccaccggccugucccccaacugagagaggagacccuuucagaugggguccuggcucccuuugaguccuacagguaagccuggggguccucgccucagauucuuaagucccuaacacaaggaaccccgaaugcacucuucaagguaaugauuuuccauuggaagaugauucguauugaaauuggcagagagagagacaacauaaaaaauuccaauuuauccacagcagagucuauacagcuucagaagucacaguaaaaucuguguguagauucaguggaggcgagugguguguguguguguguguguguguccugaaugucauguagagcgaucugggaggagcgucaccagggagucgagggggugucacaaguggaauggagguauguggguuggggagggugggcagaugaggacauggcuuaagauuaagguguuaaacugauuucaugccuaguuuucuuuuuuuuuuuuuucuuuccaggaagcccacauggauuucugacagaugagguugggaaaaaguacccuguacgaagucaaaacaauuuaaaaaaaaaaccccaaaaccaaaacccauccccagccacaaaaagcccucauucacuuuugcguucgcaggcucuccugcgcuuguuuucuaucccucucucuccccgcuucuugcugcuuuuguguccugguuccgacagaucagcugucauugcaagaggcaggauugaagccuggaggucaugcgucuacagucagucauucaugccaagaggggacuagcaggagucccuuacagaggucaugccgucagcccagaggaaugugugcaccgcugcgguggcccucagguccagcucuccuccugugugcauggcagagugugugggguucagggguugggugucgaggugugauccugggagacacaaagagagaaggagucacuuagaaugcaaaagugcaacguccagcaaaaaccccacacacagaguuuugugcuggcagcucaggccgaaucugacucaggaaaagcagucuccccaggcagggcgaugugcugagggugcugcacuugcagcccgacuuccugagaugccgcccuccuucucuugcucccuaugcagaggcuguuccucagagccgccacccaggccucaugaauuccuucugagugugcaaguguuccaggaugccucucuguaugggccaaggagagcacugugcucugugcccuuggagaggggcagaggcccccgugccuacguggucaccuggggagacaucccccagcagauccuuguacuuaggaagagccauuuuucuugagccagggcuugugccaagaaggggcuaggugaggcuaggugaggccuucacuuucucaguucagcucugccaacaugcacugauguccgccaugcgccagccuugggaacccagggauggagcggaugugcucccuggccuugggagcucaugccucaagggugacagcuccccuucagcucuggcccacagcacuuccugaccgcugccucuggcugcucuccccaugccccucagauggacagagaucucugaaaagcagaugcauccuccucuccuccuccuguauugagucuuaggcuggaaaagagcagcuuugcuggaggaacuaagcccacauucuucagccugggauucgcagugagaaaccucuccugcccccauggggccuccagccuccaaccuggggugaaaacuccauguuuucaagaccagccacucauguucuaucugcaggggcccugggaccacuggggaaaggaggaugcuucaauaaggaggaggugacaaucucuugggcagggugggaagugacacagggaggcaggagcucauucggagguggagccauccccagacauagagcuguuuuggguccuccaggugaagggguuggggaggaguguuggaagggaguagggagaacucagcucuugggugguuccccagggaugggaggguggugccagguuccuugccaggggcugcuguagaacuguaaagccaggaacugcugcugcaguggguggacagugcugccaccguagagggaagaugcuuucaucacugcugggccaucacaucggccaagucugacugucuccucuaagccucugaacacgcucuacccuccuguucucugccuucggucacgcuucugucaaggcugccuuccauucucuuuucugcagagguucugccugccgcccucaacaccuccaccccacaaaaccuuccugauccuuccuggagcaggccccucuccacucuggaagcucucccuuuuguauuuuguaaaaauacaaaauacaaaaaagaaaaaagcugccuuuucuguucaggagauggcagagucgaguggguaagagcaugaacucuggagccagaccacccggguucaagucccaugcugccugaccucggucaagugccuuaccugcucugugagucaguuuucucugcuguaaaaugagggcaguaauagggccuacccauuagagaggugugauguuuaaaaaagcuaagacacauaggugcuuagcauuguaugaaugcaaacaauuacuuggcucucuagaaauguuaccgucucuguccaucugugcuuuuugaugucugcauauuucccugacuagauuagaaacacugagggcaagaacagccuccuggugcuccccacggugccugccccaagaagugcuccucaaauaagagaccaucauggaauaugcagccugggaaagacaggcuaggaucucccaucuacuuuaccgcccaggcacugagcagaagagaaaguucagaccucagagaucaugcuggcaugacugcccauuucaucccuugguaaacugagacucuagaggcacaguggcaagagcaggggugagaugaggaccuaggccaccucacucugcccaggacuccugcauuguucuggccucuucuccuggguccccucaccuuucaaaagcuuagaaaagagucucuuucauucuuuauuuuuauuucauuuagagacagagucuugcccuguugcccaggcuagcgugcagugguauaaucauagcucacugcagccuugaacuccugggcucaagcgauccucccaccucaguuucccaagaaacuggaacuacagguguaugccaccauguccagcuaauuuuuaaacuuuuuuuguagagacaggguccuaccacauugcccaggcucaucucaaauuauccuccugccucagccucccaaagugcugggauuacaggcaugagucacuaugcccggcccuagacagcccuuucacaaacauaaacucagcaaccaucauaaccauccuacaagggaaaugcuggcauuauugcuaguuuauggcuaaggaaccugaggcuuagggaagucauuugacuugcuccgagucacacuacaaacaagaccugcaauuguuugagucccagagcauauauguucuuauuuacucucuucacaucagugcucacaguuaccauuauuauuucuaaaccuuuuucuugaaguguagcacauucgaaagggacauuuucauccucccuugaggagacugaagcuuagggcgguuaaaugacuuaaggccauacaaccuggaagcaggaggaggccuugauucuagacucacaagcuccagcuuucacucucugaaacaaauacagccauuugccauagcucuguucuauaaauuagucgcuguuugaggcugugcacaguggcucaugccuguaaucccagcacuuugggaggcugaggagggcggguugcuugaggugaggagcucgagacgagccugaccaacauggugaaaccccgucucuacuaaaaauacaaaaauuagccaagggugguggcacaugccuguaaucccagcuacucaggaggcugaggcaggaagaucacuugaacccgggagauggagguugcagugagccgagauagugccacugcacuccagccugggcgacagagcgagacucccucucaaaauauaaauaaauaaauaaauaaauaaauaaauaaauaaauagucgcugugaacacggaauuagcaaauacugaaccacugcuccuaagggaaauacaagguuaggcucccaugagccucuggccacaauauuuuggucaacugaugaauacauaacuuuguguuaaaugcguuucuguuucaagacgccuuauguaauauauaggguugacucauuaacacugacuucaccaccacaagcacucuaacucaucccugagcagagcuuaucugauguccauucccuccuuaaggaacaucccagccuucuugcacuucgcaccagacagcacuucagcacugcccucaggggccauucuaaacaaugaaaccaaaaaugugaaaaauguggcacuacacaagcugcaaggaggacacuuauuuauaguaugaggcacagaggcagaguguggcauuguucauccucagcugggauugcacggguugggcgacucaaacuuucugcccuuguguguguguccaugaaugagccaaagcacggugagugccagcuuuggggcuacagauaaauguuagcgaguggacgaauucgcaaaugcagaauccgugaaugaugaggaucgacuguacaugcuugucggggaugcggauaguaaauuaggaagccuuugggcccucaaccgucuucucuguagccuuugcccugguugggaggguagggcauuuaaugcuguccccuaacccucugggacuuuggcaggagcuuuucuccgccucucccucaccacugcucucgccccaccgccccaccccccugccacccucacacuugucccugugccugucacugacagagggccaagugcugucccagagccaggcugcuccguguuucugacacccaugcuagugugguccgguccuuaaucaccugagguuggggggcuucagccacauugcagaucacuuacggcaaauuaaaaugaaauucaaggcucccuccuucccccuagccuggcuuucgggcugccucucucccacucaggagcauccauagagccugagccaaagagaaauuuaaagccacagccgccacugcuaccauaagaaaaauaagucagaaaaguguacuuuuccuuucccuuugcugcuuuuaaacauuauuugcaucuuuggguucuuuccaggacccaacagcagcuacucagagucuucuaaaccagcagccuagugggaccccuggcagugcagggguuaacacggugaccuccuuaagcugcugaggugucaggucuaauuuuauccuauaacuggaucugccaguccucuuuuuugcccaagugcugagauauauugggaagcccagagucagcacuuuugguggcucaggaggcagcgggcccugauuuuugccgaaugcagaaagcuagagccuccuugcugcucggucccagagucaggcccuggggugugaaugguaacggccugguuagugcugcacuggggccaccaugcccccucaccuccugcugacucccaccccgaguauccuguacugagcugccccgagcugggcagcaugaagggccucggggcagcucaguacaggaugccccagggaggauggagaucagagccggccgcugaagcccccagcaccacacacaccugcuggagauggucgcacagcgucuucaugucccuuccucauggcacggcacggcacggcaugccccugcucuguggccacacugccccaugcucacacacaugcaccacagcccaggccccggccccaacccugacggucuccugacuugcagaaagcacgucguccaccccuuaggccugucggcucagcccuuuccuagaaagcaagggagcaacguguuucacaaaacaccaaagagaagcuaagccuuggccuggugagaacuguagcugggcuccagguucaagagacaguccaguccucagucuuggagcucuuauguugaagcaucacagcccagaccaacucuccuguccucuucaaugcccuguccacugcuuucuagauccccauugcuugguuuccaagauaauauuaccacuuagauuuacagagugcuuuuacuuuucaaagagcauuuuuuucuuucuggcuuuuuuuuuucuuuuuuuugugauggggucuugcucuguugcccaggcuggucuugaacuccuggccuaaagcaauccuuuugccucgaccucacaaaaugcugggauuacagacaugagccacugugcccggcccaaaaggcauucuuacaaaaccgugcggucccugauaaguggauauuauuaacucuguuuccuugaugaggaagcugggguucagagccaacuguuagcaggguugggaagugagaaucucugccucgagacacaacaacaaguuguuugucccacaucaugcugggguggcugggaggggauagggugagacagggagcagccacuccacugaagaccaggccaugcagaggggaugagaagggcagcguuaccucccgagaggcuacuccaaggagagcggcucggggucacuguuucccccuuuucaggcuggcccgcuucacuaucugcgcccccuuccugcccucuaucagguccggcuguaggccacucccucucagcuccaccugcagacagcagcagagacagaaagcaggacagaucgcaaagacgggcagaacacaggcagaagaucgaaaggaggccacacggagguggcagacacacugcccaccagggagaagagagacuggagagagagcucauaaagaggugaguggagggaggugucaugcagacggcccggcagagcaaggcagcagugauggcgcugggucccccagggccgcgggcgccucaguaccuuggaguguuucauaaaguaaucaauaucgaccuccagcucacugggauccuccaggggccccucuacagucaccuccucgugcuccugggcggcaucggcgcuggacaagucuaucugucgaaccaccuugcgaaugaucuaggaaaggaagggaaggaggaaagggcuggucaggccgggcucgggggcucaugucuguaaucucagcacuuugggaggcugacgugcagaucaucugaggucaggaguuugagaccagccuggccaacauggugaaacccugucucuacuaaaaauacaaaaauuagcccggugugguggcaggugccuguaaucccagcuacucaggaggcuguggcaggagaaucacuugaaccugguggauggagguugcagugagcugagauugcaucacugcacuccagccugguugacagagcaacacucugugucaaaaaaaaaaaggcgggggggcuggucaagcccucaagacagagcuucagaacagcaguucccaggaaugagcuccgagggggagguagcuuuuguccuaggagccccuccuugagaggccaagaagagggacagccuuugccccauugcuuaauggaaaacccucugcuagacagcccugaaggggccuuggcagugucauuucaugaccaaggugugacugggugugaccucccccucgagcccacagccuucuguuuugcuuuuugauauggaugggaguuugugcucuuccccauucuacucccaugagccuaagggcagagggcaucucuuuuucacccacccauucccguauucaccuguccaaaucuucaaacccuuuacucuguaucugccgugugcucugagugggaggugaaacaucagugagacacugucccugccugcaagcagcucacagugcaggaggcaagacagacgcacaaggagccuugcucaagggugaugagagcugcgccuaagcagaagcacauucgagauccugccucagcuccuccucuauuuuacccauagcuagcaccgugccccacacuugacaggcaaggucaugucucugaguuaauaucugcuaccaauccaaugcauuuucacuuccuuuuaauuauuuaauuauugugauggggucucacucugucacccaggcuggagugcaguggcucaaucauagcuuaugcagacuugaacugcuggguuuaagugauccuucugccucagcuuccugaguagcugugacuacaggcaugcgccaccaugccuggcuaauuuugugugugugugugucucucucucucucucuguguguguguguguguguguguguguauuuauuuauuuuuuaaaauuuuuuuuagagauggagucuugccauauugcccaggcuggucuaaaugucugggcucaagcgauccuccugccuuggccucccaaagugcugggaucacaggugugagccagcacacccggcccacauucuuuuuauuugaggaggcccaugguaggccagggaugcucaaacugcuuguuuaacagcuguuuucaggguuaggcaucaugggacuaggucugggauguuuccugggggcuggcccuucuggaaaagagcagcagaagcuauucagguugacucagacaaagcgguugugaggacaccaugacuggacugcagaugaccaaagcucccagcuccugggcccuccaucccuccugagcacgggggcagccagccuggcugugcucaccugcugugagggcagcagggagaagccacuggcuucuaccaccuuuuagcuucuagcccaccugccucuccccagcacagaggggaacacucugcacccaccuucuuggugacaauguugcccugcucauccgugaauugcuccucugucaccugcuccccuggaauauucugaaacucauuccccuggaauuagagaaagggagaaaaugcaagauuggugagugggagucugggaggaaggguggaggacgaggaaaugaaacagcaguagccacaauagccauggcccaauaacucccccagcaggaaacccggcucagcauguagcaggagccaugccagggcucccagggcgugggcggcgccccugagggucugggaggccugaagacgaacggucgagcucacaauugugcacuuggcccucacaacacccccugggaaccugcaaaaugggggcaauuaugcaagucugacggaggaggcccugagagaggaagugaggcaccuguuuccuauuuuuacagcacuuugcaguauagaaaagcccuucgacaggcagcaucacccagaaugugacuugcuugaaaccccagagccaguuggugacagaaacaggacgauccgggugcaaucccaugguggcucacgccugcuaucccagcacuuugggaggccaaggccggaggaccacuugagcccaggaguucaagaccaauuugggcaacauagcgagcccccaucucuacaaaaauuuuuuuaaaauagccaggcaugguggugugugccuguaguaccagcuacucagaaggcugaggcaggaggaucacuugagcccaggaauuuacaguaagcccagguuacagugagccaugagcaugccacugcacuccagccuggacuaaacagcaagacuucaucucuaaaaacaaaagaaaaaagagaagagaagagagagaaagaagaaagaaacaaagaaagaaacaggaugagcgcagccucccgagacccaaagcugaguguuuaaugucacugucacaaugcacugggcaccagagggcagguucuggugggcgcacacacacucuggcucccaggguggaacaugaucccugggggccuccugguccuuuuccuccggcgucucccaacucuggguccggagcuccccacagcagcguccccucagccccggccuccggcgcccacaccaccagcccugccggccuccugccaggcgguuaccuucaggaagacccgccgccggaccacccugguggagauggucuccucgucgucacugaggcccucgcucucccccagcuccuuguccagcuccugguggaugugcuuuagcacaaagcacagggacccccugacaaugugcaucacguucugacagcugaccaggaagaagcucagcagcaccagcgugaccaacagcugggugacgaaaguccacauccucgccuccucaccagcccgguccucuggcagccagggccccggccaccacggggggccugccucucauucuccacugggacuccugagucccccagggaccccuugcauucccccucccuaucucucugguuugcucucuuggucucucacuguuucucucucugugggcaggacaccgaauggcccucucggcugaagcagcccggcccaagugcccuucugcccagcagccaggcucugcccugaguggcccgggugacaucacgcuccuauaauuuuaccuccccaaaccagcugccggagcuguccaaccgggcuagaaggaagccggcaggugcccauguccugagcacugaaagcacaagugaaagucacugugugagugacacccgcugcugccuaaccccgcccugcccagagaccuggaagugggggcucggccucucaccuauccugcccauccccaugggaacuagaaagaguucugcccagggaaaguuucuuacuuucagaaaauaauacaguccg

SEQ ID NO: 15556 - RNA, 20521 nt, Homo sapiens
uuuugcggcaggacguaagugacggcgaaggcggugcgacagcagcuggagggcagaggaggcggguuuguguuucccgggccgaaccggguuguggggggcgcggggccugggccaggcggcagcuaaggcccgcggugacagcaugggugaaggggagcggggcagaggaggccuugggcuguuuucggcggcgggugggggcgaggggcuggcgggucagagucccggguccaggccggggcucugacucgcgguugguguucccccgaccccgcagcgcgggguguccuguccucgccaugaggccgcagcaggcgccgguguccggaaagguguucauucagcgagacuacagcaguggcacacgcugccaguuccagaccaaguucccugcggagcuggagaaccggguacgcaaccuggcuccccacgccugcucuggcgagggagagagacucaccggggacgggaagggugugggcgacaaccgggccuuugagggucccgcaguucuggggagguccaggcacagaaggggccuuggccaaacguguaagaagagagccacuaagcaagacagguguuuggagcaggaagaauaauauaggccgaucgccgggguugacgaccuuauggaacuuuguugcccggugccgggaaucuggauccagcaguguuccccugcugcacucccccaaauccccaccccggguuauugucggcagcgaugaggagccaauuccugaggcuccaggucgucucagucaccagguuguaaacuauauccuccuaccucuccgcgcaagauaaaucaucaucauucucgugacugguguuugcugccucugugcuggccgcacuguuuggcugaaaggguuuauuaggugcauggccaggcggugcguucaggcuuucuuggaaccuuaaagacgucgggcguuagauaggccuggacaggaaaaugucucagaacaaggccuuaaacuugucacauucacugggagccaccuguuuugucuugcauaucaaaauggucaucaggauauagguccuuugggcaacauugcaggcaaaaauggaagaaugggauuugcuuccccuucagaccuagcaaaacuuuaaaaaaaaaaaaaaaaucauuguaucuuguuguagagguaauggagugugugcgugccugccuguguuuuugugugcccacauauguacauucaaccaaagauucuuuuggucuugacccauguuauguagauuguguuucccguucagggaucaauuucugguuagcuggaagcagguuuuguggcucucuccucugugacagggaggacgagggccugagaggugauuaggcauuccuugggugugggacugagagaugcuggucaugggauaaguggguguggaugagucuguguagagaaauguguagcaguuauuuacagucaguuugcagugagguggguugcacugcccgauuuccaugguugggaaaucaacaaugauccauuauaguuuccuucaguuugacauaaccaugggcagcuucauggcccaaauauguuucuugaauugcaaauggaucaaauaugccuuuaaaagauggugaggugacuuguuucugaaaugccauuuaaaugcugcaguauguugucaacuauguuaugaguuaacugagcgugacaauagguggaacuaucuacagugguuugaagagguagaaauucagcaaguggccaguuggguagagcuacugaauguuguuuuaaaauaauuuaacaucacaauugauguguuuuacauguuaagauugacauggaaucuggcugggcccgguggcucacgccuguaaucccagcacucugggaggccguggcgggugcaucacuugaggucgggaauucaagaccagcuuggccaacauggugaaaccccaucucuacuaaaaauacaaaaauuagucaggcaugguggcgggcaccuguaauccccgcuacucaggaggcugaaguagaagaauuucuugaaccugggaggcggagguugcagugagccgagaucaugccauuguacuccagccugggcgacagagcaagacucuugucucaaaaaauaaaucaaauaaaaagauauacauggaaucaaucaaauguuuuauuuuuaagccucuuacggaaacuaugacauacaauuuauguacuucaaaaucagaauauaaaguauucuuuuuuuaccacaauuauuuggacauuaaagauuccuuugcuuuaagguuuuaaagcaacacuuacaccucauauauuugagcuaaauguguauacacagaaucagacauuagccuuccacucuguguguggcagagccuuuauuuuguaaucuaagugcaaaagcacaauguaguuacugugcuccacugauucuugucaggaaauugauguuucuaaauucuggaguccuuuuaccucuuugacucuguauagcccagaacugcuugugguacugaguacuauauggaauguuacauggcacucuucaauugugccuuugaauuucuuuuuucuuuuuaaauguuuggguuaaaacacuagcuuaugcuuuaaaccacuagaaaagcuuugauugucuguguauguguguugagauuaaauuuaaauuacagguuuaaacuuuccuugcuuugaugaaaaauugaaagguuucuguuucucuacuacuuacccuagaaauuuuacugauugcucugcuauuggagcugauuuuccuuuugugagaacaucacacuuggcaacauaauagagaaagugacuaauaugcaaguguuuuguauuauuuuaaagcauuuuuuaaaaauacacacacauuugugcccuuuaauuugggaguaggauagguucugucuguuaacaaguucauuuucucugcugccuuuuagaauguaauacuuugaugcuuaagcgauuuguugccagaacaauuccuuaaaggaaacuuuauucucauuagccuuaaaauacagauaucuuaguuacccuuggucuggguagaagaaugagugaacuguaauugaggcauuuuuucccuuuaaaaauaugucuccccaucugguuaguaauuaccuuugaccugccacccuugauacgugaucacugcaugcuucaccaugcuuucuacuguguaguucacaguaauucugggaaaauaagccugauuucucuuuccauucugauuuuugauguuuguggguccaaauuuuauuuggcugugacuucucauauaucuaaauuuugauagagcuccuguaucaguguccaggaaccuaagggagaacacuggccacuguuauucauagccuaaagguaguaagauacaaaugccaacauuuguucucuugagcccuuucuugugaaguuugucguuugccuuuauugaugccuucugugauuuuuacccuuuauuucccuuuuuuaaaauaaccuuucaaaaacuuguuggcauuuacuuuucuuuaaccauuuauccuuucuuuuucuuuuuuuauuaaccuuuuuuuguuuguuuguuuaacugacguaugauuuaccucuaaccuauagggcauuguaaucucggaauaacgcauaagaauuaaguguuucuggcugggcauggugguuugcacccaaguaaucccagcugcucuggggguugagguaggaguaucccuuggggccaggaguucaagaccagucugggcaacauagcgauacucugucacuaaacuuaaaaaauaauaauaauuaggguuuccgggauaaacaguaauucugauaugaaagaaauaagauguuucuggguugaaucccaugguuuugaauuguauuguaaagaaauauaaauaauucaaugacuuauaacauaggcacaucaaaugugauuggaauuauuuagacuuuuguagacuuaucgguggacaaacugaaggcauuaacguaggcauaauuaggugaacguaacagcuuaccauuuuuguuugcugagcucuccucagucuguuuucgugaaugagaacucacaguuucccagaugaccagccuugacaccacaucuacaagggguagcucagugaagaaacacugccccugcguuuaaaggccgucuugacccaccuagccuuuguccaaaucucuaauauuccuggaaauuuaaaguaacuccuuuugaaaaauggguagagccaacaccacuuuaaaguuugcauuaaauucaugcaugccacuagcccauugacuccucacauuuuccacacaacggacaaaacaaugacuacaacugcuucuaacuuaaagaguugucauagcuuaaggauggucaugaauuguuuuacacuuuaaaagauuauguucuugaggccaggugcagguggcucuuugggaggccagggggguggaucacaugaggcuaggagccugagaccagccuggcaacauggcaaaaccucgucucuacuaaaaauacaaaaauuaguagggaaugguggugcacgccuguaaucccagcuacucgggaggcugagacacgagaaucacuugauccugggaccagagguuacagugagccaagauugcgccacugcacuccagccagggugacagagugagacucugucucaaaaaaaaaaaaaaaaaaaaaaaagauuacauucuugggaauagugaauaguagggcucauacuguauguugaggguuuuuuuucuuucuuucuuuuuuugagacagggucucacucugucacccagacuggagugcaguggugagaucucaguucacugcaaccuccacuucccaggcuccagcaauccucccaccucagccuccugaguagcuaggacuauaggcaugcaccaccacgccuggcuaauuuuugcauuuuuaguagagacagaguuucaccauguugcccaggcuggucucaaacuccugagcucaagugauccacccagcucaacuucccaagugcugggauuacaggaaugagccaccacgccagccugauuuuuuuuuuucugagucgguuucuauuauaaagaaagauuuaauagguucacagagacaggaaaggagaaaaaaaaaaagccaaacaaaaaagucuuuuaaauaaggacuucauaaaagagagaauucauacguaaguaguuauuaauuuuagaaauaagggaauccuuaugcgagagaaggccuagagugcagacagauaagaauggcaguauuggaugauugcucuccuaaugggccuugaaaguccugggaugaaguagcaaaauuugaaaucuguuauacaaaguacuauuagaagacaguaaaguaauauuggaagaauaaaguaaaagcagaugauugagugaaacaauggaugacaguacagguucuuucuuaugugaaauauguggaaccagaaguauuucaguuuuugggguuuuuuuagauuuugaaauauuuguuuauacuaaugagauaucuugggaaugggauccaagucuaaacacgaaauucauuauguuuuauauccaccuuauacauauaaccugaagguaauuuuauacaauauuuuaaaugacuuuaugagacaaaguguguguacacugaaccaucuuaucacccuuugugagcacgcuugcaugggagaaucuggcugugcauggaaaagauacauggcagcugaugggggcuggaagggucuuuuucucuuggggacacugaauaaacuauguguugugcgccugcauuuugacugugaccccucacaugaggucggguuuggaauuucccacuugugguaucaugucagugcucaaaaguuucagauuuuggagccuuucugacuucagaauuuaagaucagggaugcucaaccugugguaguauuaguguaaauuuaagauaauggugucaccaaauagaaagagguaauaagaaugacuuaaugugaaaaauuguuuauuagcuugagauuuuaccuuaacaaauuuuaccuuauuuaguaacaagauaauugcuucaaaagagauaggcugaguaaacagaauauagaaccuacgccuuuugauccuucugcuaaaaugccauuuuuuuuuuuuuugccuaguaaauuccagucuuuaguuacucaauuuaagauuaccugcccuucccagauaaagggaauuucuccuugcuuuuguguccccacuaggcuuuauauuugccuauaugauaguacccugucaguuuauugcuuuuuuuuuuuuuuuuuuuuugagacggagucucgcucugucacccaggcuggagugcaguggcgcagucucggcucacugcaagcuccaccucccggguucacgccauucuccugccucagccuccccaguagcuggggcuauaggcacccgccaccaugcccggcuaauuuuuuuugguauuuuuaguagagacgggguuucaccauguuagccaggauggucuccaucuccugaccucgugauccgcccaccucagccucccaaagugcugggauuacaggcaugagccaccgcaccuggccagcuuacugcauuuuuauguuuacauugccuguucugcuugcauaauuaaacucuuaaggauugagacagugcuuuaucuugagauuuuucauaguaucugauaguaggcgcucaguaagugugaaacuaaaugaauggaaagaggaauagagccuaaaguuacuugaaauuuaguagaaagaauaaagaaguaccuuauugagccuugaagcuauccaguauuuauaagagggauaaaauuaaacaaauuaagcaguuuugguaacuuaggcccagauuuagucaccaaaaaaauugucaacuaagaauggugagaaaacaagauaaauuaaugauagcaugcauuaguugauuuuuuuuuuccaaaacuuaauuuuuaaauauuuucuucucuacagauugauaggcagcaguuugaagaaacaguucgaacucuaaauaaccuuuaugcagaagcagagaagcucggcggccagucauaucucgaagguuguuuggcuuguuuaacagcauauaccaucuuccuaugcauggaaacucauuaugagaagguaaugcuacauuuguuuucacaaaaaucucuuaaaaucaugaagaaggcaaguuuauuacacauugaugcuuacauggugauaguugccguaaaauauuuaggggcauuuaucauucaaauuguguuguuccuguguacagaggcacauaguccugagucuuucaaaacagguugcaguugguauguccacuugcagaugaugugucaauguucagacuggccuacacuuaagaagaauguagaaaaucuauauguucucuuccuacucagcuuucugggaauguuuuuacuuuauuucccuaaauuucacucucuucucccaccugaguucuuacuuucucuuuccagcugccuacuagcucccgaauugcugauuucucaacuuaagaugaccagaagucaaaccucccaccuccccauuuugucaauagcaccccugucuuuucaguaccaucuuugggcaugagggaugaagaagagggaaaaauuaaucuguuuucaaagacugaaguaucuuucauuuucccagucauuaacuuuuugugauuuccucugccacuauccuggguuaugcccuuauucugucucuccuagacuauugaaauagucugacuugucucauuucuucccuccuuuugcuuuucuaaacuaucugcuguuguuuuuauaaagcgcagauuuacuuccccuacuacuucugccaagucggagaccuucccuggauucccauguuuuaccacugaguaaaauucaaggcccugcucaaguugaccucagcuuaccuuuccagcgcuaccucccauuccuuccuucacuuucucccucagccaaacuccaucccucacuggucagcaaacauacccacugugguucuccuccaccuggaaugcuaucuucccagguucaaaucccaccagucccuuaggucucacuuccaucuaacuuguucucuguuuuagucagaauucuuucucuucucuugugucccuacaacauuuuauuuguaucuguuuucuggcacuugccucacucuucuuuggaauguagcaguuuauuuucuugucuuauuugccuuucaaguauguacuuuucuugaggacaaugccuuaaccauuuuguaucccucuucaugccuaacaccaugcuuuggguauaucaggcacucauugaauguauguuaaauaaaugacuguaaauuaaucaugguaagccccugguauaucacuaaauucugacagugcuuagaaaacgaaaugcuauaagaauauauuaugacccaucugauagaaaugucuuacacuccauguaguggagagugcauauaguugcagcuaaaguuuuuggagcuguuggcugaaaaugcuguuguauucuucauuaccauccuguuccaucucauauaaacagguauauuuaaguauaguuauuuauauccuuccccauguugaaacaggaaaaguucucuugucccccucgcagggcgugugaugggguguggcuugcuucuucaguacccugcugcucaaaccucuaggagagcauacagaugggcaggcuguggggcuccaaccccacagcagugucuaggggugaauguuuuacagcuccugaagccccagugggcauauguuacagggugcucuuuuaguuuagccauccauaggcggcuuguguuagcucaauuagaccccugccuuaucacaagggcagagggcuuucuguaucccagaguucuugccuugguguaccagaagaaucggaucacaugugggcuuggagaaugagugcaagguuuuguugaguggaaguagcucucagcagaugggggagccagaagggagauaguuuuccccuggagucaggccgcucgaugaccgaacucuucuccaaccacccuggccaaacuccaccugauucugccaauugauggccuaccggugugccagugugcuccuacgccaguguguuccucuugacauccagccacccuguguguuccuccacuaaugugcaccucuugacauccagccaccuguuugucugccugcuggggucucagggcuuuuauaggcacaggauagggguguggcaggccaggguggaaaugcagcauuugggcaggaaaacaaaaaugucugucuucacuacugggcacaggccuggagguggagcgcuagccagggaccaugcccuucucuacccagcacuucccugccugcuucuguaugauuuaaagggaccgugcucuucccuuccauaucaauacacagagaagcuuucauuccuguuuaaacuuucaaaaucagaaguuaucaaggcucuaugucagcuuucagucuguuucaguguaucuccucucuaauaauacguucagugagugaaggcucaggggauuuguuugcucaguaacuauugaaagccuacuaugugcuaagcaaagugcugggacauaacggaacagggcgaacaugguugcugaccuuguggaguuuauaauuaaguggugaaagcugauaauaacaaggaaacaaagccagcaaaauuacacauuaugauaagugccuugaaggaaacaaacuggccuaugcuugaaaauaauaagcgggaccuaaucuaggguguguggucagaagaggccucugagguggugacauuuaagcuguugcaugaaggaugaaaagccuggggcauuaaggcagaaagaugaacauacacaaaggcccagagagcuugauggaccuugggaacugagagaaggugaugcacaggagaggaggggcagagaaugaugggagguggauuuggagagguaagcaggagcuguaacauggagugccuaguccauggaaugaaguguagauuuuauuuuuagugcaagugggaagcuacucaaaggauuuaaucaagagagugaugugaugagauuuucauuuuauuuauuuuuguaauagagacagggucucacuguguuguccacgcuggucucgaacuccugggcucaagcgauccucucaccucagccucucagaguauugggauuaaaggccugagccgcugcgcccagcaagauuuucauuuuaaagagaucucuuugcuuuguggaaaaaaggcauaagaauagaaguagggaaacuagucaggaagcuccacagaaguccaggcaagagugagauagccuggauuaggaagggagcaggggaggugcaaagaggugaccagcuccaagggauauguugauaguugguaugaauguaggaggggaggguaaagcugaauucacauagguagaaacuuuaucaucuggaaugacuauuuacagaaguccauaauauugcuaauuuaagguagaagcacaucucuugaguauuuuauucaugcuuagugaaguauuaaaaggcuugaguuguuauuacauuuguugauaaaauuuuaauuguauuugucaaaguguauuugcugaaauagaaguacugaugucauuuguaaaaagaaauugguaauugggugcuagucaguuuauacuaauuaugagaucuuggacaaauuaaucucucugaauucucucaacuauaaaauguauauuagaauuaauaauuuuccuuacaugugguuagugcuuaauaaacaguguuuucuugaggucgauuuuuuuuuuuuuuaauugagacagagucuugcucugucacccgggcuggaaugcaguggugcgaucccggcucacugcaaccuccaccuccuggguucaagugauucuugugccaguagagaugaaguuucaccauauugaccaggcuggucucaaacuccuggccucaaguaauccaccugcauuggccucccaaaguucuaggauuacaggugugagucacugcacccagcacucagccuuuauuacuuacuuuuuuaaaaaaaacuagagauggggucucacuauguuggcuaggcuggucuugcacuccuggccucaagcgauccucccgucucggccucccaaagugcuagggcuacaggcaugagccacugugcccagccaagauagauuuuaaaugaaguuaccuauguaaguuuuaaucagauauuugugaacucacauaugauuuuuuauuuucaaguauaaguaaucuuuuagccagccgcuaguuuauuugggugcugaaaacacuuagcagcucucaauuaaaaaccuuccaauuauuaaaucuuggaagaugguccuaaauaccagaaauacaauggaaauugguugaucccaguauauguuuuagcuuggauuuguagacauuguguaagguccuauuuuauaggucuaagcaaggccccuuucuuuuuauagagcaaauguuacaaagcaaauaaagaccaaauaaaauuaauccagaaaccaaauuuaaggcauggccacauuuuaaaaauaggugauauuuuguagaaacugaacauggauaauuagauugugcagaauuaauaacuggaaugaugauaguuaagauaugauauaccuauacuuuuaauagaagugugcauuuguguuuugauaaaaugauuaaaauguaagcacagcugcccucucccuuucccaguuugucucugaggaauuuuugugcuauuauuuucuacuuacaaaaggaugagguugagucauuuagucucuauuguuuuaaacaccgaaauuccuagucuacaaacaguaagccaaauauaacagugcuuauacuuugucauguguguuaaauuuuuugaaauuguaaauaggccuuuuaaaacucacuagaacaaucaugcauuuuucccuauaaugugcuauuuauugauuuaaaaugaagauaaagacuucaguguuauuucucuauuguugcuacccaugauaauuaggggacaaaugggcucguggaagguuccccuuucaguaucucucugccuuguucaugaacuagaaaacaucccuucugccuaugugcuguaaucucuagaaggaacacaggagagaacuuggguauguucugaaaacaguaagaugugguguuacuuagccucaaucaggccauuuuucuugaaggucuggaaggcuuucuccaguugaauauccucagggaggacaguaguuuuuccaagguuugauuguguuucacuuuguaaauauuauacaaauugaaguuuuguugaggauuugaaaguagcagauaacuuuguuaaauauuaugguuugcuuugacauugauuuaccaaaaauaauaaagugugaauaaaaugucaacauaugauuucuugggggugagaauggcgcuuuguccuuucugagauugugguaugaguuuacacauauuaaugcucuucugcuauuaaagagacuuuaagaguuuuaucguuuguuuuaauuuuuauuuuauuuuuauuuugagacuaaguuuuaaagcaucuuguuaaggacaguguugccuucaccacaauaguauaagaauauuuagagcuuauacaaaaaggaaaacuaauuguuuucuuucugaacugauacccaagugcauaucaauguuacuaaaguuuauaaaaaaaaaaaaagugucuguucauguccuucgcccacuuuuugaugggguuguuuguuuuuuucuuguaaauuuguuugaguucauuguagauucuggauauuagcccuuugucagaugaguagguugcgaaaauuuucucccauguuguagguugccuguucacucugaugguaguuucuuuugcugugcagaagcucuuuaguuuaauuagaucccauuugucaauuuuggcuuuuguugccauugcuuuugguguuuuggacaugaaguccuugcccacgccuauguccugaaugguaaugccuagguuuucuucuaggguuuuuaugguuuuagguuuaacguuuaaaucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagauaguuguagauaugcggcauuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggcauauucucacucauaggugggaauugaacaaugagaucacauggacacaggaaggggaauaucacacucuggggacugugguggggucgggggagcggggagggauagcauugggagauauaccuaaugcuagaugacacauuagugggugcagcgcaccagcauggcacauguauacauauguaacuaaccugcacaaugugcacauguacccuaaaacuuagaguauaauaaaaaaaaaaaaaaaacaaaacaaaacaaaaaaaaaacuugcccagcaaaguuaugcuugaaccagauaaaagaaugauguugccguuucuuugcucguaaccuguacucggagaaaggagacggaaagcuguucugaaggaauccuuucuuugaaaccagccaugcaggcauuuuucugagugucuucccuaguauuacuggacuggagugaagggagacugagucuccaguuuccaauucugcaggugaacugagaaggaaauuagaagauugagaggccuuaguugggcaccuuuaugggcuacuuccuucuauucauuauuuuaggaugauugacaaacucugaugugaagauagugccuaaggggguuuuuuugcucauaaagaccaagcacagcuaaaauucuuugaaugcugaaaauaggagaaugauacaugcauugcuucagguaauuagaugaaaaaaacaaaucuuuuauuuagaaauaauacuccuaauuuauuacguaagaaccaugcagauugcucuuugaauaaucuuacgcucuuuugaagaagcauaaaacaugagauuuuuuuauccccaaaaaauauuugaauaaaguguuuaaauuacuuuucuucaauuagaaaauucuuuauaugaaacagguagaguuuuaaauucuaaaucaguuuauaccaaagcaucuaaauugugacauccuaauuuguuaaguuuggucuguauguuauauaagccacacuuaaaucauugcuuaauuuccaacuuuauuuccauacacuucuuuuuucccuuuaaguugugaucacauuugugacuuuaucauuugcuaauagugugaauuuaaggaaauauauaguaauuuaaagaacuggaucaaagccucuuuugaacauuagagccagaaaaaaguuaugaugacuucgagccugaaauaaaacauguaacucuuugauuugggauguagcuauuaagauuuauuuucuucuagcuuaucugucucagaauugccuuuauuaaagcuggagauuuggcaauuuccagaaguuccuuuguauccuaucugguuuuugucuacauuugcuuugacuuuuacaagcuuaauacuaaacuuauaaauugagguuccugucuaggaaaugagcaaacugcagaauagcacuacaugcagucauggaaaugacauaagacacuuguauuuaucagaaacucccuggcagcuaaugcccacaugcucuacaaaggaaauaaacuucuuaguuuugaaauaauggggcuaccuuuuguuauaagcccaccuuauaucauuacuuuaaauugaugaacauguacaaaggagagaagcaguccuuuaaguuuuguaaaaggcaaggccaagaacuguccuugauuuuagaagaugucacauuaacagcacuuuaugaauaggaaaagagaagcuugagcagccauuguguauauaaccaucuguguguuucuccauaugcaggauugaggugacugagaaguagggaggaguggguugguucucaucgugccauuguaugcuuuugcauuuauuuacauugugucgaagauauuuuugacuggaagagucccucacacuuggcuguaugucauaugcaacucaugugagccaaguaaucacagcuguauuccaccauaugaauauccaugugacuugccuugaaaacgaauucccacugccuauuuugagaucucacuaacacuuaaagggaaaucugaugaaguuuguaagaagcugugguguuucuuucugucagguucugaagaaagucuccaaauacauucaagagcagaaugagaagaucuaugcuccacaaggccuccuccugacagacccuauugagcgaggacugcgaguuguaucuuuuuaguucggaucagaaagucuaaauauuuauaacaagaaaauguugauauuguuuggcauuggcuagagagaauuuaacucucauccuguauuugcccuagguaguuucugugugaauugcauaccuacuguaaaccccgugucuccaacauuuuuuuuuaaagcaugucccuccuuccauugcauggugcaggucucugugguuuguuuacuauucuugucaccaucuuuccuggugguucugagggcaucuuguaguaauaaugggggugguuugaguaaugcauuucagcugcagaaacccugaaccugaagccccuuugaaauggauaaacucauaauguguggugagacuugucauccaaaugaauugcaguuucauggguuuaucugacuaguugaaaucaguuacagcugccagauguguaauuucauuaccuuugacauacugugcauauuuuuagaggcaguaagcuuugaaaaucacuaagugaauuugguaaauaaaauugcaaaaaacuaauuuagcuugauaacuggaguaauggguaaauaaauuuuuuuaaaaaccuaggucacauaaucccaggccuuccagcugauaauaauuucagcaguuuuguuauacucugcaacaauaguucuuaaacuuucaggggucaugaacccuuucccaagaaaaaaguuuucauauaauuucaggguauuuuuaaaucccugaauucauuaccuccauggauucucaguuaagaacucccuaguucaacaaauaaagcaucguuuucagaauuuauuuguuuuguuuucaaaacauaaguuaucaguguuugggaaggaacuacauguggacuacuauaauuacauuucuuaaaauuuucagcaaauuggagaaagcaaacuuaaguaggaaaaauguuuaauaauugaaaaauaaagcaaacugaaagcaaagucugcagaucacacccuccaccuugccaagucccccuuuguguguuguguccuguaguguguuuucuuaacagccaugcuguuuagauugaaauuaccauuuaugaagacagaggcaugagcaguggaagauaaaccgaagaauuaaagguaaauaugaaaugauauggcuuguaugcagcuuuugcaaguuuagaggaugcaugaauauucuuccccgcaugguaaauaaaucauuaaaucacgcaguuaaauaacaguauauuugcuguguuagcuuaagcuagucacuguauuagcuugauauuuaaaauguguauucggcccaaguucuauuuggugauagagaauuuaauucugauuuuuuuuccugcuguauuguguucagacugguuuuguuguuacuuuggugggggaaugggggauggcaguuacuuggcuuguuuuaauauuucaaaacuauccuagacauauaaauacuuggguuuugcauauaagaaugaguucagagaugucuaccuauaugacaaauggcuuuaauaagcaaaggaacauuucagaggggaguggggagauucugaauauuucauuuauuauguuuaaguggcuucagaccccuguggaagaaaccuuaccuacugaguagaaacauaaauuucauuccuuuguuuaaaguauuaauguccuuaaauauccagaugcugcccuuuaaugaguaagaaacaaauuaauacuacuaagaaucucuaggcagagucacguugaagcccuaaguacuuuagcauagccuucuaagugacaggaaguagcacuucacuauuucugccaauuuuaguuacguggucuuccuacagaaaguguucugcugcugcgcuuuucuaguugacugugcuuauagguaucugucacuaauuaauagacagcacagacacagaauguaccaaagcagacacaugucuuccuagggcaacaucaauaacagcuaccauuuugagggcacguacuaugugccugguauuguacaaaugguacuucugaaucucacaagaacccuacaaaguauuuccccauuuuauagaugagcaaacuuggauacaaauagauuaaaugauguucucacagucacacaguuaacgaguauugggauaugaacccaagucugauugaucauaaaaccccugucuuuuacaccguacuuccucucaguacuugcagcagcaggaacauggagaaagggaagaguucaucagauaauucuagagguuuauccccuucucuucuuuuucaauacuuuaaaaaagaauacauuuugucugcuccuguaugauuuauucaauccuguaagccaugcaacauuccagagcugccuucuuuagcacuagugaaugugucaccugaauuccugaaagccaaagaucuaaaucaugauaucuauccucugccauauguuguauuuccuuaaaaaggcuuuguuuuggaauacuuaguguuacuuguccauacgcuuucucauguacaauuuucaaacugauacuucucaaacaaccagcaaccuucuguguggcuuuuguuccaugccaugguuuguauaucaguugcagcugcgaugacuuggcacagcccauuugucaugacucauuuugcagcuauuguguaaucauguguuuuucugaugugugagguuugagcaauuacacaccagaggcuaaucuaucaauauucaaauaacuagaauuuugaaaugggaaagauuuacauuaauaacuucuggauacccucuuucaugaaugcagauauuuuuguucaacacaauuucguuuugggauuuggguguucccaagguccaggaugcaaugugagcugagaucuuagagaaggggaggaaacucuaagcauaauuuauucaauucuuccauuuuucuucagucugcaaggugucugcaauuugaagcaauaugugggaauuagugacuuaacaaaagacuacacaaacaugaggauggccuuuauuuuuaaaaggagcuuuaaacaaaaaugccuuucuuuaagcuuaauuuuuauaauaucuugcauauaucuuuauuaucacauuguuauuguuacaugcacugguguuuucucucuggauuaagauugccaucuuuauauaaaauggaauacaugauuauuccaucacaacuagugauaauaaaaacagcuaauguuuguuggcacaucugugccagcacuauucuaaaugcuuaauuuuaaucaucacaacaacccuaugagguagauauuguuaucccuguuuuucagaugaggaagccgaggcagagagaacuuaaguugcuggcccaaggacaaacagcuaguagacagcagucaaggcagcguggcuccauggugaugugcuuggucagagaucugaauauauaggacuuagauuuguagacuauugagcuguagacucauuuagacaaaugguaccaagauauuuuaguagauaaaauucuagguuaguagaacauagaccacauguuauaagcugauaucaguugauggaagaaaaaugguuuuacaaguuauuuucaggaucucuaucaaaccuuuacuucucccucuaauuacagaucccacuuccagccgggccccucauguauccacuggccgaccgcagagugucccuaccuccucuccagagcaucauuccuuucuaucugcugccagagccacggugccauuuacuccaaggacucacuuucuaaaauuccacaccuggagugaccucuagucgcucagcauccacuuugugucuccaaauuguguaggacucuguaaucuuuugauuaguuucugagaaaacacaaugaagcacuucacuuuuuuuuauucaaagccauuuaauaaaacacaguuggucagcccagugcaaagcuuguuaucugccaccaguacauaccauugguucucuucauuccuugggccagcuucucagguggcuuuagaccucaacaagccguaucuucaccaguguucuaucuuguuccccuaaauuaauaaaauguuuuucuccaggauuuuggugaggguuggcuguggcugucguuuugcaccucccagauuucaaagaauuacugguuuuaccaugacucaaaucuuaagaucuguuucuacuauucaguuccucaaacugaagcuuauugaaaaaaaaauguauaauguuauuuguuuuauuauagcaauuaugccuaauuaaagcaguauuuaaugcaauuuccaguuauuucuuuggagaauuuuaugucauuguuccauuaccuugaauguuggaaagauaugauacgugcugcuuguucaucacaaaaaucaguaagcacaauaaaguggaugccaaaccaucagacacauaaauguucccgcugugucccuggauauggaauaagcagguauaaaaaauauuuuaauuauaguuuuguuauaaauauaacuuaugagaaaaaaauuugauaggaauaauacuguauauuacuaauuuuuaacuaucccuaaggcaaaccuuaugacccacagaauuuucucauauacaguauucagugcacagaaaucuuaugauuggcucaaguacaguaaguuacuucucaguaaaacucucaagucugaguccauauuuguagcucugcuuuuggcuguacguuccuaggaucggggcugcuuaugccuuucguuuauccuugggguuugagagcgcuguauuugggagagaguuuaaaaauacauuaggagagagaaaccauuaaaaguuucacugucagauauauuguaggugcuaauacuggauuucgucucagauuuaauuucuuuuaugggucuguuagucauucaacaaaucccauaaguauguguuaauauuuuaauuguguaaaacucauuuguuacuuuacagccuguaauagugugucugcauuuucaaccuguugcaauaacuuugcugaaauauuaacacauuaauaaaacuuuucuuaaacaaguugucucugugucauauuuggugggauuugguaguaaaugaugguaaagugguaaaugauaggacacuaaauuugucagauaauacuagaau

SEQ ID NO: 15557 - RNA, 1788 nt, Homo sapiens
cagagcaggcguggggagccagguugcguacccgguucuccagcuccgcagggaacuuggucuggaacuggcagcgugugccacugcuguagucucgcugaaugaacaccuuuccggacaccggcgccugcugcggccucauggcgaggacaggacaccccgcgcugcggggucgggggaacaccaaccgcgagucagagccccggccuggacccgggacucugacccgccagccccucgcccccacccgccgccgaaaacagcccaaggccuccucugccccgcuccccuucacccaugcugucaccgcgggccuuagcugccgccuggcccaggccccgcgccccccacaacccgguucggcccgggaaacacaaacccgccuccucugcccuccagcugcugucgcaccgccuucgccgucacuuacguccugccgcaaaaagccucuuccccgccccucagcucggccuccuaccucaggucugggacccacccucuccuccggccguaaagccacccugccgaagcugcgcgcuguggggcugggccgaggaagggaaaugaugugggcggggccagggccgaccccgccuuccgcccgcgcggggauuguuuccggaaggagagaggcggggcgagcuguggggcugcggccggggcgagcuguggggcugcggccggcgcgagcgcgcgggggugugaggggcggaguuucccggcugugucacuucccuagugauuguggcaggugguucccgaucacugauugugaggggucauuuucguucuugauuggacgucgcagcuuacguguggguuaugccacccaacucauacacaaaacaaaaaacaaaacauaaagaaaaaacaacacccccuccccaaacccucaaacacaaacugcucauuguguucagaaguagaaagcaggcuccaaggauggauccauuuggucccuagacucuugagaaagggucaggaagugaggacgaagaaccugccugggccccagcguugggcgccccugccccgacucuucuuugggggcggcguuccucucaccccccauuuccacccagcucccauccacaucccucaggugaccaaggggacaagugguuccgcccucguugcccacuggcccuuacuugacucagcauuucuuugcaaggcagccaaagaaaccccaccuuacccuugucuccugcuaauacaaccuguuaguaccacugucuuuuauauauuuaauauaguuuaaauauccugccuuuuaaauaugaaaaauucucuuacuguauuuuaaaaacagcuuuuucgagauauaaauggcauacaauaaaccacacauuuaaagcaguggauuugauaacuuuggacauaugaauacacccauaaaccacugucacaaucaagauaguaaagcuccauugcccugaaaagguuccuccagcuccuguguaaucucucccuccugccucucccagaccccauuucccaggcacugauccaccuucugucacucaacauuaguuucauuuccuugaauuuuauauaaauugaaucauauaguguguacccccuuuuuuugccuggcuucuuucacauagacuauuuugaaguccaucuguuguuguguuaucaauaauucauuuauuuuugaugcuggauagcuauuccauuguauggccaucccacaguuuguuuauccauucaucuguugauggacauuuggauugcuuccaguuuugggauguuacaaauaaagcugcuauggacauucauuug

SEQ ID NO: 15558 - RNA, 909 nt, Homo sapiens
gcuggagcacgcugaggauuacacguuccugucucugcgaccagaccuuucggcagcucggaccaacugugcuagcgaugcacuuagcaauuaucugcuggcuccgacgccccgcccucugcucuugcgauuggcucuccagucccgggcaggacugcauugguuucagccgaccucacucauugcuuuggcuccuacuauuaucuaagccaucaaaggaaauaauuccauguuucauugacaaccuguaaggcucuccuccagcccaaugugggggcaggaccgggaggccaguggagagaggggagaggaguaggaaaaugugggggagcggggugggggaaggagguggaggggagaggaaaagaaggagaaacuguggggggguaggaggguaggagggagagagagagagagauggagcuaucaagcaaucagauucuugcucuagcauuuuaacuuccacaaaacagagcccauagcaacaauuuucuggcuuuauuuucccccuaacugguaaauguugcugagggcagagagaauaauaacuauggggugucugccggcaugagacagacucuagaaagccgagcaagguugagggcugaagggauggaguaaugcuuuucacagggccacccuggaggacaugugaaggacauggcagauugcuuggggagcauaguaggugcauaccuggaguuuaucuaucaguacuuuaucucacagucccccucaucccccaaccugaggagacaauuuuccuuugcacccuguccaaagagucucagaagagcuauucuuaaaauccauaaaacucuggaguuucucacuguucucacugggagguccagaaagccgagcauucuagagugaaugauucugcugggacccucacuuugguuuauu

SEQ ID NO: 15559 - RNA, 6472 nt, Homo sapiens
ugccucgcagcucuuuuggaaugggccagcauuagucuaauuuuaagcgcuauguguuuuguacccuugcaaacuugcuuucucuuucuucuugcuguugcccuuugaaugaagccuugugugcuugcaugaucagacccuguaauaggaugaauuuccaugcacuuaacaugaagagauacaaaaagaaucuagagagagauauauauuuuuaaugaaauagaagcuuggcauagaaacauugauuuagauguuaugaguugcuggccagagauuccucagauaaaagagccuagaaaauugaguuuugagcgggcaugguggcucacgccuguaaugccaguaguuugggaggcugaggcggguggaucaccugaggucaggaguucgagaucagccuggccaacauggugaaaccccgccucuacuaaaaaauaugcaaaauuagccgggcgugguggugcaggccuguaaucccagcuacucagaggcugaggcaggagauucacuugaacccaggagguggagguugcagugagccaagaucgcgccauugcacuccagucagggcaacaagagugaaacuccgucucaaaauauaaaagaaaauugagugucccacccaaauuuuagggcguaccuccuuccauuugauaagaagaugcuauuuccagugucccugggagaauucuuccauccaguuuauauggugaauugccaccagcguucccuaaaggaagagagaacuuagcuuauuucugucugugacuuuuaucagcuagaucaguuaauuguauuuuuaaauuaaaaauuaguaacuagaggaagagacuaagagaacuauuuuuaccugaguaaaugcucuccucuucuuguguccaaaucuaaugcagaggugaaaacacuugaugagaaaauccuuuguggcuugaggggaaucauguuucuuucaggacguguuguuucccugaagucuaugucacacugagaacuuuuucugacugcacugcuuuggagcuauucauuuaaauugaguuuggccuaguuuuccugguauaaaacaggaaaucuacauuguucccucuuucucucccuuccaucccuuccccugccuuuccuauacacgcuggugugcuuuugcccucagaaauucuugguuugggaguuauguauuuuugagugaucgagguuaugacauacuuggagcggcaugauuucaagaagccauuccaaauucuuauagcuccuuagcucugguuuuacucucguauuuuccccaagaaaauuuuuuggcuauucaaagaaagcacaaaauaugugauguggaacucaugaaaauagggacuuuugauaucucuuuaaauauucccugacucacggaaaagauguccucuuuugguguauacauugugaaaaucuacccauuuaucucucucucucucuuuucuuuuaaauaaauuaucugauaaggccggcaagguggcucacgccuguaaucccagcacuuugggaggccgaggcgagcggaucacgaggucaggagaucgagaccgcggugaaaccccgucucuacuaaaaauacgaaaaaaaaauuagccgggcgcaguggcaggcgccuguagucccagcuacuugggaggcugcggcaggagaauggugugaaccugggaggcggagcuugcagugagccaagaucgcgccacugcacuccagccugggcgacagagcaagacuccaucucaaaaaaaaaauuaucugauagguuacuauugcuaaauuaauuggccauuauaauaagcugauuuguuucuuauucagcaagaucucuuuugagaaugugacaaauuaaacauacauagaauccauaugguauuauccugauaaagggaaacgaggacacuaagacugucaaauggaaaucuucuugucaauuggcaaacacuugggaauuccacauuagagcauugcuuguuuuuaauuuuuuuuuuuuaauuuuuaaaagacagggucucacucucuuacccaggcuagagugcaguggugugaucauaguucaucauaacuuugaaucucugggcuuaagcaauccucccauguuagcuucccaaguagcuaggacuacaggguugugcuaccacgccuggcuaauuuuuaauuuuuuuuuaucuacagagccuggcuauguugcccaggcucucucaaacuccuggcccaagugauccuccugccuuggccuccuaaaguguugggauuacaggugugagccacugcaccuagccagaacaucguuaauguaguucaauaugagauaaauuauuaucuucaaugaaacaagcucuaaaagcauuccauuccuaaauuguauuucaaacuuccuauuuuguugauauuucuuaacuucuggccaguuuuggaccauaaucuuuuaaugugaaccaaagaugguacguauuugaccaaagcaguuaguuuuaaauguauaaaauugaaccaaauggaaaaaauagguuggggaugcaguauagauuagugacuaagugcauaggcucuggaguaaaucugaguuuuuuuuuuuuuaaaggaacuaaaaaauguacugcauuuucuuuguggaauaaaagccuugccugaguugugcuauuuucauaaggcuuuugaaguggucuugacccacuguguguaacaguauuucaggugguccuccccauggcugaauaaugccauccauuauucuuuaauuuuuauuuuuagaaacaguguuucacucugucacccaggcuggagugcaguggccugaucauggcucacugcagccuggaccuccugggcucaagugaucuuccugccucacagccucccaaaguacucagauuauaggugugagccaccacgccuggccaccaucuauuacuuuugaaaucuucaaaagacuugcuuacucaaugucagcugaugguugguaaaaauaauuuggccuuuaguguuaagugagacaucauaaggguauugagguauacauuauggagauugaugucaggucagaauauuggaguuauacaucuauuucugaguugaauacucagcucccacgagaaagaaaguaguuuuaagguccagcuucuuagucuacuugaagcaaauuuuuuuucuuuuauauuucugaauauaaauauacucuuauaugggcuaaaaagaccccaugaauaaauagcagguucaguaguugaggaguggaguuuaguagguuuguuuucaguauaaauuagauaacauguggaggucacagcauuuuggaaauugaguguccccaagugagcuuuguuuauaaacuuucaaaaugucggaaguggacagguuuguuaaaucuugucugccagcacccuuuucuuccuuuguuccuuuuccucucuguguuauugccugcggcagccaguccuucauacuagauagaguucagauaaagcaaacguuuggcaaaaacauacuguuugaccuccucccccucugcuuaugaagggguagcaugauucuguguuuuaaagcagugauguuucagcugugaaaugcacucgcuguaagcucuaggcugagugcauggaaacuguuacgcuucucauuuuaugugaucuccuaauugguauguagcaaaaauuuucuaaaacuguuuuguggcuuguuuuguaauaaaaccaugugaaauacugaaauauggucauguguuuuccuaauacugaccuucugaccaugggugggugagcuuucuuaucagucugcccucauugucgguuuuagggauuucaggagguagguuccugcuccggguagggcuagagaccuuccccucauugccugggggagaaccuggcuccggggcgccgacgggggcgggugguaggggauguacggguguguauaugcagagguaugccaggcucugccccuuaaaguuugggggccggcggaggcggcgccguggccgggagaaagugucucucauuuaggaggguuugcagguccagaguaaagucacugaagaguggaagcgaggaaggaacaggaugauuagaccucagcugcggaccgcggggcugggacgaugccuccugccggggcugcugcugcuccuggugcccguccucugggccggggcugaaaagcuacauacccagcccuccugccccgcggucugccagcccacgcgcugccccgcgcugcccaccugcgcgcuggggaccacgccgguguucgaccugugccgcuguugccgcgucugccccgcggccgagcgugaagucugcggcggggcgcagggccaaccgugcgccccggggcugcagugccuccagccgcugcgccccggguuccccagcaccugcgguugcccgacgcugggaggggccgugugcggcagcgacaggcgcaccuaccccagcaugugcgcgcuccgggccgaaaaccgcgccgcgcgccgccugggcaaggucccggccgugccugugcagugggggaacugcggggauacaggugagccgcgggggcgcgcgcccucggaacacuuucuaacucuggaggagcguaaaggaacaagaccucacugagaccgcacaguucgcgccugguccuccugcgucauuugccuccuggauucgacaccucuguguuccugauuuccuuuccuccuuaacaggggcucuuuaccggcugcuacgugguuucucccuccccaugcaccuuuugaacacugucuugccuuuaacauuuuuccaacuaggauagcaggucugguucccucgaggcguacucuugagccaguauuuuuucauagggaccagaagcgcaggcccgcucaggaggaauuacaacuucaucgccgcggugguggagaagguggcgccaucggugguucacgugcagcuguggggcagguaaaggaggaggaggaagaccuccacugucccagcuaaugguuucugcgugccuaccugcuccagacccuucgcaagcgucauuuaauccuaaaaaaccagugaggaaacugagacguaaagagguugaauaaccuguucaaggucauuuaaccaaagagcagaggcacaaggaugcugacuucuaaaucccagcucccccugcccacuuagguggcuggugcuuuuucccccuccugccacagacaaaauuuaaggucagauauaagagcuaguaggcaauuucuuuucuuuuuuugagacaaggucuugcucugucgccagggcugaaaugcagugacagaucacggcucacugcagcuccaucugcugggcucaaguaauccucccaacccagccucuggaguaacugggacuauaggcaggugccaccauacccagcuaauauuuguauuuuuuuguagagacgaggucuuguuauauugcucaggcuggucucgaacuccugggcccaaacgaucugccaccuuagccucccgacgugcugggauuacggguguagccaccacauccagcuuaguaggcauuuugguugugaucuugcucagcccccacuuuggauacaaggaaauccagacccagagagcaggguuaauuuguccuauguuacuauguuacgaggccaguuggcgguggaaacuaagccagaaucagagcccuuugauucucuccugccuggguccuugauacugugguaagaggcugacuuuugccucuaguauuaggauuggguucagucuuuucgcagcagagaacccaugggcugcuacacuaaccagcucugaagaagcagugucccuggaaaaggagagcuggaccccacucucaaccaugcucacaagagauggcuggggcccuguaccugccaaguccacugauacauggagaaaauuuacgcauagccagggaaaagugaaaugucugagaaaacugaaggaaggcuggguacgguggcucaugccuguaaucccagcacuuugggaggccgaggcggguggaucaccugaggucaggcguucgagagcagccuggccaacauggugaaaccccaucuccacuaaaaauacaaaaauuagccaggcgugguggugcaugccuguuaucccagcuacuugggaggcugaggcaggagccugggaggugguugcagugagccgagauugcgccacugcacuccagcuugggcaacagagcgagauucugucucaaaaaagaaaaaagaaaagaaaagaaaacuaugauggagguauguuuaauaagagugagguucccaugacucagauuauauggcuguauccccuaacuuucuugcccucuguuuacacuauugucuuguggagacagguuacuucacggcagcaggcuuguuccuguguacaguggcucuggguucauagugucugaggacgggcucauuauuaccaaugcccauguugucaggaaccagcaguggauugagguggugcuccagaauggggcccguuaug

SEQ ID NO: 15560 - RNA, 73409 nt, Homo sapiens
caugcucugggggcaggaagggagucuucgcaucacaccgaaaaagucccaacgggcacgguguaggcgccuguggucccagcuacucgggaggcuggggcagaaggaucgcuggacccaggaggucgaggcugcagugagcuaugacugcgccaccgcacuccagccugggcgacagagccagacccugucuugauuaaaaaauaaaauaaaauaaagaaauuaaaguccuuauaacccugguuagagcguucccgcccacuggucucuuagggcacauuuaggacaaccugaagaagccacucuucuugggacccuaacccuuaccccaacuccucgguccccaaaggcuaagggcucgggauccgaaggaggcccagcugaggucgcuggguggggcucugggaggaggaaaugggguucuugagggagcucgcgcuccagcucgccuccuccugcgaggacgcccccugcccggacaccugcugcccgagcgagcgucggggccgggccuccccgcggggcagucucggcgcgcaggucccaccugccaggcgcggaacgcgggcggccucgggcgcagccuccgggcgccccgcccccgccucccccgcgcggccccggcgcccggccgcacccccucccagcccgcggcgccccggcaccccucucccuccccggcgggcuccgcggagcauuguacucacauccggggcuggguuuugcuuuaaugcgaaacguaauuaacccggaaaaaagagccgagggacgggagagaaggagggggcacugggggagaccagagcgaggggagcgagaggcgcggagaguuuggcaggcagacccagaaaucccuggagcgcggcggacccggcggccggaggggcgaccccgcccgauguaacgcgccccgcccgagccccggccccugcacggggggguaaguugggcgcccucgcgggcucgggaguggagaggcgcagaggggcgcgcgggggcuggcggggcugggggugcagggggcgccccggcggaggccuggcggccuaggggcgcgaggggcgcgcgcgcagggcugaauacgccgguccuaguggcugacaggcgaggggagguggccgcagacccuggaggccuccuccaacccucugggagagccccgagggcagccccuccuccaagugccccggguggccaaggucgccgccgccaggggucgggcugcgggggguggggccgcggagagggugggggcgggaguucugcugagcugcauuuucucacguuugcagcagcgaaacuucucugcggguucuggcgcuggggcaccgaccccgcaacgacugcccgggcugcgggaggggaggagagcagagaacguccccaggcaagucccuuggguacggauugggccauggagacuccucuuucacucccccgacuaccuuauuaaaugacaggccuagaaggcuccccuagggacuccuguccuuuccucugggugcagccuggacuucgggcuucuggaacuccagacagugaaaaggacugcccuaaaaugcagguucggugccagguugggugagcccucgaggggagcugucguucucucucucaccaacuucuuccucaccuuacacgcuucccuuuucuccuccaguccuaaagacgauuucaccaaaauuuuuuuaaaaagaaagagaaaagaaggguguggggggggguggugggaagcuaggccguuuagaagggaaaagugucccugcacgcccagagaggggcgcagggcccgcugcggccggagcacccucacaucuccuccccggggccagcccugcccccaggcccuagccuuaggguuuggcuuccuuccuucuuggugaacgcagguucaggauguaucuuccccuucucauuccuucuuccugcccgcccccuuucuuucuuuagggcuccaagugggguuuucagaggacaguaaacggcagagaagagggaggggagagcaccccaccagaaagccagcuguggcucugggggcucugaaggcugagcuguagaugcacuuggggcugaagucccaagauugcacuaaugguguucuuaaucuaucugaccaagucccauuuucccuucuuuugucauuuuuuuucuuugguugcgaagccuuccgaaacagcaaagcaaaagaucuugaaagaauagaaguuuuugcuuucuauuucaguugcauucaguugacauguauuauacaugcaaggcagugaugaacaaaacacaaccccugucuuuauuuuuucuuuuuccuuuaccucuggagggcuggacccugucuuuggcgagcuuacaggacuuguaagccccccacuuguuuugagaagccagaguaagcuuuuagaaagcaucaucaucaucucagacauuagcccucuucaccaugugccgccugaaggcagaugacuuuugcacuaucagaggucuagcuuguagucuagauuauggccagcccaacguaugacauguaccaggugcuaaguaaauguuuauugcauuaaugaaugaaugcaaacacaugaauuguuugcacuuguccaaauggcagagaaaagagcagugugguuguuccucaaaccuguagggauuugguucuccaagcugguacaugggaguuauuaguccggauguugccuuuacaccuaaguauccuuugacccuguuuguacauuacagcaugcuuucuacaaauugucuauggcacuccuagugggguuuuagcuagcugguaaugggagccuugcucauuucacagauugguaauuaccuugguauugauugagaaacugccugcccuuuggugaagaguuuuugcaacccuuucuuuuuccuugucauuggugcuuucuucucucuucuguguuaaggaaauagggccugcagaucccaucaugucaugguagugagcugaaccauauucagcucgguauuuuugagugguuaaaauaaaucuugaagacaugcagguuuugguuggugcagguuuuuguucugcagaagugggaaggggaaggcugaugagcccuaucagcugagccccagagcagcccucccacuaccuugccaaguguuugccgaagugcuaggauacuaggaagacccaagcagcguuggucuccuguccaauucaugggacagauggacaggugggugaugccccugcugaaaggcuggaugacucagaugagagcuugcugcagaccacagugcaucagaauaucucuucugauucacggaaacugcuguggcucgacuuauuccgguugugauagaccuagggcuuggaaaagaggaucugggugcugggacguuggguugcucugcccccucucuuuuuccaccaugaacaguuuggguugccuuacuuuccguuuuccaucugucucagugagcuggaugggacuccagcaaucuaaucugguaggcuuuggaaaggaaggaaggaaagcaaauauuauaguguguuggccuaugggaagagaagaacccuggcccugccugauaugagcccauuauugagaugggguauuggacaggcgggggagauagggcagcugagaggugggagggaugcggccccauccugucaguagaggaggccggggguugguguagugagacccuacuguuccuucugaaagccccuucccugcccugaccccaguugacugaagugauuuguuaugcauuaaagccggaauugggcuuucucacuguggaggucccagcccugcuggggcaggggcuccugauauugcccagugugggcaaaaggcuugggggcuuuggcccuguggugugccuuuugcccacagugccuggucagcugagaugaagaggaugggaagcuggguccucuuguccuuaugcucuugagaagcacugcaguuaaagugcgaaggcugggacucaaauuuggcuggccccuugcaaagcagcucucugcugguaugauugcccauggcuggaucaagaggcagcuugccuuggaaacugacgagcaugucuagguuucuguuaacucucaggguagccuggccaagaaggagucagcacauugccuggacuuuuuguuuuaaaccuccuggagaauuuuuagagauguaaaaugugguguuucuuggaguagagggaagagugagggaagcugaugccuuuccucgugagaggaaucccagagucgcagcuuuuucauugacauuugcucacuggaguuagagggauggaggugcgcaugcagcagcugccugcccaguguuaagcaacuuugcaguaguaaugaugaccauguacuccuuguuaggcacccacacaugcaguuuaacaacaacaauauuuacccaaugucuggguguccagcacuuuucacacauuauuucauuuaauccucacagcagccuuugaaguagguaaagcaauuaucuccauuuugcagauuaggaaauagacccugaagacuuaagcaacuuuucugcguuugaauccaggucugucuggcucaagacucaugcucuuucccuucacuccacugcauggaugggauggguaacugaaaucagcacacccuuuugaauggucaucuucuugcaaaaguucccucaaaaauacucauauuggcuggaugccguggcucaucucuguaaucccagggcuuugggaggcugaggugggggggaucacuugaggcuaagaguuuaagaccagccuggggaacauagcgagaccccaucucuacaaaaaauugaaaaauuagcuagcuguaguagugugcgccuguagucccagcuacucgggaggcuauagcaggaggauuuuuugaacucaggaguuugagguuauagugagcugugaucgcaccacugcacuccagccugggcaccagagcgagacccugccucuaaaaaaaaaaaauuuuuuuuaaauacucauacugauuauugucaccugcacauccuccuuaccacacccagccccuccuccuucccuaaaucaagagacagaagcacaugucuuuagaggaacagagcuaggccauuuacgcuccccccucaccacuccccugccccacccccagcacuuagcaaaaggccaguagguuggagaaauuauguuuuuuguguuuuugcuuuuuuuuuuuuuuuuugagacagagucucgcccugucgcccaugcuggagugcaguggcgcuaucucggcucacugcaaccuccaccucacagguucaagcaauuuuccugcuucagccucccaaguagcugggucuacaggcgcaugccaccacgcccagcuaauuuuuuguauuuuuagcagagacaggguuucacuguguuagccaggauggucuccaucuccugaccucgugauccacccaccuuggacucccaaagugcugggauuucaggcgugagccacugugcccggccaggagaaaugguguuuucuuuucauucucuuaacugcccauguauuaguacccuuugguugacaucguccauuauaaaaugaagauuagaguuccaggacucgcagcuguuguuaggaagcccaauagugaaaccgaauucauuguggggaaacuuucacaauucugaaaguuggagaucucagcuuuuauaggcuguaaagccaguauggcugcgugccugcacuggugcccucucugguggagauggucugaugagccuucagccccgggcaggcuuuuguuuccugcaggcuccaacaaccacauuuucuuugaauguagaugaggcugcugugaagagaggucaugagugucugaaauauuuuguuguuuuuggcaucuuuauugcagugguaucaauuuccaguuacuccugccuuacaccccuccccccauauuuuuucaaaaauuccuucuugaguaucucuugcucucuacuccaaguucuaggguccaguggggauugggcuaucucagggucaagccagcacccugucugauccgccccccgccauuccuguacauguuugcauuccucacccugcacuuccucugggaacuuguucucaguacguucccuucucucgcacuuuauucucccgccuuacacuauuuggaaucugcuaucaugacaguuucaaaaugcggccauguuagagcaguaggaaguggaggcuuccacacuuccuaaguuauaaucuuugacccauucucagggauguguucucaaauagccaugcuugcauuuugcuguuguuuuuacuggguuuguacauugcgaaggcucugguuggcuucacaauauaucuugauguaugcugcaaaucugaacauauaugaacucuguugacaugguccguauguauucuagcaacaggugagugacugcuccauaucucuauaccucaguuccugucugcuguauuucauacaguccucuuugagaucucugauguuauuucccaaaaaacuuucuccuguuacccaguugagccauuucugguugguagaaccucagucacuacugaagcugcugccugcagcuucugcccugguagggguaacaggacagaagauguacguaccacacgccccacuccuugucaaaaagcaccuuuugaauauuuucuggagcaaaaucccagaaauuccuuguccugcuaacacagaaugugaaagaaacaucucuaaauuuuaaaaaugaguaauuuuuuucucauuuuugaacugagguuguaguaauuuuguacuucagccaauaccacugaaggcuuuaucucuguuaucacuuucucuuauuauuuaucucaaaaaugcuaaaguagucaggcagagucucccauauuucccucuauucuuuccucugucuccaaauuauguuagccaucuucaaaaucaagagggcuauucagaaaaccacagcucucauuacuuaauaccuuuauagcuuuucuuuaaaauaaaucuaucuggcugggcacaguggcucaugccuauaaucccagcacuuugggaggcugaggccagaggaucacuugagccuaggaguuugagaccagccugggcaaccuacaaaaaauacaaaaauuagcuggguaugguggugcacgccuguagucccagccacucaggaggcugaggugggaggaucgcaugagcccaggagguggaggcugcauugagccaucauugugccacuguacuccagacugggagacagagugagaccauaucucaaaaaaaaaaaaaaauuaaucuauucaucuuuucacucauccagccagccacuuauuuuauguauguauguauguauguauguauguauguauguauguauguauuuuugagacaggguuucacuccugucacccaggcuggagugcaauggugugagacauuggcucaacugcaaccuccaccuccugggcucaagagauucuccugcccuagccuccccaauaguugugacuauaggugcacaccaccucaccugacacuuauuuuaaaaugucaguccuaucucccaaguuucaagaaggaaaacuccacugggcguuccugucaggguccccauuuccuuuucccagagcacuuuucaagguacagcucauguguuguaggaauagaggaauagcagcaucgacuugggacugaguauucuguuggcccgaggaccugggugcuucuuaagaccagagagcaagggaccacaccagcaggagaaagagggaaaggcgcucagaggauguugccauacgaaguaagaaacccaaacagcuuggagggugcuaaagcccucugggcagguagauaucuggcucuuggaugauugugagaugugaaacauuuauuuauuagguuuaggucuuuaaaacaccaaaaaguuccaagagagcuauaauuuagggaaggccuuguuuguuuguggacucuggagaauugagaaauuuauuaucagauucaaaacuuauacacuugggugggaaucuguguggaauuaaauagcuuucucuccugcuaaauaaaguaacacaugcucccuguagaagauuuggaaaaauauguacaaguaaaugaaauuccacucauagcccguagauaauaacuuacuguuuuggugacuauauaucugguuuuaaaacagaccguauauaggaauauaagaauaauauuuggaugauugagaucauauuauguaccauuucauaucuuuuaaaaaacuuaugauguggugaguuuuccccucauucauuaaaaauaaccugaaaacagaguuuuugaauuauuguguaauauuuccuugugaguauguccuguuguuuauuuaauuauuuucugggccaggcgcgguggcucacgccuguaaucccagcacuuugggaguccaagguggguggaucaugaugucaggagaucgagaccauccuggccaacauggugaaaccccaucucuacuaaaaauacaaaaaucagcugggcgugguggugcacgccuguagucccagcuacucaggaggcugaggcaggagaauagcuugaaccugggaggcggagguugcagugagccgagauggcgccacugcacuccaaccugggcgacagagcgagacucugucucaaaaaaaaaaaaaagaauuauuuucuaaccauuguguuguucaggacauuaccaguuguuuguuacuauaaauucuauugcaguugccaucuuuuuacuuuaaucuuucuuugcaucuuuguugauugacuuggauggaauccuagaaguagaaucacugggucaaaggguaugaacauuuuuugcuuucuuguuauauauauacaacuaaauugcuuuccagaaagguucauaguccuguccuggguguauaagaauccuaggaacauuuuucaaguagacaacaucuguuuuaagcagugaucuuucccuuucagccccucuaugccucugugucccaucugggcuaugugcuauuuucucagggucugggucccagcugucucuuguauauuaugagccuugcaaaguuauccauugccucaguuccucggggcaauuuuuuucuuggcuugaaucuccacugguggaaccuaaggcaugggaaugggcaguagagagauauuuggggcugcaauaccucccagugccccccauuucauucucuggcaggcagccauugacuuccuucucaugagcugcuucuagucaacuggcaggugucggccaggaaucucucaguuuaauugccauuuaacacacuuucugccacugauuaaugggugacuccaugcaaacucacuuucuuuccccaaguuucacuuguaucauaaauacuuauuuucauucgcaguacauacuuaagaacuuauauucuacuuagaaaucuggaucauauaaaacuucccacuuuuuguuuuucuuuucauuaaaauacuuuuuuuuuuuuuuugagauggagucucacucugucacccaggcuggagugccauggugugaucucggcucacugcagccuccacuuccagggcucaagugauccuccuaccucagccuccugaguagcugggaccacaggcaugcacuaccaugcccggcuaauuuuuguauuuuugguacagaugagguuuugccauguugcccaggcuggucucaaacucuugggcucaagugaucagcccgccuuggccucccgaagugcugggauuacaggcaugagccaccaugccuagccugaaauacaguuuuuaguuacuggaauaauaugaggcuacgucuugguuugguuugguguuuguuugugagagacagagaagagagggagagagagaaugaaggagagagggagagaaggacagggagggagacagaaagagaggaauucuguaugcacauacuuuugauuugcuuuuaaugaaguucaggaaaguagaugaaauaggaaacaaacauuuaaaaaacauucaaccucacuagaugucauuauguauuugaaaccaccaauaguuuaaaauaaugagaacauucaauauauguaagauuauagugaugauaacaauauauugcugguugcaacauagauaacaucuuuuuagaaaacaauuuuguaaaaggacucaagaauuaugaaagaucauagccugugaucucauauuauuacuuggaauuuaugcucuuuccauguaaaagaagaaauaaagcaugaaaauacaaauuuuagccuuauguauaacagugaaaaauuggauauaaccuucaauuuaauuguagagaaaugguuauguaaauuauaguaaaaccaguccauuaauguuaugcaaccauuagaaacgauuauaaagacuauguagcaacauggaaaaugcuuaugacaucaucuuaaguuuuaaaaaggccaauuauguggauagggacaugaaaaagcaugcaaaugugaaaauuguuggcuggagugauuguuaaaauaauuccagcauuguuauauuaugauuuuugcacuaaacccagaaaacacgagggagguuuggcuagggaagauagggugcugaguggguuggauagaggccccuucucuuacaaauacccugugugcuuuguuagcuguguguugugaaggccaggaagcuacuugccagauaguuucauuacgguaugagagcaaaggugaagggaccaucuagagacagggguaucuagagcucuaacccagcaugaacacuuucuuuuuuuuuugagagggagucucacucugucacccaggcuggggugcaguggcaugaucucggcucacugcaaccuccgccucccagguucaagcaauucuccugucuuagucucccgaauagcugggauuauaggugcgcaccaccaugccuggcuaauuuuuguauuuuuaauggagacaggguuucaccauguuggccaugcugguuuugaacuccugaacucaagugauccaccugcuucggccucccaaagugcuggguuuacaggugugagccaccgugccaggccccagcaugaacgcuuuccauguugucccaggagaugagggcuggguauugucaggaugcccacaggcuuaccugggaacucuugagauaaaccacccucggucacccucuacccaauauuuucacacuggggaacucaggacaaaaugaaauuuaaggcugggugugguggcucaugccuauaaucccaguacuuugggaggcuugaggcaggaggauugccugggucuaagaguuugaaaacagccugggcuauguagggagaccccaucucuacgaagaauuaaaaaauuagcccuccaugguggugugcaccuguagucccagcuacuggggaggcuaaggcaggaggauggcuugagcccaggaguuggaggcugcaguaagcuacgauuacaccacugcacuccagccugggcaacagagugugaccaggucucuaaaaaauaaaaacauaaaaugaaauuuaagguaagugauuuuggcugggcguaguggcucacgccuauaaucccagcacuuggggaggcugaggcuggugguucaccugaggucaggaguuugagaccagccuggccaacauggugaaaccccaucucuacuaaaaauacaaaaauuagccggaugugguggcacacgcuguaaucccagcuacucuggaggcugaggcaggagaaugaaucacuugaacccaguagguggagguugaagugugccgagauggcuccacugcacuccagccugggcgacaaaagcaaaacucugucucaaaaaacaaaacaaacaaacaaaaaaccaaccauguaacuggcagaguguugugagaguuagaaaagacauuuugaagcuuugccuuggucuuggcaggggauuugggggugauagcauauauauguacaccaaguuguucccccaucuaaguaccaauuacuacuggcacuccccuuucuccccucacuggcucauugcuagaauaguagaagcuagggaugagcuggcaaaguuaacuuccacacaggccucugugaagaagaggaagagccagagaagauuuggaagauuauggugacauggcagaggaggcgaggacaguggaucugggggccuggggcagcucuguggacccaaucuuagcaacuguugagacaaaggauguacaaaugggaucagaaugaaccaucagaggauuagggcucaggaccugagguucauguugugugcagcaucugaacgugccgcugcugcgugggucagcuaguuagagccacauuucugugugaugcucuguucuccugcagccaguccuuccccccaccucccacauuccugaugagcucugugacucagcugcuucucgggacgucugagcagcuguuuuuuucuagggauagaagcacagucaggagauguaaccugaaugcuuaucuuucccuuggguccgugagggcccucucccaccgugaggccccugaaacaaaacuggacuuuuagaggauuguagaaagagugccuucuuuagccccugacuucagaaaaagacaggcaugaccaggcaugguggcucaugccuguaaucccagcacuuugggaggccgaggcugguggaucaccugaggucaggauuucaagaccagccuggccaacauggcgaaagcccgucucuacuaaaaauacaaaaauuagcuggguguggugaugugcaccuauaaucccagcuauuugggaggcugaggcaggacaaucgcuugaaccugggaggcggagguugcagugagccaagauugcccugcugcacuccagccugggugacauagcgagacuccaucucaaaaaggaaaaaaaaaaaaaaaagaaaaaggaaagaugaauccugcaggcuaaaaaggggaaauuugaaagccaauguucagcuggacaccuugcuuagcgauugagcccaggacaguuaccuuugcucuuccacaggagcuuguguguuuucucugggaggugccucaagaguagcgauaguccuugcagccccugcaaaucugucugugacugguugggcaucaagggaguuugccugguuuucuugaggggcuggcgaucaccagcauccugaccaggcagcucugcacccuucccggaaugcugacccagcccuucuggugggacucuuguuccuccgucauccagggagcugaggcuucuuuccaggauaugcucccccgcccccagccagcgccagaccacuccccuugcugccuuugacccaaugucugcugggagacuucacguuccuucuguggcgucuguuccucauuacuggcuugugcccaucucucuccuguuucugaacucaaacuugcuccauugugaaacuggagcuggggcggaagcuuuguuggaggaggcccugggucuguccgcaggugccauaauggaaggguugcugcuuugggcaggggugugccuccccuggccccugcugugcugcaacacauccuuuucugcuguguuucugaaaccuccucuguccaugguugauccuucucaccaccucuuuuacugcagcuccucugacuucuuccuuagcugugcuguuucaccucuguccuguuucucgccugcuuugcucuuuguccccuauccuuuugcacugaguagcugugggauuccccgacgcaucucccugauguuugugucuccagucccccugaccucaccuggaucaagggauucaccagucacugguauccauauguguguuuugggggcauuuguuccuaggggcugccucucagcacuggcccuuguggggaugggagagaacaugccacaccaccagucgccacccuuacuauuagccugaucugaaucugccugaugucagccugugcugugggagggugucucccucugggccugcaguaccggggcuguugggucucucuagcucaccugcugacccagcgucccguugugggggauggccugagccagccaucucacaacuuuguguggcuguggacagagggccuucaugggcuugggccaccaggaacuccacucuguuggagccugucagggcucagcaguggguggggucugaccuugaaagucugaaugucacguggugcuuugggaucccuugugggacccuugucccacgucagcacugggugugcauuugaauugggugucucugcucauugaaaggggccaaucuucguuggggagcaggauagagcucucgcccuucccuuuggcucucagagaggccuaagaaaauugcaacaagagcagagguuggcugguuugaagguguggcucaucccacauuaccagagagacaguuccggagucggggauagugcucacgggcugggacuuucuucuuucuuccuucuucuccuuuuucuucuuucuuccuuuauuccucuucuucugacagggucucacucugucguccaggcuagaguggaguggugcucucaugguucccugcagccccaaauucuugagcucaagcgauucuccuaccucagccuccugaguagcugggacuacaggcacgccaccgugccuggcuaauuuuuaaauuguuuuguggagacgaggucucacuguguugcgcacguuggucucaaaccccuggccucaagcgauccucccaccucagucccccaaagugcugggauuacaguugugagccacugcacccagccugggacuuuguucugauuccucauucuuuccauuauaaaggguaaccguauuaggcugcucaggccaucauaaacaaggaccacaguuuggaucgcuuaaacggcagaaguucauuuucucaccgaucuggaggcugaaaguccaagggcaggguguuaacaggguugguuucuucugagggccgugagagaaagaucuguccagggccugcgccucggcuucuggauggcugucaccucccugugucuucacagggucuuuccuccucuuacggagacaucagucauaguggauuagggcccaugccaaugacaucaugcuaacuccgucaccucuuuaaagacccugucuccaaauauagccacauuuugagggccuuaggguuaguacuucaacauaugaauuuugagaggacauaauucaccccguaacaaugacaguggagugauguaagaugcugggccggggcugugacccuaccucaaggcuccagaaacccuuugcauuuuaaucuuuugguaucuucauggagcuggagaggcuguccuuugugacuuaauuccuggcagaauuuuagaaaaauuuuuuauguuuaauuuuugugcguacguaguagguguauauauuuaugggguacaugaggcuugcagcacguaacagucacuucauggaagaugggguauucauccccuucagcauuuauccuuugcguuacagacuguucaguuauauuauuuuauuuuauuuugacagaguuuuacucuuguugcccaggcuggagugcaauggugugaucucgucucacuauaaccuccagcuccugaguucaagcgauucuccuaccucagccuccugaguagcugggauuacaggcaugcgccaccacgacuggcuaauuuuuuguauuuuuaguagagacgagguuucaccauguuggccaggcuggucucgaauuccugaccucagguaauccaccugccucagccucccaaagugcugggauuacuggcaugagccaccaugccuggccucuuuuaguuauuuuaaaaugugcaauuaaauuauuauugacuauaguuacccuguuguacuaucaaauaguaggucuuauucacucuuucuaacuauuuuuuguaccuauuaaccauccccauuuccccccagccccccacuacccuucccagccucugguaaccacccuucuacucucuaucuccaugaguucaauugauuugauuuuuagaucccauaaaugagugaggacaugugaugucugucuuucuguggcucucuuauuucacacuuaacauaaugauccccaguuccauccauguuguugcaaaugacaggaucuuacucuuuuuuuauggcugaauaguacuccauuguguauauaugccacauuuucuuuauucauucaucuguugauggccacuuaaguugcuuccaaaucuuggcuauugagaacagagcugcaacaaacauaggagugcagauauaccucuucaacagacugauuucguuucuuuggguauauacccagcagugggauugcuggaucauaugguagaucuauuuuuaguuuuuugaggaaucuccaaacuguucuccauaguggucauacuaauuuauauucccaccaauaccguacaaggguucccuuuucuccacuuccucaccagcauuuguuguugccugucuuuuggauaaaagccauuuucacgggggugagaugauaucucauuguaguuuugauuugcauuucucuggugaucaaugaugucgagcaccuuuucaugugccuguuugccacucguauguguuuuccuugagaaaugucuguuuaaaucuuuuguccauuuuaaauuuggauuaugagauuuuuuuuccuauaaaguuguuugagcucuuuauauauucugguuauuagucccuugucagauggguaauuugccgauuuuucucccauucuguggguuuucucuucacuuuguugauuguuuccuuugcugugcagaagcuuuuuaacuugaugugaucccgccuguccauguuugcuuugguugccugugcuugugggguauuguucaagagccuggcagaauuuuauucagauguuugaauuggagcuuacauccuuucugagaucauuucuuccauguauaaaauugaguugcgagccacuucacaagguuuugugcagagcaacgauaauagcuacuguucaggaagugcuuacugugugccuaccacuuaauucucagcccaagccuuauuauuaaccccguuuuacagaugcagaagcugaggcacacgaagguuaaauaauugguggucauacaauuaacaaguauccagaacuggaauuugaaugcaggccccugaucuaaagucugggcuuaucuccucuauggauguaaagugcccaaugcuauccugggcacauagagccuuggaaaagugaguugaauacgugugaauggauuuuuaggggugcuuaacauugggagagguuuccagggucugggauggaacauuuggugcccccacggaaggaagcuggugagagucucagcccagcuucuggaaaagauuccugcagguccugaggcagagcugcuucaucuuccuucucaucagcaccucccuccugcgcgcagggugaugugagcagagcccaggaaugccuuauguggaucggcagaaccgaaucuguggguuucuggacaucgaggagcaugagaacagcggcaaguuucugcggagguacuucauucuggacacccaggcuaacugccuccucugguauauggacaacccccaggugagagggucagugggaagggguggggcgacugggugcccaucacugcgccagaggaaugcacacaggguuagccuccaggccuaggcucgugagcaacacaaccugcugaucagcagggaggggacaacccuacaacacacacagacacacacacaaaugcacauucacgugcacacacaccacacacaccccauacacaccacacacacgcacacacaugcaccuuauacacacacaccacacacacacuguacagacacgacacauacacacaugcacacaccauauacacaccacacagacacacacacauaccccccauacacauaccacagacacauacacacaccacacacaccauacacacacacaacccauacaccauacacacaugcacacacgacacacaccauacacacaacccauacaccagacacacaccauacacacaugcacacacaccccauauacacacaccacacacacauuauacacacacaugcacacacaugcacacacaucccauacacacauacacaagccauacacacacaccacacacagagacacacauacaccauacacacacccccauacacacacacccccacgcacaccacacacaccacacacgcaugcaccucauacacaugcagacacaugcgcacacgcacacaccauacacacacaugcacacacacauauacacacagacuacacacauacuauacacacccauccacacacacacagaaaaccaucucagaucuuagcuuggagagaaugaugcuguccugacccuggcaucuggugucugcucucacacgcagacaccagccaggaucugccagugagauccaaguccuggauccaggcuccaaggcauggcuugcuuccuguuacuucucuccagggcuguggccuguggcugcuccugcucuuccagucugggggccccuccccagcagagaaugugaccugguucccugagccggacacauguuggacuucuuuggucuccugacucaggaaguccuagaauccuggauuggaggugcccuuggaggucacccaguuuuguuuccucaugguccagaugagaagagagccucagacacugcacuggaucuuggcaaggacauggucagaauuaggugacuugcugagcaucuuguggaggucaggcacaaagaugggggccaccuaccuuugacugcuaugucuaggagucccuggagucaucacugcucugggaacaaguugcuucacccugauuugggaucucaaggcuuuucuuauucuggcccugagugcuguuagcucuuuccuuccccuacccuugagugauuugguggaaugagccugcaaacacugacauggccucugaacagcaaggucacaggucauggcuguguugggaugaagaagggugugggaucugggauuuggcucuaguuccgaggcuugggaagaggaaauucugaaugucccagggauggaguuaugcuuuaagaugcaauguggaaaaugaguuaugugaaucucuaggucacuguccagggacuaaucaucuagugaucuugggcauuugucuucuagauuugaugaccaagagaaaaacagcauagaugcggaaaacauacucagaaagucagcugcugcuaauugccuucucuagcaaggauuaacccuaaguagaacugagccccauguuucacccugcagcccugauaaaccuguugcuuacuuucauuugaagugccuaguauucagaaugaacccuuccuaggcacacugugacacccucaacucagccuggaaugcugccauuugucauguaaugggccugguuugccuucaggcccugcgauaucauuuuccuuuccuuugcucuuuucuuuucucucuuuuuuuuugagacagagucuugcucugucacccaggcuggagugcaguggcaugaucucggcucacugcaaccucugccuccuggauuuaagugauucuccugccucagccuccucaguagcugggauuacuggcauguaccaccaugcccggcuaauuuuuguuauuuauuuauugauuuaguuuugagacggggucucucucuguugcccaggcuagagugcaguggcgcgaucucggcucgcugcaagcucugccucccggguucacgccauucuccugccucagccucccgaguaguugggacuacaggcacccgccaccacgcccagcuaauuuuuuguauuuuuuuuuaguagagacgggguuucacuguguuagccaggauggucucaagcuccugaccuccuuaucugcccaccuuggccucccaaagugcugggauuacaggcaugagccacuuuguuacuuuuaguagagacaagguuuuaccauguuggccaggcuggucuugaacuccucaccucaagugaucugccugcuuuggccucccaaagugcugggauuacaggcaugagccguugcaccuggccguuuuuuuuuuuuucaauuugggaucuuacuccguugcccaggcuggagugcagugaugcaaucauagcucaaacuccugggcucaagugauccucccaccucagccucccauguagcugggacuacaggugugcgccaccacacugggcuaauuauuuuuauuuuuuguagagauggagggucucacuuuguugaccaggcuggucucgaacuccugguuucuuuuuuuuuuuucuucuuuugagacagaguuuugcucuuguugcccacgcuggagugcaauggcgcgaucucagcucacugcaaccucugccucccggguucaagcgauucuccugucucagccucccgaguagcugggauuacaggcgucagccaccacgcccagcuaauuuuuguauuuuuaguagagacgggguuucaucauauuggucaggcuggucuugaacuccugacgucaggugauccaccggccucggccucccaaagugcugggauuacaggcaugagccacugcgacuggccugaacucuugguuucaagcgaugcuucugcuuuggcuggaguuaaauguuuguugccaguagacuuggcuuugggcacaccagagaugagcccugggugacuuaugggucuucacguucccucuccauucuccuccuuuguguacuuccucccacucaccugcuguguuagugcaagucauucgaauggauuuuugucuugauuuaccugcuucacgccaugcuuccccacuagggcugugcuuuacccgaacugacuugcuuggggaauccugucuggcuguugccagcugccucccuggagaguuggaucuuucuucacacccugggucacagacugagaguugugcugucaguggcagaucacccaggaccacaguggcaccaucuuggaacuugaauauugacgguugucaggauuccccucacucugauuugucacuggggcccagaaccugugcuaagccuggacgcugugccucgggcugccuucuaagcucucuggggucagccucugcagcagguuccccuggcccagggcaggcucuuacucuuuccugcuagcugagcucucaggguguuuugugguagaaccuucuucaaguuugaauuaccagguaaaacuaacuaguggcccacugcuggggauucuuuauguuuucccaggaagcaguagagcucaccuggcuuggcauauucuugaaaaaagagagucuugcugugauacagaaauaauucaggacauuuuacuucuucagugguuggguuaguucuuuguugugugaacagccaaacggccacuccagauuuaaguguggauguuucaguuaaguucuaaaaugguauuagugagcauuuauuacugugugccaagcacacuucauuggguuuuuauuucauucugacaacaaguuuaauugguaguuauuauugcccucauucugaagaugaggugggugaggcugacaggggaagaauuugcccgugguuacauaauaaaaaaguagcacagcugggacucuaaccccggcagucuaacucuagugccccugccauuauugcugauaaugagacaggcgucuaagggugacuuggaggaugaagagccugcaaagguaguuucugguuaagaaagagaaaccugaggacucucggggcugggagguccuagaagguagggcacucguguggcuuaguuuuuuaucauaguguuuccagcauuugaugaauauguguucauugaaugaaggaaugaaugagccagcuaaagagggccagggaaggaaguggucagaagucaggucacuggggaauguggagugcccaacauugcuuuccugggacuggggacagggccaaaauggaauggaagcucugcagagaggggcauccuggggauuuugguccauuccuaugaaaagaggcauugagaacuguguguggucguugaacaucuuuauuugauagggacaaggagaugccugcuauguuuucuuaauuauuuaauaggcaguaauaagcagaagauuuuuggacccaggucuccgaucuuuguguguugaagccaccugguaggugguguucacugagccugaaucuguuacugcugcugcuacugcuguuauuacuaacugcagcuuauacuuacuaagugguugccauguaccagcuauggugugaaaugcuuuuacauguguuaccccauggaaccucuccauaauccuggggccuagggucuguuguuacucuuugcucaugguugugcaggugguaaaugcagcgcuggagccagguccaucgacucaagugugcaaccuccucuuugucugccucccuccucccacugaccucugugcucagcccgugcaaggucuuguagaugauguggaaaaugaauucggugaggccuuugccaccaggaagcuucaggguuagcuggggagaggaaaacaacacacacaaaacuauggugcuaauaauccuggcaaaucauuauaacaggguagcauaucauuaggugccagugccaaugcccggaugccaauauuuggguugaaggagaagcaguugccauuuuccuuugcugccacccauaagggaaagauguagggcuuggagguggagucucauauggaaaguucucaugcugcagagauaagagaucaagguugcaaucuuggcucugccacuaaguugauuuacaucuuaggcaagucacuuauccuguggaguaugggcacucuaggugauccuuucaccagcacaccuggcuaauuuuuguaguuuuaguagagaugggguuucacuauguuggucagccuggucuugaacuccugaccucaaaugaucccacugccuuggccucccaaagugcugggauuacaggcaugagcuaccgcgcccagccuguaggugauccuuacgugccuuuuauccuuucauuuccugagaauagaaggagauccuggaguucaacagcauuguuaacacauauuuacuaaauuuguucagcgugccagaugcugaucuaaauacuguggcuacuucagugaacaagacagucuuugccuucauagaguuuacacuguauuuggggaaacagacaauugggguggggagagcugggggccccccuucauagaggaggugucacuagauccagauguugaagggugugugagguucauuuuugcuauacauuauuuguauuugcagagcauuuuguggguuuuccacuuacuuuuuaaaauuuguauuuauuuauuuuuuuaagacagagucucacucuguugccgaggauccagugcaguggcgcgaucucagcucacugcaaccuccgccucccagcuuaaagaaauucucgugccucagccucccaaguagcugggauuacaggccugcaccaccaugcccggcuacuuuuuguauuuuauuagagaugggggugucaccacguuggcuaggcuggucucgaacuccugaccucaggugauccacccaccucggcauccaaagugcuggguuacagaugugagccacuacgccuggcccgguuuucacuuacaagauguccuuugauuguuauaccuacucugccccaagcagagaugaagaggaggagaagggcguucugaguuggggaaacagcagucauuguggggcagaggugagcucgccugguuggaggggcauuuagggucgucaggguccccagaagaagacccugagacgaggagucaggcgcugagacagggagucaggcgcggaggcaagaucugucaggaaguucuuuauugaggaaauguucccgcggggacugugaagagagcuggggaaggaggacagggaagggaggaggccagacaagggugugaacucagguggaggucugagcaagggaugguuucacugugggccugcaggagcgcuggggugagucaugccucagccuugucucagggagcugggcuuucgugugccugcaccgggcagucacuggcuccagcucugcacaugugggcagaauggcuuccagcagcccagaggcaguucucugaagcagagcuguagaugcaggccauggaaggcacagccaaauggcaaaaagagauggagggaauuugggaagucaguggcaacgucugcuagauggacauacgguggggguguguuggggaucagaacacagcgugggccaggcgcagccuugaaugucuggcagaauuuagaaucagugugguuaaguaaugaaucaaggcuucucguacaggcaguggugacucuaaacugauauagaacaaaaacccauuagcuaaaaaggaccuguauaaauggaaagucucaguauuauugauuauggacacugauuuggcuaaugcauuuaaaaaucaauauacugacaauaucaagcaaacuuuuuuuuaaauuauaguaaggauguucagcaugagaucuacccuuuuaacaaauuuuuaaaugcaugauaccauauuguugacuguaggcacgauguaauacagccagucucccuacucuagaacuucuucaucuugcaugcaaucaaauaauucuugaacagaaacaaaugcuggcuugauuuuccuuaaaauguuacuacaauauuauggcacuagcgcuuguauuuugauuucacauugguucccgucaugauagaggagaugaaauuccuuagggccgcccuacucuaguacagcaaucugcagacuaacuauguuuuaguugcagagaauugcuuacaucccccacuuucuaaaguccacuuggcuaaguaauugcaagaccaaauuauauggcccugaacaaagaguaaacagaagcgugaaacacaauauugcacuagauugcuggucuugucaaauuuacucugucaaauguguuuuuuccucuuuuuccaaaaaauacguaguugcuuuuacuuuccaaaggccacgauaugacucauggaucaucaaauaaccaaaaagauugcauggcucuuaguacuccuggggugccaaugaaagcccuuugcuuuuauuuaauuuuuuuaaauaaacugaaagcaguucuuuccauugauggggugaagagcguuagcaguguugguaagaagauggauauuuggugcauuuuaguagaaagcauacaaaguuaugggaggagguuauaauaacacauaauguauaauggacaauacuguugucuuaaaggcuacaugaaaauugguguuuuuuuaaaaaaacgugaaauuuuccuaagcaaauuuuggcugaaagccaggaauaauuuuugcauuguaugcuucaaccugucagaaugccaagaaccaggaaauaauguucuuuaaaaauugggcaauagaugcacguggugcagaauuuggaauguaggaaugcagaguuagugacaaauuucucccucccacuucuguccucucagcaggggcagccagucuugacaguuucuugugucugucuggagauaaucucugccugagagacuaucucuuaagaucaugguaacuuucagaucuucagcaaauuguuugggcaaagugucuucaauucauggauuuuguguaauugauaucuuaacuauccauguagacuugugauuuccaggagucaguggaauauuugaugugcuuuugucuguaguguguuagaguaagaacgcagaauccuuugguaaaaaaaaaaucccaaaagaagauuauaagugacaaaucuguacuuuuaccaaaugcaaauuuugcuaaggguaaaaauauuauuaaaaaguacuuuuuuuuuuuuuuuuuagagacaggguucuuacuccgucuccgagacugaaguguagugugcagucagagcucacugcuggauuugacugggccuggucaaaacaugcuuagaauuaaaauuauaugugggcuuuuugagagcuuaauguagaauuagaaacugcaauuuugcuuuauguguuuucuguagccaucauauuuuuuaaacaaguuguaucuuuauaacaggauguacuuugucuaaauuaaaaaaaauuaaaaacuaagccgggugcgguggcucacgccuguaaucccaguacucugggaggccaaggcaggcgaucaccugcggucaggaguucaagaccagccuggccaacauggcgaaacccugucucuacuaaaaguacaauaauuagcagggcaugguggcaagcuacucaggaggcugaggcaggagaaucgcuugaacccgggaggcagagguugcagugagcugagaucacgccauugcacucuagccuggguaacaagagcgagacuccaucucaaaaaaaaccaaccaaccaaacaaacaaacaaaaaacuaaguagcacauugaaagaauuguguuaagaguuagcacuacucaguauuaaaguccaagcagcuaaacagauagaagcuaugaaacuuagcagagguuaaauaacuauugcaaaaccauagugaugacuauucuaaguuuucucaaaacuucucuuugguauguuguuguuagauuuugcuuuacauuuuaaccuucaacauuuguucaauguauuuauuauauacaucucuuucuauauuuauagaucuaguuauauaccaaagaaugguaugaccagacaugguggcucaugucuguaaucccaggccugugggaggaucacuugaggccaggaauuugagaccagccugggcaacauaggaagaccccaucucuacaaaaaauaaaauaaaauaaagaaauuaggcaaucgugguggcauaugucuguagucccagguacuugggacgcugaggugggagaaucacuugagcucaggaguuagaggcugcagugagcugugaucaggacacuguacuccagccugaguuacagagcaagacccugucucaaaaaaagucauuuuauuaauuuauuaucuaaauagugucucgaaggcaaaggagguugguuauugcauguuugggggagggguucauauuagauuuugcuucagagaccaguuuuauuaguuauaucaauugagcacaggacaacaugaugaauauauucauuaaggaaacauccauuuuuugagccuccuguccucauccacaguauaugguaaugauaucaaugaucuccaccugugacauuguugcugugaagaguaaauaauguaugugagaaugcuuugaugagcucuaaagugcuacagauguuaucuguuaagaaaguuuguucuggccaggacaucgggauggauggggagguggggagagcuggagcuggagaugacggcuggggauuugucacagagcuuccugauaugccugagguggugggaauggagagugggggggcagguuuagaggcuacaugagggaagaauguuugaaaguuuaguaccugguugacuggggagaggagguggaauuacugacagaggcuggggaggggagagggaaaccgauuagaaaguggaggggaaaugacauugaguuugaggcuggauugaagaaagggcugauggaguuggcuuauugaguuuacagcuuuagaaacauuuagguggccagcagucagaguugggacccaaaugccuccgggagauuaucugaagcccaggccucugaccuggucuuuuuuuuuuuuuuuuuuuucuuuuugagauggagucucacucacucugucacccaggcuggagugcaguggugugaucuuggcucacugcaaccucugucuccuggguucaagcgauucuccuaccgcagccucccggauaccugggauuaaaggugugcgccaccacacccagcuaauguuuguauuuuuaguagagacaggguuucaccauguuggccagguuggucuugaacuccugaccucaagugauccacccgccuuggccucccaaaguguugagauuacaggcaugaaucaccgcgcccggcccgaccuggucuuuaagucucugucaccagaguuggaagacggaaauaaagggaauggggguguggcugagagacuuaacacacaaugaaacuuauccugucuaaagcugauacuggugucugucaacaagaaaucgacauccaaguaauagaauaaaaacauuaagcccacgcagcagaggaugauauagaaucgacuucuccugaagggaaagauuaaauacacacuuugaacuggagaauggggagaguagcuaucagcgugucguguguccccgcguuagcaucagcaaguggaccuacagggcagaggggaggagagguguuuggcccuagagcagcagguagagccacggcccaggucaccuggugccugggauucgcuuggcuccccugcuuugguugcucaugucagggugagggcuuuggaauguggggcagcggcagcuaugcuccuccuucccaguccugucacaccguucuccuacauucaaaugucuacucugagcuauacccccucugcaggcacauucuuuucugugagucuacauggccguggcuuuugguggcugagcuaugguuuuagcucacagacagcaaugucagcucaugcccuagcucugggauuaccaggggcguccccucccuccgucuccugcuagcugcuuuuuacugucugcuggacaccccaggggccuguaagagaaggucagauggcaccagcaucucuccuuccuucccccuuucugcucugaaucucuggucuauuggaguuuggcacccaagagccaguuggacaaguuccugcccugcccagcuugggcaaugacacugggccucuuuugguguaacccugcugguccugcuuuuguauuuaccuuucauugauaaucagcucuuagauaaugucucaugggagauggcagggccuaaaggaaagugcaugggauuugggaaucaggaaggguugggcuugaauacuggcuccgcugcuugcugccugugugacccugggcagguuccuucaccugccccauccuuaguuucuucaucugugaaaugggauuguuaggauuaggcgaccacaugugaaggugccuagcagcaugucuggcgcaucauaauuucuaaauauauguuaguuuccuucuuucuuucucaggcuguuacuuugccaaagcaccagauugauguuaggaguuugagcucugucuucauuugacucccuaaggaagucacuucccccaguugagccuuagaggacucauguguagugaaugaagagguaugcacaggaccuuugagugcugacaugcugugaguuuauggaucgauaguugggucuucuggucauuucuguguucuuugugacucucacuggaagaggcggaagggaguagaagucacauggguaaaaauuucuucuucaacaagaaauacugcuguugcuagaaaaaggauuaacgugggaggugugccacaucccuguaugggcaccucagcugcuuccuuggugacggagaagaauaagccauauauuuuccccccuggggagcuggcuccuucaaggaccuuaguggcagaagagcucuugagcaaaaaggaagguacuggcauugucugcauaaaaccaccuaucuuuauuuauuuauuuauuuauuuauuuauuuuugagauggagucuggcucugucacccgggcuggagugcaguggcgcaaucucggcucacugcaaccuucgccuccuggguucaagcaauucucgugccucagccucccaaguagcugggauuacaggcgcaugccacuaugcccggcuaauuuuuuaauacuuuuaguagagaagggguuucaccauguuggccaggcuggucuugaauuccugaccucaggugaucccccugccucagccucccaaagugcugggauuacaggcgugagccaccacgcucagccuaaaaccaccuaucuuuuaacaggaaccugcccugugcccuaugugguuccacaaaauuuagaaguccaccaaauguacagaccacuccugacuuguagacuuccucucgugggaucgcugccagcgaggcacggcaccccacggcauggcauggcauggcacggcauggcacggcaugacacgggaaucuccauucccucuuccucucucucuccuaccuuuccuccuuccucucuguuggcugcuggugcagcagccagggugacucugugggcugcuggcuggcguagccuuuucucucaccagcugcugugucucuagggcagacucagcaggaccagcuggugccuacagccaugaccuccaaccuggaagcacauggaaucccuugggagcucuggaaacaggcaggugccuggguaucccagacgaguucaaacccugagaaugaagcaugcgucuuaguuuguuuagaaaucucccgagguggccaggagacaugguggcccaugccuguaauuccaguacuuugggaggccagggcgggcggaucaccugaugucaggaguuugagaucagccuggccaauauggugaaaccccaucucuacuaaaaauacagaaauuagccgggugugguggugcaugucuguaaucccagcuacucaggaggcugaggcacgagaauugcuugaacccgggagguggagguugcagugagccgagaucaugccacugcauauccagccugggcaacggagucaucucaaaauaaauaaauacauaaauaaaagauaccucccgaggugauucacauaagcagccuuccagaacuucauucccaccacccaccggcuccacuuuguaucugcucagacgccuucaucuugacgcuuccagucccucucccuauggcccauuccucaacucugccccuacauuuuccaccuccuuuucauugggguucaguccuuuccugccucuucuacccgauccugauuccugucccacagaggccuugccuaggucuugggagcugcaaacugaagugacccccaaguuggaaccugggagaugucacgagaaaacguuguuugccgguggugggcagagcugcauuggucuuccaguacuuuaugaacucagugggcuuguauggacugguugggaacuucaccaucaugcaaauauuguuuucauuuaaaaauuaaggaguccccucuguaaagcaguaagauccuacucaugaccuucgugugcuuccguccaguaggaagagaccuaaacucucagaaaaacauacuccgagaacagaguccaaggcuagauuuuguccuguugaccagcuguucuuaaacuugggccuguugagggaucgcgugggagcauuuuaaaaauguccauguucugaccacauuccauuuaauucucauucaguguucugguggggggaagcuugagcgcgggcuuuuuuuuaaaaucucuuuuuuucuuuuuaauaaauagagucagggccucgcccuguuacuuaggcuggagugcagugacacgaucauagcucacugcagccucgaacuccugggcucaagugaucuucccaccucagcuucccacauaccugggacuacaaaugugcaccacuacacccagcuaauuucuuuauuuuacuuuuuguagagacagagucuugcuguguugcccaggcuggucuugaaccccuggccucaagcgauccucccaccucagccuccccagguguugggauuacaggugugcgccacugcaccuggucauucuugggguuuuuaaaacaagcucuccaggagauucuggugugcaccaaaguuggagaaggauuugugugccuaaauccagagagaggggaggucagggcaggcuggagucgguucaggcuucagggaagagaguccugaguuuguccuuuuccuagaggagucugagcuauggccagggaagaggggggacagcuugggugggcuccccuccccagcucugaucccuugccgcuaccuaggugcuguuucuuggccuuccugcccugacaccuggcuaaccaggcccucagcucaggcauccccacucugucuuccuugaucagaaagcaccuuccuagggcugccgaugugucacccuggcagucagcugucaccguucaucuucuagguccagucacuggaguggacccugagcgucacuuuggaucaagccucaaggauccuggggcuguuuucucccaugucucccauuuccccuggauggggaggaaggugggagggaggaaggcagcaucagacacgcgucauauuuuccuggcuucuccugguggagaggacguacaguugagcccaggagcagacuguggguggggugugggugaaggggugaggaccccugcccuuaccccuggggucccugggccuggagaguggcugcggcaucuuucucucugaacagggagagcugccagggaggccaggacagaggguggagcagcccuugaggggcagaggggaugaaguaguugaaaccugaucagcucauaguuguuuuuccauguggguuaguguccgaaugguuccccaaaucccacuucaucacucauaauucaggcuagagcuccggaggcugcugggcugugguuuggggugaggagaguguguugugcaacagcggcccugagauuuggcauuugcaucuuguaauuagugcugugggagggggaucgggacuccaauaggagggguugggcccucucgugucuuuccauggaauucuccccaccacccuaugaaacaggguuuagcaucucuguuuuauagguaaagagacuugccugugguuacagagcauuaaugucacagcuagaauuccaacagcucaagcuuuuaaaauuaccccaugccacuugcagggcacugcauugaaagucagcuuugguuuaggcucugccaccaauuaugugaccuuggacaaauccccucacucacaagcccacuuuccuaaacugcaaaaugaggucaggggugguggacccuuaguccucagcagaguccugcaguuccugugucccuggagcccguuggucucccucuguaagucugaccuugggcagcacggugucuuugcccagagcgguucucauucccuucuaaggcagugucugucacucaugccuuuugggagcuggggcuccuauguggacucugauuuaagggcuauaaggccugucucuuccuacccaauagagguuuccuaaaaaaaaaaaaaaaagaaaagaaagaaaagcagucgcuaugugguugaaaaaaaauguguaaauagaaguguaaaucagauuauccacaguucauauacaaaucuggcuguaagaggcagcuccuuagcuuacugccucauucgcaaagggaagaacgugagugcagagucuuuucuaggucccccacucuaagauucuuggguucugagaauaccuuuuuugguaguauuauccccguccauuuucuugcuugaauuugcuucaagcgauguauguuaauuuagauaggugggguuagaaggacucuucccuaacacccugaggagacauuuacagaaaagaaaaagaagaagagguagaagaagaagaagaagaaaauauauauauauauaauguuuuuauagagacggcguuucacuauguuggccaggguggucccagaguccuggucucaagcagucccagccucccaaagugcugagauuacaggugugagccaccacgccugguccaccagagacacuucuuaaggcuaucuccugauagaucauuucacugauaauucuuagguaaauuuccuaaauuccuuuauccgagauucaucuccuuuuauugcuuugagaggaccccagguaaugggggcuucagagauuuuuuuuuuucuuuuuugagauggagucucucucuuccagagauuuuucuuggaggcuuuuggcaacaauuuaagaggucagcaggagcuauggacagagucucagauucacagggggauggucugcauucgaagccccagggcugugauuucuaaccuugaccgugacucuggcaugggacugccuuggguuuucacugcuucaucccugccaguggggacauuagaaagccaaagauggugugccaggguagagcacagugccagaccuggugccugugagucuccugcugucgugauagugcauucacuucauguuuuauacuguacagacaucuuuccuuugcuacucauaacagcccuaugagaugggcugaacagauguauauauauauauauuuuuauuucuauauugcgugaguuuguauccuauguauuauaaaaaaaaaauugaacuggcauaaaacaggacagagucagugagaucucagggcacucacaaaaacuauaacagcucacacuugcugagagucuucuacauaccagggacaauuaauuccaagugcucuuaaauguauuuauuuauuuuuuauuuuugggggauggagucuugcucugucacccaggcuggagugcaguggugagaucuuggcuuacugcaaccuccaccucccagguucaagcgauucuccugccucagcuucccaaguaggugggacuacaagugugagccaccaagcccggcucuauauuuuuagcagagaugggguuuugccauguuguccaggcuggucucgaacuccugacuugaggugauccucccgccucagccuuccaaagugcugggauuacagacgugagccacugugccuggccuucuuaaauguauuaacucauuuuuacagcuuucuuaugagguaggugcuauuaucccuauuuuacagaaggaaaaacuaaggaucggugguuaaggaacuuguucacaguggagcuuacacuuuuuuuuuuuuuuuuaagagauagggucuugcuguguugugcaguggcaugaacacagcuuaccgcagccucuaucuccugggcuccagcaguccugccaacucagccuuccauggaggugggacugcaagugugagccuccauacccagcuaauuuuuaaaauuuuuguagagauggggucuugauauguuauccaggcuggucucaaacuccuggccucaagugaucuucccaccuuggccuuccaaaguacugggauuacaggcaugaaccaguaugcccagccugagcacacacuuuuaccacuguacuagaauauuucuuuauaauagauaaggcuuggggguaauguuaaugucacagguuucuaucaggaauccugaaucauuauccaggaauuaucaucacuguuucacaggugaggaaugcaaguuaaagaaugguugaguaacuugcucaguguugccaggaaaguggcauaaacagagcuagaaucuuggucuucugucucuuggugcuguuuccacagccuucuuaaaaugaaaacuaugugucuuucagaaucuggcaaugggggcaggagcuguuggagcuuugcagcugaccuacaucucgaagguaauguugaccuggaacucugggaauucaugcucuguaagucgaucugguuucuaagcaaggggaaguguccaguccuuugggcauuaguauuuagggacguugcaugguguugaaaugcuccccugaacccacacaaugccuguggaggcuuagcugcuaauggguggcuguagagguaugugguuccaaguuguuggaggguggaccuacagccucuuacuccuugaacacaucaauccauaaugcucccagcuccugcgcaggagguguuauguggugguggagcugggguagggguaguacaugauccaugaccuuuuuuuguaauugggacgaaagggaacacgaaaacaaucaccaaaaauccagcaacugugaaggauucucucaaaggguacagucaaacaaaaaauauuggggcuucacuggauuuuuuaccagucaccuggacaggauuacuguggagggaaggcuaagaaggcccugagaagccacucagauuaccaagaagacauucagcagccagauaacugcuggggguuggggcagguggcugcgaggccacccccgucccauuuguacagaaggggccggagcaggcccucucuugugcugagagcugggguggggacugguuaacggugcccacauguaacugcugaauucagcuucuauuagcagccgcucccuggagcaggcaccacugcugacccgugaugcagcggugauaaaaaggccgggagauuuagagccuccccaggaagaggaacucuuuguacagugaggagagccagguggcaccccgccagcacugagguuucggaaguccugugcuccccacacacccucacugcaggccucuugggagccucuucugcccugcacauccccuuucauccucaggggcuggaggccugggggccccugagccaagggucuaucggcuccaucuuguaacaagcuuugggagucuuguacccuggcuggucaggagaugaaccugaaggggacugggggacucuggaggagaggccacccuuggcuggaggggcagcccgccccugugccugugguaugcaggcagagucuggcagacacagcccaguacaaaggcacaagaugcagggcagcgucagggcggauuaaagagggagagaaugaccucagggaaggaggaagggccuuuucaaguccagccuugcuagcacagcugccggcaauuugugcaugccuuguggugagaaauguggcugccuccccgggccagagcagccagaggcccaggccugcccgcccucccuggcuuguccucaucuugcugagagcuccugaggucguuucuccaggagggucggagauggagaauugagagcagaggagcagagaaccucgcaguaauaaaggaaaacugaaacccucuccugugugagaggguuugggaagccuuuuuuuuuuauuuuugguuggggaagaaugaauucagucuccugcugaaucaugauuuauaaaugcagcucagaugaggguuuuagaguucucagccuuggaggcugcgucauuuagaaagggugaccugccguuuagccccuucccgagaaaggcagggcuggaugggcauuuugcaaaacccacagcugccacugggucggguuacacagagcucagagccuuuaacuccugccugacucccugccagaaagcagggguuuuucccagaaugacauuuagccucagaggcgcuggacuccagcucagcauuccaggucauuauuuguuaacucuuagguauuccuucuuggaggagagcgcuugccaccgugucagguggccuggccagagggcugcgugugggcuggcuguucagggugugugcuucucugcugucugcugagggccagugaugggaagaugaggacgggcguguggcccuggcccuuuggagagacagagaugaaagugaugauuggaugucauccagagcaucaauggcaacagaaccaguucuuagcaaacuagaaaauaauuaaagcugcacuuugaccccugccuccacccgccgacugcacagccaaccccgcugucccacccccagcugugucccaguugucagggccuugcuuucagccaccucucagaaagaacuuguaggggcucauggauccuuuuuugagacugaugaaaugcauggaugccuucuccagguaaaugcauagguguacagacacacccugcuuuugccuauaauuucagggagcccauugaccuccugaagcugguccagagacccccaucccauguagguggcugcuauuccccugauccugaugccaccuuguggggcaaggucacccccagauaccagggcagaggccgcagcagagcuaggagaccuuguuuugcugccacugcuucugccagaggggccccagcuccucuuccggccaugggcagacaggguggggcuggcccuagccgugccuggccgcugacgagcuugcagcuccuguggucuguguuugaucugauaagcgcaaguuccugagagucuguugagcuguggagcagcccugucugcgucacucuacgggggaccugugcccacucccugcucacaucccugaccucugcucgcugcugggguguucacaggacccaccagucaaccacugcuggguagcgccucugcuguggccaccucggcuguguggauggcugcacuuugguggccucacuggagucagacggucgggugaccucacccgccugcagccacgccucuucaugagaggaggugaagccaccacgucuccaugauaaguuagauuuccuucuuggccuuucuuuuucuuuuuuuuuuuuuuuaaauuugagacaaagucuugcucugucacccaggcuggagugcaauggugcaaucucgccucacuucaaccuuugccuccuggguucaagcgauuguucugccucagccucccgaguagcugggauuacagguguguaccaccaugccuggcuaauuuuuguauuuuuaguagagacgggguuucaccauguugaccaggcuggucucgaacuccugaccucaggugauccgccugccuuggccucccaaagugcugggauuauaggugggagccacugcacccggccccaucuuggccuuucuuuccgugggacucagcaacaaguagaaaucauuucauuguccucuuuugccacucuguggcaaaggagaauaguguuuuuacucuggcuucaccuauuguaaagcugaucaaagacauugagggucuuacccuugcagugagccaaucagggcagaaccagaaccgauccuguuaauucagcaaugaguugguuugccgaaucgcccuuccaugguaagccauuaggcaugaggccaaugaugguuguacacgcaugcacucacacgugcacucucacaugccuccugaccaaaacuggauaaacagaggaaagcaaacaaacaaacccaaagccagaccgucucuuugaaggcuccaguucccauaauaagcacauggguagcauucucacagcacaggcuggcuaaucaguuguggucaaaacgagcauuuguuauccaaacagaauuaaaacaguccgccuguggugcucucucuagucagugacaaauaggaguuuuucagagaaaaggcaguucuccuaauaagccagaaagggucuuggagugcccaguuuuucaaugucauucuaaagcuggaaguagguugggcauagugacucaugccuguaaucccagcacuuugggagucugaggugggaggaucgcuugaggccaggaguucaagaccaguuucaguaacauagcgagacccugucucuacaaaaaaaauuuaaaaaauaaaauuuagcugagcaugguggugagugucuguagucccagcuacuugggaggcugaguugggaggaucgcuggagcccaggaguuugaggcugaccaagccaugacugcaccuccacacuccagccugagacagagugagacccuaucucuuaaaaaaaaaaaaaaaaaaaaagggccaggcgugguggcucacgccuauaaucccagcacuuugggagaccgagguggguggaucaccugaggucaggaguuccagaccagccuggccaacauggcgaaaccccaucucuacuaaaaauauaaaacauuagccaggugugguggugcgugccuguaauuccagcaacuugggaggcugaggcaggagaaucgcuugaaccuggggggcggagguuguagugagccaagaucgugccauugcacuccagccugggugacagagcaagacucugucucaaauaaauaaauaaagcuggaaguagaaggggaggaugagauugguggguucugagggcugggauggccaaacacaguucugcuguggucaggauuaugcagagaucaggggcagaacaaccaggaguuauggaccagaggacugcaggaauguggacgcugagggccaaagcaagaaaaugagugacugacagauuaacacucagguguaagcaggacagaagucuaugccgugguccagauugaaggggcggggggggggggucagaaacccaggaagcaagaugucuaggggccuggacuauuguguuauggagccaccagcguccucuuacugugaguugacacacaacugaauuuggauccucuguguccgaacuugggauaagcggguuuaccuuugcucaaaucaucauuuuuuuagguuuuucguaggcucuguggcuuucaccucacaucucaaaauguacaucccuuauuaaauauaauuggcuauuauauauauauauaaaauauuugaaaggauuuuaaucauuuuacuuuuggaaugauuuggcucugaguaacucauccaauuuguaacuggcucuaauuucugggcaaucaucuugcacacgcacaaaaggauucuugugagcuaagaaaaucuaagguaucuuuuuuuuuuuuuuuuuuaaagacagagucucgcucugucaccaaggcuggagugcaauggcgggaucucagcucacugcaaccuccaucucccggguucaagcgauucuccugccucggccucccaaguagcugggauuacaggcaugugccaccacacccggcuaauuuuguauuuuuaguagagacaggguuucaccauguuagucaggcuggucucgaacuccuuaccucaagugauccaccggcuguggccucccaaaguacugggauuacaggcgugagccacugugcccggccugguaccaauuauuuucaaaugaaaaacuuuuuaauguuucauugaaaaauuaaugacguuuacuugacguaacauccuguacgcauuuaaauacuugucagggagguugauauaauguuauguaggcauucaauuaaauguuuauuaacaccagauacagcaucuucacuuuguauguaggaggccaggcaauuuuuucagguuucauacaguuuugcaggcccagagaaacucauggacccucagcauuuugcccguaguuccaggugggacacugccuguguugauguguggagugaggcuuuaaaggaaaugagguaucaaaagcuauaaauaaucccuccuggguugagcagauucuguguggaagaaugacugucuuaccugcacuaucauauuuaacccucaugauaacccugugagaacacgauauuaugaucccuuauuugauagaacaggaaauggaggucauucaguuggaacaccugucauuugagacucucugucucugccugaccuucuuuugaucuuuuauaaggugccaccucaguucccauuuauuuggggcaauauuaauuuugguuaaggaaucuaggcagguguauagcaagaacuuagagccaagaguaagaaccuagacagacuggugagucagucauuguuagacccuaacugcugucagccaggaagauacuuuaauuucaauucaggacuuuuucuuuagcaccuggcuucugauacgcugcccguuaaaguagcagccagccgguugcgguggcucaugccuauaaucccagcacuuugugaggcugaggcaggaggaucacuugaggccaggagguugagaccagccuugacaacauagcgagaccccaucucuaaaaaaaaaauggaaaaauuagcuggguguggugguacacaccuguagucuagcuacucaggagggugagguggaaggaucacuucagucugagaagucgaggcugcagugagcugugauugcgccacugcacuccagccugggugacagaaugagauggggucucauucugggcucaagugauccuccagcuuccugucucaaagaaagaaaacccaaaaaaaccccacaaacaaauaaaauaaagugggaaccacuccuggauccccuagguggaggacaugucgaagaauacccuuggcuggagggggauggagagaaugguauucaggggaggacugugacaucaugugaauaguccccggccuaggacccaugggaaggugacugucucuuuagaggcucagugguggaggcucacuccagggaggcucagccuccaucaaggauugucccuaaucuuugugggcaugugguggaauaugaguugcuuucuuuuuucuuuuguuugagccugaaugaugagaguucacauaugcagauacucaggaguguacaugccagggguaggauugccagagcaagaugaaauacagcaacaggagguauagaaauaccuccucuguuucuugcccuucccugagauauauaggaauguucuccgauuccaucagccccucucugggcaccuggaaggugcuuauuuucaugguuaggccaucagggcagauguaaaggcaauuguuccaugugucugagggcagcgagcagccugcugcuucaucucucugaguguucugauuggaauccaugcauuuguagcaauauugccuucagcuuggagaacgauuuagggagaggguuggcgguugaaagaggaggggaggaggggaaucuugcuagugugaaugaggccaggauagguuuucgucaggacuuaguggcuuuuaaaagucuuuuugagcugggugcaguggcucauacuuguaauccuaacacuuugggaggcugaggcgggaggauugcuugagcccaggaguuugagaccagccugggcaacauagcaagacccuguuucugcaaauauuuuucuuuuuuaaaaaaaacuagccaggcauaggggcauuuaaaaaaaauuagccaggagguggagacuggaggaucacuugagcccaggaguuggaggcugcagugagcuaugauugcaccacuguacuccagccugggugacagagugagacccuauaucuaaauaaauaaauaaauaauaaacauaagucuuuuuguaaagaugaacagaccucaagauaaugguuaucucugacgguggggauucugucagggaggggcacacagggcuucuaagaaauaggacugauaaugccuguuucuuaaucuggaugaugaguacaggguuuucauuuaauuauuauuuuuuaaaaauguagacauauguuuaauguacucuuuauauaugagaaauuucacaauaagaaaucuucaacauuguaagacacauauucauguuucuuuuauuucuuauuugauuuaggugagcauagcuaccccaaaacagaaaccaaaaacuccauuuugcuuugguaaguacugagccaggggagggacucauuuaauauugacauggcaacuuccucuuuugcauggagacaguccugugaucacaugugacuauacccugugaguaugagugacuuaaaucacagugacgguccuggacgucaagugauauuguuuucccuggucuugcugcaaagguuguuaauaacauaaggacagagguucagggacuaguaacauuucuguuuucuuucuuuuuuuuuugguuuuaguuuuauuuuuuaaguugacaaauaauaauuauauauauucaugggguacauaauguauagaguaauuagcauaucuauauuagucuguucuugaacugcuauaaagaaauaccugagacuggguaauuuaaaaagagaacagguuugcccgggccugguggcucacaccuauaaucccagcacguugggaggccgaggcgggcagaucaccugagaucaggaguuugagaccagccuggccaacauagugaaaccccaucucuacuaaaaauacaaaaaaauuagcugggcgugguggugaguaccuguaauuccagcuacucgggaggcuaaggcaggagaaucucuugaacccaggaggcggagguugcagugagcugauuucaggccauugcacucuacuccaccucaaaaaaagaaaaaaaaaagagguuuaauuggcucaguguucugcaggcucuauggggccagaggagaagcaagaaagagaguggggaggugcuaugcauauuuaaauaaccaaauuucacaagaacucacuauuaugacacaacagcaugggggaugguguuaaaccaugagaaaccgcccccacgacccaucaugauccagucaccucccaccaggccccaccuccaacauugaggauuacaauugaacaugagauuuggguagggacacagauuuggguggggacagagauccaaaccauaucaauguccaucaucucgaacauuuuuuucuuuuaauaauuguccauaugcauuucaguuuucuugaugccacaaggcaggugcaaaauguccacuauaaguuucugugaaccuuauuuuagagcugagaaauguugugcucagaaaagauggaggacucagaggagacgcagauggcagugccaggaaggggauaagacaaaggaaggagaauucuguuaagggucucaguugcccaauagugacauguugggggaugguguaggaggcagagucaccgugcaugggugccucaagucaggaaguggucagugaauucagugaauccaucaucaaauaguuacuuggcuccuacuauguucucacagcugugcuaagugcuaugagcaaaugcuaacaaauaguuucuguugccuaucuggggugguucugaauguaaguuucacaaaggcagggguauuccucugccuugucacugugguauccucagcacuuaaagauguuuccuagcgcauaguaggugcucaguaaauauuugucaaaugaaugaaugaacggaugaauucugcaucuaccccaugagacucaccuccuacaguucaagcuuaugcuaagagaauaaaguauucccuugagcgauucugucuccccaccucagauuuguucagacuucuuuggcaugcucauucuucuauuucuugcaaauuucauagcuaagcucagaaaugacucucacguuuugugguuaucagaucugaaaauauauauauguaauaauagugaauguggaaguaaauuguugaccuaauggaaugcucagaggaaagaacagguugagagugaggccaaggucacagauuugaucucaggaaagcuuuguucuauuucccaaccacagacaacucucccaguccagaccaguugugccagaggagaccaagcauggguccaaaauucuguauauaccgugaugacaguaaauguauuagcaccgccagaaugcgguucacaguugugucuuguugacggcagaccagcagccucaucaccgcagaacagcacacugaggcugcuguuaacauggucagguguuguuccuguggccaaugggauguuuuuaaaggugggaaagagagugagcagguguggccuggggcuuccuagauauccaggcaaaugacuuagcaucaugggagauuucuuguucugcuuuguggaguucacucaucucacucccucaaacaccuuagcuuuguggagacuuguuguauugcuuguauucugaccuaggaaugucuucccuucuuuucuguggcuuuuguaguuaucaaugcccugucucagagauauuuccuucaagccaaugaucagaaagauaugaaggacuggguugaagcccugaaccaagccagcaagaucaccguaaguuugguuucuucuguuuucuggugguaguaaaagugccucuucccaggcuauggccuuguugggguuggggaaaacugagauggcagcggggacuuucccaggagccuggucuguacccaguucucucccaccucgucuuuuuccuuggcugaccaaacacaaguugaacugagagucugaguuugaaucaaguucaaggggaaguucauggagcguccccuuugugcuuccugggagggcucccgaucagucauguuucgggugauucugggaugcugauucagaaugugguaggauuggaaaauggauuggugacugugaaaagucaaguaaggggaaaagcauauggggagggaagucagaacuuuuucccagcuugggggauacucuucuuacuuucagaggcugccugcagggucaguccaagccauccgccucccuguccuagaaaagccuucuguuuaaaagcaucacagagcucguucauggacuguccuacgagugugcucuuuuuccuugaguuggcuaaugaagaauuccuuucuuuuuccuuagagauauagaaaaagaaaggaagaaggguaggaaggauggagaggggaaacuauguuuuggaaaaaacuagacuuuuaaucaauaagacaggcagacuccuggcuuauauagaucauggcuucuuugcugaaaaguuuguuucuguaucauacagucagaaaugcuuauguuugaggggcuuccaguagugacuauuacaugcugcagcaaauuauccucccagauuucucaggguuccugugaacaacuguauagaagaaauuuguacacguauauaguauucauauugcuagacccaaccugaguguaauugagucuccuauaagcacuuuugcugauuagcuucuuauucugauaaaccuugguaaacccgugaaaagagagagugaugaaaagagagaggauggauggcugggugcaguggcucacgcuuguaauuccagcacuuugggaggccgagguggguggaucaccuguggccaacauagugaaaccccgucucuacuaaaaauacaaaauuagcugggcgugguggcacacgccuguagucccagcuacucaggaggcugaggcaggagaaucacuugaaccugggaggcagagguugcagugagccgagaucgugccauugcauuccagccugggcgacaagagugaaacuccaccucaaaaaaaauaaaaaauaaaaaaauuagccaggccugguggcuuacaccuguauucccagcuacuuaggaggcugaggcaggaggaucacuugagcccagaaguuugaggcugcagggaguuaugaucgcaccacuguacuucagccuaggcaacagagugaaagcccaucucuuaaagaagucucagguaguguaaacagcuuuggaaaggcucugcauguugaucugaagcacugcaugacaccggagcauaagcacugacaaacaguguucuucgggauuuugagaggaaacacagcagccaagcuucugugccuccuuuucuggccacugggaacucuaaaaaguuacuuucuggccaggcgcgguggcucacgccuguaaucccagcacuuugggaggcugaggcggguggaucacaaggucaggaguucgagaccagccuggcuaacauggugaaaccccgucucuacuaaaaauauaaaaacuagcugggcauguuggcaugcaccguaaucccagcuacuugggaggcugaggcaggagaaucacuugaacccaggagcuggagauugcagugagccgagaucgcgccacugcacuccagccugggcgacagagcaagacuccaucucaaaaaaaaaaaaaaaaaaauuguuauuucccuccuucuuugcuggguuucaggaauucaucugggucauuuaggggaaauuucugcaguuccauggugauuuuaaucacuaaauaucaacuaaaaaucaacaucccuaaaaaugugguuacauaauaacagaacucacagaaagugagaaagaguagcuuagguaggucgugacaugcagcaacaaggagucaggcaguccuagagccaaaucacuuaauuuuaaugagcuugaguugaccucaucuauaaaguggagaaaaucaugccugguugauaagauuagugauaaugcagcaaagagcuuaucagugcauugccuggcacugaaugguggcccagagaaacuguaacugcugguaucucucagccagaaagaaaauagaaggcggaauuucuggccugauuuggagggguagggagggggcagaggacguccuugucuauguaaacugagugugcaguccaggaagagaaggucucguugucuuugugggggcccagcauaaucagggugcucuuauuguuuugaacagacaccaaaugacagggcugucauauagcucugagcucggauccuuaggucuuucuuacucugaaagcuguagaagugggagaggaccuuagcuuuucucucgaagucccggugacgucccggcagauagauguaggguguugcguucuccugaagguggggcauugugaugcuggggcacuggugggaagucagaguuuaguagacauucagcuguuuuuuuguuuuguuuuuguuuugaaacggagucucgcucuauagcccaggcuggagugcaauggcgugaucucggcucacugcaaccucugccuucuggguucaagcgauucuccugccucagccuccugaguagcugggguuacaggugcccgccacuacgcccagcuaauuuuuguauuuuuaguagagacggaauuucacuauauuggucaggcuagucucgaacucccgaccucaggugauccgcccgccucggccucccaaagugcugggauuauaggcaugagccacugugccuggccgacauucagcuguuaauccuggcuuuggguaaaugacucaacuguucuggaccucuuuuuuuuuuuuucuuucuaacaaaaugaaagauuuccucagcauuugcagacucuaguauaaaugagugaagugggcaaggaggaggaaacagggcaacaggaaugaggauaagugacauuugaccccuggccucucccguucugcuggggagaaugguagggacugugcaaacacaauguauuuucuaucuaaaagggaacugcugcauagcugaaaaucuggauuuuucugugaaauaucccaaaacuuagaugcagauuuuaaaaaauacugcaugugacuaacaaaacauuguuugggcaaagucagugggugggccaccaauuugcaaccucuggccugugauuuccaacuaacaauaaaaauuuuaugaugauuugaucagcugugguaccauaucucugucaaggaagagcaaagauagcucauucuuccaaaagggcucuguguauaauuauuaguaacaacgugggaagccuuaauuauaauauuuuguaauauguuuuucuuuuuaguuguguuucuaaagcauuuaauauacucuaucauuugauaaccacaacgaugguuaugauaaauauuauuccacuuuucauuuuaugcaugagacgguuuaggccuagaaagguuugaugguugccaaaggucucucaggugguucgugagaggugaaggguuauaccacacaucuucuggcuccagacuucauggaccccuuguucugucucuacaaaggcaugcaugcauuuuuaccuguucaaucugcccagaaugccuucucccagcuucauguuccugguuccuuuuauuuaguuuuuuauuuuguauuuuuuucgagacagggucucugucaccuagccuggaguacaguggugugauuauagcucacuucagccuccaauuccugggcucaagagauucuccuaccuuggccuguugagcagcugugugcuaccacaccuggcuaauuuuuuuuuucauuuuuaguagagaugggaucucacuauguuccccaggcuggucuugaacuccugggcucaagugacccuccugccuuggccucccaaagugcugggguuacaggugugaggccccggaccuggcccccaucuccugcuuacccuccagguugccguuugagugucucccugccuucuccucuagagaccucccugcccacucuguuuccagcagguccccugcugugcgcugccucagcucucuugaucuucuuugugccacucaccaccauuuguaauuacucuguuuguuuuacguuuuuuuuugucauucccccuacuagcauguaagugccgugaagguggggacccacguguguuucgcuugacacuuuaucuuugguuucuagccagggaagggcuggcucauaaguaggcgcucaagaaauuccuggagucaguuuguaucuguguagggggagggcguugcugguugagaugcucauauucagauuuggacuguggaaggcuuggggaggacacgcaagucugacuguaauuuggcacaugagcuuuucucacggcagccccauucuguuuugggcuccccauguuuccuaaauguucuguuccccauugauuguugcugccgcucaccccagguucccaaaggugggggccuacccaugaccacugaaguucucaagagcuuagcagcuccuccagcccuggagaagaagccacagguggccuacaagacggagaucauuggagggguggugguccacacacccaucagccaggugaggggccugacuggggcugcggggggaguggggguguggaaguguccauggugugcccaugaugugcucggagcacuguacuggggaaaaggagggugggaguggggggcagcuggugccaguggagccaucaggaaaguacaggucauguuacauccccauucauggguguuagugacggcagugcggaaguggaggcugcugcaucuugaagccauguggccugugcaguucugugccgaacacgggagacacagaagaugaggguuugugaaaccauaggaaaugggacagagcauggcaaacaaggcuggaaaccagccuggugucccugcugguucacauucccuauccuucccuuucuccugggucggcccaaccucccugaugcugguucugugaaaguacccaguagagugcaugacagagaaaggaaagguuuauuuuccuguuuuaauuauuuauauuuauuuaaguuuuuuuuuuuuuuuuuuuuuuuugagauggggugucccucugucacccagccugaagugcauauacacauaaucacggcuuauugcagcgucugccuccuaggcucaugcaauccuccugccucagccuuccuaggcucaagugauccucccaccucaucugggaccacaggcaugugccaccacgccuggcuaaauuuuuuuguauuuuuuguuggagaugggguuuugccauguuguuauuuaauuuuuuuagagacaaggucucgcuguguugcccagacugaagugcaguggugcaaucauggcucacuucagugucagacuccugggcugaagccauccuccaaccucugcuuccugaguagcugggacuacacgccuggguaauucuuuuuuuuaauuuuuaaauuuuaaaaucaaaauuaaacaaaaauuuuaaaacaauuuuuaauuuuuuuguagagacugggucucacuguguuguccagucuggucuagaacuccugggcucaagcgauccuccugccuuggccucccaaaguguugggauuacaggcgugagccacugugcccaccauuuauuucuucuuugacuuagggcaaagaggccagagauucaggcagagggagguagguggggcuguggcugcauagagggagggaggcgcugauacugacacuguuuccuugcagaacgguggggaugggcaggaagggagugagcccgggucccacaccauccuucgaaggucucagaguuacauccccacgucaggcugccgugcuuccacugggccuccccucauuaagagugguuacugcgugaagcaagggaauguggugagugucagcacaggggcugaauugggguucuggugacuccucagagccaguggcuguagacauagcagaggugagaggggauugacaggaggugccucaguccuccauggagccuccaccuuugagggugagauuuugggacugaccuuuggcucccaccugucagagguguugccccugauaugaagaagcccuugccccugcugaaugugggagccggacuuccauggggcuggguccuugggagcuuagcaugaguacacccuccacaaugcugggcaccucucgcuaauggucugccuuuuauuuuuuuauuacagcggaagagcuggaaacgucgcuucuuugcacuugaugacuuuaccaucugcuacuucaagugugagcagguuuguaguagcuuugcugcccuucugagaggucauggaaacuaagaggugcauaggugcacacccacaggagagcgugcaugaguggagaugugggcacacaaagacuucaaaggcgccucugucuuaucuccauucugugcacacaucuuuacagugacacuaaaguguccucucugcagugagcugcuguguggucagagucauagcuacacaacaucuucuucuuauauuuuuuugucuuuuuucuuguuuuuggagacagggucuuucucugucaccugucacccaggcuggagcacagugguggauuuuuuguagagacaggauuucacuauguugcccaggcuggucuugaacuccuggccucaagcaauccuccagccuuggccuuccaaaguccugguauuacaggcaugagccacucugcccagccagauuuuuuuuucucuugcugauuauuuugagaccagauuauuugucaaccugauuuuagccaaccaucucugagaaagggguauuggucagcuggucugggucgugauaugacacagacagccucacuuaccugucuuucuguucuuuccaccaggaccgagaaccacugcgcaccauauuucuuaaggauguucugaagacccaugaaugucuggucaagucuggguaauugugucugcuuuuucucuucuaauccaaaccuccauuuguccucuuaaaucucccuuuacuacccuucagagacucuaugcaagagucaucuucuuccaagagccaggcacaggagccuaacaccuuguggcugacucacugcauccaagcuaacacagggaggagaccgcccugggcacacuugcccucuucccauaccuuacucuggcuccuaagcagauaggccuacguaauaguuucuggugggcaaaaagaaaggguauagaaacaaagaguggggcuccgaagcuucucagguguuaggauuagaugcucaaucccuagcagaacacaggcucagaggagagaccacgccucuaggucacucaccucagugcuucuggucagaucacuguacuagugccucuucccugaccuucuuauuccuuuucuccuccuuuugacccugaugucccauuaacacaaggugauucauagcaucucuguguuacucccacugggaaggaagaacagguauuuuaaagggauuccucuguccacuaggaaauaguuaccuuccaagugccacuuugcauaggaugaguuugggaccuggcaagggaucuccuagguccaacaccaaauacagaugccuauagaacuaaacuuuagagacccuaaggguauuggggcauccaaaaacccuuuuucuggccaccaaucugcagucuuuagagacaggguguuugugucccuccgucucauggcuuguacaagcagaacccucagauaucaucaggaaagcuguucacagcaggccgacucuucucccaugaaggcacaaacagucuugcaugaaaacaacaugcugugugacccaagggggcagagacagaagcacucucccgagucuugcaaauggcaguugcagaguacagaagacuggggagguucccagugacuauuuauaauucgggaaaguagcuauagauggaaauuccagaaguguggcucuagaaguaggcagagggaagauugggcaugaugagauccuugauuguacuugacccuggagggcccuugcagaugugagaccaccugggcacaugggggaagcuuagagaaccauaaggaacuuacgguuaaauccuaagaaugccuugaacuuucucuaacucucuaacucugccagagucacacuaaacugaguuaaggaagucagggacuagcagggaaggaagguccuuagggcucugcagcuuccaugccuguuagacugcuuggccucccuggaacccaguccaggguuuuaggauaucuugauaaucaauuaauauuuguugaaaggcaccauguagccuggugccguuuuaaaaaaauauauaucuuuuuaggccgggcgugguggcucacaccuguaauccaaucccagcacuuugggaggccgaggcgggcggaucaccugaggccaggaguuccagaccauccuggccaacauagcgaaaccccuucuuuacuaaaaauacaaaaaauuagccgggcaugguggugggugccuguaauccccgcuacuugggaggcugaggcaggagaaucgcuugaacccgggaggcggagguugcagugagccaagaucgugccacugcacuccagccugggcaacaagagugaaacucugucucaaauaaauaaauaaauaaauuuuuacauuuuuuaaaauuucuaucguuuugggggaacaggugguguuugguugcauggaaaaguucuucaguggugauuucugagauuguggugcacccaucugcagcaguguccacggugcccaaaugcauagucuuuuaucccucaccccccuccugcccuucccacccugagaaguagaugugaaaggaguggggauuucccaccugcuuuucuuucaccuccucaauaguuguuuaugugacuuuacuggcuaugcaugaguagaauuugaaaggcuaagacauuuuagccagaaagaggcauuuuuuauucagaaacucagaaaguaaucauaguuggugaaauuugcuucaagugacuauucugugacauacauuaugccggaugccuucuguaccuuauaacuaacuggucuuuguagugaccagccugaucaaggggguccucuuauuugucucuguuuuauaccuggggucacaaaggcuccccaaguuuuuacaacauucucaaacaucucuucccuacauguagucaggauucaccccaggucuaucuggccccuauccuguuguucuugcucauggaucucuggucucaugcacuccuuugcccagguaccuguggcacuggccgagguagugccauuuucuugcaggcuuucucauucauaaagccaaccccaccugugaucaguccuuuccaacucuuggcauauaacacacaaucuaacaucugaugguacaguuuugcuuccuuauguucuuuuuuuguuguuguugagauagagucuugcucuguccccagauuggagugcaaucucaguucacugcagccucugccucccaggcucaggugauccucccgccucagccucccgaguagcugggacuauagaugugugccaccacaccugacucaguuuuguauuuuuuuuuauagagaacaagguucaccauguuguccaggcuggccuagaacucaagugauuugccugccuuggccucccaaagugcugggauuacaggcguaagccacugcgccuggcccuuauguucuuucacuggguaggaauuagaucuuuuacuccuuauguauuccccgcaguggcuggggauauacgcggcaggcauuuaacacugggaaauaacuugggcugcuuugagguuugucacugagcaucaucuacuccccgcccucuuccuugcagaagucaggauuucuuuuccaaaacccacacccagcaguguccccuaaaggagugcccugaggucaucuccucuccccuugcuuuccuccucuuuagcucuuugucuccugggccccgcacagugaggcaaggagcaggagcugagugagguugauggggcugcugugaggguggaggagacgguuuagggagcggagaguuggcucccuuaggagaggccaauggcaguggaguaauuaaaagcauaggcucacuggguucaguggcucauaccuguaaucccaggacuuugggaagcugaggcaggcagauugcuugagcucaggaguucaagaccagccugagcaacauggaaacacccugucucuaugacaaauauaaaaauuagccaggagugguggcaugugccuguagccccagugagccaugauuguaccacuguaccccagccugggcaacagagcgagacccugucucaaaaaaauaaauaaauaaagcagagacucuggagucagaccuagguuccaaaucuccagcaacuuggaggagucauuuaagcucugacccugagugugggucuggguuuccucaucuguaaaaugggggaagucuuaagugccccccggggcuguugugaagauuagaugaaauaaucuacaaaaaagcacccgaaacggugcuucccacaaagcacuucauacaccuuagagggaaggagggaggcaggaaggaaggaaacuguaggagauggugguggugggguuggauauuaggcaggagguuuuggagggaaaggagcuuguuagaacugcuggugggagaggggccuggggaggguccaucuggauggcaaagccuccugagacccucuaggaaaugaagcuagaggaaaccccuggaguguuuuucaaggcaggagcugaaggaagaauggcuuggaaccaccccccacccaucuuccuuuuuuaugguagagggcacuggggucuuaggacauaucgaguccucucugaguaugucagcacgccauaacauucuuucucuuucucugucuagugaucucuuaaugagggacaaccuguuugaaauaauaacaagcuccaggaccuucuacguacagguaaaaugcucccuuccagaagacuccagcauucuguuucugugaauggugcccucacaggccguguccuuuccuuugcuuucucuuuucauuugcuugaaguuucuaggcaguaaauuuagccccugagagucagucugagucccauuucauccuaaacaggauguuugccaaaagcuucccaaccauaaaauaaugaaagcagguugagccgcucuacugaggaaugugaguguguaccaguugcucucagcugcugggcuccagcuaagcagagaaaaggagaaccggucaaugauuucacuucuccuuuggaggguauuuauaagucucgucuguguguggacaucacugugugcggaaggacaaaagcacagagggcccugugcaggcaccaggugcagagcccagcugcacagaggaagccauuguucaggcucugaugguucacuuaucaggagcuucuccccuccacccacagcucuggaguucucccaacuccuucuaaagucauaggaacuagaaaggcagauuuccaagcagggacuagacuuucagggccaaguccuaacccagcuugccuagcagugcacagagagugccuugauucgcagccccguggugaugcuggacuuuuaguauugaaacugacacuuggccaggcgcgguggcucaugccuggaaucccagcauuuugggaggccgaggugggcggaucacuugaggucaggaguuugagaccagccuggucaacauggugaaaaccccaucuuuauaaaaauacaaaaaaauuagcuggacaugguggugucuguaaucccagcugcuugggaggcugaggcaggagaauugcuugaacccgggaggcagagguugcagugagcugagaucauaccacugcacuccagccugggugacagagcgagacuuugucucaaaaaaaagggaaacaaaaagaacagaaauaaaaaacugacaaguaagcagguugguuuaaaggugugguuucccaacuaaagcuuuucaagcucccgcugcccuuucuucugggccucgagugucacucccuguuaagcaaccucccuuccccaaggagcugguccgcuuucccauuucuugggcagcaauuccugucacaacuccuuccgccgagcccagcacguguuugaguaacuuagucaucucggggcuauauccauuuggacaagcacauaccauccaggaagagacagcggagugggggcuugggagugaacuggagcuguggaaagggcugccaugggcaucggagcuacuaauucaccagcaacacugccacucagggacaagguuuaaccuguagauugcucuacaaguuuguaguucuugcauucaacagauauuuguagaguauccucagagugcugggcauuuugucucaggcuggggacaccagguuaaacagaacagaucccgaacccaagagagagagagcucgucaaguccauaggcaguuaaacuguggcauggcgcaggggagggagugcugggggagauggagcacaggggaguuugcagacagugaaacgauuccguaugacacugugauggugggugugugaugaagaacuugacagcacaaagaauugaccuaauguaugcaaauugagaaaaaaauuuaggaggucaagugauccuagcaggaaaugcagaaugugacaguaaucgaaauguauuacagguccucccugaaguggguaggggaauacaaaauaaaaaaaaaaauggugugauaagugcuacugccauuagacugaaacgugaaccauaagcaggucgccucacccagucuuagggaguuggggaggguuucugaagaaagauacagcuaagcucagucuguugggggaaaaguggcccaggcaaaggaaauaggagguauuuuuuuaaagccugguaauaaaaggagcaaagggccaaaaggaggcuggacaguuaggcacggaggacccucauaugccuuauugaagagcucguauuuuauccuuagaauuaaugcccuuagagguuaaacaaagggcuugaucugaucugccuugccauuaaaaaauaccacuugggcaaguuauuuaacuucagugccuguuuuccucaucugugaaauggagaugaugaucuucaaccccagcccuuuuaaugacaugcugucaaggauugccuggcccugugcaguguggaggacagaagagaaaaggcuaagauaggaugagagagaacaguuugaaggcuguuguuaauaauuuagugaaggauaaaggaagccugaaugaggguagauggagaaaaguggaaaauuugagagauauuaaaaagguauauuuuccaggacuugagagucagucggaugaagggagagaggacagguaugcccggauguuuggcuggagccucaggauggcucauggcaccagucauuguaacaggagcaugggaggaggagcuguugagaggaaacacaagguuagcauaggugguucagaguuuacagugccugcuggacauccaaggagaugugcuaugaagaccauuggauacacacugcuuggcauguugcugacacuaaauaaauauuugcuaagggaaugauugugcugguugaguucaggagagagcuuuggacuaaagacagcaauuugggaaacacgaaacccaaccaaaaaauguuccaaagauaaucuacaugaguguaugcacauuuaccagaagauucuaaucaccccaucuuccauugccuucugcuucccacauuucugggauaagagaacacuagcgucacacugaauaaguaaacgagagggaggacaaaucuguuuacagcaccuaacucaaaaaacaguggaaagagaauaguauagauuaaaaaucacuuaaaauauuuaucaauucauuaaaaauagcaacuaucaagcugggcaccaugggaugcaccugucgucccagcuacuugggaggcugaggcaggaggagaguuugagcccuggaguuugaaguugcaguuagcuaugaucucgccacugcacuccggccugggugacaaaucaagacccuuuaaagaccuugucucaaaaaaaaaugagcaaucauaaacucauuauaaguuaauaaaacagauuuugugaaaaaaacauauuucuaaaaaauagcaagaauaguauuguuuuuacaguuuugcacaucuaucuuuaauggcuggcauaauagaagacaacaggauucuccuaucugcuucugcauucuaucuguggccauauguuguuuugauugaagaauauggagaaaaucuugccucacacagauguguauuuggaaaaaaggaauauuuuaauagccuuuuuagauaauuguggauauucuuugauucuauaccaaaacuugacaaauguuaauuucuuaauguuuagguacaauguacaaucugaagccauaucaagaaauuuuuauacucuuacauuaaaauccauuggucaauuuugcacuuugaauagauacuuuuuauccaugcaugguuuuuaacaguaugcauuggucauuuggaaaacaauggucucacugagguaugcagauauucaaaauguugacacauuuuauuauguacuauccaaaaucacaucauuaagauaucaccacuaauaucauuaacagucuuugaguguagaaaacuauuaagcucauggagguagccagaauuuuuuuugaaauucuaguuuuugcuuugaaagcucaaagcuuacucauuuuggggauaaaaaucuaccaaauaccuaacucggaauaaguuugacugacaguuuguaugucagucauuuguucuaaguaaaaauuguguuuuaggccaggcacgguggcucacgccugcaauccugggacuuugggaggccaaggcaguggaucaucugaggucaggaguucgaggucagccuggccaacauagugaaacccugucucuauuaaaaauacaaaaauuagcggggugugguggugcgcaccuguaaucccagcuacuugguaggcugaggcaggagaaucucuugaacccagggggcggagguugcagugagccgagaucacaccacugcacuccagccuggaagacagagugagacucugucucaaaaaauuaaauaaauaaauaauaaaaauuguguuuuacacaaaagaugaaagaauaugccuacugguagagcuuggugcuaaggugcuggcaguuuuacccaccaugccaaaguguccuucugaccugcuccccaagguuaugcucaguaaaucugccagaaagaaccguucauccugaguaucuaagagagcuagaccaaagagcagggcagaucaugguggagaagacucccuagacagaagagaaagacuuggguuagauucuaaccacuuagaucuuggucguuuaacuguuuaacucagaugucauauuuacguauaauuuguacccugugauuucucacacuguaguagucuuuucuguuaagaaaagcuaccauuuuuuggacaccuagaugucccaggcauagugcuaaacaacuuacagguaguauaaguuaaaguuuaucacuuuguaguauaaguacuauaaguaguauaaguuuaucacuuaaaucucagccgucucugaaauuaucuccaguuuacacacaggaaaaagaaggcuuugaagguaaauuauuugugcaggaucauaauaaauccagugaauuauggaaccaacugggaagcaccaggugcuggagcaagauuugccaacuuggguuguuugcgagcagccugguccaggccgggugcaguggcucacaccucuaaucccagcacuuugggaggccaaaguggaaggauuguuggagcccaggagugcgacaccagccucagcaacccagugagaccccugucucuaaaaacaagcaaaaguaaaccaaaagaaaagaaaaaaauaagagcagccugguccagaacccaugauauagaggguguggucacagacaaccagggaagucugacucuguuggagaagaccaacuugggguaauugggugucuuggcaaauggaucauggugaccaaaaauccaagaucuggaaauaaccagguaucuaagcagguagaaaggccagugauuucagcaagcuuguaagcagguaaacaguucucaguucugggcaaaaguucaaaaucacauuucaauucuugagcuaccaggcaaguagaggucaccauuuccccauuucccauucauagaaugucaagggaauuaggcaguuuaucaagagggaaauuaguuauucgaaaugagaaauguggugcaaacuggucuuagcuuggcauaagcccaguuguuagaacuagggugcuaugucaggacaagaguagcaauaaguggacucaagugaguugcagaguguugcauuagagcucuucggauacuuacuguuuaauuuagacuacagggugaaugaugucaccuagaacuauguagugugcaaucuacacaaucguauguggcagggcugugucuagagauggcacuaguucuugggaaaggaggguugcagagguggagaacagaaugaaggaggaguugccuaaaaauuuuggauagcggcaauggcaguaaccagaaguagauauggaagccuuuauggccucuagaauucauugcuucaaaccauuguaucuauuauagugcugggcuuauguuagauagucaauagaagcucacuggacuacaauaaaacugcaggcugcaacgauucauuuuaauacugucuguccuacucaucucaaaaacugcccucaaggacagaagcccugcuuuuucuuuugaaccgagcaccagaaacaggugcacacacauaagcacaccaggaagagaugaagcuaugaccuuggcacuuccuuuuuuguuuuacugaguuuaaaguauguuuuuagucucaugguaauucaucauggguggguagacuucagcuauauauauuuuuuuaaaccucuguuucaugaagcuacuuugugaugugguuuuacgauuuugaugaaagcuaagcacaggcuuuccguaaaaauagauauguacauaaccauaauuuuugcauacaauuuuggaguuucauugaguuuuuguuucucaugaaucccaguucuuaaaacuacuaggagagauuauaggccaggccugguggcucaugccuguaaucccagcacuuugggaggcugaggcaggaggauugcuugaggccaggaauacccugcuccaaaaaaaauuuaaaaauaaaacauuguaauugugaucucaauaaaauaauauuguuucuucucauauggaauucauugcaauaucugauuuucuuuuugagcaguauuuuaaaauaacauuuauuagggaguagcauuuaucuucauggcugaguuacuaucuagguuaucugaccgaaaaauguucuuaagaaggaauuagagaauuagggaagaaauauaacuaguaaacaauuuccgucuucacuaaauuacuaaauguuuuaagaaagagauuuaauuauuuuaccuaucauauuagcaaagauuuaaaaaauuauaauauuuaauucuagcaagggugcauguaacaaaaauguuggcaaaugaaauuuauauuauuggccagaaaucucucuggccagauguaagaagagauuuaaaagggugugaauucuuuaauuuaguaauugccuugggagcugaggguuccuaaauauuccuaaauacgaaaaaagcuuuauccccaaagaugugaguagcagcauuauucauaugaggagaauagggaauauucaaaaaauauuuuagagcagcgauccccaaccccuaagcuguggacugguacugguccauggccuguuaggaaccugaccacacaguaggaggugagcagugggagagcaaacauuaucgccugaguuccaccuccugucggaucggcagcggcauuaaauucucauaggacugcgaacccuauugugaacugugcaugugagggaucuagguugugcgcuuccuaugagaauguaaugccugaugaucugagguggaacaguuucaucccgaaaccacccgucaucccccucccuuuacccuuccaaguucauggaaaaauugucuuccacaaaaccgaucccuaugcugaaaagguugaugaccacuguuuuagaggacuaggugggugaaccauaguauaucuacuuggauccccugaaaaugcuuacaaagacgucugguaacauggaaaaauccuucuauuauuaacugaaaaaaaaaaucaagauauaauguaucuuuguauuuuggaaaacagaaaugaauagcaaaaagacuggauuugcucucaauuguuauuuuagaauuuugugagguuuuaaagugauuuuauuuuauuuuuucuuguuacuucccuuuuuuuuuuuuuuuuuuuuuuuuuuuuuugcaaagguuagggagaagaggucuugcucuguugcccaugcuggucucgaacuccugggcuuaagccaucuucccacauucuaaacuuuagccuccuaacauugugggauuacaggcuugaaccacaguauccagccgauuuuaauuuuuuauuuuucuacauuuauuaucuauauugucuuuaaugagcccuuauuacuugcaaaaaggaaaacggggaaaaaauaacaaauuguauuagguagucauccaagaauaauagugguauuuugauucuuguacuugagugcccaucuaaaucaggauaguccuaguuuucugugauucugugauuucuugcuaagcagaggcugggugaagacaccuggguuuccugugugacaguuccuggagaaggaguuuguggggaggcaguacuucaaagcgcagucaggcagguggccuguggccuguggggguagcauuugacaugacggagagcauuucaguagacugcuggaaggagcauggagauagcuuaacaccccuggaaacugauuaucggauugucauccuggggauguuccugucuguuuaaugaaaaugucagaucuccuaugugacauaggagacuuucucccucagcucauaugccuccuaccaaaucaucuuuuguuccccuaggaggaaaaucucuuaauaaaugcuuuucuccuaauggaugaugaccuccaucucauucaaauucaaaauaaccuuuuuuuuaaccuccaaauacaugaucuuauuugaucuugaugauuugaucuuugagguaggaauuagcugcaguuugaggaugaggaaacugagaaaaggucuucuuauggagagggcaaugcgcuuaucuguaaaugguggcguuuaaggcuucauuuuuuugucgcauaucauauaauaccagugaaaacaacaauaauaucugcuacuuacagagcccauucugugcguucggcccuguuucaauaguuuuuccuaauugaggucauuuaauucccucaauaauuaagcuuguggaacaggccagcccugauauuuguaaagaaccuucuggaaggaucuuggaguccuuauccuggugaucuuuuuggacaaaggauggguuugucuuuuucuugggaaaccaccagauugucaaauaacuggaaaaagucaagcggggagacagcgcuaguaaguuugcaggcagagcacacguuagagagguguucacuuuggccacuugucacuacacccuuuuugcccucgugcaccaggaccugaacgguuuuccuuguaggugcacacaucuaaccaaggaggguuuguuuuggggugacaggaagggguagggaugcagguuugagaauuuuuguuuuacugucuuuuccugauagaaugcaaagaggaggggucacuuuggggauggggggaugaggggggauguggaguccuuugggggcuaguguguggugguggcacauacaucugcaugugcacaccaaugcacgcguguguguuuuggugggacuguuaggggaugaugcuggagacagaggaaggcuaacaugcauauuucuggagauucugccuggucccauugcugugucuggcaccugaugcagcauguaacaccggguggggcccuuagccagcguuugcucuguucacuugaacucaaccccuauaaagcuggagggcacugacaggcuccaccggcaguagcgaggccgcuggaguuuccucccuuuuuucauagagccgcugcugcccccuucugggguuuauagguuguuucugggaggaaauaaguaacucggcuucauccuucacauacugugaagcuuggugcugcgagucccacaacucuuuaaauuuuuuuaaaaguuuuauucacaauagcaaagucacaacucuuuuuuuuuuguauaaauuuaagggguacaagugcgguuuuguuacaugaauauauugccuuuuggugaagucugggcuuuugcuguaaccaucaccugaguauugugcaucguacgcaucaaguaauuucucaucccucacccgccucccacccucccucccuuccaugucuccagugacaauuauuucacacccuauguccauguguacccauuauuuagcucccaguuauaagugagaauaugugguauuugacuuucugugucugaguuguuucacuuaagauaauaguuucaucuauauuucugcaaaagacacgauuucauucauuuuuauagaugaguaguauuccauuauacauauggacaccacauuuucuuuaucgaguccucuguugguggacacuuagguugguuccaugaccuuacuauugugaauauugcugcaauaaacacaagggugcagguaucuuuuugauauaaugauuucuuuaaaaaauuuuuaaaguuuuauuuuagguuugggggcacaugugaagauauaaugauuucuuuuccuuuggagagacacccacuauugggauugcugaccugaaugguaguucuauuuuuaguucuuugagaaaucucucuacuccuuuccauaaagguuguacuaauuuacaugccuuucagcaguguauaagcagucccuuuuccccacauccuugucagaaucuguuuuuuguccuaauaauagcuauucugacugguaugagaugauuuuaauuugcauuucuccaaugauuagggauagugaacauuuuuuucauaugcuucuuggccacuuguaugucuuguuuugaaaacuauucauguccuuugcucacuuuuuuuuuuuuuuugagacagagucucacucugucacccagacuggagugcaguggugugaucucggcucacugcaaccucugccuccuggguucaagcaauucuccugccucagccucccaaauagcugggacuacgggcgcacgccaccacuccuggcuaauuuuuuguauuuuaguagagacgggguuucaccauguugcccaggcuggucgugaacuccugagcucaggcaauccacccgccucgaccucccaagugcugagauuacaggcaugagccaccacgcuuggccuacacuuuuuaaugggaugauuuaugguuuuguuguuguuguugaguuauuugaguuccuuguaaauuucaaagcgacccaguagcuuguauucugagaaaagccccauuucugaaggcaauacauaucuuagaggauuuacagugggauuuggcuuuaauagggcuggaauugaaagugggauuauucuguucagauaguuacaguggaaaggcaacuauguugagagugaggagaacucgaaucucuaccagccauaaaccuugggcuuuggcuuucugggccucauuuuccuuuuuuauaaaacuaggaggcuagacuggaucaguuguuuucuggagggggugauggacuucagcagcggauagggucuuaaacuuuccccuuccucacagccugugccucauuucagagcagcuccacuuugagcgguuuuauuuauugggugucaaauaagauauugcagggaaaacauguccuuaaaagucugaaagcuacuggacuagaugauuucugggaugcuuucuaccccuaaugguguaauuuuauaaacuuaauauugagucagagacuuggaagcugaaaucauagugccuaaaauuucuugguaagagccauggauguuuugcaggcagacaguccagaagacaugcacagcuggauuaaggagauuggcgcagcuguccaggcccucaagugccaccccagaguaagucacuuccuuucuguugcacagugucaacucagagaugaauuccucucaagcaggcauguuuuauuuggugauguaggcaagcagccuggucccgaggugcagcugaagccccaggcugucuugcuuguuuuucucauucuacuaauuuggguacacauuuuuauuuuucucuguuugguugugggaggaggugagguaggguuagauagagaaauggaauuucuuuuuuuuuuuuuuuuuugagacggagucucacucugucgcccagacuggagugcaguggcacgaucucagcuuacugcaaccucugccucccagguucaagugauucuccugccucagccucccaaguagcugggauuacaggcacgugccaccacgcccagcugauuuuuuuguauuuuuaguagaaaugggguuucaccauguuggcuaggcugaucucaaacuccugaccucaggugauccacuugccucgggcucccaaagugcugggauuucaggcaugagccaccacgcccggccgagaaacagaauuucugauauguccugcaaguuucacugccaggcugacguugacacauuuggagugaauccuuuugacuguauuucauuuuuguaggcaagcauccuuggacuuaugagguggugauccugguuggguacucuuucugggacucugugauaaacauugucugaaaagcccuaacuuucuuuugucuuuuucuuccuuuuauuuuuauaggaaacguccuuuucuagauccauuucuuugacccgaccuggaagcuccagccuuucaagugggcccaacucuauccugugcagggggcggccaccuuuggaggaaaagaaagcccucugcaaagcccccucuguggccuccuccuggcagcccuggacaccugucccccaggcuggggagaagcugcuuccaccuggagacacuucagaggacuccuuguucacgccucguccuggggagggcagcgccuccuggggugcugcccagcucccggauaaggcacagaucggagccccagcaccccaaggagaagccguuuauguucaaccuugaugaugaaaacauacggaccucugaugugugauggagcacagugccaugggagggagggagggagggaggacuugagagaaggaggcugugacucaguuucucuaccuuguuggaggguagucagaggccuuuaugucacucauauuccuguggaugcucuuugggagggaggggcccauccagcugggcuguguguguguguguguguguguguguguguguguguaauaucaacgcaguguauuuaauuuggggaagucacuagguuagaacuguaggcauacucaguggagaggaagcuaccuauucuauucuaacuauucugaggucuuccuggagagggauuguuuuagcagcuccucuccagagggggcuggaaguccaguuucaccaaugaccaaguuuuauuuccuuguccuuguuuuaguuuuuucauuuuguuuucaguccaggugccucgcagcucuuuuggaaugggccagcauuagucuaauuuuaagcgcuauguguuuuguacccuugcaaacuugcuuucucuuucuucuugcuguugcccuuugaaugaagccuugugugcuugcaugaucagacccuguaauaggaugaauuuccaugcacuuaacaugaagagauacaaaaagaaucuagagagagauauauauuuuuaaugaaauagaagcuuggcauagaaacauugauuuagauguuaugaguugcuggccagagauuccucagauaaaagagccuagaaaauugaguuuugagcgggcaugguggcucacgccuguaaugccaguaguuugggaggcugaggcggguggaucaccugaggucaggaguucgagaucagccuggccaacauggugaaaccccgccucuacuaaaaaauaugcaaaauuagccgggcgugguggugcaggccuguaaucccagcuacucagaggcugaggcaggagauucacuugaacccaggagguggagguugcagugagccaagaucgcgccauugcacuccagucagggcaacaagagugaaacuccgucucaaaauauaaaagaaaauugagugucccacccaaauuuuagggcguaccuccuuccauuugauaagaagaugcuauuuccagugucccugggagaauucuuccauccaguuuauauggugaauugccaccagcguucccuaaaggaagagagaacuuagcuuauuucugucugugacuuuuaucagcuagaucaguuaauuguauuuuuaaauuaaaaauuaguaacuagaggaagagacuaagagaacuauuuuuaccugaguaaaugcucuccucuucuuguguccaaaucuaaugcagaggugaaaacacuugaugagaaaauccuuuguggcuugaggggaaucauguuucuuucaggacguguuguuucccugaagucuaugucacacugagaacuuuuucugacugcacugcuuuggagcuauucauuuaaauugaguuuggccuaguuuuccugguauaaaacaggaaaucuacauuguucccucuuucucucccuuccaucccuuccccugccuuuccuauacacgcuggugugcuuuugcccucagaaauucuugguuugggaguuauguauuuuugagugaucgagguuaugacauacuuggagcggcaugauuucaagaagccauuccaaauucuuauagcuccuuagcucugguuuuacucucguauuuuccccaagaaaauuuuuuggcuauucaaagaaagcacaaaauaugugauguggaacucaugaaaauagggacuuuugauaucucuuuaaauauucccugacucacggaaaagauguccucuuuugguguauacauugugaaaaucuacccauuuaucucucucucucucuuuucuuuuaaauaaauuaucugauaaggccggcaagguggcucacgccuguaaucccagcacuuugggaggccgaggcgagcggaucacgaggucaggagaucgagaccgcggugaaaccccgucucuacuaaaaauacgaaaaaaaaauuagccgggcgcaguggcaggcgccuguagucccagcuacuugggaggcugcggcaggagaauggugugaaccugggaggcggagcuugcagugagccaagaucgcgccacugcacuccagccugggcgacagagcaagacuccaucucaaaaaaaaaauuaucugauagguuacuauugcuaaauuaauuggccauuauaauaagcugauuuguuucuuauucagcaagaucucuuuugagaaugugacaaauuaaacauacauagaauccauaugguauuauccugauaaagggaaacgaggacacuaagacugucaaauggaaaucuucuugucaauuggcaaacacuugggaauuccacauuagagcauugcuuguuuuuaauuuuuuuuuuuuaauuuuuaaaagacagggucucacucucuuacccaggcuagagugcaguggugugaucauaguucaucauaacuuugaaucucugggcuuaagcaauccucccauguuagcuucccaaguagcuaggacuacaggguugugcuaccacgccuggcuaauuuuuaauuuuuuuuuaucuacagagccuggcuauguugcccaggcucucucaaacuccuggcccaagugauccuccugccuuggccuccuaaaguguugggauuacaggugugagccacugcaccuagccagaacaucguuaauguaguucaauaugagauaaauuauuaucuucaaugaaacaagcucuaaaagcauuccauuccuaaauuguauuucaaacuuccuauuuuguugauauuucuuaacuucuggccaguuuuggaccauaaucuuuuaaugugaaccaaagaugguacguauuugaccaaagcaguuaguuuuaaauguauaaaauugaaccaaauggaaaaaauagguuggggaugcaguauagauuagugacuaagugcauaggcucuggaguaaaucugaguuuuuuuuuuuuuaaaggaacuaaaaaauguacugcauuuucuuuguggaauaaaagccuugccugaguugugcuauuuucauaaggcuuuugaaguggucuugacccacuguguguaacaguauuucaggugguccuccccauggcugaauaaugccauccauuauucuuuaauuuuuauuuuuagaaacaguguuucacucugucacccaggcuggagugcaguggccugaucauggcucacugcagccuggaccuccugggcucaagugaucuuccugccucacagccucccaaaguacucagauuauaggugugagccaccacgccuggccaccaucuauuacuuuugaaaucuucaaaagacuugcuuacucaaugucagcugaugguugguaaaaauaauuuggccuuuaguguuaagugagacaucauaaggguauugagguauacauuauggagauugaugucaggucagaauauuggaguuauacaucuauuucugaguugaauacucagcucccacgagaaagaaaguaguuuuaagguccagcuucuuagucuacuugaagcaaauuuuuuuucuuuuauauuucugaauauaaauauacucuuauaugggcuaaaaagaccccaugaauaaauagcagguucaguaguugaggaguggaguuuaguagguuuguuuucaguauaaauuagauaacauguggaggucacagcauuuuggaaauugaguguccccaagugagcuuuguuuauaaacuuucaaaaugucggaaguggacagguuuguuaaaucuugucugccagcacccuuuucuuccuuuguuccuuuuccucucuguguuauugccugcggcagccaguccuucauacuagauagaguucagauaaagcaaacguuuggcaaaaacauacuguuugaccuccucccccucugcuuaugaagggguagcaugauucuguguuuuaaagcagugauguuucagcugugaaaugcacucgcuguaagcucuaggcugagugcauggaaacuguuacgcuucucauuuuaugugaucuccuaauugguauguagcaaaaauuuucuaaaacuguuuuguggcuuguuuuguaauaaaaccaugugaaauacugaaau

SEQ ID NO: 15561 - RNA, 521 nt, Homo sapiens
uuucuuuuuuuucuuuuuggcauaugaacauuuauuacuacaguguuuucaccauuaaaauuuaugaucuuggucuuuccuucuugccuuuguauagggccaaaagaaagacacaggcuacuuugacaaccugaaagcgaacuccagaaauaucaccaacagcaugaccuuuuugaccaaauccagcaaccagagcuuuaugguuuuccacaauaagguucaagcaaccaucacugaauacaaaggcugugauuuucuugccauccuugauccacuggacccugacacacuuccuaauggcagaauuuggcuuuuuggcuucaacuccuacuuuucccagcacaauuccuuuugcaugagaagcaccuccaaaaggguuggccuucagggcugugcccaaaugggcuuucuuguacuguuuaucaugccacuucugaucuuguuggugacuacagagacuccuagcaguaugagguccacgacacuugcccauccugcagugcuacgggccugagcaaaag

SEQ ID NO: 15562 - RNA, 6100 nt, Homo sapiens
uauaggaacauacacauaaaagacaaugucauauuuaaaguauaaucacaauaaagagaaagggagcuguagguccuauggcauccauucugaugacaucccauaauuguuccuuauauuccauugugaagaaggggcagaaaaagauucaucuguccuucagaugacgauaccugucauuuuucuuuucuaccuuagucacuuggcaguguuggugcauuugagcagaucuucagucaugaauggaaggaaagaagcucacaaguacaguuauggucaaaugagguagaaacagucaucuguuaguagugcugaaaccacacuccugaccauuuucuucuuuauuauuguuuucacuuaguaauucaacaaauuguuuaugcccacgguguucaaaaugcacagcaguaccagauggcuggacucagauaagaugcacacaaaagugauaaauuacccuagauucgacauuuuccuauuuaaggcuugauggaauugucaucagagaagguaaacagaaucaaaguaauuuaguuggccaugcccuagauuuuaagauuuugagcuauaugaaauggaaauuaaguuuugauaaugaacucuagcuucugagacaagguggggcuauguaaaggcuucuuugugacaagauccuucuaagaauggcauuuaaauuaaauguaaaaacacuguagaucuucagauauuaaucugauagaccagauucauaagguguuggacaccuuugaaagauccuuuuacuagaacauguggcauacaguaguggaaaagaaccguaacuccucaagauagaugagcaggggcaaaaguguguaaucauuuggaggcagaauacaguguggcuuauguccucacuugcaccuuggaaggggaaaaaaaggcuagaauuucuugucuugugcaugguccgguuaggagggcuaguucaccuguucucuauugagauagauucaauuuuuuuuuuuuuugagauggggucucacucuguugccuaggcuggagugcaguggugcgaucucggcucacuggaaccuccagcucccagguucaagcaauucuccuaccucagccucccagguagcugggauuacggcacacaacuccuggcuaauuuuuguauuuuuaguagagacaggguucaccauguuggccaggcugguccugaccucaggugauccacccuccucagccucccaaaguguugggauuacaggcaugagccaccacgcccggccagauucaauuuuuaaauaucaaaacaauaagaauccccaggcuucugugcaguggaaaguacaaguuugucuugaaaugguuuauggcauucugcaucagucagaggaggauaauacugccgauagcagacauaggcaaaugucauuccaaucauggauccaacuaguacaucugaagagaguggaaacaaggucuucucuuaauauuaggcuccuaaauccuauuacauacacauagcauagaggaccuggcccuccaggauacucuacuguggggcuaaaauaaccucaauuccagacuuaugauuucuaaauaaaaucuuuuuauucucaauuuuaucauaguuacaguauuaucauugucagguugcuuucugaacaccaaaucaaaacacaucuuaaguaaguauaauaagcuuuguucagaguguacuaaauuagaauuuuucuaacucagaagaguaacaaagguccacuuauugcuauucaucugcccauuuucaccauuuaaaggguccuagaggaaggaauaaaguauuuuaagaguugcuucucgccgggcacggugacucacgccuguaaucccagcacuuugggaggaccaggcagauggaucccgaggucaggagauugagaccagccugaccaacaagugaaacccugucucuacuaaaaauacaaaaauuagccgggcgugguggcaugugccuguaaucccagauacucaggaggcugaggcaggagacuugcuugaacccaggagguggagguugcagugagccgagauggugccacugcacuccagccugggcgcagagcuagacucugucucaaaaaaaaaaaaaaaaaaaagaguugcuucucuuugcaaaaaacuaguuuauuuaaaaauuuaaaauaggguuccugaggaccugugggcaauaccuccagcguuuuuuuuggaauugugucagguucaagccauucuccugccucagccucccaaguagcugggauuaaaggcgugugccaccaugcccagcugauuuuguauuuuuaguagagauagcguuucacuguuggucaggcuggucuucaacuccugaccucaggugauccaccuaccucaccuucccaaagugcugugauuacaggcaugagccacugcaccuggccucaauuuuuguauuuuuaguagagacgggguuucaauauguuggccaggcuggucucgaauuccugacuacaggugauccgccugccucagccucccaaagugcugaggugugagccaccgcgccaagccagguguucuguaauuuggauauuuuacuuacuauagcauucagcuuaaauuuguuugguuuaauuauaauuuuauguuuucuugaauuuuacuuauguuuuugaacaaaaguccuaugacaaugaaccugauuuuuaagagaguaaauugaacuuugagguuuuaaauuuccuguagaugcaguuuaacuugaacuuacaaugcuucaaauaauggaaaaauuaggauguuuaucuuugguaaacucuuuuugucuuaucuuuccuauaauuuuaaauguacuuaguacagaacccagaccauccauacucauuaauuuguucauucagcagauauuuaguaagcaucuccucugugcuaggugcuaggaauaaaaugagugaaauaugcaagcuuccauagccugaguacuuugcuuaccuugccagugaugcuuguagucacaugugcgggacagugcaaucacagcugcaaaaaguagaggugacagaaaggcacagaaccuccaagauuucccacggccuuguggugugaagcaguguaacuucccugccagguagaaggacgcaaaggccagaccagcaaaugcaacuggaacaagaaaaacuuuuaagugguuugucuuuuaaaggaagcuaccucauucauccccacauaggaggcuaggaagcaugaguauguuuuuauuuauuuauuuuuugagacagucuugcucugucgcccaggcuggagugcaguggcaccaucucggcucacugcaaccuccaccacccggguucaagcgauucuccugccuuagccucccgaguagcugggacuccaugugugugccaccaugcccagcuaauuuuuuuauuuuuaguagaguugggauuucaccauguuggcuagccuggucuugaacuccuggccucaagugaccugcaugccuuggccucccaauugcugggauuacagguaugagccaccacacccggccaugaggguguuuuaauccuuuuuuguguauacuuauaguguaagucauugugaaggaaagggaaacaaaaagaaaaaugaaggacuuagugccccaaaguuaauguuuuaucugaguauaguuuucgguauacuagcuauauguaucaacuuguugaugcuuuaguuuccucaucuauaaaugggacucauaaauacaauaguccccaccucauuggauuauugugagcuauaauuagguaagaaaugaaaaugcuucaaaguaccugacacauagaaacucuucguuaaagguauuuuuauugcuaguacaagauugcaggaucuaggcaaauaauauaacaauuaaaugugcaaaucucaugaagguaaacuaccuuucuguucuguaauauuuacccaaauagucaaggcucagacuuguuaaacuguggaguuacuaaagaaggggggauuuuccaaauuguagaaacaagaguagucagauuuucccaucccuacuagcuuucuagguuaaauucaaugaugugaaaacaagcauaggguagaguccauaugauauucauacaggaagaauguccacuggggaagcucuuucggcccucauucaccacguccuuauccccuguacacaucaagucagaaugggcuagcccaucagggaagcagcgguagaagaaaucugggcguggccuggaagaaagcagcaugguuggaacguaaaucauuaacuccagaaauuauuuuucaguuguagcagacauuaauaauccuguuaacuauuggucaaauagugccccaggcaaaauaagguaacuggcuuaguauagucaccacacuaagagaaaagccuuucaaggugagcauuuaaauuaggggaaaaacgcccauuccagcacaugauuacuuuuuagggcaaacagcaaaugacacugcagcuucaggaggugcucaagaggacacugaccgacugcuguggccguuggugggaaaugcuguucaggcagaaaagagcccaggugucaccuggaggacugagguauggggaagggaguaagcguugaaugacaaaagaaaaaucagagugaagauaaaggagaaaagaaugagaaagacgugugguggacaccauuaaccucucuguucugguggguaagggcugaggcagaugcuggggugguuagcuguugucacuuaccucccuacgaucaguuuuauuguguugguaaagacgccauucagagccagggcaaggcuggcagcugcaaagcaaagccauuaguugaaaggaucugucuaggaggaaagguauggucauggccucguuaugagagcagccgugcuguuucugagauggauagaauccaaccaggccugggcacaaaaauaauuaggguccucagugaucacucuuuuguagccgagaacuuuuguacuaggccaaagacauuucugagguacaaauaacccagugcauuuaggcacagggcugccugccguguagccugcguaaccaagucccugcagugcuauuuuccucucccgcggggauagaguuccuuuaggaaugcagaacucaguggccuccacacaggcucaccguggcugaaucccacaacgaccuccuagguucccagcacgaagaaaccggcccgaaagggcuagcgcucacccaggcaggcuugucugcugucucuugugucugccuucuugagaaauuuggccaggaagaucagagacaguggagagagaaaugcaauaaccugaaucagaaugucagagguuaaaaacaauccaaaaaaaagccacacucgugcuccuacaggaaagagggaugugacacagcaggacucacuggagcuaacauaaggucucugagugcgcguaaccgggcgccaggcagcgccaccagugaacagcagcgcccgugcggcucgggccccgguaccucaggcugaggcacagagcgcccgggaaaacguugucucagcccaaagaggcucggacacccuccucucucaaucaggaucuuaaacacucgagcccuaggaggcggaacccagcgcacagcagcggagugggcagugggucccuacaaaggccgucucgggguggaaaacgcacaggugcccgcgggaagccgggucauggggagggaggaaagacgaucuuucuccacgcacaaacaucggcuugguggggaaauacuccgccuccacguagggguuccgguagagccacaucuccuccggcuggaugagucucuggaacggggggagcagcuccgucacccuagaggggaacaaagaagcgcagagcaggucgccuggcuuccuccccgcuuccccacugcccgacccgccgccccgugccgcccgccugccugggaagcggggccgcccgggcccggccguggaucuuucuuacaggaaggccgcgaacagcgcgagccgcacgcccacuucggccccaaaggccaccgccgccgccgccuuccccauccggccgcgagcuccgagcgacgcugcgcugacguggccaccuccgcggggagggccgggccgggaacugggcaccg

SEQ ID NO: 15563 - RNA, 12481 nt, Homo sapiens
ggcuggaaacaaugccuucaggcagguuuccugagucuaaagauauaccugcaccccuagcugcuuucccaguuggucacucaauagagaaggagcacaccaggcacaguggcucacuuugggaggccgaggcaggaggauggcuugaccccaggaguucaagaccagccuggguaacauagcaagaccccgucucuauuuuuaaaaauuaaaaaaaaaaaaaguuuuaauagagaaggagcaagaguccccugugucucugcuggaggugagugcugaggguggggacagcuuuuaagggggaaaguggacccagcaccugccuuggggagauaauuccacagaagagacaagcaaacacauacaaaccauucaacaaaucaggaccagaacuaagccccucaagugauacugacaguaaggguguggugggaggagccagcauuccagaagaccaggauggucuaggaagguuuccuggaggagguuuugaggaaggggccggguaccucuaggcagccucugcucacaggauuccccgacugcaucaccgggguggaaaucgggggccaggggggugacuccccuguucuauaugggcuccaagugccaggccuggcucugagcagauccugucccuuucacccugucugguguuggggagacagcgagagugcauggggccccggcacugcuccccauuuuuagggcuccccucugccucugugaggugguggcaggacacagaacucccucccacagggagcagggccugggccaggggcaguuccagugugaguuuuuccacucccaauauucuugcccagugaaucuggcuuaaaagcagccucaaggucacuguaaagggaagagauuccgucagagucagagcccagcacgugcugcgccuggguaagggugagugggaaaugcagaggccucguggggccuugcucagccugacagggccccuaaagugcaaagacuagggugaacaccccaacgcccugucuuuucuuuuuuuccuuuuuuuuuuuuugcaacagagucucgcgcucugucauccaggcuggaaugcaauggugugaucucagaucacugcaaccucuaccucccaaguucaagcaauucugccucagccuccugaguagcugggauuacaggugccugccacuaugccuggcuaauuuuuguuuuuuuguuuuuguuuuuguuuugagacggagucuugcucugucacccaggcuggaguacaguggcuuuaucuuggcucacugcaaccucugccucccggguucaagugauuauccugccucagucuccugaguagcugggauuauaggcauacgcuaccacucccggcuaauuuuuguauugucaguagagacgagguuucaccauguuggucaggcuggucucaaacuccugaccuugugauuugcccgccucagccucccaaagugcugggauuacaggcaugagccacugugcccagcccaugcccugucuuuucaagcuuucugcacauaccaagacccccagcccagcucacucagacaaagcuacuggcgggaaagugugaggaagggugugggcguggcccaggcccuccucuucucucugccguauacugauagggcugccccgcccccccccgcccccccgcgacucagccacgagaggucauccuugcuccagcacagaccccuaagaacccucacucggaacaggacuuugggaaaggugguuucuauaaauagaugaguaaauaaauugacaguugaauauaccaagcguccuggggaccgcaggaggaacuguguacagauggcuugaaggccagaggcuuggguuguuguccuggcccugccacuggccagcuguuugaccuugaacaagucaguuccacucuguggacuucaggguccucacccagaagaagagcagccauauggucucuacugccugguaaacacccuggcucacucucgcgagacggugguucucaaaguguaguguguaguccacacaacaccugcauugcaaccacuggguauuuauuuauuuauuuauuuaauuuauuuauuuaugacggagucucacucugucgcccaggauggagugcaguggcacgaucuuggcuuacugcaaccucugccuccuggguucaagugauucucaugccucagccucccgaguagcugggacuacaggugccugccacaucacccggcuaauuuuuuguauuuuuaguagagaugagguuucaccauguuggccaugcuggucucgaacgccugaccucaagugaucugcccaccucggccucccaaagugcugggguuacaggcguaagccaccgcgccuggccaagggaaguuuuuuucuuuucuuuuuuucuuuuuucuuuucuuuuccuucuuuuuuuuuuuuuuuuuuuuuuuuuuuuuuuuuuuuaacacagguuucugagccucaauuccagaucagcugagccuggaguuucugaagacaagggcuagaaaucugcacuuuaaagucuugaaaaccacugugugccuucaucuaagcugccccugcuucucuccccuccaucccucgccuggcccuguccucccuacucuccccugcacccucccccgccccaagcuccccacaaacggccaaagcagcagugugaggcaaucgcucuauccuugaccccuuccuuugcacagugagugauggcguuuuuaucuccugaugaugaugcacagccuucagcgggggacauuuaagacgcagaacaccagguccaggcugcagcugcgggacucagaggcgaagcuugaggggcucaggaaggacgaagaaccacccuugagagaagaggcagcagcagcggcggcagcagcagcggcagcgaccccaccacugccacauuugccaggaaacaaugcugcuagcgacauucaagcugugcgcugggagcuccuacagacacaugcgcaacaugaagggugagcgcugcgggaaggaggcgaugagggguuggccagcucucagcggaugaggcucaggccacccaauucugauccuaguugugccucuuacugggugaaccugggcaaguuucuucccuucuugaaucucaguuuuccccucggaagaagugggcugguuacuaagauauaucccuuccagauucuauaauuucuggucuccccuccaggacuccaaucuuuuuuucuccuuuucuuucauuuuuauucuuuuucuuucuuccuucccuccuuccuuuccuuucuuucuuccuuucuuccuuccccuuuuccuucauucguucuuuuuuucuuccgccuuuucuuuuuuuuuuguuugaauaaaggucucugucacagaggcuggaguacaguagaacaaucauagcucacugcagccucaaacucaugggcucaagccauccucccaccucagccucuugaguaccugggacuacaggcgugcaccaccacaaccagcuaguuuuauuuauuuauuuuuauuuuuauuuuuuuuagagacaaugucuugcuauauuggucacgcuggucuugacccccugggcucaagggauucucccaccuuggccucccaaagugcugggauuacaggugugagccgccacaccuggcuuacuuuauuuugagauggagucucacucuguugcccagccuggagcgcaguggcacgaucucggcucacugcaaccuccgccuccuggguagcugggauuacaggugcaugccaccacgccuggcuaguuuuuguauuuuuaguagagacaggguuucgccacgucgaccagacuggucuugaacuccugaccucaggugaucugccucccaaacugcugggauuauaggcaugagccauggcgcucagccuauuuuauuuuugaggcagucucgcucuguugccuaggcuggagugcacuggcgcuaucuuggcucacugcagccucugcguccuggguucaagcaauucuccugccucagccuccugaguggcugggaccacaggcgugcaccaccaugccuggccaucuuucuugaacuauuccugacuuugccuuccuucagagcuggacaagucuuguagcagggguacacaggaaagucuugcccacaguggcagaguaaauauuagacuugacucccacaggcaaaaaaagacggagaagagacauaggggaguaagacaggagggcaagguaaagagauaagacggaagacugauuaucauugaauagccaggaaggggcagaaaccagcuacaagaggccacuuuuguagagcugauucgcauccaaggucauuugaaucaauccccugcugccacugaaggguacacaagucaaucuaggcacgaucuuuccaauuacacuggauugaauuagcuaccuuuagagcgagaagccaugcuuagaucugcagcuggcagugguguugucguccucacuagauggacagggcuucccuggcccagaauccaggggcacacagaguagcuuaugcaugcaagcacacagacucacagaagcacagauucaugcaaucagauucuggcaagcacacagaccucaugcaagcacagacucgugcagacacacagacucaugcaagcacacaggccucaggaguuguauucuccuuaugaaguaggauuuuucugguugcuugaacacagcuuuuuccccuuuuagagacagaaacuccagcaggcucugguauagcccaucuccaggcagggccaggccugaccaccccagauggaaggcagauuucuggacccuggagcacugccaugggaguugagggccuggcucuaguucaggucccugcuagaauccugugugcuccugagcaagucacuucccucuccaaaccaacuuacucauuugagacaagaugagggggugggagugguccaucucuaaggggcuuuccagcuccuagacaaggguuauucccuucugcagggcugaggcaacaggcugugauggccaucagccaggagcugaaccggagggcccuggggggccccaccccuagcacguggauuaaccagguucggcggcggagcucucuacucgguaagugcugaggcuucugggcuccuggugcugcuggcaggagguucccuggagggugauguggugcauguggcuuuggcuccccuccugccauuccuucauuuugagaggacguccccagccuagaguuccucaaggccagaucccucucuggucaccuggggcggcugugauuaacucgaccagcaggcuggccccuauggcuuuaguccgggcucuucagagcaaugagcagacccagagcuccagggaugagagcugguggaggcugggagaagaaggaagcucugucucuccucggcuguguauccagguucucggcuagaagagacucucuacagugaccaggagcuggccuaucuccagcagggggaggaggccaugcagaaggccuugggcauccuuagcaaccaagagggcuggaagaaggagagucagcagguaagugucggggagaagccugugguuccuccaugcuccacugccauccucaaggccagcugggguuacuauuuuucccagaauuccugucucaugcagcagucacuggguagcaagugguuuuaucuugagaacucuccuuucucgagaauauauccucagauaaugcucuucccccauaaaagacacccuggagaguccuguuugagaaacacuauuccuguguccuuaguuacagaauaggauugcauugugugcccacuuggcagacaucaugcaaggggaacuccaagugccucauugcccugggucagauaucccaacgaugccaaagugcacugucugugcugucagcccaccuguggcugggcuugcaggggugaugugggcucacccuacaacaggccuggacuagaacacagagugguccauggccuucugggguucucugcgcuugagcacugacccaucacaggggacaguaaccagguucacgguaaaggcugguggcucuguuauggagauuuugguggcuuuaccuucagcaaaagcugacaugcugcccacuacacaaaguucagguagaacccuuccuucccuaaguucucagaguaauggaguuaacagacuacuaguuugggagccaacugggacuuaggucggcacugcucuuaguuaagggucccugggccaaucacugaccuucucuggccccacauucuucugguguggaaugagguauugaacuaaaacaaaucuugaagaucccauucaacauucuauguaucuaauuaagcugguguaaaacacuuuucccacucccagguuucucucuugggaucuuugagcuucugaagucaaguaagagucuuuucaguuggaccuacccauaccaccaucauucaccaccaagacaaaggguccaguggggcugggugcaguggcuuacgccuggaggccgagacuggagaauugcuugagccuaggaguuugagaccagccugggcaacacagggagaucacaucucuacaaaaaauuuaaaaauuagcuagguguaaugcugcuugccuguagucucagcuacuugggaggccgaggcaggagaauuucuugagccuaggagguugaggcugcaaugacccgugauugugccacugcacuccagccuggacaacagagugagacggucucaaaaaaaaaaaacaagaaaaaaaucuuaaaaaggguccaguggcagcagguaacuuccuccaguugucagcagaugcacaaggccauggcaacaaugauuaccgacucuaucuuaggacaguuccaggcuuccucgugcucaacuuggaguuccuuugcuguuccccuccccaucuugccuuguauugccuaugggaccuagacuaagaauauauauauauauauaaaauuuuuuuuuuugagacaacucugucgcccaggcuggagugcaguggugcaaucuccacucacugcaaccucugccgugcagguucaagcaauucuccugccucagcuucccaaguagcugggauuacaggcgccugccaccaugucuggcuaauuuuguaguuuuaguagagacgggguuucaccaucuuggccaggcuggucucgaacuccugaccuugugauccacccaccuuggccucccaaagugcugggauuauaggcgugaaccaccaugcccggccaagaauauuuuugucuaaccaccuucugggggcuccuuucucugacaggacaauggggacaaagugaugaguaaaguggucccagaugugggcaagguguuccggcuggaggucgugguggaccagcccauggagaggcucuaugaagagcucguggagcgcauggaagcaaugggggaguggaaccccaaugucaaggagaucaaggugagcaaaguccaggugcagguggcaggggcccaggagagcccagugugaaugcuguaucaaagagaggaccccuagcuguggggggugcuuagcccaacacaggcugagucgugauucugguuccccauggccugguagguccugcagaagaucggaaaagauacauucauuacucacgagcuggcugccgaggcagcaggaaaccugguggggccccgugacuuugugagcgugcgcugugccaagcgccgaggcuccaccugugugcuggcuggcauggccacagacuucgggaacaugccugagcagaagggugucaucagguaauacgggcagcaggcuccaaaccccccucuucuaacacaggccugcaggugugcacccaagcauguggacugcauccccagcuccaagaaaccaacccuuggugcacccauggcuuccuucuacaaaagaagauacuuauuuaccaaaggagggacaaagacaagauaggcccuacuuggacagccagacagcuugucaugacccucccagaaaguuuaagaaccuuaauaauuuucugaagcauggggcagggcugagguucaccugguacgcucaggaacagcuguaauguagacuaaaauauugaaauaauccauaccacucaguacaccacagccuccugaauuucccaaggccccagcccagccaccagccugaauccuuucccugacaucccaguaauccagcaacuaaagggcacaagaggccgcaggggcugcuccagcuacaagcagccuuuauucugaugagcugguaacugugccaacugccaaauaauuacccuuugcaaagggcacuucccugaugagacucagaaaagacaagguaccguagaaacguguuaucuaugguacugguguaagcagccagugcaagagagaacucgcaacuguccuccugacuugacuucuccauuugccagggcggagcacggucccacuugcauggugcuucacccguuggcuggaagucccucuaagaccaaacuuacguggcuacucagcaucgaccucaaggugaagggcaugggagggggaccuggaaggcaggugguagugagaaaaacaggcucuucccauuccccccaugcugcagaaagaauccucuucuauucugauagaaucacaggcuguaagacagggaagggucuggagugauggccuaacugcuacucuaccaucuccaaagccugugauggcccccucuucuuuuuuuuuuuuuuuuuuuucgagacucaguuucauucugucacucaggcuggaguacaaugacauggucucagcucaccguaaccuccgccucccggauucaagugauucuuccgccucagccuccugaguagcuggaacuacaggcgugugccaccacacauggcuaauuuuuguauuuuuaguagagacgggguuucacuaugguggccaggcuggucucaaacuccugaccucgugaucugccugccuccaaaagugcugggauuacaggcgugagccacugcgccuggcccucuucugucucacagcaaaguucaacucuuauauguaguuaucauuuuagaaagaaggaaacuuagguccagagaucugaagggugaaaaaggcaacauaacugguucagggucacacagcugggaacaccaggcugaaacaucuuguuggccagucuugugcuucugaaagucaugacagcagaggagcaaugcaguccucccgcccuugacugggcaacuccaaggcugcaccuauuaacagagcucgaagaccaagccccuggcagccuguuugugauagggugcagugucaagagugggccaaaacccacaagauggccaaauucuccuaccuccuacugcagggguggcugcccaagagcaucaucaaccagguccugucccagacccagguggauuuugccaaccaccugcgcaagcgccuggagucccacccugccucugaagccagguguugaagaccagccugcuguucccaacugugcccagcugcacugguacacacgcucaucaggagaaucccuacuggaagccugcaagucuaagaucuccaucuggugacagugggaugggugggguucguguuuagaguaugacacuaggauucagauuggugaaaguuuuuaguaccaagaaaacagggaugaggcucuuggauuaaaagguaacuucauucacugauuagcuaugacaugaggguucaggccccuaaaauaauuguaaaacuuuuuuucugggcccuuauguacccaccuaaaaccaucuuuaaaaugcuaguggcugauaugggugugggggaugcuaaccacagggccugagaagucuugcuuuaugggcucaagaaugccaugcgcuggcaguacaugugcacaaagcagaaucucagagggucuccugcagcccucugcuccucccggccgcugcacagcaacaccacagaacaagcagcaccccacagugggugccuuccagaaauauaguccaagcuuucucuguggaaaaagacaaaacucauuaguagacauguuucccuauugcuuucauaggcaccagucagaauaaagaaucauaauucacacaaacaucagucuuuguuuuaauauuguacuguuaaaaaaaucuaugcagcugggugcaguggcucacgccuguaaucccagcauuuugggaggcugagguaggcggaucacaaggucaggagaucgagaccauccuggccaacauggugaaaccccgucucuacuaaaauacaaaaaauuagcugggugugguggcgcaaaccuguagucguagcuacuugggaggcugaggcaggggaaucacuugaaccccggaggcggagguuguagugggccgagauugugccacugcgcuccagcgugggcgacagagugagacuccaucucaaaaaaaaaaaaaaaaaaaucuaugcuaguagauuacaacuucacacuagaggaguucuggacaaagcuuuuaauuagucaaacuaaauuaaggcucauuaaaaggaaaggaacuacugggaaauuaugcaauucaauaauuuagacucuguuaccaggaucuuucauaaaaauuuaauuuccauaaucauaaccuaaaugaguucuuaaagaauucuauaagcaauagcugauuaaugggcccuggaagaugaagauuauaacuguuuauuuaccuaauuaaaaggaaaggcagugccaaauaugagaggauaaacaauauuaguuaacauuucuguuauuuaugaugccaauuaguaguaagauaauuccacagcugucaacuuuguuuggggcuggcaacuucucugcuuaaacaggcuaaaaguuuaguauucugggagaaguggcuggaagaagggguaauauggugaaagcaaauucccuuucccaggagucaagagaauuuaugugagguggcucccgccuguaaucucagcacuuugggaggccaaggcaggcaaucaccugagggcaggagaccagccugacuaacauggagaaaccccaucucuacuaaaaauacaaaaugagcugggcgugguggugcaugccuguaaucccagcuacuugggaggcugaggcaggagaaucgccugaacccgggaggcggagguugaagugagccaagaucgagccacuguacuccagccugggcgacagagcgaggcugucuuaaaaaaaaaaaaaaaauuauacacacacacacacacacacacacacacacacacacauugggaugggagggggguagggaggaugaaaaaaucaccauuaccaccugaagcuuuuccauucuuguuuuaauagcauugaugauuugcaccauuuggagauagagcucuggcuuauuuauuauaaaacaggagcugggcacaguggugccuacccacaaugccagcuacucugaaggcugaggugggagaauugcuggagggcaauucgaaaccagucugggcaagauagugagaccucaucucaaaaaaaaaaaaagaaggaaaaaacaaaggaguugaugaaaccaaauuaugacaaacuaaauuaaaaaauuaaaaaauagcauuagugggaacacugugguauuuccugagguauuaaaauuuuacaacuaguaaagguauuuauuauaauuuauucggauuguuucuuaguuuauuuuugacauggauaaaauuauuguuuaucuaggagccucagaguugagagaggauaguuguagagaaguauuucuaaaauggaauuaucauccacuaccagcuaagagaaaauaguuacuuguuuaaagauaccuuaaagcaacauauauuguaguuucaagagaacaggcugacagucaagaaauaggcuuuuaacaaacccacugguuugcuggauucuaauugccuccuucaaacuauguaauugugucuuucugguuucuguggagauauuuucccacuuguuuaauuuuacacuggaauaaaacaaguuaucacuguugaucugauuacagaaacuauuuuauauaggacgcugugaagaguagauauucucugagcccuucaaaugaacuguauuaaaacacacacacacuuuugaaguuugagaagaacaucauuaccuguaaccuuugauuugugaaaauauauacaaaaagcuaauuuuauaauuuagauggagaguguguauacaacuuauaugugguaauuuauauuacaaagaguuaacauucagcuuccucuaaauaacaccacccucauuuucuuggaguaccucaaacuccgaugaucuagaagcuuuauaaccaggucugcccuugaagacuaguucacgcauuaauaggugucuagggcugagccucagccuccaaucacacucgaccuguauaggcuuuccuguucagagauaugcaguggccaaaucaaagugucugggugauucaucgggagacaaauauauuaaucaaugcuacua

SEQ ID NO: 15564 - RNA, 12481 nt, Homo sapiens
uaguagcauugauuaauauauuugucucccgaugaaucacccagacacuuugauuuggccacugcauaucucugaacaggaaagccuauacaggucgagugugauuggaggcugaggcucagcccuagacaccuauuaaugcgugaacuagucuucaagggcagaccugguuauaaagcuucuagaucaucggaguuugagguacuccaagaaaaugagggugguguuauuuagaggaagcugaauguuaacucuuuguaauauaaauuaccacauauaaguuguauacacacucuccaucuaaauuauaaaauuagcuuuuuguauauauuuucacaaaucaaagguuacagguaaugauguucuucucaaacuucaaaaguguguguguguuuuaauacaguucauuugaagggcucagagaauaucuacucuucacagcguccuauauaaaauaguuucuguaaucagaucaacagugauaacuuguuuuauuccaguguaaaauuaaacaagugggaaaauaucuccacagaaaccagaaagacacaauuacauaguuugaaggaggcaauuagaauccagcaaaccaguggguuuguuaaaagccuauuucuugacugucagccuguucucuugaaacuacaauauauguugcuuuaagguaucuuuaaacaaguaacuauuuucucuuagcugguaguggaugauaauuccauuuuagaaauacuucucuacaacuauccucucucaacucugaggcuccuagauaaacaauaauuuuauccaugucaaaaauaaacuaagaaacaauccgaauaaauuauaauaaauaccuuuacuaguuguaaaauuuuaauaccucaggaaauaccacaguguucccacuaaugcuauuuuuuaauuuuuuaauuuaguuugucauaauuugguuucaucaacuccuuuguuuuuuccuucuuuuuuuuuuuuugagaugaggucucacuaucuugcccagacugguuucgaauugcccuccagcaauucucccaccucagccuucagaguagcuggcauuguggguaggcaccacugugcccagcuccuguuuuauaauaaauaagccagagcucuaucuccaaauggugcaaaucaucaaugcuauuaaaacaagaauggaaaagcuucaggugguaauggugauuuuuucauccucccuaccccccucccaucccaauguguguguguguguguguguguguguguguguguguauaauuuuuuuuuuuuuuuuaagacagccucgcucugucgcccaggcuggaguacaguggcucgaucuuggcucacuucaaccuccgccucccggguucaggcgauucuccugccucagccucccaaguagcugggauuacaggcaugcaccaccacgcccagcucauuuuguauuuuuaguagagaugggguuucuccauguuagucaggcuggucuccugcccucaggugauugccugccuuggccucccaaagugcugagauuacaggcgggagccaccucacauaaauucucuugacuccugggaaagggaauuugcuuucaccauauuaccccuucuuccagccacuucucccagaauacuaaacuuuuagccuguuuaagcagagaaguugccagccccaaacaaaguugacagcuguggaauuaucuuacuacuaauuggcaucauaaauaacagaaauguuaacuaauauuguuuauccucucauauuuggcacugccuuuccuuuuaauuagguaaauaaacaguuauaaucuucaucuuccagggcccauuaaucagcuauugcuuauagaauucuuuaagaacucauuuagguuaugauuauggaaauuaaauuuuuaugaaagauccugguaacagagucuaaauuauugaauugcauaauuucccaguaguuccuuuccuuuuaaugagccuuaauuuaguuugacuaauuaaaagcuuuguccagaacuccucuagugugaaguuguaaucuacuagcauagauuuuuuuuuuuuuuuuuuugagauggagucucacucugucgcccacgcuggagcgcaguggcacaaucucggcccacuacaaccuccgccuccgggguucaagugauuccccugccucagccucccaaguagcuacgacuacagguuugcgccaccacacccagcuaauuuuuuguauuuuaguagagacgggguuucaccauguuggccaggauggucucgaucuccugaccuugugauccgccuaccucagccucccaaaaugcugggauuacaggcgugagccacugcacccagcugcauagauuuuuuuaacaguacaauauuaaaacaaagacugauguuugugugaauuaugauucuuuauucugacuggugccuaugaaagcaauagggaaacaugucuacuaaugaguuuugucuuuuuccacagagaaagcuuggacuauauuucuggaaggcacccacuguggggugcugcuuguucugugguguugcugugcagcggccgggaggagcagagggcugcaggagacccucugagauucugcuuugugcacauguacugccagcgcauggcauucuugagcccauaaagcaagacuucucaggcccugugguuagcaucccccacacccauaucagccacuagcauuuuaaagaugguuuuagguggguacauaagggcccagaaaaaaaguuuuacaauuauuuuaggggccugaacccucaugucauagcuaaucagugaaugaaguuaccuuuuaauccaagagccucaucccuguuuucuugguacuaaaaacuuucaccaaucugaauccuagugucauacucuaaacacgaaccccacccaucccacugucaccagauggagaucuuagacuugcaggcuuccaguagggauucuccugaugagcguguguaccagugcagcugggcacaguugggaacagcaggcuggucuucaacaccuggcuucagaggcagggugggacuccaggcgcuugcgcaggugguuggcaaaauccaccugggucugggacaggaccugguugaugaugcucuugggcagccaccccugcaguaggagguaggagaauuuggccaucuuguggguuuuggcccacucuugacacugcacccuaucacaaacaggcugccaggggcuuggucuucgagcucuguuaauaggugcagccuuggaguugcccagucaagggcgggaggacugcauugcuccucugcugucaugacuuucagaagcacaagacuggccaacaagauguuucagccugguguucccagcugugugacccugaaccaguuauguugccuuuuucacccuucagaucucuggaccuaaguuuccuucuuucuaaaaugauaacuacauauaagaguugaacuuugcugugagacagaagagggccaggcgcaguggcucacgccuguaaucccagcacuuuuggaggcaggcagaucacgaggucaggaguuugagaccagccuggccaccauagugaaaccccgucucuacuaaaaauacaaaaauuagccaugugugguggcacacgccuguaguuccagcuacucaggaggcugaggcggaagaaucacuugaauccgggaggcggagguuacggugagcugagaccaugucauuguacuccagccugagugacagaaugaaacugagucucgaaaaaaaaaaaaaaaaaaaagaagagggggccaucacaggcuuuggagaugguagaguagcaguuaggccaucacuccagacccuucccugucuuacagccugugauucuaucagaauagaagaggauucuuucugcagcauggggggaaugggaagagccuguuuuucucacuaccaccugccuuccaggucccccucccaugcccuucaccuugaggucgaugcugaguagccacguaaguuuggucuuagagggacuuccagccaacgggugaagcaccaugcaagugggaccgugcuccgcccuggcaaauggagaagucaagucaggaggacaguugcgaguucucucuugcacuggcugcuuacaccaguaccauagauaacacguuucuacgguaccuugucuuuucugagucucaucagggaagugcccuuugcaaaggguaauuauuuggcaguuggcacaguuaccagcucaucagaauaaaggcugcuuguagcuggagcagccccugcggccucuugugcccuuuaguugcuggauuacugggaugucagggaaaggauucaggcugguggcugggcuggggccuugggaaauucaggaggcugugguguacugagugguauggauuauuucaauauuuuagucuacauuacagcuguuccugagcguaccaggugaaccucagcccugccccaugcuucagaaaauuauuaagguucuuaaacuuucugggagggucaugacaagcugucuggcuguccaaguagggccuaucuugucuuugucccuccuuugguaaauaaguaucuucuuuuguagaaggaagccaugggugcaccaaggguugguuucuuggagcuggggaugcaguccacaugcuugggugcacaccugcaggccuguguuagaagagggggguuuggagccugcugcccguauuaccugaugacacccuucugcucaggcauguucccgaagucuguggccaugccagccagcacacagguggagccucggcgcuuggcacagcgcacgcucacaaagucacggggccccaccagguuuccugcugccucggcagccagcucgugaguaaugaauguaucuuuuccgaucuucugcaggaccuaccaggccauggggaaccagaaucacgacucagccuguguugggcuaagcaccccccacagcuagggguccucucuuugauacagcauucacacugggcucuccugggccccugccaccugcaccuggacuuugcucaccuugaucuccuugacauugggguuccacucccccauugcuuccaugcgcuccacgagcucuucauagagccucuccaugggcugguccaccacgaccuccagccggaacaccuugcccacaucugggaccacuuuacucaucacuuuguccccauuguccugucagagaaaggagcccccagaaggugguuagacaaaaauauucuuggccgggcauggugguucacgccuauaaucccagcacuuugggaggccaagguggguggaucacaaggucaggaguucgagaccagccuggccaagauggugaaaccccgucucuacuaaaacuacaaaauuagccagacaugguggcaggcgccuguaaucccagcuacuugggaagcugaggcaggagaauugcuugaaccugcacggcagagguugcagugaguggagauugcaccacugcacuccagccugggcgacagaguugucucaaaaaaaaaaauuuuauauauauauauauauucuuagucuaggucccauaggcaauacaaggcaagauggggaggggaacagcaaaggaacuccaaguugagcacgaggaagccuggaacuguccuaagauagagucgguaaucauuguugccauggccuugugcaucugcugacaacuggaggaaguuaccugcugccacuggacccuuuuuaagauuuuuuucuuguuuuuuuuuuuugagaccgucucacucuguuguccaggcuggagugcaguggcacaaucacgggucauugcagccucaaccuccuaggcucaagaaauucuccugccucggccucccaaguagcugagacuacaggcaagcagcauuacaccuagcuaauuuuuaaauuuuuuguagagaugugaucucccuguguugcccaggcuggucucaaacuccuaggcucaagcaauucuccagucucggccuccaggcguaagccacugcacccagccccacuggacccuuugucuugguggugaaugauggugguauggguagguccaacugaaaagacucuuacuugacuucagaagcucaaagaucccaagagagaaaccugggagugggaaaaguguuuuacaccagcuuaauuagauacauagaauguugaaugggaucuucaagauuuguuuuaguucaauaccucauuccacaccagaagaauguggggccagagaaggucagugauuggcccagggacccuuaacuaagagcagugccgaccuaagucccaguuggcucccaaacuaguagucuguuaacuccauuacucugagaacuuagggaaggaaggguucuaccugaacuuuguguagugggcagcaugucagcuuuugcugaagguaaagccaccaaaaucuccauaacagagccaccagccuuuaccgugaaccugguuacuguccccugugaugggucagugcucaagcgcagagaaccccagaaggccauggaccacucuguguucuaguccaggccuguuguagggugagcccacaucaccccugcaagcccagccacaggugggcugacagcacagacagugcacuuuggcaucguugggauaucugacccagggcaaugaggcacuuggaguuccccuugcaugaugucugccaagugggcacacaaugcaauccuauucuguaacuaaggacacaggaauaguguuucucaaacaggacucuccagggugucuuuuaugggggaagagcauuaucugaggauauauucucgagaaaggagaguucucaagauaaaaccacuugcuacccagugacugcugcaugagacaggaauucugggaaaaauaguaaccccagcuggccuugaggauggcaguggagcauggaggaaccacaggcuucuccccgacacuuaccugcugacucuccuucuuccagcccucuugguugcuaaggaugcccaaggccuucugcauggccuccucccccugcuggagauaggccagcuccuggucacuguagagagucucuucuagccgagaaccuggauacacagccgaggagagacagagcuuccuucuucucccagccuccaccagcucucaucccuggagcucugggucugcucauugcucugaagagcccggacuaaagccauaggggccagccugcuggucgaguuaaucacagccgccccaggugaccagagagggaucuggccuugaggaacucuaggcuggggacguccucucaaaaugaaggaauggcaggaggggagccaaagccacaugcaccacaucacccuccagggaaccuccugccagcagcaccaggagcccagaagccucagcacuuaccgaguagagagcuccgccgccgaaccugguuaauccacgugcuagggguggggccccccagggcccuccgguucagcuccuggcugauggccaucacagccuguugccucagcccugcagaagggaauaacccuugucuaggagcuggaaagccccuuagagauggaccacucccacccccucaucuugucucaaaugaguaaguugguuuggagagggaagugacuugcucaggagcacacaggauucuagcagggaccugaacuagagccaggcccucaacucccauggcagugcuccaggguccagaaaucugccuuccaucugggguggucaggccuggcccugccuggagaugggcuauaccagagccugcuggaguuucugucucuaaaaggggaaaaagcuguguucaagcaaccagaaaaauccuacuucauaaggagaauacaacuccugaggccugugugcuugcaugagucugugugucugcacgagucugugcuugcaugaggucugugugcuugccagaaucugauugcaugaaucugugcuucugugagucugugugcuugcaugcauaagcuacucugugugccccuggauucugggccagggaagcccuguccaucuagugaggacgacaacaccacugccagcugcagaucuaagcauggcuucucgcucuaaagguagcuaauucaauccaguguaauuggaaagaucgugccuagauugacuuguguacccuucaguggcagcaggggauugauucaaaugaccuuggaugcgaaucagcucuacaaaaguggccucuuguagcugguuucugccccuuccuggcuauucaaugauaaucagucuuccgucuuaucucuuuaccuugcccuccugucuuacuccccuaugucucuucuccgucuuuuuuugccugugggagucaagucuaauauuuacucugccacugugggcaagacuuuccuguguaccccugcuacaagacuuguccagcucugaaggaaggcaaagucaggaauaguucaagaaagauggccaggcaugguggugcacgccuguggucccagccacucaggaggcugaggcaggagaauugcuugaacccaggacgcagaggcugcagugagccaagauagcgccagugcacuccagccuaggcaacagagcgagacugccucaaaaauaaaauaggcugagcgccauggcucaugccuauaaucccagcaguuugggaggcagaucaccugaggucaggaguucaagaccagucuggucgacguggcgaaacccugucucuacuaaaaauacaaaaacuagccaggcgugguggcaugcaccuguaaucccagcuacccaggaggcggagguugcagugagccgagaucgugccacugcgcuccaggcugggcaacagagugagacuccaucucaaaauaaaguaagccagguguggcggcucacaccuguaaucccagcacuuugggaggccaaggugggagaaucccuugagcccagggggucaagaccagcgugaccaauauagcaagacauugucucuaaaaaaaauaaaaauaaaaauaaauaaauaaaacuagcugguugugguggugcacgccuguagucccagguacucaagaggcugaggugggaggauggcuugagcccaugaguuugaggcugcagugagcuaugauuguucuacuguacuccagccucugugacagagaccuuuauucaaacaaaaaaaaaagaaaaggcggaagaaaaaaagaacgaaugaaggaaaaggggaaggaagaaaggaagaaagaaaggaaaggaaggagggaaggaagaaagaaaaagaauaaaaaugaaagaaaaggagaaaaaaagauuggaguccuggaggggagaccagaaauuauagaaucuggaagggauauaucuuaguaaccagcccacuucuuccgaggggaaaacugagauucaagaagggaagaaacuugcccagguucacccaguaagaggcacaacuaggaucagaauuggguggccugagccucauccgcugagagcuggccaaccccucaucgccuccuucccgcagcgcucacccuucauguugcgcaugugucuguaggagcucccagcgcacagcuugaaugucgcuagcagcauuguuuccuggcaaauguggcagugguggggucgcugccgcugcugcugccgccgcugcugcugccucuucucucaagggugguucuucguccuuccugagccccucaagcuucgccucugagucccgcagcugcagccuggaccugguguucugcgucuuaaaugucccccgcugaaggcugugcaucaucaucaggagauaaaaacgccaucacucacugugcaaaggaaggggucaaggauagagcgauugccucacacugcugcuuuggccguuuguggggagcuuggggcgggggagggugcaggggagaguagggaggacagggccaggcgagggauggaggggagagaagcaggggcagcuuagaugaaggcacacagugguuuucaagacuuuaaagugcagauuucuagcccuugucuucagaaacuccaggcucagcugaucuggaauugaggcucagaaaccuguguuaaaaaaaaaaaaaaaaaaaaaaaaaaaaaaaaaaaagaaggaaaagaaaagaaaaaagaaaaaaagaaaagaaaaaaacuucccuuggccaggcgcgguggcuuacgccuguaaccccagcacuuugggaggccgaggugggcagaucacuugaggucaggcguucgagaccagcauggccaacauggugaaaccucaucucuacuaaaaauacaaaaaauuagccgggugauguggcaggcaccuguagucccagcuacucgggaggcugaggcaugagaaucacuugaacccaggaggcagagguugcaguaagccaagaucgugccacugcacuccauccugggcgacagagugagacuccgucauaaauaaauaaauuaaauaaauaaauaaauaaauacccagugguugcaaugcagguguuguguggacuacacacuacacuuugagaaccaccgucucgcgagagugagccaggguguuuaccaggcaguagagaccauauggcugcucuucuucugggugaggacccugaaguccacagaguggaacugacuuguucaaggucaaacagcuggccaguggcagggccaggacaacaacccaagccucuggccuucaagccaucuguacacaguuccuccugcgguccccaggacgcuugguauauucaacugucaauuuauuuacucaucuauuuauagaaaccaccuuucccaaaguccuguuccgagugaggguucuuaggggucugugcuggagcaaggaugaccucucguggcugagucgcgggggggcgggggggggcggggcagcccuaucaguauacggcagagagaagaggagggccugggccacgcccacacccuuccucacacuuucccgccaguagcuuugucugagugagcugggcugggggucuugguaugugcagaaagcuugaaaagacagggcaugggcugggcacaguggcucaugccuguaaucccagcacuuugggaggcugaggcgggcaaaucacaaggucaggaguuugagaccagccugaccaacauggugaaaccucgucucuacugacaauacaaaaauuagccgggagugguagcguaugccuauaaucccagcuacucaggagacugaggcaggauaaucacuugaacccgggaggcagagguugcagugagccaagauaaagccacuguacuccagccugggugacagagcaagacuccgucucaaaacaaaaacaaaaacaaaaaaacaaaaauuagccaggcauaguggcaggcaccuguaaucccagcuacucaggaggcugaggcagaauugcuugaacuugggagguagagguugcagugaucugagaucacaccauugcauuccagccuggaugacagagcgcgagacucuguugcaaaaaaaaaaaaaggaaaaaaagaaaagacagggcguugggguguucacccuagucuuugcacuuuaggggcccugucaggcugagcaaggccccacgaggccucugcauuucccacucacccuuacccaggcgcagcacgugcugggcucugacucugacggaaucucuucccuuuacagugaccuugaggcugcuuuuaagccagauucacugggcaagaauauugggaguggaaaaacucacacuggaacugccccuggcccaggcccugcucccugugggagggaguucuguguccugccaccaccucacagaggcagaggggagcccuaaaaauggggagcagugccggggccccaugcacucucgcugucuccccaacaccagacagggugaaagggacaggaucugcucagagccaggccuggcacuuggagcccauauagaacaggggagucaccccccuggcccccgauuuccaccccggugaugcagucggggaauccugugagcagaggcugccuagagguacccggccccuuccucaaaaccuccuccaggaaaccuuccuagaccauccuggucuucuggaaugcuggcuccucccaccacacccuuacugucaguaucacuugaggggcuuaguucugguccugauuuguugaaugguuuguauguguuugcuugucucuucuguggaauuaucuccccaaggcaggugcuggguccacuuucccccuuaaaagcuguccccacccucagcacucaccuccagcagagacacaggggacucuugcuccuucucuauuaaaacuuuuuuuuuuuuuaauuuuuaaaaauagagacggggucuugcuauguuacccaggcuggucuugaacuccuggggucaagccauccuccugccucggccucccaaagugagccacugugccuggugugcuccuucucuauugagugaccaacugggaaagcagcuaggggugcagguauaucuuuagacucaggaaaccugccugaaggcauuguuuccagcc

SEQ ID NO: 15565 - RNA, 6674 nt, Homo sapiens
uaaugauaacagcauguuaaaaacuuggaagucuuuaucccaauauaagaauuaucuugaaacaaaaaucuaaauuacuuuuaaaaauucucuuaacucugcauuuagucuccuauuaucuagaucucugaguccaggauaacuccaguuauccccaguuggaucaugugugauuuaucugagaaagcauccacaacccacagcuaguggaaaccgagcuaguuuacagccacguggauaagaacaucuuuguuucuaaagugagaggaaagugcuugguaucuugcuuuuugcugagggcaaaauaacaacaugaagacaaagugcuuuuuguugucuauucaugaaacuguagaagaauauuuugaguuuuuauucuuauauuaugaagggauucuuugccuagcaguggccgucaaacugauguagcauuguacuucucaacagugaagccuguguaauaccauacaguaggaugaaagacuauucugagcaaaaucaaaugggaugucagaaucuuugaaaauuauuuuaucauuuuuucuauuuuuucauuuuuauaaauuagaaggauuuuccauucaauaaggauaaucucucuuccuaucauucugucaaaauggcaguuucuuuugguaauuauccaaccuaguuucauuacauuuagaaggagguuucagagcuuauucuugauaacuauaauaaugauuugaauguuuuauaucaugaaguuuuuucuaugaggaaggcuauucucaauguaucugucgucuaauuuuuuauuuucuaucuauaaagaauauuuaaauaauaauugguguauguuccuuuuguugaaaauguuuuauuguccaguuuuaacacagaaguggucuaaaguuuugcagcaaaugcuguucaguucccagaagccuaaaaaacauaacauaauaugcuaacagagcuaauuuccacccaaucccucaaauuaccgaaguauuaauauuuagcuuccuuucuagaaaacaaggggcagcacaaaugggguggcauccaucucuuuuaaaucacugaugauuuucuggggaaguauauauagaugauuuuauuuuuuaaauagccuuuuaucaaaccauuucacauguauuaucuauaugacuauagaaacuuauaaaacauuuaauucauguugacuuaaaacaugggcauccuuggauucuccacauugacugaaaugauagagaaagggacauuuguuugagaaacaagagaccuguaccuaauuauggcaaguauaugaguuuuggugauugugggggguuauaaauguuuuccuaugauagauaaauauauagauauagaucaggaauuacuugaugucucuucagaaguuuucuguuuucuuauaauuuccaguaauacucuguaagacucgguuugcaugcuguguguguuugcaugaguauagaaaccuaagaacauaauggaaggcuauuaaggcaaauucauuccuagaaaguggaguggaucauugggauaagaaauagccuaauuauaaacaaauaugcaggcagagggaaguccuaauacaaugaaaacuugcauuaucuaaacagauguucccaaagcaauaguuugccuaaaauccucuguauuacaugauuauucaguaaaagaguaaacaaauaucuaauuuauuuucuaauuguccuucccuucauugaguauuaacuaggugcauaauguaguuguauauguuuacuaguaaagggaaaaacacuuauuuucauuuugagacuguuuggcuauuacuaaagcugagaaagugauuuuaggucgccaaggauacuaugauuugaugagaugagaagaaaucugcgguggcugaaaaucgugaccaacuugguguuaucuagaucugcuuuaucuaguuugcaagccauaggcucaauuuuauguccuucuuacuuacacacaguagccccacacaguuuuguuuuaaaugaaggcaaaaguagacauuuuuaaaguauauucaacauugugccauuauuuaccugauaaaggugaaaucagagguguccacggccucaaaguuugggcccaugggacuaucaaauccgaauuauaucuacuuagagcuuagaggaagaauuagguaucaugagaaaagcaacuccuacuugagagaaagaagacuaccaaagcauguugaggcuuuaacaugggagacuuccagguaggcguuaacacuugagugguaacuagcuugaugaaggaaaauaauuacuuuagcaguuauguuguaaaauuaauaaaaaggacucauguuuauucugguguauuugucaacccauggguagugauuacuccguguacauucuauaguguguguauuuuauuuagugucuuaauauauagucuuuauauaguaucuuaauauuauuuacuguuacuucuagucauuuauguaguauauuuuacugcaaaauuuguagcacuuuacuaauauuagaucauuauuuucccucuuccccucuaccuuucuggcauuuucuguuaucuuagagucaggaaucuaaaggucuaagucuagaaaucuguuggaagcuggguuggagcuacuggauaugaguuacuuuuuacaugucuccuuaagaagacucuuuuauaauguaauacuuagaagccaaauccuuucaaacgcaaacacccuugaaacuugaugcuuucugaaguuguauucauaaaaauuaucccaucuuacaguuaaucagaagauguucuuaccuuugguuugccugccuccugaaacacaaaccugcagauugccccuaacuucagcagugccuccgucacugcauguaccuaaaagacaggaaagccaaguucugggagcugucaagucggaggaucaggaaaaugguggggaagaggugacuggaaaggcaggcacuaaagauggcaggcugcaaaagcauucugaguuccccuguaacagauagguuuuaugaacucagcuguuuucuuuuuucuuuuuuuuucuuuugagauggagucucacucugagucucacucuguugcccaggcuggagugcaguggcacaaucucagcucacugcagccuccaccucccgguuucaagugauucucccaccucagccucccgaguaguuaggauuacaggugcccaccaccacgcccaacuaauuuuuguauuuuuaguaaagacagggugucgccauauuggcuaggcugguuuugaacuccugaccucagguaauccacccgccucagccucccaaagugcugggauuauuauaggcgugagccaccaugcccagugaacuuggccauuuucuuacauucauauauagcaaaguuuucaacuugucuaccgagagacuuucuuuaggagccaggacuucuacauuuguaacuugaguauauuaauauucaaaucauaguucaaaaauacugaaauacuuguuuauuauguuacauaaauauggacacaauuacugccaaagaauagagagauuugcuuaugagaacauucugucauuuguucuguuuguagaugagagacaugcuuuuaaaguacaaaacguuucucuucuaccuuacccccuguucuacugacgugcuuugcaugagaagcucaucuagaagagagcaacgcuggaauagagaagucuagacccuggccuuugagggaaaggacugcuuuuuuucucucccaaauuagaaaauuaaaagugaaacauaacacauaaggacgaaauacaauguucugaauaucuuccacuaauuaauuguugaaugauuaagucucuaaguaucuuaacuuccauugucuucuuguuaaccuagacaagaguagauuauucaguagccacaugugacaguuaaaauuaaguaaaauuaaaacuauaguuucucaguggccuagccacauuucaaguguuccacagucacauguggauaguaguuaccuaucagacaguacagguauagaacauuuccaguauugccaaaaaugcuauucaacagcacuuuuauugcccagagagaaaauaaggacaaaauaaaggcagugaaguaacuuaagacaacucugagauuuuaccaccauacuuagagaaaguuuuucuguuauaaaaauuaauacuaauccuuuuuaaagaccuuggaaaaaaucaaaaccccauuccuuuaagcuagucuucaguauauauuuuucuaagaacagauucucaauacuuuauuuuucaagugauaaaaucauuuuauaaaucauuucuuaauaucuucaguguuuuuucccuuuuuauguaaacucuuuuaaaauugauauuagcugggcaugguagcucaugccuguagucccagcuacuccagaggucgaggcaggagcaucgcuuaagcccaggagguucaggcugcaguaaggucugaucacaccugacugcacuccagccuggguggcaaagcaagaccccugucucuaaaaaaaaauaauauaaauugauguuauauaguuaacauuuaucaggcaaauucauaugaaugcuuauuucaaauaaagauugauagauuuaaugauauccuuccuuuuaaauuuauauagaucuaaugaacauugccaacaguuuuuuuuguuucugucccuuaaacauuuccccugaaaguccaccucaaagguacaucaagaugcaaacaauuuuuuuaucuucauaacuuccugcucuuauuaacuuguauuaugaaucaaauuaaguuuuauguauaaggcauuuacuauuccagugacuuagcuaaugaaaacauuuaaaaauauguauuaauuuacuuggccugcuacuaaagugcuuaacauaacuaaauggaucuauaguaacaugucuaaauuuuuuaauggaaauaagggacuaaccauaauccuuuugagucagcuuggugcuuacaauuauuuuguuaggaaaucuugaugcuuucuucuuucucuuuaaauuuuuguaaucaagcaacagacuugauccagcagugucgaauuccaagcaaguuaugaugauucuuauuguaguucaaguacagaugaguaaguggugugacuucaguuuauuaucuucuuggugaccuacuuuaguauguguucuguagcgauucauauuaguuaagggacguuuucaauaugcuugaaauaagaaauagcauuuuacucuaaauacaagaaaugacuguacacaaaugcuaaucagugauuuggggccuuuuaaugucuuuaacagcaaucuuuuauuuauuuauuuauuuauuuuugagacggagucuugcugugucaccaggcuggagcaguggcacgaucucgccucacugcaaccuccgccucccagguucaagcuauucuccugccucagccucccaaguaacugggacugcaggcacaugccaccacauccagcuaauuuuuguauuuuuaguagagacgggguuucaccuuguuggccaggaugaucucgaucucuugaucucgugaucugcccgcauuggccuccugaagugcugggauuacaggcaugagccacugcgcccggcccaaaucuuuuauuuuuuaacagccuuaguuauuuauaauucaaaugcacuaaaauaucaucgcugucaugaacuuugcuguuuacagguucuguguaauucagaaugcuuuguacuuagaaaauaauuucuaggcuuaucuuguuuugcaguuuucauguuuugacaauugcccaccauuuacaauacucaauuuuugauuaugaaaugaauaguaaaauucaaacauaucuaauaauaauuugccuuaguuugauuaauaaauuauaucaaaaaacuuggggauagaaagaggcuuuuuuuucccccuguaguauuuuuaaaacuuuuuagaugagcuggaugaaaccuuaguacauuggagcuggaguuguauugaguacagccccaacucugaagccuuauauucaugucuuaaguaccauugauuguucugugaauuguuguuaguuucauauuugacauuguaguaauccaccuugcauuuuagucuuugcaaaaaggauauugcuagguauauucuuauuucugauugaguauugaauuuacauuuuucagaauuucauucuuugucauuauaauccaaaaacaauguccacaucagacuuggaacuucucacuucaaaaaugaaauacagauuuagcaguguuguacauaaugauguccaagcauuuuuccaccuguuuacugaguuuuccaaccauuuacuauguguugagauugguggguuuucuggcuguuuuucugaggugaaugacuuguuacagagccucaguaagaaauuucaacuaaaaucacaaaaacauaaaguccaggaaaccaccagaagauggauuuuuaguguuuuugaaaucuuguauuuccuuuugauaucauuuacucauuuuaauuuuacgacugccaacuuguuacgguauuaauuauauguauguguuuauauguaugcauauaauauauguauauguauaugaagaauaaaguuaagauuuggucaaacuauauuuucccauucaaguacaaaaauguuuucaaggcugcaaaaaguguacaguuguuaaacaaguuguaaauaaagacuuguauaaaaauucagccu

SEQ ID NO: 15566 - RNA, 9697 nt, Homo sapiens
aaaaucagacaauuaagccugaauuuuuccaaaagaaaauuugugccuaauuaugggaacuaaaaugccucuaugagauuuuaaucuauagugaguaguauuaacauuccuaauugugcuuuaugauacacuguaacaaauucugcaugaugaaauuuucuuuugugaaguauguuccacuauuuuuucauugauuccuuuuuuuguuuuaauguugcagggaaugacccugcauaaaaaggcagcugaagauagacuggcaagcacaggcucagggcagucauuucuggcgaggcagaggcaagcgaccagcagcagaagaucauacccaggccacgugcagccggccacagcaagguagagaaguugugccgcucaaucacagacaccugcacccacaacauacuucuguuacacacaagaacauuucaggaaacucagccagcuuauuuuuuguuucucuucuaugucaauacuuaguguuucucauuuugaggacuuuuucucucuccuguaucuuuguuuuaguuucuuugguuuuuauuuuguaguccuuucaguuauuuuuaaugugccaaaaauuuguacauguucaauuaaaaauguuguauaauaguguaauacuuuucuuuguaugaaaauguccucuucuucaaagguauaggcuuuguaaugaauuagauuuucugccaauaauugauauacaauuuauauucuuuauugugccuguguguuaccaugcuaagaaugucuuuguuuaaagggaauuaaucuuuuuaugauguauuaaucuguguuuucaauuguuuuccaaguacaguucaaauaacuugcauauuuacuauacaaaaugguugacaaguguucuuuuugcaaagacuugaauacauuggcagaggugcuaaucacaucuucccuaaggcaccuggaagaauuauuugaggaaaaaaugaguuuucacauuguuuuauaggaaauuaaauuuguccaaagauuuggagacuauuuuuaaaacauaaauacauaaaauuucauuauuuccugcuaucuuguuugcuggcagaagugaauguuuggugagguuauuuugggauaaauuacaaaagaaaaaaaauuagacacugcauuaauuucuuguucuuuuggaauaucuuaguaacugaggaucauuuucuaacaaugugguugacauaccuucaguugcuuuccacaucuaaaagaguuaucuuucauauauguacaaguuauugguagucuuauuuuugggcuguuuguugacuuaugccccauuuguuuuacuuguucuuuaauauaaacccuuccauuuuuuaacaauuccuaacacuugauaucuuaauaucagucacuaacauuaguaacuucuuguauguuauauuauggcagaucucuuuacguuuuuucucacaucuaucugcuaguccaggaauuuguuacuaaauagauuuucuuggauauuugguugccucaaagugcuuacauuuguuaacagauuguaaaccacauuuauuuacauugaugaaugggcuguugaauaaucauuguaaagcacuuuguauauauaaggugcuauauaagugugaaauaucauucauuuauaaaugaaaugccuucuaacuuuccauauugacuuauguauuuggucccaaauuauauuuaagucuuuuuucuugcaacguagcccauuuuuugaaagcaaaacauuucugaaauuaggucaugguuuuuuuguuuauuuuuagguuaggucacuuaauauaggaggauguuuucucauguacuugcuauuugcaaguucagguuucauuugguucuuuauguuaaauacgaauaaguaaccucaaaucaagcuaaauguaauuaagaauuuucagcaacuauauucaaguguuugauuuuuaaauucuuucuuucuuuuuaauaagaaagaugaccuaaaaaucagugguauuuguuuguccucagaagccguaguugaagaaagauauuagaguauacacagaacuggagccauacauugugcuaauuuuuuacauuaaguacagaagucugagcacagcaugaaugcuucugccugacaggaccacaaagcagcagaaguuagggauaaauggagauagccaugaguagaacugcuguagggcuucaggaggcuacgcagaccugaucaacugcaaaguuuccaaaguaaaagauuaaaaacuuucagacgguucuuaccucuacccguguuucacaaauagccugaggauccaacuauuuuuaaagcaaauuggggccagacguggugccucacgccugcaaucucaccauuugggagaccuagguggggguggaucacuugaggucaggaguuugagaccagccuggccaacauggugaaaccccaucucuacuaaauuacaaaaauuagcugggcaugguggcauguggcuguaaucccagcuacuugggaggcugaggcaggagagucacuugaacucaggagccagagacugcagugagcugagaucgcaccacugcauuccagccugggcgacagagugagacucugucucaaucagucaaucaaucaaucaaucaaauuggaauaugagcacuaaccuugguaaguuaaaauuuugggaaaauuguaccugcagaauaugauggaugaaaacaacagccaggugcaguggcucacgcguauaaucccagcacuuugggaggccgagacaggcacaucaucugaggucaggacuuccagaccagccuguccaacauggugaaacuccgucucuacuaaaaauacaaacaauuagccaggcaugguggugugugccuguagucccagcuacuugggagggugaggcaggagaauugcuugaaccugggagacagagauugcagugagccgagauggcgccauugcaccccagccuggcgacaagagcgaaacucugucgcaagaaaaaaaaaaaaaaaaaaaaaaaaaaaaacagucugugaacuacucacugaaugaauuuuguucugugagaugagagguuuucauuuucauuuucuauuuacagccccaguccuaaucuccuacccauccaccuacccagauauuuuuucucuaucuggguuggaaaggccccaggcuuuuagaggggaguuuuacuucugacuuuuuuuuccccccgagacggagccucguuccgucacccaggcuguagugccguggcaugaucucggcucacugcagccucugccucccggguucaagcaauucuccugccucagccuccagaguagcugggauuacaggugcccaccaccauggcuggcuaauuuuuguaauuuaguagagaugguguuucaccauguuggccaggcuggucucaaacuccugaccucgugaucuacccaccucggccucccaaagugcugagauuacaggcacgagccaccgcgcccagucguacuucugacuuuucuucagcaucuguuguaugcuauuauuuugauguuuacauuuauaauuuucuuucuuuuuuuuuuuuuugugagaugaugucucgcucugucacccaggcuggagugcaguggcgcgaucucggcucacugcaagcuccgccucccggguucacgccauucuccugccucagccuccugaguagcggggacuacaggcgcccgccacuacgcccgacuaauuuuuuguauuuuuuaguagagacgggguuucaccauguuagccaggauggucucgaucuccugaccucgugauccacccgccucagccucccagagugcugggauuacaggcgugagccaccgcgcccagccuacauuuauaauuuucauucucuuuuaccuauaaaauucaguguauuaguuucauuacauaggagaaauuauauuucuaaacauuuuaugauguuuaaaaacaaaacaggcuguuguaaaaaaaaaaaaaaaaaaaacuucugaauauacuuuagguaucagaaagccaagaauaaaauuuagcucuaacgguggcaacuccauguccgguguccagcuuuggacaggguuuaugacguuucuguuucucuaguaaugauuaaugauuccucaggagauucgugauguugucuggucuaucuggaaauuuaaagucacuaggagcuuugccucaucgugagugaugcugugcuguauuuuuacaaacucucgcauacagcaccuuccuggggccacguuggcuugugcaguggagcuuguccaggcaccagcauggagcaaguacaggguugcuguguuggguuggagcacacugucaccacagugucugaagucuuauaaacaggaagaucauuuucuguuuuccuucuaaccagggugagaaaauacaaaguaaagaacuaaagaauauuaaaaccuagcauuuauguuccacaguguguauuucagaaguuuguaauccagaaaauauaguaguguauaauaucugaaaagagaaucaaguauacaauuguacauauuuuuaaagaacuuugaaaaacuccgucauaucuuuuaccauuugucuauuugauaguaaugcagaaaaaagucccuaaagacccuguguuccaaaauuuaccaagauugacauuucuauuagacauccuuaaccuaaguguuuuaauuagauuauuagacuauaauaaggaugaaauugcugucuguaauuuuguugagguuuuauuguuaauauaauaaaagcucaacuguacaaaauuaagcuaaauguuauccagucagaaacaucagccuguggccaggugcgguggcucacgccuguaaucccagcacuuugggaggccaaggcaggcggaucaccugaggucaggaguucaagaccagccuggcuaauauggugaaaccccaucucuacuaaaaauacaguauuagccaggcaugguggcaggcgccugugaucccagcuacuugggaggcugaggcaggagaaucaugugaacccaggagguggagguugcaguaagccgagauugugccacugcacuccagccugggccacagagugagacuccaucucaaaaaaaaaaaaaaaaaaaaaaagaaacaucagccuguauauuccaguaguucucacagaagaaugaaaauccgugcugugcaaauagaucaguagugagugaguguuaagugaaagaugagcuagguugaagaaaauauacauuuuauugaugagccacuuugcuaucucuccuuccuuccuccuuccuuccuuccuuccuuccuuccuuccuucccuucuuuucuuuuuucuuuucuuuucuuuucucccuccuuucuuccuucccuucccuuccccuccccucccccaggcuggagugcagaggcacgauccuggcugacugcaaacucugccuaccagguucaagcgauucuccugccucauccucccuaguagcuaggauuacaggcaucugccaccacgcccagcuaauuuuuguauuuuuacaaaauacaaagagacgggguuucaccauguuggccaggcuggucucuaacuccugaccucaggugauccguccaccuuggccucccaaagugcugggauuacaggcguguguuacugccccagccuccuauuuccuuuucgaaaguagcaguuugguuuauucucguuugcuaaguaauuguuugaaauauuuuucagccucuccugcucccucacaaaaauucaccugucauuuuaaugauaacagcauguuaaaaacuuggaagucuuuaucccaauauaagaauuaucuugaaacaaaaaucuaaauuacuuuuaaaaauucucuuaacucugcauuuagucuccuauuaucuagaucucugaguccaggauaacuccaguuauccccaguuggaucaugugugauuuaucugagaaagcauccacaacccacagcuaguggaaaccgagcuaguuuacagccacguggauaagaacaucuuuguuucuaaagugagaggaaagugcuugguaucuugcuuuuugcugagggcaaaauaacaacaugaagacaaagugcuuuuuguugucuauucaugaaacuguagaagaauauuuugaguuuuuauucuuauauuaugaagggauucuuugccuagcaguggccgucaaacugauguagcauuguacuucucaacagugaagccuguguaauaccauacaguaggaugaaagacuauucugagcaaaaucaaaugggaugucagaaucuuugaaaauuauuuuaucauuuuuucuauuuuuucauuuuuauaaauuagaaggauuuuccauucaauaaggauaaucucucuuccuaucauucugucaaaauggcaguuucuuuugguaauuauccaaccuaguuucauuacauuuagaaggagguuucagagcuuauucuugauaacuauaauaaugauuugaauguuuuauaucaugaaguuuuuucuaugaggaaggcuauucucaauguaucugucgucuaauuuuuuauuuucuaucuauaaagaauauuuaaauaauaauugguguauguuccuuuuguugaaaauguuuuauuguccaguuuuaacacagaaguggucuaaaguuuugcagcaaaugcuguucaguucccagaagccuaaaaaacauaacauaauaugcuaacagagcuaauuuccacccaaucccucaaauuaccgaaguauuaauauuuagcuuccuuucuagaaaacaaggggcagcacaaaugggguggcauccaucucuuuuaaaucacugaugauuuucuggggaaguauauauagaugauuuuauuuuuuaaauagccuuuuaucaaaccauuucacauguauuaucuauaugacuauagaaacuuauaaaacauuuaauucauguugacuuaaaacaugggcauccuuggauucuccacauugacugaaaugauagagaaagggacauuuguuugagaaacaagagaccuguaccuaauuauggcaaguauaugaguuuuggugauugugggggguuauaaauguuuuccuaugauagauaaauauauagauauagaucaggaauuacuugaugucucuucagaaguuuucuguuuucuuauaauuuccaguaauacucuguaagacucgguuugcaugcuguguguguuugcaugaguauagaaaccuaagaacauaauggaaggcuauuaaggcaaauucauuccuagaaaguggaguggaucauugggauaagaaauagccuaauuauaaacaaauaugcaggcagagggaaguccuaauacaaugaaaacuugcauuaucuaaacagauguucccaaagcaauaguuugccuaaaauccucuguauuacaugauuauucaguaaaagaguaaacaaauaucuaauuuauuuucuaauuguccuucccuucauugaguauuaacuaggugcauaauguaguuguauauguuuacuaguaaagggaaaaacacuuauuuucauuuugagacuguuuggcuauuacuaaagcugagaaagugauuuuaggucgccaaggauacuaugauuugaugagaugagaagaaaucugcgguggcugaaaaucgugaccaacuugguguuaucuagaucugcuuuaucuaguuugcaagccauaggcucaauuuuauguccuucuuacuuacacacaguagccccacacaguuuuguuuuaaaugaaggcaaaaguagacauuuuuaaaguauauucaacauugugccauuauuuaccugauaaaggugaaaucagagguguccacggccucaaaguuugggcccaugggacuaucaaauccgaauuauaucuacuuagagcuuagaggaagaauuagguaucaugagaaaagcaacuccuacuugagagaaagaagacuaccaaagcauguugaggcuuuaacaugggagacuuccagguaggcguuaacacuugagugguaacuagcuugaugaaggaaaauaauuacuuuagcaguuauguuguaaaauuaauaaaaaggacucauguuuauucugguguauuugucaacccauggguagugauuacuccguguacauucuauaguguguguauuuuauuuagugucuuaauauauagucuuuauauaguaucuuaauauuauuuacuguuacuucuagucauuuauguaguauauuuuacugcaaaauuuguagcacuuuacuaauauuagaucauuauuuucccucuuccccucuaccuuucuggcauuuucuguuaucuuagagucaggaaucuaaaggucuaagucuagaaaucuguuggaagcuggguuggagcuacuggauaugaguuacuuuuuacaugucuccuuaagaagacucuuuuauaauguaauacuuagaagccaaauccuuucaaacgcaaacacccuugaaacuugaugcuuucugaaguuguauucauaaaaauuaucccaucuuacaguuaaucagaagauguucuuaccuuugguuugccugccuccugaaacacaaaccugcagauugccccuaacuucagcagugccuccgucacugcauguaccuaaaagacaggaaagccaaguucugggagcugucaagucggaggaucaggaaaaugguggggaagaggugacuggaaaggcaggcacuaaagauggcaggcugcaaaagcauucugaguuccccuguaacagauagguuuuaugaacucagcuguuuucuuuuuucuuuuuuuuucuuuugagauggagucucacucugagucucacucuguugcccaggcuggagugcaguggcacaaucucagcucacugcagccuccaccucccgguuucaagugauucucccaccucagccucccgaguaguuaggauuacaggugcccaccaccacgcccaacuaauuuuuguauuuuuaguaaagacagggugucgccauauuggcuaggcugguuuugaacuccugaccucagguaauccacccgccucagccucccaaagugcugggauuauuauaggcgugagccaccaugcccagugaacuuggccauuuucuuacauucauauauagcaaaguuuucaacuugucuaccgagagacuuucuuuaggagccaggacuucuacauuuguaacuugaguauauuaauauucaaaucauaguucaaaaauacugaaauacuuguuuauuauguuacauaaauauggacacaauuacugccaaagaauagagagauuugcuuaugagaacauucugucauuuguucuguuuguagaugagagacaugcuuuuaaaguacaaaacguuucucuucuaccuuacccccuguucuacugacgugcuuugcaugagaagcucaucuagaagagagcaacgcuggaauagagaagucuagacccuggccuuugagggaaaggacugcuuuuuuucucucccaaauuagaaaauuaaaagugaaacauaacacauaaggacgaaauacaauguucugaauaucuuccacuaauuaauuguugaaugauuaagucucuaaguaucuuaacuuccauugucuucuuguuaaccuagacaagaguagauuauucaguagccacaugugacaguuaaaauuaaguaaaauuaaaacuauaguuucucaguggccuagccacauuucaaguguuccacagucacauguggau

SEQ ID NO: 15567 - RNA, 8218 nt, Homo sapiens
ugccacacauuaaauaugcagggagucccaaauggggcccagaccugguucaggcaggucugggcaggccuggugaacugcugcaugggccuguuagaagccuaugugcaccagagaucauggagccuccugggaaggagcucgucuugaaggaagaaggaaccaggcauuaacaccuaacuuggucacugagcuuuaauugugacaggaaaggagagguucugagcauggcccaguguacagcucacagcagaaucugucucacuacucagcccccauuggacuucguuaagagaucuauggagagcaaaaaagcuaugcacaaaaauggaaagaaugguugacacuaacaugugguagucacuggggaaccagcucugggacucaucuugagacuaacacgaaacggggagagaggcucacuccuccacugcacugcagagccugcgguucucuggucuugagcaucucugugguggcaaggacagcgauccccagcaagagguagcagcgcccuguguccuggcagaggccuggaucaggccaaugagaguagaacuauggggaccagaaaacugcuguguguguugagcacacaugaggcacccccaagucacucuagaaauacugggggacacuugcaaacaggcugccgcucugagugagcuggugaaaguuaagucauuguuggcugggugcgguggcucacaccuguaaucccagcacuuugggaggcugaggcggguggauugccugaggucaggaguucgagaccagccugggcaacauggugaaacccugucucuaccaaaaauaccaaaaauuaaccgggcaugaagguaugugccuguggucccaacuacucgggagacugagguaggaagaucacuugaguccaggaggcagagguugcagagagccgagauugugccacugcacuccagccugggcaacagagcaaggcccugucucaaaaaaaaaaaaaaaaaaaaaaaaagaaaguuacacuaaugggaucacaugcaaaugggcugauugaaacccagaggaccaucaccaucccccguccucucuuuuccuggaugaacauucccaguguuuucaaucucuuuucugaacugaccauucugagcccuccaccauucuuguuacucucuuuugaaaccauuccaggcugugagagccaaagcuguuugcuaugaggguuuucagaaaucucagaauuaaucuggccuaacauucuuuuuuaggcuacaugaaagaaaggcccacaaaggcuugaagagacuugucccaacucuauguccaguuaggagaagagcaaggacuucacucaauacacacggcccuguuuuuuucuuuuauucccauccagauuuauuuacccuuuauuuuucuguuguuggguuuguuucugagccaggggcuugcaacgucugggcaaaugcagccauuauguucucauggucaggcaugguagaguuuuggacuauccagcaguugucaggugcauuugguuuuaacccucuaagggcgagggaaacagacacagcuuuucacugacccucagggacucugcauucucucugcagagaccagcaggaggagccccucaguggaaaaagcaucucuuuacuugcaaggaauaaggucacugcaggugcucugugcagaagcagaaagugacagaaggaaguaugguccagugaccccaaaacaagugggaaaauugcccacauggaauaacuuagugcucagacaaaaaaucucccaagaaaaacugaccaggaaaauguccugcuaucaacugugguuccagauggagagcugggauggguccuuguagccaguggagucccuuugaugucagagaugagacguaagauucuacacaucucugucuuuggcuggggcuacaccaaaacccugagauggccugcaaagaucagcauuuccuagaccacccuacccgcguucaaggguuugcuuuguauguugaauucagggcuagcaaguggaugcugcuucuaugccaaggccagugcauucauggugccugaggaagcaugguguuugaaaggaaucugagacuggaugugaggaggaaaugaguguucugaucaagcagcaaugucucugucagcccgaaggggaaaaggauggggaggagguuugaauaccagguaggcagaauaauaguucuccaaagauauccaugucuucaucucuggaaccugagaauauggaauguuacaugguggggguggggauuaaggaugcagauggaauuaagguugccaauuugcugcucuugacaggggaagauuacccugauuuucugugugaguccaaagucaucauagggauccuuauaaguaagaaagggagaccagagacccagagucagugaugucaugugagaaagacuugacuggucauugugagcuuugaagauggcagaaggggccaugagucaaggaaugugggcagccccuagaauuuggaaaaggcaaggaaacagauuucuccugaguccccagaaagaaacacagcccugcccacccccugauuuuagcccugaauuuaggaaccauuuuagauuugugaccuccacaagaguaagauaauacauucuugugguuuuaagccaccacauuugugguauuuuguuacagcaacuguaggaaacuaauucagauuucucuuuuccacucaugacucaugaagaaaacguuucuuaccuuuagccuacaguucuuguucaguugcucaagccccuucccucaggacaccaggaacagaaucgcuaagauugcuaagaccccagaacaguuucccguaaggauggcuauaaaagcaccaucaauauucaaucuuuaaaaggcaauggcacagguuaugcauuacccucuaaacuugaaguguguaguuaggugggggagggucccagggaugcagguucagagccgggugucagcccuuagcagucacugccacaccauacagcauguucuggggacagaagguuaggcugggacuccccacacucauccucaguuuucuuacccaugagaugaacauccagugaccucaggaggucucuuugauguuuuaucauuugaaguauucagaaaugaugcuggagaagagaaaugaaaaauaauggaacauuuucuuuuuuuucacucuguugcucaggcuggagugcagugaugcaaucuuggcugacuguagucuccaccuccugaguucaagugauucuccugccucaguauguugaauagcggggacuacaagugugcagcaccaugccuggcuaauuuuuguauuuuuaauagagacgggguuucaccauguuggccaggcuggucucaaacuccugaccucaagugauccacccaccucagccucccaaaguguuguuacaggcaugagccaccgugccuggccaaaacaauggaacacuuucuaaauagcaagcauguuaguuacauaaucucauuaguuccucacaacaguucugugagguugucaugucagguggguuccauuuuauagaugagaacauagaggccagagagagguugagcaguuuuucaagucauccagcuaguaaacugaggaaccaggaauuauaucaugacgucagaagccuaugcuuuucccugugaugucaugacaccucccaagaaggaccacggccccgggucaugcugaugacaggauccagguggucaaacugcaagcugagcccaggaaugaugcucuuggggaaaacucuuuggcauuccgggauaucaaaacuugggguaacaagaauaauucuuugguagcacaaguaucugugauuuuguuucuuuuccugguuugccugggaggcaguugugugaucuugccuaagucacuugccuucccugggcuucaguuuuccggucugugaaaauggggaagacaaacuagaaucaguguuuucuacucauucuuguuuuaaaaaaaaucauaccccaucagcuaaggagauuuuguugaguguuacuugcugcaauuuauauucaaaaagcaaguaauuuucuuauuuucaaaguaaaucauaaauaugcuuuuucucuuuccucuccucuccucuccuuuccucuccuuuccuuuccuuuccucuccuuuucuuuuuuuuugagauggagucucccucuggcucccaggcuggagugcaguggcacgaucucggcucacugcaaccucugccuccuggauucaagagauucuccugcauuagccuccugaguagcugggauuacaggcaugaaccaccaugccccacuaauuuuuguuuuuuuuuuaguagagaaaagauuuugccacguuggcuaggcugcucuggaacucuugaccucaggugaucugccugccacccaaccuacugggauuacagguaugagccacuuuccccggccaaaaugugcuuuuucaaacugcacauuccucucuuccuccaccugccuuucugggugauguggugaucuuuccucugaccugacauauugcccacucuugaggucccuuuacuugauaguugagaauuuucucugcauuuaggauuguuggagacuuagaauauauauauauauauauauauauauguauauauucuggaagagaggagacaagcagccuuucugaguugcccaucucuuuuccuggaaccucccccugcccccacuauuuuucuuugccuggaacauuuaucucucuguguuccccucuaggccaccccuugacucucaugucugcggagcagcaggcaggcggcccuccuguuugagugggccaucucucagcaagauugcaagagugguuaucuuuuauuucuggcaugugcugcaacacaagagugaucccagcuucagagauuaucaccucucaucuuuuauucucccuuuucuccucuccuuuuucuuccugcaagauaauaaaauuaccaggccagcccuccguuccucauggccuagucagaguucagagauauuugcuucuuggguaaauagcuguaaucucccugaccaggcuuucucgcacuuaagugaguuaaauucuccuggucuaaucccccaugugcugugguuuuuugaguauaaagcuuuugacaucuuuugauauaaaaugucaacucugggccacuggaucugauuaggcaucaggcgaagagugacuagccuggaaaagaggggccucucugcagaauagcuuuggguagaaaaaaaaauacauggaaaagaagcuuugcuccagagaggagaggaggagggauauguggguauuuggcagggccagggauguccucagucaugcaaauccuuggugcccagucgggaacgcaagguccugaaucgagccggcccaccacccaugcccuuccguguuugcccugacaugugcuggacauagcgacccacgcaggaggagcagguggcaacgugccugagcucaggugacacgcuguuuuuacugggagacacaagauguacgugaaccucuaggaaacaauacaagggcagauuaggaucaaacgcuaagucacacuuggcucaaauuuucaaaaauucuggggugugggcaagauucauaaagggcuagaggauggaagaucaauauuguuugacaggaaagugucugaaugcagauggaggcuguaccuauccuugaagauuggauaggucgugugugugugugugugugugcaugcgugcgugcacgugugcauuuguguguguaauggugguuucagugaggguggcagagcaacuuuccaaguaccggaaucaguagaaauaggcucaggaguaggaaugagccugguguggauggcauccaggggggacacaugugggacacuuuuucaagcucaggggcacccaugggugcccugaaagggccccggcugggaagccauccuuguuucuauguauauucgcugcacguuggcuuuucuuucuugucgaccuuccagucacuccuaaauucgguucccgcucucugccucucccagccugccaggcugcccgugccuccgccaagcagugacauuuucccaagcacagccugugccguuuaaagccugagaugcgcuuugggguuugacuccccaugccacccucccuucaaaugugugugugugugugcgagaguaccgauuuuuggccuugaauccccauuaaaaagaaaaagaaagucaauugccagggccaaggauuaaugagcaguucauggagccugaaaaacugcccaccuguccccacugcuagcugcccuugaaugcaggcagagccauccgcaagugauucucuccucugagagcagccccaacacccuggcgggggugcugcaggggaaaggaagguuucacucacucauuguccugcuuggggaaggacaaggccccaggucaccucuucaaggguuucugucuuccacuggucacaucucccuauagagcugcaggaaguguguccugcaucccuucucuauucucaaguuuucgucuccucucuuccaguagccaguccugccaggguucuggcugugccgggacagugaauggccacuccgucccagaugagcugcaggaagcguuucgaugucauguggagguggguaccuucuccccauccucggcuccugucccugaacacguuccuugcagcuccucauggccugcuugggcucuucacucccagaggcucccccuuugcccuucccccuaguuuuuuguuucugucuccauauuugucuccugcagagcccccuuguugcauuuuguugaaauaugugcaucugaaaaccauaaaagagaaucaaaaguaggguguuuucuuuagauaccuuucgcugaaacaccagcccccucuccucugcaaaauuugucuucuucacuucuuuucugcauugguaauugguuuuuggguaugggaggggguuaaggaugugucuuucuugcucuaagugccuaacaugcauucauaucucacuguggguugucaucuucuaugcacagcuggugggagcuggguuugaagggguugcaggagcagcagagagauggccugggcugucuugcuggggaggugcucugagcuguucaggggugcccaagacacuggccucacaggugacuaaaaggaaggcagggagggagagcuuagugggacccagagaggagacagggcacugauggaaaaggugaccugauuuucaaucaugaacucuaccuguuucuuuuucccucuccauaucuuccucucaggggcuagugaggugaggggcaguguuuggggaggacgcgauguugccaggacuagccuagcugucugcaugggcuguguccuauauacccagauugggaugaguggguggcaccucucccuagggagguugagcaugccuggcucucugcugugggugucuguacagcuucuacagcucccugcccugcucuggacaucacugucuaaagcauaccaugacaagacucccucagcugacacauuuguucuccaugcagugacauaaauguaauaauucucagauucuaagcccugaauaccaaaaugcuauagacagcuguugaaacaauaaaaaaacaagcagaagaauauuucuaccacacuaccacagccaaagcuuugaacaugacauuguccaucacaagacuauuaauaaaacaacuguaaucauauugauugauaccauucacggagugucuucgauguuccaggcauuuucucaucuacuuuugacaauaacccuuuuaucuccagcugacaguugaggaaacagacuugaagagguugaguaacuugcccaaggcuacguaacuacuucaggguaaggcugggguucagacucagcuccagugccaagcugcaaagccaggaaguacgugaacacaggaaccgaccaagccaggaaaagcacagugcguggacagugaaucucagaggagguguucaagggagcaggucuguggacgcuagcauggcgacagaggguucuggaaagagucgaggcaugauuuggauuuaggcacguaaugcggccggcagaggcauuucaggaugauuaagacauuagaggugaggagaugagggagagaggaauggaggcuuggcucagggaaguggugggagccagggcagcaauuggugagguuaaaugcuggaguccc

SEQ ID NO: 15568 - RNA, 4065 nt, Homo sapiens
cggugugaauauagccaaguauuccauuuauuaacaaaauaagucuuaccaagggagagcucuguucgucccaaacaggccccgcagcccccgcgcugccgcaucagaccagaaggagggaggaguggggagaagaccccagucgcugggggguccacucugggggcucugccgggccaggccuaggagagggcgggggcugcugugauccgagagcucccugacgccccaaccuuccccgaacgcagcuaacgagcucgugacauccgcugacaucgccaccggucugcuuuggagggaucuagcgagagucaccuaccccaccccuacugccaggggaggggucguugcccccacgagggagagaaaaacaaggacuauaaugcacuucgcaaaauguaaggggccggcuucacgccagcggggccuucugggacuuugaauucaaccaggugagcgcuccaggugccccgacaggcgcacuguagccacuggguguuaggggcgggagucuggaaggugacgguagacggccacuugggcccuucugggggcgagccuacugguggggucagggcucuccgugcucagagcaagguagaggagcaaggcccuacuuuuggggggcaggguccagaccaaggacccuaugcgcggaggguggcgggggaggagucccggagcaguguaccaggucaauagagcuccagggccccugccacccagguggcccccuccacccccaaaaugaguuacaaaaaaaaccuccucucuguuacuuguacaacaaaggaaaaaacaaaacaaaacaaaacaaaaaacaaaaacagaaccgcaaauggaaggaaacaagagggaaugaagggggaagagggaaaaagagaaggcggaaacguaguuuuaaguuaagacucaugcaagaaacuccccaggaagggaaaacaaaacgucuagaagaacccaaagaccccaacucucccucaaaccaaaccaaucaaaaccaaaaaaagaggaaaaggaauaaaaaauguaaaacuuauaucuaagaaaaaauaacagaaaggaacaggggcggggaucaugucguuauuugugggauuaauauuauuauuugggagaacacagacuuuuugcauaccauugacucaugugggccguuaaugcacuuauauucccagcuuguaagcuaacauuauaguaaauaaauacacaguccgguggggaagggcuggguggggaaucccggcagggucaagcaguaguggagguugcagcggcgacggcagguggggagggaggaggagggagagggaggagggugagggggcugggguggaggaagagcuguaguuacugguaucccagcgccgaggcugaagcuagucucuguccauacagcgcguauggcgaauaguaggguccggcuguggggagggacggcacggccaggccccccgcuguggauaaguggcucuugccauaggggugguaccggcuuaggcccaaaguguguggauuccgcaaggacagcgacccggggcugccgggggcggcgggcggggggaggugcagauggcaggaggcggcggcggcggcggcggcggcggcgcugcccaggcccgaggccccgggguaggcggccagaaguuucucggcucccggcagggccguguggguccguagguggcugagcagcuccuccgagguggcgaagcgcuugucgcacggcccacuggcugccacccaguugcagcugugcggcagcgguucguucugcagcaugaagccguagguguagagcggguggccggggagcgcggccugggcggcgcuggacgagagcgcggcgggcugcagcgggugcccgggguacaccagcggguagccccccgccuucaggcugggcccggcagggucgugcgcgcugcagguggagcagcuggagccgccgaggugcgaggcgccgugguaaccucccaagcaauaggggucgcggcauaaucccugcaggaaggagggcggggaggccccggugagcgggcuggagcuggggggcuugcccggcggcaggcccaggcccccagacagcuggccucccacgaggccggacuugcuaggauccaggccaggcacgaacugagacggguagccggcguaggcgcccacgauggagccgugguagccaaugcuggagggcggcagcgggaacaccgaguggcccggcuuguagggagacaccggcgccacguggccggcccccaccagcgccgagggcggcucggacuugcgcccggaggccccggacucggcgccaccgugcgccccgggcuccccaccgccgccgcggcucacggcugccggcuccgggcugggcuugggcuccuggucuuucuuguccagcuccccgccgccaaccccgccgccguucuugcagucagaguggugcggggagccgccgcgggagccgccgggcgacgacgaggacgaggaugcggagaccggcgcuccaugcgggggaaagggcgggcaggcggcgcuggggacccugaagcccgccuugucucccggggacgaggaggacgaggaggagguggaagacaccgaggaggagccgcugucuuugcgggagucgccgccgccggagcccuuggaguagggcuugaagcuggacuuguccucggccggugagucccccagcugcuucagggccgcggcugcggaggcggcgcccggggcugagcggccgggguccuucuccgcucccagcccguuggccgccgccgccaccgaguugaguuuggaggagggcggcggguccggcuugccgaucugcgagcaggucugagccagcagcgccaaggggcucuucuuggcguccagcugugggagacagaagcagggggagggagaaggagugagacucagaggccugcggggcgagcgggggcgcccggggagcugggcggcggcgccacggggcggggcgggccuggggagagggucugcgagcgagggccgggccgggcgcggcagcuggcggaacugcgcccacacugccgcugggucccggggugcgccgcaggcccugcggaaggaguucacccaggaccccugcgggagaaggugacgucucuggagucggggcugugacucgccacuucccucuaaugucccccuccuccaggcccaggaaaaaacuuauuccuuuaguuugggggaacuucgcuugggacggguuucuggcgauggcgccgcgggguaggagaggggagcgcggauucuaaaggaggggcugcaguuggcgcucucuccguagccccucccucccggggagggcacccagggaagaggcaggaagaaagauccgggaucgggagcgccagggcgccgugcgcccucaccggaugggacagaggcgaagugggacccgggcagccagggcuucaaagaaaacagcccggcguggggggcggggaagacccagcagagaccaacuccuggcuggaaacuggggaucagaggaaaaguaaaggacccagaggggacuccaggagcaaauccaauccgagagaaaacacggagcuccgaagggcgagcguggaaggagacccuuccacggggaagccuggggaagcccuggugggcucugaucccucgguuuucuuccccuccucacucagcccgccagcgugaccagacuugggugucgcaccgagccccggggcgcugggagcugggucagggucccggucgcggugggaggaauggggccggcgcccgggggcagcggccggggacugaccucaauggggcugacgggaguggaggacagcggcugcagguacuccgggugcaggaggugaccggugugagcgcucagcaucuucaggacccugaucgggagccgguucgccuggcgcaggggguccgccgguggcaagagggacaccgcugccggcaccgccggccucuucccgccgccgccgcugccgcugccgcugcuuucggguguccuuggguuagauccagcgggcgaaucgcucauuuggaggaggcagcgccgcu

SEQ ID NO: 15569 - RNA, 1951 nt, Homo sapiens
uucuuuuucucucuuuuuuccacgaugugggguagaggggcuggcuugugcauuguaggauguuuagcagauucucuggccucuaucccuagaugcugguagcaacacccccaccucguugugacaaccaaauaugucuucaagcauugccaaauguccccaguugugugugcgugagacaaauuugcccccagcugagaacaacugugguguggauagacuuaaaaaugaggggauuaagaauaagagggcuuugcuuugcuucccaaagcauggcagguguuccauggguacaguucuguaugggcuaagagucaggggaguagggagggagagaaggagauguuaggagugugucugcauggaagcagaggccaguaggaguucuggaagaagauagaagaugggcgagugguguugaagggugggguccuagagaacccaugauaauaggaacguuggcuaugcaaugggagaggaagaaaugugugugcauaugugugugaaauguagaucucagcucauccuaccgaaccaaauucuaaagaggagagucaguuguucuuuggaagaccagacuuggggagaagccaggcuauaaauccuggaggggaggacuuuacugccacuuagaaaucaggccugaaacacccauaauguuugucaguccacauuuuaguguucuuaaguaaguuugcaggguguggggaaugaaauauggcagguauuugauuuaaaaagccugcacagauuuaauguccugauaaaauguauuaaaucuuuuaagguuuuaaugaaucuaguauguguuucauaaaucaagaacucugcuaagccgucuucugguuuaauaagaguaaacuaggaaauugcucugagcagaagcaaaauacauuuauaucacacugaaaaguaauagauuuuuaagcugagggggucuuucugggcuuuuuaugcuguuugcuuauuauguugcuccaacuccuucaaauauuaaaccacagggaaacgugcuuaaccguaucaagaugugaacuagcacaaagguaaauauuauuuguaagagagcagaaaacaaagccaguauuuccuuacccuuagaccuaggaccagguugauuucugcacugacaccuggcuuuguguaucuaggcguaaggugguugguuaaaaaucauuauuaacuguuauuaaaucaccuuucccaaguucucucacuccuccauccucacccccuuagcacaucugccagauugaagccgugaguguauaaaauacuucuugaauuuuacagcuggcuguggaauggccuuguuaaacuugcuggccagaccguccaaagcaaguguucagagauccuuccaucaucuuaaacccaagggcugaaguguucgcuuugguucuuuuuccuuccuuccagccccauugcucaagcuccagugggaaugggaaaggggcuuuuggggguguggguguaacagauggguaucugugagcaggcuggggcuugaagccucacuacccagcuuccuugguggaugggcaagauuuuggggugagauggugguucagggaguuggggggaggugguguuggaggaaugaagggggguggggcuugaacauuccggugcacaaaagcuggcagggcuugugagcucugcaggggagggagcgggccuguaaagcucaguguggagaagccuguccaaccucauuagcugucaggggcaacaauacugaucuggcaauagaggcgauuccaaaccuguuggucauuaaucacccgccugacaguugcgaauggaaguggaaaaaccucauccccccuccacccuuccccuccuccugggcccagcucuggaguuuagaguuaccucuucguguauaugugguucacggcugugugcuggguccuucccucuuggcuuuuuuagcgggucguuuucagca

SEQ ID NO: 15570 - RNA, 22431 nt, Homo sapiens
uuaaaauuagaauaauaauuccuuguuaauauacuuuguggcguugcaggaucccaagggccaaagcucccagaaaaauauaaagaacaacucaagguagggauuuuugauuggugagguaaugaugcuaaucuguacauugaaaagacuguuucauuucagcugugcuauaggaaagcaaacaguugcaacucgccaguaccuuaucaaggagagaaaaaaaaaaaggccgcgcaugguggcucaugccuguaaucccagcaguuugggaggccgaggcaggaggauugcuugaagccagaguuugagaccagaaauaccaagacccugucuuuacuaaaaauaaaauugucaagugucguggcgugcgccuguggucccagcuacucagcagggugaggugggaggaucgcuuaagcccaggaguucgaggcuguagugagcuaugaucgugccacugcacuccagccugggcaaaagagcgagaccuugucucuaaaaaaaccaaaacgaaccagguucggccuaaugcagaaggaaauccggagcaauccccaaagucaacgccuuggaaagguucgcccugggucucaguacuccggggcaugcgcguccugccgcucgcucucggggagcucccaccaacaccgcccucauccccagccccaggacggauacccaagaccgagguccaggaccgcaccgaccaagucgcgggcgaucccuggcggccagcuacggccauugaccgcugggagcgcgaggggcggggcgcagagcgagcgcggggcggggguguggucuucucgcgugaauugauggcgucaucgaagcgacggcccggaaggaagucgcgugcugaggggugugacgguuuucuugcucgugggcucggacgaguacggagcgccugcagggacagccugguacgcggcccccgccccuucgugcgcgcgcugggccuagcugccgcucagggucggggcugacccgucacuuucgggaaccucagucccagcagcuucucucccucagccggcccgcuccuggagagagacagaaacccuuuucugucgcguccucuccuugcgagccgcagggggaccgagcggaggcuauuggagccgcagccccagaccagggcgcuugacccucucucggaacggggcggggaaggggcgcgagugaccucggggagggaagggcacuggcaggaaaggacgcaacugcagaucgguagccggaggccgccacgguaaaauaagcgccucgcagauguccgcgccccgguuacguuagaccugggaggcagaauccacgcccugcgcucacgggcccacgcacgcacagcugaacuuugcagucagucaccauaguuccagaucauucagcguucaggaucccacuccuccgcguccuggugccugaacgcgguuggaccuaggagccuagaggcucgcaguuugggacauugccuuucucucugaccacgggcuuggggaucugucaggugcaaagugccaaaguauaugggggggaguguggcuucaggcuuguucagagcccuguccuguuuagggccaaaggaauaacugggaagguggaugcgaggccaacgaauccuaccuugaaacucugcucgccugcuggcucugccacuccagcaucugaaaggaguaaauaaugguuuccuuugaaacugcaggcaauuaggagugggagacucugaccagaauuacauagccacaacugccugucauuuggcauccucuguaauuugggccaaaguacugcagcugccucucuucccuacuacugguaggaaagguucagugacagcacauucguguucacaggaagacaaggcuguguucugaacccuacccagcuggcacggguucucccuugagcaacggcuguauccggagccagugcuuccucagugcggugggggcucuaauuuuacaguuaaagaaaggggaacguugacugagaacgaggaggaagcgaguuguagaucuagccuuguguucacacgacaccaggcuggauaugagucacucgcagggagcucagcuuggugagguccucucgcuguuguggccuuuucuccugcacguuggaccacacacauuuucccgugucuuuucccuaggauaaaggcucacugauggcucaguugggagcaguuguggcuguggcuuccaguuucuuuugugcaucucucuucucagcugugcacaagauagaagagggacauauugggguauauuacagguaaggcagagacagggagaagccggcaacuuccuguuaaauagcucccuuuccuggucauugcuuuccuagcagauucugcugaacaucucuauuuauauuuccuugaauaggggagccuuuucagauggagcuuuuuaugucaguaaccacgggaaagagaauacacacacacacauauauauguaaauuuagaacuucacuuaguaguccaagaugaugccauggguggugauuaauaaauguguauauagauuuagagacaaaaucuaaaggaaacuggugcuccucauugaucaucccuaaaauacuguuuucuccuacauuccucuggcagucuuagcucuacaucccucuggcagucuuagcucuacaucccucuggcagucuuagcucuacacugcuagguuaccuuuacaaaagccagcugaguaccaguucuugauggcaacuugagaagguagccuacucugcuaauuugggaugcucuuuuaaaauuaacauuucagccagccugggucacauagugagacccuaucucuaaaaaaauaaaauaaaaaauaaaauuuuaauuggccggcuguggugucacacacacguaguccuagcuacucaggaggcuuagaugggaggaucaccugagcccaggagauugagaccagccugagcaacauagugagagcccaucucuacaaaaaguaaaaaauuagccgagcauggcagcacgugccuguaaucccaguuauuuggggggcugaggugggaggaucacuugagcccagaaguuugaggcugcagugagcuaugaucacaccacugcacuccagccugggugacagagcaagacccugucucuaaaaauaaaauaauauuaacauuucaagaaaaaugaaagagccugcagguugacuuacgucaaucaaagcaagccuuaggauagugguuccuacaauaaaggaacccauuaugucacuguuuauuuuauugguuuuuuuuuuaauucuuugccuaauauaaagcaaagaagcacuuauaagucuuggguugcuuucuuuuuaguaaccuccaugaccaaguguuuugcuuuaugucuuuaugaacucuucuuauaugugcuguugugaugcuuguuucuggauugcuaacagcaaguucuaaaacucugauuggaauuccucucuccuuuaauucuuucuccccaucaucugcuuacauguuccccaaaaaggcuuuuaacuucaucauuuacauauaacuugauuagaaagguaacucuauugccaaaacauauauuucaauuauuuauaaaguacuucaaauuauucuuuugguuggucaugucauuggacuccagcauuagugcagguaguugauaaccauauuacuggacuuaacugcccuaauggauugccacaagcccaacagauaugacaaaguaaaacagacuucuuaucuuuuuuuuuuuugagacagucucgcuguguugcccaggcuggagugcaguggugagaucuugguucacugcaaccuccgccucccagguucaagcaauucucugccucagccuccuaaguagcugggauuacaggugccugccaccacgccuggcuaauuuuuguauuuuuaguagagacgagguuucaccauguuggccaggcuggucuugaacuccugaccuaauaauccacucaccucagccucccaaagaucacaggcgugagccaccgcgccuggccagacuuucucuuaucuaaguauacccauggauucugcugucuuuuucuuuuuuuuuuuuagacagagucucacuuuguugcccaagcuggagugcaguggcacaauuaugucucacuacauccucaaccucccaggcucaagcaauucuuacaucucagccucccaaguagcugggacuauaggcauacaaccaccacacucagcuaauuuuuuuccuuuucuuuuuuuguagagacagggucucacuauuugagacagguuggucucaaacuccugaguucaugcaauccucucaccucagccccgcaaagcgcugggacugcacuaguggguucugcugucuuuauuccauuuagccuaugugccuauuuuucuccuugcaaaagcaugaacaauaguuuuauguuuuaccaucaggcuuccuagaauauuaggaucuagcugagaggaagaaagggaucuguagccauggcugcagcacaugucacucucuauuauauguuuauagggcugaagggaaaguugacccucaugauauugaucuaacagagccuucuugccaaacugaagcugccucucucuucccccuccucugcagaggcggugcccugcugacuucgaccagcggcccugguuuccaucucaugcucccuuucaucacaucauauaagucugugcagguaugcuuggccucugugguauggcuggacgacugcaaacuugggcuguuaacuagugcaugauuugaaauuauuuagccauuggaugaguaaaaugccauucuagagaaugauauaaggauaauauauacauauuauauauauauaauauauauauauauacacacauacacuauauauauauaaaaugaggcuggggauuauuccuucaagauaaagccagagaagaaccuguucugaguauauggaaagaaaagucaggguuuauguguguauguuuuaaaucacaggcuaccauguuaaauggaaagaaaacauaguaauuuugcugauucuuauuugaauucagaaauacgaacauaauuuuugcagugaguggggaggaguuaaacuaagugaggggaggugacaucuaaaauaggagugagguuaguuguggcagaucuaaagccuggcuaaguuggacuugccaucucugaaguauguccagcuaagaagaauaacaagauuuuacacuuuacacugacccaggagaaugucuugggauaccugcuaggcauuuucccuguaaguuucaugugcuguuuaccaggcuuuguggcuuucaaacugcauucagguacauugucucauuugagucuuguaguaauccugagaaugggcugagcaugugcuagggucugagacagguuaaauagguaaucugcuguuucaaaacuaguacaacagcccucccccuuauccacuauuucacuuuccacaggcucaguuacccacaauaaaccauggucugaaaacaggugacuacaguacaauaagauauuuugagagagagagagagagaccaccuucaaauaacuuuuaugacaguauauuguuauaauuguucuauuuuauuauuguugaucacuuacuguaccuaauuuauaaauuaaacuuuaucauagguauguguuauaggguuugguacucuccccgguuucaagcauccacugggggccuucgaacauaaagcggugccuaacauaaauagaagagguagaagcaagcacaagucuuaagaugcccaauccagugucaucuucacuaaaccauuauuacucagcuuguugauguggugguucacuuauagugaggcuggggcacgggccuuuacuuggcuuagcaacccugugaggaaggaggauuaggugggguaaucauguuuaaugaaggccaugcucaacccaaacaguuauuccaggacaaaggcauuuaggauucugaaaaguaaguuacuuugucacugcccaucuucuagcacuuuauguuuccucuguuuccagaccacacuccagacagaugaggugaagaauguaccuugugggacuagguaagguacccagaauaaagcuuuuaagcccaaauaagucagagaaaaggcugucuggcugguugcaggaagagacagugaaaagggaggcacccuuucuugguuaauucccugucucguagcucccuauauugauuugaccaggugauggagugcaguagaggaaaucauagaagguucaggaggggcuagaaugcuguaugugauaaggaguuugcacuuacucuauuagaagugaggaucggccgggcgcgguggcucacaccuguaaucccagcacuuugggaggcugaggcagguggaucaugaggucaggauaucgagaccauccuggccaacauggugaaaccccgucucuacuaaaauacaaaaauuagcugggugugguggugcaugcauguagucccagcuacucgggaggcugaggcaggggaaugacuugaaccugggaggcagagauugcagugagccaagaucacacaauugcacuccagccuggcgacagagugagacuccgucuuuaaaaaaaaaaaaaaaaagaagugaggaucacuagucacaauaacaaagacauggaaucaacccaaaugcccaucaacgauagacaggauaaagaaaaugugauacauauauacuauggaauacuaugcagccauaaaaaggaacaagaucauguccuuugcacgggacauggauggagcuggaagccauuauccucagcaaacuaaugcaggaacagaaaaccaaacaccacauguucucacuuauaagugggaacugaaugaugagaacacauggacacauggaggggaacaacacacacuggggccugucaguggauaggggguggggagagggagagcaucaggaagaauagcuaauagaugcugagcuuaauacuugggugaugggaugaucugagcagcaaaccaccauggcacacguuuaccuauguaacaaaccugcacauccugcacauguaccucugaauuuaaacaauggaaaauaaaauaaaauuuuaacguuaaaaacaaaaaaagaagugaggaugcacaaagguuuuuagcagauaaaugaccugauacaagaagauaacuugcauaacuaaagagaaugucauaaagguaggggagaccuucagggcaaagagauccgaagagaacacugcuacagcggucccacuggaaagcaaagacaguuuaaacugggauagagugacaaagaauaccacaaagaaacacucugacaaauccggaauuggaacaucccacaagaucgcaggccugaucucuucacaaagugguuguauuuagagggaugcuggauuggacagagacuuacaagaaacauaaacagaagcaagggugagcauugauuagaaccugguucaaaauuaacagcuauaacagauacgacagaaacuauaugaguccacucaggcugccaugacagaggacuacacaccaagggacuaaaauaauagauauuuucucaccauucugaaggcccaaaguccaagauccggguaacagcagggguaguuuuggugagaccucucuuucuggcuugcaggugaccaccuuuuugucacauccucacaaggccuuuccucuguaugugcaagaagagagaaaaaggucuuugguggauaccagaccuuuuggauuacagcccacccuuaugaccuguuuaaccuuaauuaccuucuuaaaggucuaaucuccaaauacagucacauuggggguuagggcuucaacauaugaaucugggggcgaggcauacacaggucaguccauaacacaaacuguuggggaaaucugaauaaggacuggguauuaggugauauuacagaauuauugcuaauuuucuuaggcuugggaaugauaccaugaguguguaggagaaugauuauucuuaagacagugcucaccaaaguaaaggaguaaaguauccuaacugcagcuuacuuugaaauguucagaaaaaaaaaaggucaauaaauaagguaaaauguuaucaguguugaauucagguaucuggauauggauguuaguuauacuacucuuucggcuucucuauguuugaaaucuuuuuauaauaaauauuugagggcaaagggagugugacaccaaaguaauagugaagacaguuuaagaaacauugaucauaacauuccacaguaaccuucuaaguucugaaaacuucaccuugacccuccuuagucuuuuccgugcaacugauuaaucaaaaggcauugcugauuccaaagauaugaguuacucuuucguacugguccccaaaagucucauucaugucuuuguagagauguuccuaggcagugugauuucucaggagaguauguuguugccaugagcccugcagaaccucccacuuggagauccaagcugccuuccaacuucccgugaacucuucuacuccuuuucugccaagccccacaucuuacgccaucacccugggggacugcaccauauucuaaggcuucccagugacuucuuguccauucucccuccaauagugguggugugaugaucuacuuugacagaauugaaguggugaacuuccuggucccgaacgcagguacgucuuaacaguuuauucccaccaccagcucacuuuccccagcaugccacucccgugucuguuguagcaccuuggaaaaggagagcugccgugucugagggcauuuugagucuugccuuuucuuaugccaagcccucuccuucccucucaguguaugauauagugaagaacuauacugcugacuaugacaaggcccucaucuucaacaagauccaccacgaacugaaccaguucugcagugugcacacgcuucaagaggucuacauugagcuguuugguaagaaagucucuccugagcaugccgugcuuaagcaggguuccuggaaccccgcgucucuccacugccuaaagccuggcugccugcagggugugauggucacuuauggacaggaaauguuaaagaaucuugugcucaggagcuggucacaaaggaguucauggagaaugcugauagcuaugcaacaagauccuuagagggcuggagcuuugggcacagggaccauaguggaguagaguauucacuucuggccucaaucagaggcuggaguggaaauguguucccacuguuccuaaacuaucauucuauaaugaagacaagguccauucuagaagaaccuuagagauuguccagaccagcauccucauuuuaagcugaggguacugugacccaaagcaagaaagucacagagccagaugccaauuaguaguggggcugaaacaggagccuuccucuccuggcucuucagcauucuucucaccaugcaacacugaauggagggcccccaggaaugggugaugaaaaagacaugauucauaguuaauucuagaagugagaugagaaccauagcuccuuccaguucucagaaccuuugugauuauuauuuuuuuacucuguaccuguagcaacgaauagaaaaacacuuuaaacaaaaagauuccacgugccuaaguagauauguuuuguccuuuuuaccuuuuucaaaguaaaggcaaccugacuuagcagcaaaggaaggacacaguuggguaacuguuauaacuuguuugcagucaaguauucuguuuaaacucacugccagaaauucucuaauagccaaugccaaaaguaaaugaauuuuuaaccaauaguauaacuguucuugacacuaggacuggaaaaugauuuuucccaggaaucuucauaaaagggacccugagcaagaacauuuuucauagcagacaggaggacucauccacaucgccagcaaucauaauuaagcaaaccgccuuuugcaccauuuaagauuuaggaaaucauccaaauuacuuuuaauguuucugcaguagaaaaugaaucuaaauucauuuuauaggguuuguagucuuuuaucuguuuuggauucacugugcuuuuaagaaaaaguugguaaauuugccguugauuuuucuuuuuaaccucaaacuaauagaauuuuauaaaauauuaauuuucucuagccauugucuuaggacuugugacauuacaugaacauuucaaagcacugaaaaaagacaaaggaucccuaaugucccugaagaggaaauuaaaauacaaaguuguuuuucauuagcaaacuucuuacuuucuuacagcuaaacuugguagcuuagugaaguacagcugcuuguauggaggagcuggggaaauauauuugcuuugaaacuuuuuuauuuuuacaucucagucuugcuagcaagcacuacuuggcuuagaaucugucauauccauaaaggaggagcucaugucucuaguccuggcccuucaacucagaagguucuucuauacuuuccuucucucaggacucuuauagcccagacuuuaaacaugaagcugcauaauuuucaucacuucuuacucugccgcauccucuuugcccauguuauuaaaguauuaucuaauacuuugaaguuuaccugaagaaccucuuuguguguacuuaguaauacaacuuuuuuuccugucccaacaccuuuuaauacaguugaauggauaaaaacauggauacaaacacauggauauaguuaucacugaagcagugugacauaaaauaauaccuauguauacaacacuccucuguaaauagcaaauguaaaguaaaagauacacaacagaucauuuuguuuaucucacuaucauuuauuaaucuauaauguaucccuccuauguauccaugcaaggaagcaauacuagcugcccgacuagagggcagcucccuuggguuacuuauucagaccccauuuucauucggaucugagcugucuuacccgcucacugcaacuuggcuuuuccuucuuugaguauaaagucugacaugggauggcucaccuauagcuucaguguguuaaguaaagaaagcuuuaugcagauucugguuuuuagugggucuccucugacaguagaaagauucaaaccacaaccaauuccaagaacccuucuaagaacagagacagagucacuucaaaggaucugacuugcuauaccuaaauauaauucacgcugcuuuucucuaugacguaccauaauauuuuguccaaaaaucuugaaacauguuauuaacuuugaagaaagaauaaaaccagccacuuuagagaccagagacacucaagcacuuaucuauucauaaaguuucuacacagcugaagaaguuugcaucaaauggacaaaaaauaguaaagaaaaucuaaauacagaaaaaaaauuagagaaaaauccaucuccuagaaagcaggucaaauggacucaguuaaagaccucacugcauguaggagaaucaaugggaaacaacauaaagccuucugcugggauauaaauaggaaccagucuauguaaucaagaaguuacuuugucuccugaucuaaaugcuugccuccagucuagggcucagaaaaaaagccugguuauuugaacugguugucaaucaagguccccuucauuuucacuuucuuggcuucccauucagccagcucuugcaguggccucuugcucaugccuuugcgcuccagcuguuuuucaaucacuuuggcauucugugcauacgagucagcaacuucccuagccucaaucuccucuuccucuucaucaaugguagacacagugacagaacugaacuugcccaugucuuugguccguuuggucaucaucaccuucuuaggaggcucuuguuucugaguauauauguucguuuucccaaagcccuggccaaacuugacgacugcuccauccacaaugaagguaacgggagcauucuucggcugggauugguagaagagcagcaguccacacuuugcacauuucuuucuguacuguaguucaaugccuucaggucuccgcagauacauagucucuucgucuucuguguuacaaaacuuaugggcauguuuggcagcaucaaucacacgggaccggucccggggccucaugggcaauuucucuaacugacaguccagcacuaggaccaccuggccgcacaaacaguaguacacauggaggggcuucucgccgucgucauauuccucccggucccgagugucagagcagacuacugaccgagacacuacuuucggcaugguuuccaggagcaaccugaaaaacucuacgcaaagaagagggucgcgccgaaaugacgucacgagcgcgccuugcgccuuuucccugcggcuaccuuaguaauacaauuuaaauggcauuuaucaacauuuccauaacauauaaacaucaauauuacuaaaacaacuugaaaaguauuucuuucacauuuuuccgguaagcuacuagcccagggccacagguuuccaccuugacagauauaauuuggucugaggaaugacguuauuaacuuauggaggauacgggccauuuaaaguuugguugguauucuacuuaaaauuacuuaaaauaugaaauguaauauuuaguucuaguuguuaaauugguugaccccuggcaggugugaggugccgacuugauggcauuucuccuucggugcucagaggcuugugagagcacauccuauauguggaaacguuaccgucccuuguuuacugauacuacugucuuaaaauccuaacaaucaaggcccaccaguuaaacaagcuuguuauuuuugcuacuagccagcuuucaugggccuccguuuuggcaucagugaaagagcggagacuuucucuuccucagaggcucuuauuugagcacaggugaccacgaaaggaccacuuaaagcagauggcggcugacagcaaaggagagaugcaguguacaagucccagccugauuucacucugucuuuuucucuaagccccuccgggaucuuaucaaggauaucaugggcagaaggcaaggaagaggauucuaaaaccugagaagcccaugccagagaagucagcuuugguacugcuguucugagauugcagcuggaaaggaagguggggggagagucaguuacagcuguuccuacauuugucugugaaacaacucauguggauuccagacaaagaaaucaggaccaaagcaaacagcacaucaaaagccuggggcucgcuuccagaacuguaaauuuuaauuuucccuuuguguuguuugauggaguuccuaauagaaacagucuuccuuggggcucuccuugacgucaaagucuguuuuucuuuuagaaacuucuaaaauuacuagauuuaaugugcucagcucuuuccacaaaaccuaaauagccauuccaccuuccuucuucuuggaaacugugaaccuuccuucucuuuugcugcuauugucuagggaaaggcugcugccucacgcaagaaaugugcuagaauuguuuguucuuccuuuuuuuucuuuuuaagcucucacccccuguagggcaugguuaguauuuucagaacaaagguugaguuuuaucuugaggcacagaaagaaaaugcccuugcguucaccauguagagggcugccugcacaggcugcuucagaaguugggcaggggaucuuuagauuugugggcuuugauaagcacacucccuugggaaaguacauucuugagcuggugauugagcuugcacuuuaccucauccugcccucccucaucuagaaaguguaacaacuccuuuuucuccaucuuuucuuuauuccagaucagauugaugaaaaucucaaacuggcuuugcaacaggaccugaccuccauggccccugggcuggucauucaaguaagcauugcugcaugggagcagccccucucucucugacacugcuucccuucucccaagggauguccuuuuugugcaggaagaucaaggcccagugggagcugggugugucccucacuacccucacuuucccaucagcugcuguuuuaaucucucuccaggcugugcggguaacaaagcccaacauaccagaggcaauccgcagaaacuacgaguugaugugaguauacccuccgccugggcugugaccaccacugccucccaccucccaccucgucccaucccagagguaaccaaagcugccaggcuucucgguuauccccuugcuggaggauuugcuacagcccauugcacuguaagauugggcaggcgugucagggccaccacuggggcucccuaccugugauugagaaccccaggauaaucccuguagagcagcgauguuuugaaaagggccagggggccuuguuuguguucagugacucaugcccaagguggagacaggagcaagagaccaguaaguggacaggcagguguauuuuacuaaauuauguuuuauuucccacaaaugaguuacuugggaggagaagagcuauguuacugucaacaacagaucagcuuuuaccugggccaucgaacagccuuccaggaggaguaggaaaugggaguuugccucucuucagcagaagaauucgacuuaccuggggauagugaagcuccugaguuuuccauagcugccucacggcuuuuucuucucuucagggaaagugagaagacaaagcuucucauugccgcccagaaacagaaggugguggaaaaggaagcagagacagagcggaagaaggcgcucauuggucugaaugugguucugugaucccccuuuccaggcagaaaggcuggggguggugggaagaugcaaggaggcuaaggccuggugagaccccaugguccuccaaaccacuuccacagcacaggaguggcagguggacucccagaaacaaaguugaaauugucagaucauggccaaggauaaugaguuuuuugaguuuccacuuaacucuuaaaugaaagaagccccaccuguuaauucuuucuuuuuuuuuucuuuugagacggagucuugcucugucacccaggcuagaaugcaguggcacgaucucagcuuacugcagccucugccucagguucaagugauucuccugucucagccuccugaguagcugggauuacagcgggugccggcacgccuggcuaauuuuuguauuuuuaguagagauggggugucaccauguuggccaagcuggccucgaacacuugaccucaugaucugcccaccucagccucccaaagugcugggauuacagacgugagccaccgugcccagccuguuaauucuuaauaauaauggcuaauacuuaauuaagcaauuacugugagccacauacuuuucuaaccacuuaauauguggguuaagucaacccucacaaccacuguggagguagguacuguauuauccuuaaccucauuuuaucgaaccaaagcacagagggguaaaauaccaugcccaagggcauauggcaaguaagggguggaacugggguucaaaccaaggacacuggcucuagaagcuauguucuaagucacugcaccguauuaucaacaacuaaccugaccccugucuacagugaagggccagguagaacccuacuagaguacuucauucuuacagaauauuccuuugggagaaguucccuugugaaguuagggcucaugcuuccuauguugggcccaggucuccuugguuacugucucacacugauggaaggggacugugcucacuggcauaucccacucugcccuugugugcacucacagcugcccucugggggcucuccagacaagcuggcccaccaggacacucagcucgggugaaaggugaaauuagucaaacucugaaaugccagaaccguaauccucacuaucauuuauucagaggcagaaaaaguggcccagguggcugagaucaccuacgggcagaaggugauggagaaggagacugagaagaagauuucagaaauugaagguaagcagaaguggcagucaugccugaguccuccucagaccccgcccuguggccaguggguuggggagccauugccuuugcccuuuaacugugcucaaggaugucaugaucucugugcaacagcagcuuuucuccauguggagacuugaguuuugaggcuauuguggccaggcuagcaucuguuuucuacuucagagagcauuuguucauucagcaaauguggcuggagugccaguaugugcccaggauuuuguuaggcaugagaaaaaggaagucccguagacccugcuuucuuggaguucccaggcuagcagggccuuggagcggugggaguguacucucagcaguuggcucucccccuugccuuagcuacuucugcuccaaaguuggucagugccacgguuuugggcucaaagucuguucuccaggucuaugcagauauuaagccagguuugaagaagacagauuuucagcaccugucagacaggagcuggagagaaagguuuucuuugcuggcuuuucugaauaucauucaccuucuguuccugcuucuaagccugcaccuccuucccacugcccaccucuuacuucuugggguggcuuauuucaagcaaauuccaaggcacaacugggaccucaaggcccagcuucaggcuacaaaguguuaugucuaauuauacucauuauugggccugucaggcuuugcaggggcccauagaggagccaguuaggauuucacagaucaguggcuccucauuagggagcucuuagcaaagcaacacguuuuuauuucucacaaauacaugucaucaagugcucaggccagcugagggggccccacagcagccagaacccuggcuggacugcagguuccuuccacgcggggucacacugagggcacucagugaaaacccacccacagacuaaccuuucucccaggcauguugcuacauauauuacucacaugaggcuggcccguucccaagacaaggagguaaauaucaaaaauuuucuaucagcuugacagaaagcuagucucagagcugauuagggaagaauaugacuugcauagaggaauuaaauaggucuuaauccaaacacguguuggucuggaccauggcguguaauucucucucagaaucgcgccagcuuaaucacuguuaauuaggaccuuuuugaaaugauugauggaaauaaaagggaauugaaguuggagagggacugaacuauguuauguucguggcauucaguuuuaggguggaucgaccucugaccguacuuagagccaccuuugagcuuuccugcuuuugcuauguagcacaagagggaggaguggagagcucuggccuagagcuugaggcagggucccacugcugugcuacacagacauggaucuccaaaagaaguaagacaggaagcgcuucuggcuaacagugcuuucuuccauagugcugucaacauguauguuugggccauagccacagacuugcuguccuugucauagggagaugcuuucaaaacacuuuuucaucuuaguugauccuuacaacaacuuguacaauaggggaaaaugcauguaaaacacagaggaaaaagcagucugccccaagucacagaggcaaucaggggcgaaguuccagggaccagaacagagucuucccauagccucugcacuuccugcaaagaacucaguuuuagcacuucaccaaguucacugcacuccuucccccucagaugcugcauuucuggcccgggagaaggcaaaggcagaugcugagugcuacacugcuaugaaaauagccgaagccaauaagguaaagaccccgcacagccugauaaaaaggagucuuugggucugggucuguauugcaggagaguuuccaguguugagcgccugccaccacccaaagcccuucaugggcagaacugaggaugccuuugcuguguggugcagguacuuuccuucuccuuggacaugccuugauagaaguuuaguuuaauuuuguguuaaacauggaaacuuuuaacuuuugcaccuaugcuccaagaucugagaugacugucucuuacagaaauguaacaaugagaccacaaaaaguagguaggggcauaaauauaggaaaauugaaggggcaccacuccccuccuucucuaauaugguucaacauaagucuuccauacuuuuuuuuuuuuuaacagcugaagcuaaccccugaauaucugcagcugaugaaguacaaggccauugcuuccaacagcaagauuuacuuuggcaaagacauuccuaacauguucauggacucugcgggcagugugagcaagcaguuugaggggcuagcugacaagcuaagcuuuggcuuagaagaugaacccuuggagacggccacuaaggagaauugaaaaaaacuugauaugacugcaaaugauacuuaagcagaucuuuauuuuuuaagaugaaucagaauguuccucccuccccgacuaccuucucugacugucuuccaguuacuguggugaaaaagaagaaaugaacuuaaauccacucccuuucuagggaaaggaggguggggacugaugaugggggguuuuauuucagguaagcaguuuauaugacuuccaauaagauuuguaaaucaugggcuugaccuuugaccucuagacacuaauuuuauccuuugaggcuggcuuaauuagggaugcugucauuaaggagagggagaaauguagaguguuaccuccaacucauuugauuucccuuacuugggaaaaugcaguccaguguucucaccucugccuccaagguaggagaugucugugggugaggcucagcaacugagcaaauaugugccugugaguuugccaguagagcugugaagaaacagcugcagagaacauuugaccuuccuggcauucuugucugcaugugugugaguuauuuuagaggugugcuuucuugagcccucauaaggaaguacuggugcuagguuuugcaagauuuuguauacacuuugcuccuugcccuagggcucagaguggugguuucugacuacauuucuagagucagagcuugaucaccacaacucaauuauuucggcaucuuuucaccuaugcugugauuuguuuuuuuuuuuucuucucaaaaauucuguucauugguuccacucagcaucaagaagacagggacaaacaacucaagugucuuaacagcugcuggagugggauccuuguuaucucuuagccacugcaggaccugccugacagguuaugugugcaccucgagaugaagugucuuucuauuauuguagagauucuguagugaagaggucugacaccauguguggaggaggaggaacgaucagucaagagauguccuggucuuaaugccuguggcuugugcugggagugggucugacuuagugauaaaaggacucuauucacuaaguagccuguguuuuuaaauccagggcugcaggcagcaacgcaagucaggcugaacauucagucuccagagacagcuguguggagcaaaucagaguucaugcccaaguccccagguuggaauggcugugccaaaauccauucaaaggguuuucuuuuucauuacuaggucagaacauuuugagucaccuugggagauucaggauggggagagcaaauuugaacaaaagguuuuucuuauauccugagauugagggguaggggguguccaaccuguauagcccauggguugugucuagaauuaaguggagggcagcuaucuggaguuaacuugcaagcauauuggugcccuccaugaccaccucuggcuuaggacuuggcccuguuaugagcugacccccaccccccaccccccaccccccccccccgccaacuccuauacccaucuucccuaggugaaucugugaaugguccuuucuggcagcaaucccugccuucuuuuugggcccaugcccagacuucugguuuaaggaauggucccagagcuugggccagcuugcucagaaguuuugggagcauugagccugccuagaaagauacaguguuagcuccccuuacuucaaaguugcccuucucuguucugacuccugggacuucugguccugggcacacuuuuugcaggcaacaaaaugugccugggagugauggauuuuaaugugcuccagaguccuuucagaagguggucauuucccuuggccgggcgcgguggcucacaccuguaaucccagcacuuugggaggccaaggcaggcggaucaccugagguuaggaguucgagaccacccuggccaacaugcgaaaccccaucucuacgaaaaauagaaauauuagccgggcauggugucaggcaccuguaaucccagcuacuugggaggcugaggcaggagaauugcuugaacucgggaggcagagguugcagugagccaagaucaugccaucccacucuagcuugggcaauagagcaaggcuccgucucaagaaaagaaggucauuucccaagacuagcauagggaguauccauuuaaaauacauucaucuuccucccauuuccgugcuauuaaucacuuguuagagcaacaugacaugcccagcaucccacuucccgaaaaugucuacuccuucuacucugagcucuuguugccuagaccucagaaaacaccaauucaccacaguagaaccgggagcagggauagcucagcuucucugaauagcacacuuugcucaggucuuaacuugagggccucuccgguacuaacauccugcgauagcuugucccaugagcacagaagagccucaguagagucaaguccugcugcagcugccccaccccaaguuucuaucauuuccucuuuaaacaaaaaauauguuauccuacacauuagugucaauccaaugguugucucuuaucugucuaaauagcaaaaucaugaaaaucagcuguuuuauuugcauaggacaacuaaccugucuguguaacuuuguuuuuauuuuaacucuuacuagaaaaucuaaucuuaaaacauuugaauucuaaacauguaaaaugugacagccugcaauuuuguagacagugaaguaauggcugcuauuuauaaauggaacaucuaucaaaauaaguaacuguuuauaaaauucaguuuuuguaggguuuuccaaggaaaaaucaccuugguugaauguuucucacucauuaaacuuugcagaagugauucauauucaguacuguuuuuaaucacuuuuuaaaauauaaggaccgaaugcaaggaaaccaaaguuuauuaauaauuuuuauauaacuaaaauaaaauagauguggagggaucugugaucauauaaaaagggaggguuacugaaagaauuuuagcaauauauugauucaggaaaaggagcuguuuuauaaaugaucauucacuguuccuaugguucuauguaucuuucaaaccgauaccuuuacuauuuaaagagcguaaauagugaaaguaagauggucauacuuacugacuuuaucuauuuaaguuugauggagauaaacuauaucuuggcuaguggcuacugugucugugaauguaaccaguacuucuuuaagcucuauucaguaggguuccagccacugcuuuuuuguuguuucuagccacuguuuuuuuuuucuuguuuccuuauaaaacagguaauaaccaaucauuuuguguuuguauuuccauuccuuuuuauuucugccuuuguguagacugaugauuaaguaggcaaacuacuucuacuuucaaagagccccaagggcuuaaugaccccauuuguaacugagaaaugauucuuguuuuaguaaucauucuauaaaugauacugcuggauugauugccguggguugauagcuggaggaauuguuuuggacaauacuaacaugugaauuuaugucuuaguuuuauuugcagucuugcuaaguaaaaugagucuuuguaucuacuuuuuuauuaaagugaaauuuagcaauaguuaauauuaggugacauaaauaaaacaucccagacuagugaguuaaguacaagaucucucuaaaaauaaacagaugaaaaucuauccccauuaucgauacagaauuugugaacguggcauaauucuugguaggugcuauagagauuuaucauuuuaaacaguucacacaccacugcaauucugcuccaaaggacaaagauauuuucaagugaaccaaaauucauuuugauaucaguucaguggacgaacucccagucuuuacucuggaaagcugcccagcuuaggguugccagauaaaacauaagauaccuaguuaaauaugaauuucaacaauguacaauuuuuagucuaaguacuauguguccuaaacacugcaugagacauacucauaccaaaguauuuguugcuuauguguaauucauauuuaacuggguauccuguauuuuuacuuguuaaguccggcaacccuagcccaggcuuu

SEQ ID NO: 15571 - RNA, 731 nt, Homo sapiens
cucagccccuaggcuccauuuccagguucgcgggugaccuccccaagauggccgccgccugggggcgggccuccacgcugcacggguguugauugggugagacgacucaaugaugagcaaugauugguucacacggcgcaagcugggcggaaccggaagauggugugagccacgggcugccgggggccuggggcucggcgucgguccccgggggauguggagagcuggcagcaugucggccgagcugggagucgggugcgcauugcgggcggugaacgagcgcgugcagcaggcuguggcgcggcggccgcgggugaggaaggaggcugcguggggacggugggcggccgccuugagaagagggacaccugcgugggaaugggucgucacggugacgcagaggggucucccagagaggcgggacuggucggccgccuagggccaccgaaaggcuagcgaaggguuuccccagccuccuuaccuugagucuguuagguuuucuggagauuggcuucguuggagcagaggguaccgcuaccucgggaaaaugacuuagugccuaggugucguggccacuugcgcaccgcgucguuucggggucgauagccuuggcggaugcgaggggggccaggccugugcccacggaugguaaggggagacggggguacaagagcaccccgcggaggccagagacgcccgagaucgcguguguggcagcgucucaccugcua

SEQ ID NO: 15572 - RNA, 17701 nt, Homo sapiens
cucagccccuaggcuccauuuccagguucgcgggugaccuccccaagauggccgccgccugggggcgggccuccacgcugcacggguguugauugggugagacgacucaaugaugagcaaugauugguucacacggcgcaagcugggcggaaccggaagauggugugagccacgggcugccgggggccuggggcucggcgucgguccccgggggauguggagagcuggcagcaugucggccgagcugggagucgggugcgcauugcgggcggugaacgagcgcgugcagcaggcuguggcgcggcggccgcgggugaggaaggaggcugcguggggacggugggcggccgccuugagaagagggacaccugcgugggaaugggucgucacggugacgcagaggggucucccagagaggcgggacuggucggccgccuagggccaccgaaaggcuagcgaaggguuuccccagccuccuuaccuugagucuguuagguuuucuggagauuggcuucguuggagcagaggguaccgcuaccucgggaaaaugacuuagugccuaggugucguggccacuugcgcaccgcgucguuucggggucgauagccuuggcggaugcgaggggggccaggccugugcccacggaugguaaggggagacggggguacaagagcaccccgcggaggccagagacgcccgagaucgcguguguggcagcgucucaccugcuaagugcccaagaaaugccagugccgcccggaggccgaggugaggguggacuggccggacuucgcuggcaucagagcggcacuuguuuauggggcaggagggagaaguccaaucccaagccgguuaaggggagcuuucgucuuuuguguauauauauauuacauccucuuggacuuugauuagaccaagaaucaaaaucugcccaccucagugcaaguuuaagcugaaugguguggaaugagacggaccuuaacagagaggucacagguuucucugaucgagcauuuaugcuggcugaagacaagaccuguauuauagucuuucuuugacuauuccuuagacguuaccuugaacaagucagguaacuauuccggcccucagcucugaaagcucugagaucucuucugauguuaauauucugugauucucggugauucuccaagaaaaaucuagggcuuccccuaauaaacaucaccuuggagguucucucagggaaacucucaggcagaugggcugccuguucggguaacucucuggaaagcgucaaucaucagcauacucccaguagucacgacuuggacucaaacgaggcugguuacgcaucgcuguggaaggaaggaagaggagacauuuuucuaauugaucugacuccgucacguccuugagaacacugugauucugugaaaacuucaggggaugauggauacaagaagacuaaaucgugcaaggauaaacgaaucucuucucuuacuguuucuauguggauuggguggcagcagaacgcauagaacccccgcucuuuguauaguggucgugagaggaugucacauaggucugauccugaauccagaauuuuuugugucgcagccuuaguucugccacugguucuuuucuuucuuuuuuuuuuuuuuuuuguuguguuguuuuguuuuguuuuguuuuguuugagacagagucucguucugucgcccaggcuggagugcaguggcacgaucuuggcucaccgcaaccuccaccucccggguucacgcaauucuccugccucagccuccugaguagcugggauuacaggcacacaccaccacaccuggcuaauuuuuuguguauuuuuaguagagacaggguuucauuauguuggccagacuguuguuuuuuguuuuauuuugagacggagucucacucugucacccaggcuggagugcaauggcacagccucagcucacugcaaccuccaccucccggauucaagcaauucuccugccuuagcuucccaaguagcucggauuacagaugcccaccaccacaccuggcuaaguuuuaguauuuuaauagagaugggguuucaccuuuuggccaggcuggucucgaacucguaacuucaggugauccacccaccucggccucccacagugcagggauuacaggcguguggcucaccuggccaugccacugguucuuaauucacagauugaacaaucaauuacuuaguuaccuaagugggccacuuuuagaguaaauggggcaguguuauuaugguguaaugauacaccaggacuagaaugagucgccaaacugcuaacguuuggguuucagaagccagaagugaccucucuuuuacuuagagugcagccuucuauuaaugaagugauucuuaagccuccaacauuaguaugucuuagagucaucuggagagauuguuaaaaaggaaauucuccgcugggcacaguggcucaugccuguaaucccagcacuuugggaggccgaagugggcagaucaccugaggucgggaguucaaggccagccugaccaacauggggaaacccugucucuacuaaaaauacagaauuagucaggcauggugaugcaugccuguaaucccagcuacucaggaggcugaggcaggagaauugcuugaucacuugaacccaggaggcagagguugcggugagccgagauggcaccauugcacuccagccugggcaacaagagugaaacucugucucaaaaaaaaaggaaauucucacccaggugaugccgaugcaguuggucaaagaccacacuuacaggaaauacugcuuuaacuugcccggcucuccugagagagacauuucuucugcugaauauugacaucgcuaacauugaugcauagauugagaugccaugcgccuaaaaaacauuugaucaugaucaccacuauuugauauugaucugccuacaguguugaaaaaauggaucuuaccuaaugccaaguugagaucaaugccugucuauccuacaggaucuauccuaugggauucauugggguacuguucccaaacauucacucauauggcucuuucccucuuggcaggaucucccagccauccagccccggcuaguggcggucagcaaaaccaaaccugcagacauggugaucgaggccuauggacaugggcagcgcacuuuuggcgagaacuacguaagagcccuuuccugaagcccuuuggaagcaucaugauugccaggcuucugacuuguucuguuuugaccuuuuagguucaggaacugcuagaaaaagcaucaaaucccaaaguaaguagauagcugaauucuuuaauuuguaucuaaaucuuggcucuuuaguugaaaauuagacccauccuggugguugaguuguacagcaguuuuagggugguugacuuuagauugggccagggauagaaaugucagcuuccuccuugagccccaaguaauucucagcuagauuuuucucuuuguucagacugucguuuucucauugguggcuguuuggaaauggugguuucaggagcuugcuguaaucuuggaucuuuucaagauuugaaagcuuaaaucaguucauccuagaugggcaauaucugaaagauggagggaauugaugggaacaaggaaggaaaacagaacagaagccuuagauuuuucucuauccuuuuaccucauuaggaggccgggugaagauugugauaguuuauuacauuuaaggaacagagaguggaugugaaaggugacagggagugcacgaggcguuugagccagcaaggccucuauaaaaucugaauuacacaugguuaccuuuuuccccucagauucugucuuuguguccugagaucaaauggcacuucauuggccaccuacagaaacaaaaugucaacaaauugauggguaagauaaaauuaaauaugaaaacaaaauuguucugucauuguauugcuucuacuacccuuuguggaagagagagcaacuuuuagaauagccccaauucaccauuuguuuuuggaauuucuuuaggaaagucugaguucuuaauaaaaagagaaaacaucaugccaagaacagaaugaauucaccauuuucuggguuauauauacuuggaaaccuacccaaccucauguuuauuauuauuugguggucuuucagaaaaauuauaaagaauuguagcccauaaauuuuuuuaacuagcaaaagagacauuucuguucuuuuuccuuuaaauaaaaggcuacaguaaauaaaauacaauacaguaaaguaaguauaguaaaguaaaauuaagaauuauaguaaaguaggccaggcgcgguggcugacaccuauaaucccagcaccaugggaggccgaggcaggcggaucaccugaggucaggaguucaagaccagccuggccaacauggugaaaccccaacucuauuaaaaaugcaaaaaaauagcugagcgugguggugcaugccugucaagucccagcuacacaggaggcugacgcaggagaaucgcaugaacccgggaggcagagguugcagugauccaagaucacgccacugcacuccagacuagguaacagagcaagacuucaucccaaaaaaaaaaaaaaaaaaaaaaacaagaaucauaguaaaauaaaauuaagaaagacauggagaucuugaguaacugaacuuauuucccuuaagguauaaaaauuuaaauaaccuguauauauuuuguaacagcuuuauuagggagguaagugacuuacaauacauugcacauauuuaaaguauagaauucgacgaguuuugauguauguuugcaccugugaaaccaucacaacaaacagugagcauaucuaucaccccuaaaaguuuccuccugucccuugguaaucccucucuuaccugucccacuucucuuccucaagaaccacuuaccugcuuuugucacuguuaauguacgugaguuuacauuuuuuagaguuuuauccaaagggaaucaugaaguauguacucuuuuuugucugacuucuuucauucaguguagugauucaucauguucauaccuguaucaaagguucaauucuuuuuaucauucaguaguauuccauuguauaaguauauuacaauuuguuuauccauucaccuguugaugaauguuggguugcuucugauuuuugacuguugcaaauaaguugcuaugaauauuuguguacgagccuuuguauggauauauuucccuuuuucuuggaauaaauauauaggaauagaauggcugaaucacaaguuaaguguuauguuuaacuuuuuauaacugcaauaaaacaaacauaaaauuuacugucuugaucuuuuauuuacuuuuuuuuuuuuuuuuuuuuuuuugagauggagucucgcucugucgcccaagcuggagugcaguggcgugaucccggcucacugcaaccuccaccgcccgaguucaagcgauucuccugccucagccuuccgaguagcuaggauuacaggcacaugccaccacaccuggcuaauuuuuuacguuuuuaguagagacaagguuucaucauauuggccaggcuggucucgaacuccugaccuugugauccacccgccucagccuccgaaagugcuaggauugcaggcaugagccaccaugcccggccuauugauuuucaaauguuaaaccaacccugcacuccuaggauaaauccuacuugaaggcugggucucuauuaaucuuauuauaugucauauaaacaaaauaacuguguuaugggauuuauaacuauguaaaagcaaaaugcaugacaacaauaacagaaggggauaaacagaaguacacuauuguaaaguucuuaaacugugugaaguaguguaacacaccuugaagguggacuguuguaaguuaaaccccaaagcaaccaauaaaauaacacaauaaagaguuauagcuuauaagucaacaaaggagauauauuggacucaaaaaaugugaaaugguaucuccuuacaguuuugauuuucuuuuuuuuuuuuuuuuuuuuuuuuugagacggauucucacucuguugcccgggcuggagugcaguggugcgaucucagcuuucugcaaccuccgcuucccagguucaagcaauucuucugccucagccucccgaguagcugggacuacaggcgcccaccaccacgcccagcuaauguuuuuguauuuuuaguagagaugcgguuucaccaucuuggcuaggcuggucucaaacuccagaccucaugauccgccugccuuggccucccaaagugcugggauuacaggcgugagccaccacgcccggcgguuuugauuuucauuaauaacgaaugauguugagcaucucuucaugggcuuauuggccauuuuuaugucuucuuuggaaaaaugucuagucaguccucugcauguuuuuuaaauugaguugucuuuucauuauugaguuguaaauuccagcuagauuaaauaaucuaacuugaaaauaaaagcuauaaaaguauuagaauaaaaugcaggaaaauauuuuuauuuucuugggcuuuucuaagcaagacauaaaaucuggaaaccauaaaaaaaacaacuaggccaggcacaguggcucacaccuguaaaucuagcacuuugggaggccaaggcagguggaucacuugagcccaagaguuuaagaccagccuggguaacauggcaaaacccugucuccacuaaaaauacaaaaaauuagcugggcguaguggugugugucuguggucccagcuaccugggaggcugagguaggacgaucaccugaguccaaaagguuaagccugcagugagcugugauugugccacugcacuccagccuggaugacagaggagacccuaucuaauaauaauaauaauauuaauaauaauaaauuuuaaaagaacaacuagcagauuugaucacacaaaaauuaaagcuuucugcaugucaaagcaaaagggaggcacagaguggaagaaaaauaauauuuuugaagagggaagagauucauauccagaauacauaaagagcuacaaaucuuuuuguuuauagggaaaaaaaauaggcaaaaacuggggcaauuuauaagggguaaaaauacaaaaggccaguaaucaaaugaaaaauauucauccucagagaaauacaaaaucacuaaucagauuuguaaaaaaucaaaaagacugcuaagauccaguguuuugagggagugaguaaaugaguacuccuucgucuuaccaggagauucuaaaaccguagagucuuggaaaaacauaaagauuccaccaaaaaacuauuauaacugaaaaacaacuucaguaacauugcaggauacaaaauaaauauacaaaaaucaguagcauuucuauaugccaacagugaaugaucuggaaaagaaaucaggaaaguaaucccauuuacaauagcuacaaaugaaauaccuaagaauaaacuucaccaaagaagugaaagauuucugcaaugaaaacuguaaaacacugaugcaagaauuugaagaggacaugaaaaaauggaaagauauuccaugcucaugaauuggaaaaaucaguauugucaaaauguccuuauugcccaaagcaaucuacagauccagugcagucccuaucagaauacuagugacauucuucacagaaauagaaaaacacaguccugaaauuuauauggaaccacaaaagacccauaauagccaaagccauccugagcaaaaaacaaagcuggaggaaucacauuaccugacuucaaauuauacuguagagcuauaguaaccaaaacuagcauaaaaacagacacauagaccaauggaacagaauagagaacucagaaauaaauuuguacaucuacagagaauuuauuuuuaacagaggugccaagaacauacauugggaaaaggacaaucucuucaauaagugcugcugggaaaacuagauauccauaugcagaagaauaaaacuagacuccuaucucucaccauguacaaaaaucaaaucaaaauagauuaaagacuuaaaucuaaauccaagaccugaaacuacuaaaagaaaacauuggggaaacucuccaagacauuagucuggacaaauuuuguuuguuuguuuguuuguuuugagacagggucucacucugcacccagacuggaaugcaguggcaugaucucggcucacugcaaccuccaucuccuggguucaagcgauucuccugccucagccucccaaguagcugggauuacaggcacgccccaccaugcuggcuaauuuuuguauuuuugguaaagacgggguuucaccauguuggccaggcuggucuccaauuccugaccucaggugauccgcccaccucagccucccaaggugcugggaucgcaggugugagccacugcaccuagccauguuagaaauauguaaaggugaugggaggagggagcggggaaggagccagcaggcauagaaggggcaggaaaaccuaacagaacuguuguuuuagugccauuuucccuucuggaugauccguuauacucauucaaccucacagcucaauucauuuccauaaaggcuucuugaggccagaugcagugacucacaccaguaaucccaacacuuugggaggccaaggugggaggaucacuugaagccaaauacauauauguauauuucuuucuuuuuuagucuuucuagucuugcucugucacccaggcuggagugcaguggcgugaucccggcucacugcaaccucugccucccagauugaaggaauucuccuaccucagccucccgaguagcugggauuacaggcaugugccaccaggccuggcuaauuuuuuuuguauuuuuaauagagacaggguuucaccauguuggccaaauggaucucaaacuccuggccucaagugauucgaccaccucggccuccccaagugcugggauuacaggcgugagccacaaugccuagccaucucuggcuaauuuuuuuauuuuuugguagagacaggguuucacuguguuggacaggcuggucuugaacuccuggccucaagugaucugcccuccucagccucccaaaguguggggauuacaggugugagccacugcaccugaccuugacaaagauugcuugaguaaauacuccaaaagcacaggcaaccaaagcaaaaauggacaaaugggaucacaucaaguuaaaaagcucuugcaggcugggcacaguggcucacgccuguaaucccagcacuuugggaggccaaggccagcagaucacgagguaaggaguucaagaacagccuggccaacauggcaaaaccccaucucuaccaacaauacaaaaauuagugagguguaguggugggugccuguaaucucagcuacuugggaggcugaggcagaagaauagcuugaacccaggaggcagagguugcagugagccaagauugugccacugcacucuagccugggcgacagagcgagacucugucuccaaaagaaaacaagcucuugcagagcaaaggaaacaacaaagugaagagacaacucagaaugggagaaaauauuugcaaacugcccaucugaaauacuuguacauagcaccaaguucuauauccaagcuuuguuuuuguaauaaaaaauaagaaacaaucuaauauccauuaacgaggaauaguuauguaaacugugauaaucuguccuguggauugcugcaguuuuuuaguagagaugggguuucaccauguuggccaggcuggugucaaacuccugaccucaggugauccacccaccugguauuacacgugugagccaccacaccuggccaguguuagggucauggugauguccuuguuggauaagaauacccucaucccagaaaguugaagaauuguggugauaugcuagggaagcaucuuggcuuccacuggucauccuuucuucauugucauccugaccuguuucucucaguuugaacugagacauagaucaagccuuuuacuaggaaucuguccguuaccagcuucuugaagcuuauggauguauaugcugccugaucauguaugucagcuuuucccuuauuuaccuuugcugauuagccagggauggucugacauuugaauuuguaucuaguaaaacugucacauuugucuucucagaggaacugagauuuaacuguguuuuucuuuuccuggcauauuuuuuccucuaacaagucagagauuuguugcauguuacuugcugcaauagagcaaauaaggaauacuacuuugccucugucucauuacagcuguccccaaucucuucaugcuggaaacaguggauucugugaaguuggcagacaaagugaacaguuccuggcagagaaaagguucuccugaaagguuaaagguuaugguccagauuaacaccagcggagaagagaguaaguaaccagaccugaauuguagauuuuucuuccuuuaggaugguugaagcuuagggagaaugggugggcccaagugucugauggauaagguuauagaaacaaaucacaggaucacaggccucuaaguuggcuguuuuaugugugaucuagguagcauaauggcaugcaaagcagucuauguaucauucuuuacuacaucaugguucauuauaucuuaauuuuaggggaagaagaauggauggggaguucaagaaggggauugugacuucguuuuguauuuuuguuuuuuuuuugagauggagucuugcuaugucgcccaggcuggagugcaauggugcgaucucggcucacugcaaccuccgccucccggguugaagcaauucucccaccucagccucccaaguagcugggacuacaggcgugcaccaccacgccuggcuaauuuuuguauuuguaauagcgaugggguuucaccauauuggccagacugcucucgagcucaugaccucucaagugauccacccaucucggccucccaaagugcugggauuacaggcgugagccaccacacucagccuuuuuuuuuuuuuuuuuugagacagagccucacucugucgccaggcuggagugcaguggcacgaucucagcucacugcaaccuccgccuccuggguugaagcgauucuccugccucagccucccgaguagcugggauuacaggcacgcgcuaccacgcccagcuaauauuuguauuuuuaguagagacggaguuucgccauauuggucaggcuggucuugaacucuugaccucaggugauccacccaccucagccucccaaagugcugagauuaaagacaugagccacugcacccggccugggauugugucuuucaucuggaaacccccaaaggucaccaucacuccuacaaggaguauuuuaaauuuuuaagaccuaagauuauauaaauacucuuagaucuuaaaaaaauuacuugauguugcauugggagagaauggaagauaauuacugugagugggccaggugcgguggcuuacaccuguaaucccagcacuugggaaggcugaggcagguggaucaccugaggucagaaauucgauaccagccuagccaacaugaugaaacuucaucucuaccauacauacaaaaauuagccaggcaugauggugugcacccauagccccagcugcucgggaugcugaggcaggaggaucccucgaacccaggaggugaauauugcagugauccgagaucgcgccacugcacuccagccugggcgacagaguuagacuccaucucaaaaaaaaauaaauaaauaaaaaauuauggugagcaccagucaaugaauaucuuuauggggcuuggauuaacaguguaacauagugugaauagaagcaugggcuuugaaaucagacagaccuuggguuucagcuacacuacuuuccaguauuguaaccuuggauaaguuaccuaaucucucuguacuucaguuuccuuuuuuggcaaugguaucaugagaaugcuuacuucagagggugugguuaggacugaauaugauaauccaggcaacauuguuagcacagaacccuacacauguuguuagcuauucguuaagaauaaauguauacagaucaggcauuugauugcaaccaucaaagcaccaguauucaccaaaucuuaguaugcaggaacacaguagaggcaucuguuuucuagauaacguccuagagucagacuaccuggguuuaaaucccaauuaucaauagaaaucugaaaucaacuauaggucaagucuuuauuguaucauuucuugauaauuagcuauaauaugcccuauuuaaagacugaaguaaauguuacuaguaucuccgccuaauaaaugggggcaagacaauaucaauagcucuuauaacuguauaacaaauaauugcuugcugcagauuucucuuccaguuguuaauuagaaaguucaguuaaacuuugcuaauauauagccaaaaauauuuaacauguacuuuauacuaaauuuuuugcaacuccauuaaauuaauaaaacuauaaaaauucuugauuuagaaaaguaauucucagguucaucuggcauuuuggcaaugcaaaucuuccugguaucccaaaaaagcaagauuuuuucuuuuccaugucuccuagcuguuuucagcugaaauccugagauggaggaaagagaauccaacugauaguucuuuucuugagaaauuuagaaccugaccagaagcagagcaacauagaaaaccccaaguauaaaguuacucuuuaggacuugaggcucuuucaagagguucucuuguugggggucaccucuucugucguaaggaagggaggaaaauggagccuuccucuggccauuuacccuugcaguauaccuguuuucuguuucuuuucuugaagguaaacauggccuuccaccuucagagaccauagccaucguggagcacauaaacgccaaguguccuaaccuggaguuuguggggcugaugaccauaggaagcuuugggcaugaucuuagucaaggaccaaauccagacuuccagguacuggggggucggggagauugcucgugugcuaaagaagcagggugcuggagugcuauugcagggcuggcugcaguggggauugcagagucaucccagacacugccuguugaguguucuagcccucuuuugaacucuucucagaaggaaaagggaagaacagguuuccaaagccccacaaaccuuuuucaacucaacuugaacuuggcuaaaacauagucuuuagagaauaugagauuucuuccucuccagugacuaauaguuuucucgaaagugggauaguuugcaaaaaacccuuucaguaacgucuggcaauuuuggcaggccuugaaaucauaaggaauacauaaccguugucagagaaguucagauucagacacuuuugggcaucguuagagaaggcaggaguaaaauaggugucaucucuuucugucagcuguuauugucccuccgggaggagcuguguaaaaagcugaacaucccugcugaccagguugagcugagcaugggcauguccgcggauuuccagcaugcggugaguguccugccagugcccugucugccucgagggguggggguagggggucugagaggcugacacaagagcagaucuuugcuguagaagccuuggaaaugccuugggauggcaguaagguacccagugucagcuauuccagcaucucccauuccccaugcccuuucuuuuuugaaaagagccaggugcgguggcgcacgccuguaaucccagcacuuugggaggccgagccgggcagaucacgaggucaggaguucgagaccagccugaccaacauggugaaaccccgucucuccuaaaaauacaaaaauuagcugggcgugguggcgcacgccuguaaucccagcuacucaggaggcugaggcaggagaaucgcuugaacccaggaggcggagauugcagugagccgaggucgcgccacugcacuccagccuggcuggcaacagagcgagacuccaucucaaaaaaaaaaaaaaaaaaaaaaaaacaaaagaaagaaaagaaauguauagaaauuauagccugacaucugaacuuuuaaaacaaaauauaauuccguaaguguaaucuaaaggaaauaagaaauuaauuauaauuauaauuucauaaauuauaaacauaauuccauaaguguagucuaaaggaaaauaagaaauuaagcuauaauuuuuggaaaggcauuucauuacguaagugcgugggcauggcuguaucacagcaaaucacgaugaagcagccuaaggcuucauguuuguuuguuuuuuuuuggagacugagucucgcucuauugcccaggccggagugcaguggcgcgaucucagcucacuguaaccuccaccucccagguucaagugauucuccugcuucagccucccaaguagcugggauuacaggcgccugccacaaugcccagcuaauuuuugaauuuuuaguuaagacaggguuucaccguauuggccaggcuggucucgaacuccugaccucagguaauccacccaccuaggccucccaaagugaugggauuacaggcaugagccacugcacccguccgaggcuuaaucuuauguguagauucaccaacaaucuuauauguacaucaacagcuguaaauaucaacugauacaggugugcuagauuggcaacgcaaauacaugauuuucugaaauagcaaauaacuugauaaaguuucaaaaaucaaaauauaaacuugcauuccuggaaaauuguauuucuuaaaacagugcaaaaauacauugcauugauaaguaaaauggaauuugaucagauaauuauaaggauauuuuuuucaucuaccugaccguggcacauuggagagguaggugggcugugcuguguggcugcgucucacacuggacgucuaauguccuugacccccuccgagcugagugccagccacacucuccaaccacuggaaauccagagaaacccaacuuguuuccuauauaugcccucagaggcaauuuuaccucugaggagaacaaucauccugaagccaucuucagcuguguuauuauucauagaaggcucuguuuuuguuuuuuuuuguuuuuuuugagauggaguuucgcucuuguugcccaggcuggagugcaauggcgcaaccucugcucaccgcaaccuccaccuccuggguucaagcaauucuccugcuucagccucccgaguagcugggauuacaggcaugugccacuaugcccggcuaauuuuguauuuuuaauagagacaggguuucuccauguuggucaggcuggucucaaaccccugaucucgugaucugcccaccucggccucccaaaaugcugggauuacaggcgugagccaccacgccccguccauagaaggcucuugagagccagaaugggggcacagcuucagcacuggcuccauuuuauuauuuuaaaccugguccucgauaccuucucuuuuuucccacagguugaaguaggaucuacaaauguccgaauaggaagcacgauuuuuggagagcgggauuacucaaagaaacccaccccggacaagugcgcagcagacgugaaggccccgcuggagguggcacaggagcacugagccagggaauacugagagcacuaacuaugcacuaaccuagauuuucauuucgauauucccugugucccagcgcaguccugcucuccugugaccuguggagagcacuaaugaucacguguguugauggaaaccaucugugcuuagucucugacauaggaagcuugcuucaggcaauggcuuuggauugaguuugagaaauucaaacauuucugcagaacagauaccaaaucaauagcuaggaaucauguucaauauugaauucugcccaggagcaugaacugauccaugaaugccuuuuccagguuaaaauuuggucacugaugccuauaaucguggaagucagagggauuccccuuuuucaucucauuuuaauaggaaaauuccuuaugguuaacaucucccuacaaacuccuacuacgucgucuaaauugcugcucuggaauaaggugauuucugcccccagauucuucccuagccgguagauacgugaagauauucccaacuguggaauggcaguguagguagcuucaggaaauggcucagguuaauucucaaaacacaaauuguugcuggccaggcauggugacucaugccuguaaucccagcaauuugggagacagaggcggaaggaucaccugagccuaggaguucaagaccagccucagcaacagcaggagccccaccccccgucucuacaaaaaaauuuaaaaauuaacugggcaugguggcugagguggaagaauggaagaaucacuugagcccaggaguuugaggcugcagugagcuaugauugcaccacuguacuccugccuuaaaaaaaaaaaaaaaaucccaauaguccaugaaggcuuugaucucuugggaaguucuucauagaugcugucacauuucuuaaagcaaccuuuuaauaugcagauaauaccccccaacuuuuuuagagacagccugucucuuaaaaaaaaaauuaauuugguagugagagcuugugucacugccacucuguuuuaucccugaaauuaaaggauaacauaaggaggacuugggccuuucugacaucauccugaagagacaggacuuugcguuuuuccucugggaccuacagugaugagaauuuaaugauuaucuccuccacuauaauccucuuuagggugauuuuuuaaaucaaaacccagugaaucucauuacuccuaagaaacgaaagauuccuucaaagccuuuucaggcacaugguuucaacaaagccuggcuuugacauuccuuguccugaggagcacuuuccaggcauaguuacagcuuccccacuguauuuacaagccagaauugugcaacucuucuggaucauuaauaaaguagcaagauccucaaaaaacccaaaaacaccauucucuaauagucaugacaaauggcuucaguauggcuuguuuuuuauuuuccagauggcuuuuucucuuauuuuuugaagccccagucuuugauuuuacagguaacuuucaaaacaucaugaugcugccaaauguacuuuuguaaacuuaaacauuaugauuccuguauuauuucagugagagcuacagugugauauuucagagucuauuaaauaaaaaugugaguuugaauuacaccaucugugccaauuacaaagcaauuaaaagauuuauuuuuuaugaucugguguagugacugaauauaacaggugggggcauuggaaccgacgggaagcagcuaugcuggugccuuggcauugugccagccuggcuuuggaggagggcuucccuggggucacagacgcagccaaagcuacaccaugggugagagggauucugaacuucuaagggcaagaaaaaggacauuucaagaauuacaaaaauaguuaccccucacugcaagagacuuuugaauugccucuagauggcgacauuggcuaaccugagggacaagcacuggcucuccacugucaguaguuuaccuuaugagggacuccugguuacucagucugguggaggccagagaggacaugacgcucucaagugauagugugacuugca

SEQ ID NO: 15573 - RNA, 1190 nt, Homo sapiens
uuugacuagcaucaccuuuuauuacacaaaauagauuucagccacguugcacauucauucucgcuauaaaucuggcuuuaaaaaaaucccuagggauucagucucaucgauuucaugauuuuccuuucauugaugucaugccuauauuguagucagaguccucucaaaggacaaaagcagauguggcugccuuggaucagcugcacgcagugcacucccggccugcccgcuggaggcgcggcucccaccaucaucuggaccgcgacugcuagggacugucaaagcggcagcaugcuaucgccuucuccagcccuucuccagcagcacaaccaguccucccagcugguccucugaggaccagccaucguggcgacgugguggcaauguccccaggcagccgaccauccugggcuucucuuugggcagaccugggccagggccuuaggggaucucuguguccgugguauaaaucugaaugagaucagauacaauauuaucaaugauugguaaggucgucaccaaacaccugccaccacggcuucucagccucgaccucagcgggcaccucaacuccgcagaccugcagggccagguagagcaccgccacggugaugugcugguccuggaagcggaggcacagacccccgugguagcugucccgcagcagggcccaggcagugacggcaacggggauccgcugccagcuguggcgguucagccacuucuugagggaaagcagguaguggagcagguacuuguguggaugcuggaaggagaccuggaagcgcagaacucucagcaugagaagcugacacugcacaaugcugucccggagcucccagaagcgggaguccaauuccaggggcucaccgcuuggguuaaaguaccuguuggacacauugaugaugucacgagucugcaggugcugcucuuccacuuugccggccaaguaaauggaagacauggcaaucagguaagggucacaggcguccaggcuggucucgcagaagaacuuaugguaaauggugcaagcaguggcaaugggaauggaccgcaucccuagcuugacacuugccugcaugaugaaccucgccacucggaagugcacccuggcuucgggcgccggcugccccuccgggccccgcgcugcgggccccgcuccgccgcccucccgggcuuccaugaggcuc

SEQ ID NO: 15574 - RNA, 1203 nt, Homo sapiens
ugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccaug

SEQ ID NO: 15575 - RNA, 4783 nt, Homo sapiens
uguaaugccacaauguuugguauaguguuuaauguauuuauuuaucaucauuucuuguugaaucccuaugauguaucaaguaccauuccaauguucuuuguaaaauuucauucaguuggaggggagagaaaauaaacaugauacaauuaaauacuuuuagaaggugaugagugcuauuaagaauauucuucugugauugagaugaaucacuuugaagaauuacagccuuuauaaccacuaccuuaaaauuuaauuugccccacugacuaagaacuuaauaaaaauucaugagaccaaugaaugugucauagguuuucugaaaugaugcuuugacaauguauuguucagagaaaauucaauaaacgauagucuuucacuggaucucugauucuaaaaucucuugccugcacagcaagugaacaagaauaucucggagugagcccaagcaucuuuguguuuuauuuuccuuuaaaucuaauguguagaauaaggaguagggaaacaaagggagagaacuagagaucagaaauauaauuugucaauggcuaucuaagguagacccugcauugacugaaaggugacuuuuagaaaaugucugcauuaucaagagaaaaaaaauuuaauuggguuucaaauauuccuugucuuuagaaauggaagauaaucuuuuuuuuuuuuuuuuaaaaaaaagaaaacuaugaguuaguuuaaaagacauuauuuggagaaacauagaguagcaugcauggaaacaggacugaacugaauaaacauucagcuguaggagguuuaggaauugauuuucacaauauugaauuuaugguucaauaauuuuccauugggauggaggucaugguuuuggagcaauuuccccgauacuaucacauuucucuuaugugaaaaugcauuauuuaccuaacauaggaaaaggcagacuuccugaaacuagauauuuuaaaauauuaaucauggaaccuugcaacaggguuggcaaacucaguucaguguucacugaaucuaaaaccuaagcugggaaccaucguagguuucugggcguucuuaagguauuccauuaaccaagguuccaugauuaauauuuuaaaauaucuaguuucaggaagucugccuuuuccuauguuacguuucugaggagaugacucuuuuagaaaggcugagcuuggcaggaauaaacaagcuccacuggugaugaaacuagaguugaggccaacugaguucuaauaacuuucaugugggccauugcucuugauauuuaccuggcacuuugcuuacuauuguucugcccaggccuuccaugcuugugaaguuaacauuugccuaaccccauuaaauuauggagaaaguauauggcuggcuuuuggauaguuaaguuuaguuuaucuaccuaaacuuagauaguucaguagcuucuugaggaagugaaugauuucagggaaaguuacauugggugucauuggaaauuuaugucuugccagaauuauaagcaaaaauauucaguaccaauuuuggaaggcuuuaggucauuuuuguauggcagaaacaauucagagaugucuugcaggcuuggaaguuuguacagguccauguuauuuuccccauggaaucauaauuccaggaaacugagcuccaauaucacucacuggcuaauaagccccauaauuggagaagagaaauagacaacuauagguaaggcaggacaguuggcuuuauuuagcauuucuuuccucacagcuucuuuuuaguugaucaacaacucauuucagaugaauugaaguaauguucaacuccuugcuguucuuuuaagcuggcuuuaucuuuaugcacacaauuucaauaaaaugacuacacuucuccugucaagauaugaaaagauauauaguaaaacacaugggcacauuuuuguaggaaagauagauacauucauauacauguaugugucuauguauguacguguguguguacgugcuuugaucugguuuugauuuuuuuccuucccucuguuggauagaauacugaagucagagcuucuguucuugccuaggguccauggcaucauuaaauaguauuguucucaaagcccagaagaacuaugccugguaagcagggaaaauaaaugaaguuuuguuugucauauguuaaaacagaccacaacaaugcucuaacaguaggacuugcugaagaaauuguacuguaaugaauauuuguaaaauauuuuaaugaagucaauuauaguuaaguucauuuaaggaaaagaacucaaaaaugauuaaagaaaagucuagguuuauuuaagugaaggucaagauuuggaucuugggcaaauacauacucuuuuaauuuguggaugaauccccuacguagugaauaaauaucacuuuuggugacagaauuaaggcugguuucucugauagcugucaggauaugccagagugcaugcaugucucagcggcuaucuguugaacauaguccuguaggcgcuguacauguauaugcauugaucugcuuugcagcagcuccaccuaucgguaacaagcggcagaggacggaccaaugcaaacuggcuucaaggcagauuucaaaaaguuuguuuguauuguucaucacugcuagaaaacagugggacaggugaucaucgucucuugaaccucacacugcaagcuccccagguccagcugaggaaguugucaucguguguuaguuuagcgcaggcucugggaauuaacuccauuauaugcaaaaggacaaugagaggauuuugcaggcuaaaugaacagaaaugcugccuggggauucccaguuucauguugcuaacaaauauuaacaaagauuuucacccuugggaaacccuaucaguagccuucucuuuuuucucucugucagguguuugcagggaaggaaguuuggaccuccuuaaagguacugagcuuucagcauucaaauaaagaguucuauucuguagcagucuuucuggcuuaggaauuucagagggcuugaugagcagguugcacacugacauuccacagcagaaaacuguccacccaccacgucuuaggcagggugauacaguuguauagaugguuucuuuaguggaugcuugacaaggcauuauggcaguguugacauuggaauggagcugcuuugcagaaaauucagaaaaacacauugacuaccaaucuuuccuuaacuuuucauuccaaauguaacuggagucucuugugauuuuuuuuuuuuuuuuuuuuuuuugguggcaggugagaaaagaaagagagauaauuaacaauauuuguguucuaauuuucuuauggauaguuuuaauucuaccugcuccuccuaauuaccugccuacuuccuccucccccagcccagcccaaacucaaagugaguggagaaggaaaggcuaugggucauuuugguauuccacgcagccuacagucaaaguugauggugagaagcagagagacuacuuuugcuucuccuuaacaugcucucccaccccaaguugcuacaggcuuacugacacuauuuaaccacgguucucaccaucauuuauuuauucauaguuaaacagccucaaggaucccauggaagccccucacuuacuuucaguucuucuucauugaaaucagauaugaaucuaaaaaccugagacaaauagacaggcaugaaggaagcaacuuucuuccuuccaguauguauaguaaacacaaacagcaaaauggguaaaauaauagcagacuacaccagggcacggaguagcaaaaauugugaguuaaaaaucagacuugacauuuaaacuccauuauuauuaaugcagcaugaaucuuuucuugucuuuuuuguuauuucucagaaccaauucuagaaccauguaugcuuaaucauucaaauccugagcaaaauaauaugaaucacaagaugauuucccuuaguaucgucccaccaaacaauuccuguucaaucaaaauacaucaaguguagcuugcuggacuuaagugccuugaucaccauugcaaaaguaaaaaacaaaaaacaaaaaacagcaaaggcugaacauauaacagagagcgaaauuagccaaacuaagcaaaagaaaugacaccccucccccaaauaacacuaacaugaauauuucaccguauguucuaaaguuuaaaacaaagcaaaaaugaauuauuauuugaauauuugaauaauacaugaagcagaccacuaauuucugaaggagauuuuguacucaaagaguuuaaacucuacugaggaaauaagauaucuguaauauugaaauuaaaugaaagaagaauguauaguaguaguaggugguaauacagaauauauaugagacagagauuaauuagcaaaugagugauacaccaugcuauaugaguuuauaagaaggaguggacgaugauugucuggaaaagcauagaaagauuauuuuggcuuugaaagauacaauagaaacaauuauaugguaaaaugaugacccuuuccuaauucuuaauugaacucuccagagguauuuuacuuugaucucuuacgcauuuucuaggguaagugguuuaugcaucuuaauucaagaacagccuaaaauauaucauaaaauaugaaaaaagguaaaaggcagcuuugaacuccaaccucuucaaagaguugaaauaaaugaacaacuguacaaaaaacagcaacaaaucuuugaugaguuggaauauacagagagaaaccaugagacucuguuuugaaagcacagauuauaccaugagccauu

SEQ ID NO: 15576 - RNA, 14706 nt, Homo sapiens
gcauauaauagcuguguacuucuauguauuuaauaaacuacugccucauuucuuaccccuuuuagaaaucuuuaguugaagauugaagguagcaugaaaagaaauucaugccauaagucacuggacaaucuacccagcaggaaaaaaaaauucauauccuaaaaauauguagagauaguaugaauuguuauuuuaccaguuuauucaaacuauuucaucuuagcucuuuaaucuugggcaguuuucaagcccuagauccaacugaauuugccuuggcuggaauucugcuguuucaugagccagcaggagauuugcaaguacauuaacacaguuuuuaaaguagcaccuucaauacaugagagcuauauaaauuuaaaaauaauaaaaaaccaacuaauaccuauucugcuuagugaccugucccuaagugucauccauucuuuccuccuuugaauaugauaccaaggaagaagaaucaagcaaaaggggaaaguaauuaaaaaaaaaaaaauaucaaagccuguuugguuucauguuucagggucuccuggccaaaauuccccaaagcugugaagacagaaaaguggugaacuauaucagaaaagugcagcagguuucugaaggcgcacccuacaauggaacuuaagacuuguauuacuuucccaagaggaaaggauuuucuucccaucccaauuuguaugaauggaguuauuuaagaaaaaaagauauuuuuacacgaaacuuuguaagugaaagcugcuuuuuccuuccuuccuuuccuuuuaccuccauaagaauagggaaaguagaacaagaaaaaauugaacuccuuccauuucuaaauaaaguuugggagaaaaaaggacaccaaguaauguagcauuuaaaauuuagaaauauuuacauccgucaucucaucccagauucaagaacucaucuguuaaguuucucgggcacaagcuguuacuucaacacauaugcuauaaaaacacucuuguucacaacuuagcuuucuucacucacuccagauuucuugccccacugacguggcauaaauaauaaaaacacaaauauuguguucaguacaacacaaaagagcaaaaacuggagguguguauguguuuaagauaaaaaaaaaaaaaaaacaguucugcauguucaguccuggguauaaaugcugaaagggaaaucacgugguuuuggcuuuggccacgggcucugucuccugcucguauucuauuuccacauaggcucguuuucucugcagugguccucucaagggcauuuugccuuuguguuucgcacuaagggccuuuucuuccuccuccucacuggaggauuuaccauccugaucuucaucacugcuggcauccaguuuauccauauccuauuacggggagagaaaagauaaaggaagagggaaaacacuagauuucuccaaacucccuuccuuguccccucaaucuagaacagacuagggcauugauuugucuaugucuguguucagaaauugucccuuucuuuaauuuuuuuuuuuuuuuuuuuuugagacggggucuugcucuguugcccaagcaggagugcaguggcauagucauggcucacugcagccucaaacugcuguagucaacaauccucccaccucagcuuccugaguagcugggacuacaggcaaccgccaccacauccagcugaauuuuaauuuuuuuuuuuuuuuuuuuuggagacggagucucgcucuguugcccaggcuggaguguaguggugcgcucucagcucacugcaaccuccaucuccuagguucaagcgauucuucugccucagccucccaaguagcagggauuacaggcaugcaccaccauaccuagcuaauuuuuguauuuuuaguagacacgggguuuugcuauguuggccaggcuggucucgaacuccugaccucaugugauccgcccaccucggccucccaaagugcuaggauuauaggcgugagccaccacgccuggucaugauuuuuaaaaaauuuuaggccaggcccugugacucaugccucuaaucuuagcacuuugggagacugaggcaggcggauuaccagaggucuggaguucuagaccagccuggccaacauggugaaaccccgugucuacuaaaaauacaaaaaauuagccggguggaguggcacaugccuguaauuccagcuacuugggaggcugaaggaggagaaucgcuugaacccgggaggcugaggcugcgaugagcccagauugcacuauggcacucuagccugagcuacagagcgaaacuucaucuaaaaaaaaaaauuuuuuuuuuuauuagagaugaggucucacuauguucuucaggcuggucucgaacuccugagcucaaacaauccucccauuuuggccucccaaagugcugcaauuauaggagugaaccacggugccuggccaccucccuguuuuuguuuuuuuuuuuuuuuugcugcaggccaaaggacaaucuuuuuacccauaaagcucaccucaaaaucacuuaugucacucucaucuaccucaccaucuucgacaaauucucuuuuccccacauccuauaaauaaaacauaacuguuagguucagaauacauaaugaagauucagauuagacaucuaaguaaguacaaaauaacauaaugagaaccacagucuuuucacuaggcaaugaaaauuuaguucuuucuaaauuuaaugcuucugaauuuuaaaaauuuuagggcuaccagaucauucuuauucuugauuuaaauuauuagcaauaaaacauccucauuaugguuaaaaacuacauauagacaggaaaggcuuuauaauuugucaccuugcaggaacaauuuuagaagaccaauaaauuaagacuaaaauuguuaaugguuuguugguuagccugaagaacagagcaaccagugcuaaaccaaaauuaaucacaugaaagaaaaaagaagacauaucauuuuugguuagcggacugaagaugauauucuguuucucaguuuuauacaaaugguaucuaguagguuuggcaaaacaaaaacaagacuuacuuccucaucaucaucaucaucaucuuuuuccucaguaucugaagagucacucucugccuccuguuguuccagggcuuugucgaaggcaugaauggggaaguuguagaugucgccauacugaagaacauaaacacagauuggcuuuaacuacauuuggauauuacacuugaaguuccacuuucuguggagaauauuacuuuuuccucagugauuaaaucagaauacuuaauuugaugaguaauauuuuuaaguguagagccagcagugucuuaaaaaagcauguucuuuugaacauuuaaaucaucugcaguuaguaucaaauagguaacuucuauggaguuacauuuuaaaauaauuuaaaauguaauagucuacaaaacccaugcauugggacaaaugucauuuugcugacaaggggaaauaauaaggaaaaagcauacuuuagucauguugucuguauaaacaacacuaauuuuuaaaaagagaauaaaaacuuauuucaaagagccuuaaaagacuaggguaauaugcaggagaagcaaaaccccauggcuuuuauacagaaaucuggaauuguugucuuggggaauggagcugagaauaauggcaaaaagggaaaggucucuuauagugaauggaguaucaaggguaaccaaagcauuuuaugugcuugcauuaauuaaagcaaggaagccaggccgauauggauuuauuuuauuccagggauaaaauucgaguggagaucuucauaucauguuaaaaaacauuucccagccaggcacaguggcucacgaggucaggaguucaagaccagccuggccaagauggugaaacccugucucuacuaaaaauacaaaaauuagcugggugcagugguggugccuguaaucccaacuacucaggaggcugaggcaggagaauugcuugaacuugggaggcagagguugcagugagccgagauugcaccacugcacucuaaccugggcaacaaagcaagacuccaucucaaaaaaaaaaaaaaaaaaaaaaaaaaaaaaaaaaaaaaaaaaaaaaaaauucccaauaugucuuagcaacauacuaccacuuaaaauuucaguaccccaaagcuaauggcuuucucaccguaucuuguuucagucucuccaguaauuccuucucaauggcauuguccagcugagcagcuauuaaugccuuuuccuauaagggggaaagagcaaaucuguuuaauucaucagugcucauuacucaucuuauaaaaauggaagaaacuaccaaguuguuuauaagaaagacaauguaauuauuuccccuccuugcuaauacuggcuuuugccuuuccaacgagauagauuucuucuucuuucucuuguaaacuuccuugggaacauuuccauuuugaaauuccuaugguuuuguaaacaacauucuaaauuaaauucuaacacaggcuuugauagauacaaagcauguaagucuauauacauuuaagugucucagaaauaaucuagcaacucuggagccagacuuuguaaaagcugagaaaagagaacagaaaucuucauucguuuacauuuucuaaaaucaugcuagauuccaugugacagaauagguaaaaaucucuuccuccagugaucucucauuggagaugacacaugacaucaaccuguacuaccacacaauagcccaggauggugcauuaauuugauagugaaagucauagaggguuuuaaaguguuauaucuguaaguuauguuagaaugauuacguaaaacuguguaggggcacauggaaaauuagccaggcauguuagcgggcgccuauagucccagcuacucgggaggcugaggcaggagaauggugugaacccaggaggcggaacuugcagugagccgagaucacgccacugcacuccagccugggcaacagagcaagacuccaucuuaaaaaaaaaaagggcuacagcgauguuccauguuguucucuagagugggguguuuacacuucaaggguauccgcugaaguguaggaagaaaauauucaaaacuuccacauaucucuuuuuccuuaaaaaauuuaacaucauuacuacuuuucuuguacacugacauuggugccuugacucugucuauaaaguaaauaguugugugucagauacagugagccagauaucucaagggaggaauacggcagauagggcuugcaagugguggucucacuuguuuauuuagacgacuauuuaacuguuuauguuugcuuaguuaagcggauucauagaugacacugaauauucugccaaagauagagaguaguuauaaaaguaugcugguuaucuaauggguuaguauuuuuaaaaguuguagaaccaggcuggcaagguggcucaugccuguaaucccagcacuuugagaggucgaggugggcagaucacccgacgucaggagaucaagaccagccugacaaacgucgugaaaccccgucucuacuaaaaacacaaaaaauuagccgggcagagugguguaugccuguaaucccaguuacucaggaggcugaggcacaagaauugcuugaacccaggagguggagguugcagugagccgagauggcgccacugcacuccagccugggcgacagagcaaaagcuguagaaccuaaagaugauccaugcacuuuucacaaaaagaaaaauauuccaaauuugccaaucuuuuuauguaacccaguagacauuuuuaaaaauaaauacgcuuaaucugugucuuccaaacaaaagcaacauuuuaauaguuugaggaagacaauuguuuuuugaaaaaaaaaaaacuuguucugugaagguugugaaaagaaaacugauuauaucuacauauggcacugcugaaaacaugucuccuauaaaaauugcaaucacacacuuuaaaaauguggaaacagaauauuguaaugcauuuaaaacucuuccaaaucuacauuuuucagaggguuacaaacucaauuggugaaaauagaaaaaauuaauuucuucugaaagguuuguaggaacaccuguuugacaacuggagaugaaaacucacuaacuggacuugaaaaaaagccgcuccauaacuaauggagcauaaugaaaaauuaaaguacuugagaccaccuaucaacaaugcacuucucuacaaucccucaguuauguaugacagcccuucaagacaaaaucauacucagcuaagaagcagacuuuuguuucacuacaucacaauuaguuauaauacacauuguauuauuaguggaaguguguauguauaauaacauuuauagccuguaaucccagcacuuugggaggcuaaggcgggugaaucaccucagguugggaguuugagaccagccuggccaauguggugaaaccccaucucuacuaaaaauacaaaaauuagccgggugugguggugcaugccuggaaucccagcuacuugggaggcugaggcacaagaauugcuugaauccaggagacagagguugcagugagccaaaacugcaccacugcauuccagccugagaaacagaaugaaccuuugucucaaaauaaaauauuuauaaauaacauuggggaauacauguucaaaaauuuuacugaggugagcacaacuuugcagaccaaugauacagauuuuagauacauaacugugauuaauggggacagaagcaucaaaagaaaagcuaucccuaucaaaauaccaaugacaaauauaaauauaaaaaaaagaaaaauaccaaugacauucuucacagaaauagaaaaaaaaauccuaaaauuguuaugaaaccacaaaagaucuaggauagcuaaagcuaucccaaacaaaacagcaaaacaaacaaaaaaaaacaacaaaaaaaacacaaaacaaaccuagaggaaucacauuaccuaacuucaaauuauacuauggaccuauagcaaccacaacacuauaguaauggcauaagaacagacacagagaccaauggaacagaauagagaacccagaaacaauuccacacacguacagugaacucauuuucgacaaacgugccacgaacauacacuagggaaaagacagucucuucaauaaauggugcuggaaaaacuugaucuccauaugcagaagaaugaaacuagaccccuaucuugugcuauauacaaaaaucaaaccaaaauggauuaaaaaacuaagaccuccaacuacaaaacuacaagaaaacacugagaaaacuccaggucauagaucugggcaaaauuucuuaauaucccacaagcaaagguaaccaaagcaaaaauggacaaaugggagcacaucaaguuaaaaagcuucugcacagcaaaggaaacaacaaagugaagagacaauccacugacugggcaaacuauccaccugacaagggauuaauaaccagaauacaggccagcgcgguggcucacgucuguaaucccagcacucugggaggcugaggcagguagaucaccugaggucaggaguucgagaccagccuggccaacauggcuaaaccccaucucuacuaaaaauacaaaacaaacagccaggcaugguggugcacaccuggcaucccagcuacuugggaggcugaggcacaagaaucgcuugaaccugggaggcagagguugcagugagcugggauugccccauagcacuccagccugggugacagaaugagacuccaucucaaaaacaaaacaaaacaaaauccagacuauauaaggagcucaaacaacucuauaggaaaaaauucuaauuauuggauuaaaaagugaauaaaagggccagacaugguggcucacaccuguaaucccagcacuuugggaggcugaagugguuggauugcuugagcccaggaguucaagaccagcaugggcaacauagugaagccucgucucuacaaaauauauaaaaauuagccaggcaugguggcaugcaccuguagucccagcuacuugggaggcugaggcaugagaaucacuugaauccaggaagcagagguugcagugagccaagaucgcaccacugcacuccagccuggacaauagagugagaccuugucucaaaaaaaaaaaaaaaaaaaaaaaagcagggggcagggauuggggaggcaaaagauuugaguagacauuuuucaaaagaagacauacaaauggcaaacaggcauaugaaaagguguucaacaucauugaucaucagagaaaugcaaaucaaaacaaugaaauaucucaccccaguuaaaauggcuuuuaucuuuuaaaagacaggcaauaacaaaugcuagagaggauguggagaaagggaacccuugugcacugguggugggaauguaaauuaguacaaccacuauggagaacaguuuggagcuuccucaaaaaacuaaaacuagagcuaccauaccaucuagcagucccacuucuggguacagacccaaaaggaaauuaguguaucaaagggauacccacacuccauguguguuacagcucuguucacgacagccaaaauuuggaagcaaccuaaguguccaucaauagaugaauggauaaagaaaauaugguacuuauacacaauagaguacuauccagccauuaaaaagaaugagauucugucauuuguaacaacauggauggaaccggaggucauuauguuaagugaaagaagccaggcacagaaaggcaaacacugcacauuuucacuuauuugugggaucaaaaaaucaaaacaauugaacucauggauauacagaguagaaggaugguuaccagaggcugggaaggguaauggggguggggaugauuaauggguacccccgcuaaaaaaaauaggaagaaugaaauaagaccuaguauuugcuagcagcacaacagcgugacuauagucaauuauuuaauuguacauuuuaaaauaacuguaaggauaauugaacuguuuguaacacaaaggauaaaugcuugaggggacggauacccaauuuuccaugauguuauuacucacugcaugccuguauuguauuucacugcagaaauuccauuugauuagaaugcucaaaaucuacuaaagguuuuauguaguauguaaaauaugcaacaucaaaauucugaagucugaaauauuugaccacaagaaauucagaaaaaggaguuguggauucuuucuguucuccauuacauauauccccaaagcacacauacuuuaaccugugcugaaaaucauaaucuuaaaauaugaaaaauuaaaugucuuaggcaacuaauaguuaucuauuagugaaccauuauccaaggccucaacaguuuacauaaugauggugacugaaucuauaagagacccccagaaagaaaauguagaagguaugaauaucucaacaauaaguuaccucucuucuuuucucccuacgcuccaccuucuuacucaaaggaacaaguuuccuccuaagggaaagaaaauauaucagaaaauccacugucaugugcuguguuccuuuuuaaggaugagaagaaaaaaggauuggaauuggugacuaaaauggaagucuacucaugugcagggcaggauggcugagcuucaggcauucacggaggcuagcgauucaaacaagccuuggagcccaagguuggugcuguagggcucagcucaauacagcaagauacacuaaacgcuucuagaaauuuaauacuauaaaaagucauauauuuuuacauguauuuuaauccggccauuuuuguucaggcauucugggauucucagggcauucaccaugcuaaaauuaagacuucagugaacuaagaaaaaagaauuuucugucgaagucugacaucaucuuuagcauucuauguagaucacagucaaaaagcauuagggccuaacaguccuagagaagguauucuguuaauucuggggauuucauaucacuuuuaaaaauuaguuuucagugaauccagaguaaaguucuuacauuccuguauagucacaugucuuagaucauuuucaaaucucuaaaguuaagauucccucgggggucauagaggaaauuuucugaaggcugggcaugguggcucaugccuguaaucccagcacuuugggaggcuaaggcggaucgcuugaggucaggaauucuagaccagccuggccaacauggugaaaccccaucucuacuaaaaauacaaaaaaaauuaaccaggcauggugguccaugccuguaauccuagcugcucaggaggcugaggugggaggauugcuucaaccggggagauggagguugcagugagcugaggucgcgccacugcaaauuccagccugggcgacagagugagacuccgucuuaacaaaaaagaaaauaaaauuuucugaaagauuuucagacaaggagggugauaaucaaguuguauucuacuguuuuaaaaguccugccauaucaaagggcacaccuuuagucaaagcuaaaguuucucuuuaguacaucauaacagacuccacaaaguugaauagaaagccccgaaguuucacaauuucucaacuucaaaacaagcuccauaaaaagagagauuuaaaaauaaugaaugauccaaauacuuacugucgcuuuaguguaaguuuucuaauucgaauuagguauugggugaucuuggugaaucucugcuuacauuugugucgaaugaaacggggccaguaaaucagauuuucaucuauuugcuccagugcuuucucauaguuuuuacuaagccggaccuaccaaacagaaacaggaaguuugaagggcaaguguaaaugauucauuagguuuucacugucagugacacccauggccuaaugaggauggccucaaaaguuaauggucauggaauugggcaucauggucaagcauguggcuuugaugcucuugaucagcggucacuguaguuuuguuguaaggcuuacccguucccagagacgccgaggaaaagccgcucguucuauaaccuucauauacaaguagcacuguccugaagauaaaguaaaauagcuuuaguguuauuuacagaaacuaaagaacaucccuguaaaagcuguggagcaguucuucuagaaguuaaaacuggggaguuaccuuucucuucuuuaauaguggcauacugacuauuugccaggggacaggaugaccgauuacacaguccagucaggcuauauucauuucggcagaagcucugagucuugguucuagaaugggagaaaagaaacaaagauuauaaaauggguugccaaagaggcaacugaaggaaucuuugaccaaguuguaaauugagacucaccuuauuuugaaggaacaaaauugcuuguuuccuaguguaucccagauaaccugcaagacaaaguaaaagcccauuucaaauccucugccccaagagauacuauauuaauucaagaaggcaaugcccaaggacaggaaugagaggaagaaauguuuuguaaaauagccugacuuguuuacuuuuuaaaauacaaacagcaaggccgggcacgguggcucacgccuguaaucccagcacuuugggaggcugaguugggcggaucaccugaggugaggaguuugagaccagccugauuaacauggagaaacccuguuuauauuaaaaauacaaaauuagcugggcaugguggcgcaugccuguaauccuagcuacucgggaggcuggggcaggagaaucgcuugaacccaggagagggagguugcggugagccgagauugugccauugcgcuccagccuggacaacaagagugaaacuccgucucaaaacaaaacaaaacaaaacaaaaaagcccagcagauucuuauagaaaagcuaaauacagaugagcaauaaucauaacuccauuacccagagauaaaauuucauuacuauucuguaaauauuuuuccagacuuuuuuugacauacucugugaaaucacauuuuauauacuucguaacuuucccuuuuuacuuauguucauuauccauuauuaaaggcucucaugggccggguguaguggcucacaccuguaaucccagcacuuugagugccaaggcaggcggaucacuugagguugggaguuugaggccagccuggccaacauggugaaaccccaucucuacuaauagaaaaauuagccaggugugguggcaggugccuguaaucccagcuacuugagaggcugaggcaggagaaucgcuugaacccaggaggcagaaguugcgguaagccgagaucacgccacugcacuccagccugggcgacagagugagaauccaucuccaaaaaaaaaaaaaaggcuucaugguauuagauuuuuagauauacauaccauaauuuuaucucauugagggcaaagaaaacuaucuacugcuauccuccuguacuuaaugugcucuuuauucauucagcauuauauacuuaauuuauguaaggcacugacaucuccaaguccugacacacaguagccacuuaaguauuugcugaaugaaagaaaguauacucuuuaaagaguuucgucuaucuaguuaggggaaagauauguaaacaaaguaucacaaaauagcaggucuaaaggccacauagcaugcguaagaguaugacagccuuugagugcgcugccuugaggaacugggguaaaaaaaagcuuuaccacuguuaaaggaaaaauaugaagagggcaaaagaauaaaacacacuuuaagaauuuuauaggugugucuggugggggaugguaggaaacagguaagaagaauaagggagcucuuuuaggcuuguggcuuuaaguaucaucucuaaauggaugacuccuaaauuguuauuuucuggucagacuucuuuccugagcaccagauuuuuauaugacaucucuucaauaucuaaaaggcaacauaaauauuaacauauccacaaggaguucucaauuccacaucccucguaagaacagucuucccuagaguucccccacuucaauaaauaaaaucaccauuuaacuauguauuuauaucccaaauccuuugauuucuuccuuuucuucuucacuuaauccaucaccaaagucuugucaauuauacugacguaaaaggucucaaauucaucaauuucuuuucaucuccaccauuaaauuacuaccuuaggcgaagccacuuucguuuuuaaaaaaauuuauuuacuuuagagauagggucucucugucacccaggcuggagugcaguggugccaucauagcucacugcagccucggacuuuucggcucaaguaguccuucugccucagccuucgaaguaacugggaccucaggcgaacaccaccgcgcccagcuaauuuuuuauuuuuuguagagauggagucucacuuuauugccuaggcuggaaucgaacuccuggccucaagcgauccuccagccccagccucccaaagcguugggauuacaggcaugagccacugugucuggcuugaagcaaccuuugucauacccuagucuccuugcuuucauuuuuucccuccaaaaguccuucacacagcaacuagacaacuuuucacaaacauagaucauuaaaaggccuaaaaaacacuuccuacaagauucugcaugaccucgcccuggcaagcauaucuaauuucauuaccugucuuacauugucacuuugaugacccuuauauucauucucucauaucuucaacucuuuguacuuuacuguuccuacugccuggauugcuuuuuccucagcuccucagugacuggcuuauucuuaucuuuuagaucucaacucaaacaucuucuguucagagaaaccuucccugaguaacccuaucugaaguguccuucaucaucucuggucuuucuuucauaguaugauuauauaguguaauuguuaacuuauuuguucacuuguuuacugugucucccccaucaguguuccaggagaggugggacauuuuuucugguuaaccaaauccucaauaauuaccacaaugccuggcacacuguaagcacacuguuauuucuccaacaaaaaacucaaugaaugaaucuaggauacuuccgaaauuaugacuuaggcagaaguagagcaaauguaaagaaaagccuacacaggaaacgcagauggaagaguaacgcgcacauggaugagaaggacgcuuaaacuuggagucagcuucgccaaaucccgggccgccccccaccccaaguccggagcugacagcugacagcugacagcaugacgcgacguccugcauugguaggcacgaaggacgggacacaucgaccccaugggcugaggugacggaguccugugcucacaacccggccggggcagcgggcaguaaaccccugcuagacacgcgugagaaccuauguuggaaaaucgggguuccggaagccucacauccagagcggcacgaggcaacagacccgcugcguacgcguuuucuaaguguccgaaaaugggcaaaauucccugcgcaaaccccggguguaagaacaaccggaggagacucacaucauccgacugcaugguguccgcggcucagcgugcaacuuccggucggaucgcgggcgcagacaugcuccuuccgggaaaccaguuccggaacgcgcagccucaccua

SEQ ID NO: 15577 - RNA, 38817 nt, Homo sapiens
uagucucuucgcaggugcggcugggcagcuagaguccugcaucccgguggaauccggagaagugagaacauucccgccgcccgguccucauucccaucuucccaccuguccaguccccucgcacucccgcugcaccccacgcgccgggcuucagucagagagugcacugaggaagagcggagacccccucuuccccucagcaggcugugccgggggaggcgggguccaccgcccgccccccgccgucgcucuccccgccuccccuucccuccccuccuggcgggugcggggccgguguccgaagucaggcggcggcccccgcagcggccgcaggaggggcggcugcggugggcgccgcgggcgaugccccugcccggcugcuccggcggggggcagugcgagcggcggcggcgggggaggaggcggggggcggcggcugcggcggcugcagcagaggggccgagagcuggcgguggcggcggcgguggucgugaagggcaucggcggcggcggugauggcagagaugaugugagugcccgccggcuggagaccuggggccgcggagcgcgggacgggcggcggcggcgugcgggagcggccccgggggcggcggagggaugcggggagcgcgggcagagccggagcggcggccgccaaccggccggcaguggcuggagccccgcgcugcggcgccgggggagccgggcccggcgugggggucgcgggcggcggcggggcggucaggccgaggggcgucugcgauuguucucaacaccccucccccaccccaucccgugugucuguuuguuacuugcagcugaagauggaaagagccaggcgaaggggaggcggcggcggccgcggccgcggaggcaagaauguagggggcucuggccuaagcaagaguagacucuauccccaggcccagcacucccacuacccccacuacgcggccucagccaccccuaaucaggccgggggcgcagccgaaauccaggagcuggccuccaaacgaguggacauccagaaaaagagguuuuaccuagacgugaagcaaagcucccggggccgcuuccuaaagauagccgaagucuggauagggagaggccggcaggacaacaucagaaagaguaaacugacccucucccugucuguggcagcggagcugaaggacugucuaggggacuucaucgagcacuaugcccaccugggccugaaaggccaccggcaagagcauggccacagcaaagagcaaggcuccagaaggaggcagaagcacucggcacccuccccaccagucucggugggguccgaagagcauccucacaguguccugaaaacagacuauaucgagagggacaauaggaaauauuaccuagaccuaaaggaaaaucagcggggucgcuuccuacggauuagacaaaccaugaugcgggggacuggcaugauagguuauuuuggccacaguuugggccaagaacagacuauuguccucccagcacaaggaaugauugaguuucgugaugccuugguucagcugauugaagacuauggcgaaggagacauagaagaacgaagagguggagacgaugacccgcuugaacucccagaggggacuucuuucagaguggacaauaaaagguucuacuuugaugugggcucuaauaaauauggaauuuuccugaagguaagugaggugagaccaccuuaccguaauacuauuacuguuccauucaaagcuuggacaagguuuggggagaauuuuaucaaguaugaagaagagaugaggaaaauuugcaacagccauaaagaaaagagaauggauggcagaaaggccaguggugaagaacaagaaugccucgacuagagugaaauugaacuccaucaggcaaaauuuaaaaucacaaauuggcuaaaaguacugauccauuauccuuugaagaaguuuuuccucuuuuuuggcccguuguuauuaguaauaccucuaguaguugauacuucaggaagucugauucucauguuauguuacacauagaucacuauaauucuuacgggaauuccaaccuucccagagcuaaauaguuuagcugcuucaacugcuccagacuauugaaguaugcaaaucagcacaaaaugugacauucugacauucuaaauaccauaacuaagauuuacauugcacuaugacauaaucccgaaaaaagauacauauacuuaaauagaagugugacuuucccccaaaaguauuucaauucuacuucauuaaaagcugcuaagcuuaccuguagggcaguuaccacagaaacagaaauugaccuccgguauauauaaauauuuacuuauaaaaguacaaguagacguauauuguccguugaauaacugaauauaccaucaaaggaucaaaucuuauuaccuaauuaaaccuuaaaaauauaaugucauaauauuucuuaagaauacuauaguauucuauaauuucaaacuuugugguaacccuacauuuuauaguugccauaucaaagccaugggagaguuuuaauucguuauucuaaguuuaguuacaaucccuucuuuaccucuacuuaauguuccauauauuuuuauugacuuuccaaaguuucaggaauuacuuuuaugucacauugagugggaggcuucauccaauggcuuugcuauggaaaucuuggugguguagcuuuucaugcuaauuuaaagauugcaagagguuucuuccccaaaauauaucauggacucaagguguuauacuuuaugcuucuucuuuaacacucuuucagaaggguugguguaccaauuaacugauauaaaaauauaccuguaauaauauauuuuaguagcacuuuugcaauugcuacccuuaaaaccaugucaacacuuccaauauaauccugaauuuuacagguguuuuaauucuggaggggguggggauuuuuuuuuucuaaaaauaauuuagaauacaaauuuccagucugagaaaaauauuauuugaagauugguuauaaauauauuugaaaggaaaauucaggcauuuuccaaggugcucuuucugacuuuacacaagacucacccauuuaccuguauuaaaaauuacuuuccaggaagugccacagcaauuuuucaacaccuaagcaauuuuuuaaacaaguggauauaguguuauauguguaccaacccauccuguauuaauugacugaaauuacaucuauucagcuauauuuucuucugaaugaaauuauugucuuuuaucuuggcuuuauucaccucccacacaauaaguccaucuaaucauauuuaagagccagaacacugauuucaacccccaaauaucacucucauugaugagagcuggcugcauggauucaaaucagaauguagcucuucuuuuauaugcuaaaaguaauuuaaaauuauaucagcgauuuuuuucuuccagaguuuugucccccaauaccuuuacgugaggucacuaagaaaacuugaugguaugaauuaaaaaaauuaauuucauugguuuauguuacuuaagaacaagcaaucaguaaccccgacauauauacuaguguugguuugcagauuguauuucacauuuccucuaguagcgugaaggaaucucauuaguucauuauaauuguggaccaucuggaucacuauggaacaacugaagguuaggagauaauguuaguacuagagcuaauagcacaugguggguguugagacucuaaaaguagcaaggauuuuuaaacaguccuaacuguaaaauaacuauguaggcuugcuaaaaaaguaguuuuuggucuaugaaggaaugaugugcacuugaauuacuguacuacugauuguuauugcugcccaucauagugccuauuaauaauaaucaaccugucagauuuuggcaaacuggagcugugaauauucuaguauuugauuguuccuaucgcuauugcuaugaguguauacacucucuuaaagucuuccuuucuaaaauauuuauauccauuaggucuaaaugauuuccuuuuaccuuuugggucugauaagauuuggguaugugucuauaucuauauauauacacacagacauauguauauacauguauacauauauauguguguauacauacauacaauaccaugucagacuuaaagauaaauaucuuuaacucauuguauauaaacauuauuaaauuuaguuuuccauuaauuauuuaaguaaagaauuaguuaagcagccagauuuucuacuuuguauguauacuucaaaguuuuuaccaucucaaagcugcagauuaaauagaugcauauauacuggcaauugaguauacucuaaaauuauuaagccuucugccaguccuuuuguuucauuuuuuucauaguuaaucauucaaaaaugagaugaugcuaugacuuuuugauacuuaaaauucccaagaauucauuagccguaauuaaauaugauccaguucaaaacucuggucuuaggacauguauugccauguaucuuauaaaauaagcuacuauucuuaucugugcaauaugcauuuuauuuauugucauuuguaacauacauggagcugcaaguguucaugguauccuucaaaauaacagaaucccugccuugaagacauuaaacucuuaaggcaacuggaaguuagaaguuaaaaaaugagcaugaaaguuaguaaccaaaaguacuaguucacuguauaauucuaaaacacugaugauguuugcaccuaauaauccaagcauaaugugguacaggcucaaacuguaguaauauaagcuaauaguaugaaauuuggaaacggguuccucuugauaguuggcagugugcuccuagcaaucgaaagcagcacuaaucuguugcuuuaugcaaaagaugcaauguauuauaaagauauuaaaguuccucuacauuuuauaauuuuccuuguuaaagccccagacugccaugucccugaaacuugagucaaacacaagcuuauuugcacuaaagagcauggccaaaaaaauaaaugacaggguggaaaagcuaguuggaaccucuugaaauaauugguucuaauaugagaauuucacauuugucuauuugaaagcuguaugguccaggcagacaaucugucaguucacuaauuuaauaaugcacuuuaccuuuuguauauagaagauguacauuuaugccacuugacaggugggauguguuucaauaacuauguagcuagaaucuauaaggugaucccgugcaugcauauguuuguguuggaacuguuguuguaacagguuuccauuaaaucaguguaauggagaaggguagaagaugcuuuugaaacaaaucccaguauauuuaacaaagaauuuuaaaguagaguucacauuugaugucuuaagaacuagaauaaauaaaauacuauuucuaacccaaauucuuauuacaguugagacuauauuuaguugagauuccccacagugcccugacaguuaauuuggggaauuugucuagacaaaauuuuuuucaaucauuguuucauuguugauauguguuuaaguaaugaauaaauaugcaguacauaauauuauacucaaauuaaaagugugguuagcugauguggcauuauuuaaagaacauucagacuaaagaaguaagguuucaaguuaaggaaaugcaaggaaccuaugaacagucacuaacacaaauaugauaucucagaauucacagaaguacuaaccuuccccaacuaaaaaggguauugggggauuuaguguauccuuccaucuuaaaagcuucuuaagauguacauuugaaaacuagauaacuguugcuuaauaauacuuuacugagaaacacuguguacuaacaauucaucaagagugugcuauauuuacugaguucauuuuauaucuauagauaagaauaaauuauauagucauccuaccuuaauauaaucauguauuuauauuguaauuuugcaaauauuuuccauaaaauaaacauuuaucugagcugcacaauuugaagaggaugaaacuggaauauacccucagaugcucauuuuaaauaagcagcuaccauugaaagcugauguauguauuaucauuccuuuaaauuuggguuuaugguauauuuuaauauuuaaaugaauaggacuuaauuugaauuuuaagugguuuucugaaaauaauuuuuucauaagugugagcuuuuuuuccuucuuaucuccaaauguuuuucauuggaacuauuuaugaaauccuauucaaagcuuuauguaagggguuugcuuagucaccacuuaguuugaagucugucuuuacuaaaacaccaaacaucuuugacaacauacaaagaggaguuaacauugauucuaugccuacagaauaauacagguguaauauuuaucacggccugaaaaggaucuuaaauccuucugaaauuuccuuaaauauuucuugaauuucaaagagaaaugguggcuaauggcuagcccaucagagaaaaagaauaaguauguuaacaugcuguugaaacaacucauaguccaccauacuguagcaaugaaguucagggaaaauguguuuuucccaacuuaauaucaugugaaaauuggguuuucagaucacaguaacucugucguaaagaaaauauacccaaauuuaguagguagagcuuagaaaaauaauauaaguauauauuuucauguauaauggaaaaaauccguacuuguuauuaauuugacaugcuauuuuaaaucauuuaaauuuauuuugguaaugagauuuuaaucaauauuuuugaauagggaaaaacauacauauaguacaaaauggaaacaguacagauggguagagggugaaaaguagcaaccaauguuagcaauuucuuguguauccuucuagaguuacucugcauauacaaguauauguguauguauauauauauauauauauauauauucuuuuuaaaacauacagaugaaaacauauuauauauacuaucuuguaccuaguagauucaauuucagaucugucauuuuaagugacuuuuuuuuaacuuagauaucauacuugagcuaguuaacauaucacuuaauuugaaauauauuaacuauaccaaggaaauaucaaggaaauuuugaaugaaucccauugguauuuacuuaaagugcaaauauauguguauuuuaaauauacaaauauucaguucauccuacuaguuuccuuucucucuuccuagccaucuugccuuccuguauuccccucacaaauauauuggucuuuuuccugaaguagugcacuucaggagugccaggauauuaaauaauuuaaccaaguguuaucuuaaaccguauucccuaaugaaaaacacccauauuuaaaagcuuuaauaaaguaucacguucagucaauuuuuacuaauucuguuacuauuaucuuuauccaaagaccuugcccuuauaagagcaaaugaguauuagaacuauaguaaaaagguauauuucuguugaaauacuuuauuagcaugaagccuuuaucuuuaugagaaagguauaauguucauuuagcaaccucaucaaauccaaguuuaagcaaauagguaacucuagacccgauuguuuaaagcauugauuuuucacugaaggaccaagagucugucaguagucuugggaccaaaggcagugggaugauuuggggaaugaguaaaaacuggagugcugugagguuacaaguacagcuaaacugucucucugguggaagaauauaaaauggucaauauaauuuuuuaaugaaguuagcauuauuacuaguccuauaaacauaaacaaagcugccuuaauaguuuugugagcacccguccccaaaaaucauaauucucuuuucauucccaucaagagugcauuuugauaugacuuuucuauugaccaccaagaaaaaauuaucugaaaaaugaaagaucccauacuugaguccugaaagaugcuaucuaauuaugaauuaaagcaaccagaguaaaagauccaauacaauuguaaauaucuuuaaaaauguggguugaggaagaagaauuuuuucauggauugguauccgugaauuuuaugaacaugucauaagguuuaaaaauuuaaagcauugcuuuaaacuuuagaauaauaacucuauauuugguagcauaauguccuguuuacaaaaugaaagagguguuguuaaaagauaagauccucuuaaacauauuuuaaaagcauaaaaguuugcucccuuuauuuucaugcugaauaauucauuauaaaauucauuaaaaauucaucuuuaggaaugaauuuugcuuaaauuuaggcuaaagcauauuaauaauuucccauccuuaauugaagagcuucccauguuggugcuuucugguaaauuauauuuuucaaacuuuauguucuuuugaauauuucuuaugaaaaauuacauauuuuuauugaggccagugacauccaccaguaaauaaaaacauaaugaauuagugcugcuauagugaaguuacuuugugauaugaauaugaagaaaaaaacucauuuaaauggaauauauacuuuccuguuuaauauuguuuacuuauuucugauuaaguagcaguucucugucuucacauuuuacccucuuaaacuuaauuuuugcaaaaaauuuuucuauucgguuuucauuuuccuagggaaagggaaaaauugucccugaugaaaaguguuuauaguauuuaaaagaguugcucaaaguguaagacuggggaaaaaaagcuuauguuguuuuuuuugucuuuaucaaaauaaugguauaaaucugauuaucuuacuugaucugauuaaagucaggauuacuuuuaucagaaacuuuuauauucaaaacauauuuaguauuuuauuuuucuuaaagaaaaugguucucuuggauaauacagaaaucuucaggauuuuguuguggauucaaugagguuguugccuagagguggcaaacagaaaagaaaaaauagaaaagagaaagacaguggcugauuauuuugcuugucuguaacgaaauucaucuaagagaaauaagucauucucaaaacucaaccucuguuuaaccuuuaaaagagcauuugagaaagaauaauaagacguaauucugccaaggugcggccugacccugaguaaaucauucaacuucuguuggaugauuuccucaugugaaagaugaacaguauugugcuggaagcuaagguucccuccuacucuaaauguuuaaaauucuguaucaguggacugugaaaggaaaaauagauggauaauaccagaguuggaaagugugagaguuuaucuguuuacauuaaaaacaacuauaaugaugcagcaaccugugaugauacccaacggaacaaugcaaaaaaaugucaguuuuauaauauguauguauuucuuuagccacacaaaauaaaauuuuguuucuaguccuuauuaagaccaaguuguuguauacuaacuacguaacuauccuaaacuuuaauuuuuuaaaaggaauauuuuuaaauauugauuauuucccaucuccuuauuauaucaaauaucucauuauuuggaaggagcauugcuuuuuucugcauauucuguaaucauuuuuuauauucugcauggcaaaggaauuuuacagauuaauaucacuuccugaaaugccauuuuuccuaaaauaaccauagaucacauugccaaauaauacugcagcugucaugguaguggucccuacugucuucgauuccuuuuuguugauccuguccaauauccuaugcuagaaauaaugaugucugacaaagaccaucagaaaggauacugaccugugaacuguaugguucuguuuuagaggacuuguaacuacuaggguaugcaaagauuaaacaucuaaugguuuggggguuuuuuuuagccuuaagaaacgucaaaggauggugauuggaaaagagaagaagcagcacacaaggguuuugucuuagaagcauuuauuuuauuuauuuauuuauuauuacuuuuuuuuuuuuuugagaugcagucucacucuaucgcccaggcuggaaugcagagaagcauguauuuaagcaccccaguccucagcuaugcagugccccgccacugccagugaagaggcuuaaaaaagagugacauguuucucccuagaccucucuuuuagugccuauuuguuuaucagagacuccauuuaaggguaacugaaguguauuuucaagugcauaugcauguguauuuugcuaauuucaaaaguuucugugcacauaaauuccauuacggaaacauuccauaugauaacuaaucuuugcccugguggugguucaaaauagcaauuugguuggucuguuuucaacaaauucuauagaaugaauuggcuguuguuagaaaauguuuucucucuuuucuccucccucuucucaaaauagcagauacauuuuaaauccuugauugcuucuuuuucagugguguuugaaaucuaagugggauuugagagaauaguuuaguuuggcaguucuuuacccuugccauuuuguagaaacuuuccucagcuucccaucagauauucuaagcaacuuuaccaaaagaagucaccuacgugccaaaacugccgagcaaaauaaaacaacagagccauagaaaaugauguaggaguaaggauaaagauauauacagacacccaaauucacaacauuccuuaucauuugcuaauuuacuucagagacuguuguauuuuauuucuugguucuucaaacuagcaaugugguuuauuccaaugauuugucagucuagaaugucaauagaacaaaaucuuuugcugcuuaguaaauguuccaaaaaggguaucucauguuauaaucaguuguaaaaauagaauucuaaaauuccauucauuauaauccucuuuccuucuucccuccuguacacuguacccuauuggaaguggguaagggcauuaauuucuuucacuaucacauggacccacuccauccuauuuauuuguucagaagacaauugaaacauaauagagaccagagcugcucuuugaaaaucuagaaauugcccugugagcuugaucuauagacuguaagaaagaaggguuacuacuucacugaacuguucuccacgcucuugccagauuucuauaugacaguuuaggaugaauagaaaacagauuugacuugggaugacaugaacugaaaggucaguuccuccagcuuuucaauacacagugcaucuucagaaaauauuuuugacgagcaugauugacagguaauuucagaaaugaauuuaggcugggugugguggcucaugccuguaaucccagcacuuugggaggccaaggcgggcggaucacuuaaguucaggaguucaagaccagccugaccaacaugguuaaacuccgucucuacuaaaaauaccaaaauuagccaggcaugguggcacgcuccuguaaucccagcuagucagaaggcugaggcaggagaaucgcuugaaccuaggaggcggagguugcagugagcugagauggcaccacugcacuccugccugggcaacggagugagacgccaucucaaaaaaaaaaaaaaaaagaaagaaaugaauuuggucccuagagaaguuucaccaugaccauuuuaaaagagcaggugguaagaaaaggaagagucaauuaagauuuauuaguaguaauaacuauugcuuauggaccacccacuguauacuagacauagcugggccccuuauagcuacuauuccuaauccuuauaacaacccuauuauccccauuuucauaugauuuuccagagguuuauaaacugguucagaauaucagaacuaauguauuugaacccaaauuuacaccaaagccaacgauugugcccguucaguuaggccaaacugccuuucagauuuccuaugaagcugauccuuccaacucuaauaaagcacagucuacccccagccgccacuauacaucugccucagcuuacuuggaauuauuuuauccaaaaccguccccuauaugugggacuagucucaccaaagagacacuuggcuuauaugaggauuccauugguuaaaguuggugcuaauaaauacaaguuauuugaucuuuaguuuacagauaaaaccucuaaucuugaucaacuauuuccaauaaacuuuuuaaagggaucauaacuuuuuaaagggaucagaucauaagaauguagaagagcuucacaguuucaucccuaagggcagagaggagacaaauuacuauucaccaugggucuacaauuucauuuucaugaaccaaaaacaacugguuacguuaucuuaguuucaaaauaaaucuuaucaauauuuuuggaaguuuuauugauuucuuacaacuuuuuccugccaucuuauugaugucucacaacuuuuccugccauacuccucccuauaucauuccacucauuuucauauuuaauuaccaaauuuccuccucuuucucuuaauuccaguacaauaaacagauaauucuccauuuacagauacauauuuuuccccauuacuauagggcacuaauuuucaaacuucagugugaauacaaaucaucuugaugguuuguuaaaccacagauugcuggccccagcucagaguuucuguucaguaggacuggugagguggggagaagaccaagaauaugcauuucuaacaguccuaaggagaguggaugcugugaucuagggggaccgcacuuuaagaaccacacugcugucagcugaugagauuuuaccuuagcuacagaagauagugauggaaaaacucggucaaaacaacuaggguaucuggguagaaagaagacugagagcuacuccuucuucugccuugacaagcuuacaaaucuugaaacaagcaacuuuuuaauaaguugaccagaguuuuguaaaaaauuauuuucuucccuuuugaauaaccuuucugauucccucucauuuuucaacagcuaucuugagagaaaucugauaggaauuaacaguuaugaagccucaugugaaaagcuuagcuuuuaaauauauggagacugaugcauauuuuuaauuuauuuuguaauuauaguauauaaaucuugguaaagaaaagugaacaauuucucuaccuaagaauuauuaauacaaguuuaaugacuauuaaauauuaggacuuaaaagaccuuggaauuaauuuaaucccuuaguuuuccauuuugugacauacaucauguagcucaaauuguucauaguuacuagaauacgcuaaguaaacagaauuuaaaggcuagagcuuaaauugcugauuaucucaagauauauaaauggugagaaauauacuaauuucuucuaaaagcauaucgcauuuuuaccaucuuccuguauccucucuguacguauagaauggaggaacuauauacuguacuguguuuauaguaccuuuuuuugucuucaaacucugccucccagguucaagcgauucuccagccucagccucccgaguagcuggaauuacaggcgcgugccaccacgcccagcuaauuuuuguauucuugguagaaacaggguuuugccauguuggccaggcuggucucgaacuccugaccucaggugauccacccgccuuggccucccaaaguggugggauuauaggcaugagccaccacccccagccuacaguacuuuucuuuagaucagcaauugaacucacugcuuuaaaauuagagauauugggccagacaugguggcucacgccuguacucccagcacuuugggaggccgaggcggguggaucacaaggucagguguucgagaccagccuggcuaacauagugaaaccccaucucuacuaaaaauacaaaaaauuagccaggcauggggaugacagagugagacuccaucucacaaaaaaaaaagaaaaaagagauauuggcugggcaugguagcucacaccuguaaucccaacacuuugggaggcagaggcaggcagaucauuugaggucaggaguucaagaucagcuugaccuacauagugaaaccccgucucuacuaaaauacaaaaauuagccaggcguguuggcaggcuccuguaaucccagcaacuuggaaggcugaggcaggagaaucacuugaacacaggaaguggagauugcagugagccaagauugagccacuagacuccagccugggcaacagagcaagacucccucuaaaaaaaaaaaaaaaaaaaaaaaaauuagagguguuucaccugaacacucauugagcccauuuucuauaacuaacauauuuuuaaauaauuuauucuaugcuugacaaccuuguagauauucuguacuauaauuaauauguugaucaaaauuaaagccauauauauauauauauauauauauauauauauauuuuuuuuuuuuuuuuuuuuuuuuuuuuuuuuuuuuuugagacagagucucgcucugucacccaggcuggagugcaguggcgcgaucucggcucacugcaagcuccgccucccggguucaugccauucuccugccucagccucccgaguagcugggacuacaggcgcccgccacaacgccuaauuuuuucuauucuuuaguagagacggguuuucaccauguuagccagaauggucucgaucuccugaccucgugauccgcccgccucagccucccaauaauaaaaccauauuuuaugucuaaaucuauauaauaucuauaacuauauauaaaccuuaaugcugucauucuaguggauuacauuguauugaaguauuaaauuaauucauacauagacauuuggcaguucugcaaguucauugacuucucuuaacagcuacuaccuuugaaugauuagcacuccagaacacugaaugaguuccuaauugugaaaaugauuaacuaacugcugacauaacagagauagucacaaacucaaauggaucauuacaggcaauguaacuuuuuuaaaaauucucuauucauuugcauuauggcuacaagauaaauuuuagauuuaaaaaaauuaaguguuagaauuauacuuugaguaggcuucaggcagaauaaauuuauaguagacuucagcucaacauuagggcaaacuuuaaggauugcaugacuucucugcuccuggaauuaauuauuuaggcacgcacugaaugugggaugcauaaagggaauuaauaaaucagaaaaggugaauuguuauggcucagauucuucuccacucugagggauucagaauuuauuggaaauaaucauuggaacuuuugccuucaggccuucuguuaauuuacugguuuggauaaagaagugugauuucaaauuuucuaauauuauugugaaaacauauaaagaaaagaaauccuucuucccauccuuuguuauugcaaaacaacguaagaacuagguuuuaaauuuucaugaacuuuauuaauuaaaugacuaguuaaauagaauuuaugaaauuuauucuguaagauuaagucuaccuuuuauaaucuucaaagaaacuuuucacuuucaaucuguuuucaaaaauaugaaggaauaaauuuaguauuuauagugcuauuucaaaaguaccugcugucgguuuauuuagaaugacacaagaggcaauaggguaaauuggaaaaccaaauuauuggauauuaucaaauuuuuucuuuauaaaauucacauuaaauucuguuuaaaagucgaaacaucuauaauaucuuucuccauuuuuucuugcacugcuaauuaagguggaaagaagcaacaucguuugcuaauuucaucuuaaauuuuuuguuuuagacaacaaguuuccaaguaaguucauuauugcuacaaaugcaaucauaucuaaauucaggaccuagugaauucauaugaaacucgauucugccuggugguguccacuuuuuucuugucacuucuucuaaucaucugugcuuucuugugauacuguaacauuuccagauuucaagugggcaaauaguagcuuuuauggagagaucugagugauuuaaauguuaucacacaaacaucuauaaacuauauugcacauuucuaaauauuuggcuaagcaaauuuuauuccuccagauaaauauuacauacccuuuauauauaauagauagauauagauauagauauauaaucucuuauagagaguauguguaauauauauuaaacauacauauauugcacaugcauauauauacaauuuuuuacauauauauguaaaaauuuuuaaaagagaucccaauccuauucaccuuuuucuugucccuggagaaguagugguaaauggguuucaucucgcuuguauuugcaauugauuggcugcccuaaagugcuguguuuguaucuacagggagagggaaaaaacaguguucaugccaaauauuugcuauuuaucauuccugcuuuagagacauaaaaguuuucauuguagcucuaaaaauuucuagcuuagccagauagcuggcaguugcagcacaaacuaccaugugacucaccuggaaugugucucuucuaauaugugaaagagauuauuugaaaucucuuuccuuuuuucuuuuuucuuuugaucaucucuccuuuaaaagagcagagcaucuccacuaugccucugagaaacuagaaugauggccaugaugaugucaucaaagauacucuuaaguauuaaacucuacauuugcuucuaaugaguucuaacccccauuaaaaugacagcaguugcauccuuuaaaauuuaguccagugauucucaaacacaagugugcagguguauuaaauaaaaauacagguuugguccccauccucagagauucugauuugauugguucaagagagggguucagaaauuggcauuuuucaucgucuuacucauucugauacaaguggucuggaagccacucuuugucauucacuuagacuguggacuugcguucuuucuuuuuuuuuuuuuuuuuuuuuuuuuuuugguucuugguagacuugcauucuuucuuccauaucguuuuuccagcacaaauugcuuaaguuuuaaauacugucagucaugacaccauggaaugaugauuuuuuugguuacaauauuaauaaguaguauccagggcucacuuuauuuuauuuauuuauuuaucuaucuauguauuuauuuaucuauuuauuuauuuauuuuugagacagagucucacucuguugcccaggcuggggugcaguggugcgaucucagcucacugcaaccuccaccucccagguucaagugauucucaugccucggccuccugaguagcugggacugcaggcaugugccacugugccuggcuaauuuuuguauuuuugauagagacaggguuucaccauguuggccaggcuggugucaaacuccuagccucagcugaccugcccgccuuggccucccaaagugcuggaauuacaggugugagccacugugccuggccuugguuuguuuguauguuuuugucguuguuuguuuguuuguuuuugagacagggucuuguucugucacacaagcuggagugcagugacccaaucacagcucacugcagccucgacuuggcaggcacaagcaguccucccaccucagccucccaaguagcugggaccauaggugcaugccaccaugccuggcgaauuuuuuuuuauuuuuuguaaugacagcaucucuuuauguugacccagcugguguuaaaguccugggcucaagcauuucucccaccucagccuuccaaagugcugggauuacaggcaugaggcacugcacccggccagggcucacuuuaaacacagagaggcuaaaugcauaaauccagguguuuaagauuuuguaugcuaucauauuggccagcuuucugggcagugauuacuggaaaugccaguuucucacccgccuccuaaacucaaguucugucugucuggucuuacuugacaucaguccacugguuucauacucccuggauuucacaaccaaacauucagagucuucagagccaagcgacuggucuuucagucucaaaaguugacccuuuacgucucaaaugacauuucucaaccucuuuuuuuuuuaaaauauauaugcaguauaaaccuaucauuuaucaggaguagaaaaaaauugccuuagucaaucuaguuaaucuuugaaugccucacuucugguggugguguguuuguuuguuuguguguuuguuuucaauugugguuaaaaaaaugcauagcauaaaauuuaccaucuuaagcauuucuaaguguucaguaauguuguguucaguagcguuaaguauauucaccuugucaugcaaccaaucuccagaacuuuuuuguccugcaaaacugaaaagcuauauccauugaacaacuccccaucuuccuuucccccgcaagccuggcaacuaccauuacacuuucuucucaaccuuuucuuuaaaauaagcaauauguuuucuuaaccuuucucccauccauaauggguuuacaguuauugcuauuuagcucuccaaguauaaagcuuaucuccuguauuguuagaauucucacaugcaaaaagauuuacaauuacaaagcaauugugcuaauaagauaugcuuauaaucuuugagugaagguauuuuauccuggaagcuuuuccacugauuuacagggggagguaagccuuuauuccucuugagaccuauggaucucacuuuaugcuuccuggcugguuugguauuuuauuuguuuguugaagguuuaaguuuagaguuaccagggcaauuaggcuuaaauccuagaauuuccuuggcuuuuuccugucuacauucuaagacuguuuuaccauaacacuuuauaacguaaguaguagauuggaaguuuuucuggaauuugacaaauuaguguuuacuaaaugauuuaauaaucuuugcuuauucaguauaaaaugguuuaccuuuaaacagcuuuaauagaaacacaauuugggaggaaauagguaaaaaauaaaaauguauuuuucugcaaaugaacuguuucaaauguuauuuucaaaaucuuuggcaguaagaaaauacucaacccgagaaauaaauuuuuuaaacucuuauucuguaaaaguuuuucuuuugaaacauuucucuuccucuguuauuaaaauuuuuuuaagaaaucaauaaaagcuuaaagucuuauaagcaauacacaucuaaauaaccaaaaaugcuauaauuaugaguaugcugcuuaugauccucccauagggaaaaacaucugucuuuucuuggccuaaauuauuucagagcuagcacaaaaacugauugaucaugacucuuggauaaugauaacuaagucuucguuucaugaauuuaacaauuuguaucagugcuaccuuaugaguuuuucagaaaaaugcuauuuguauugaaccauuuuaaauaauuccauaaucuggaauaauucagauuuuuuuaaugaucugcugcaacauauugguauuauugaaucucauuuuuucuuugauuuccauuauaaaauuagaaauauuuucugggagaaaaaauacuccuugaguugaaaagauuuagugaaggaguuguguugcagcugauucaguaauguuccaggcaauuaaccuuuuuuuguuuucagcgcuccucucacucuuuaagaucuuuccucauugaucaucauaccaccccaaaaucacagaaguuuauuuaauuccaugcguuccucagagcacgugaugucagaacuuaaccuccccucaauuuucagcuucuaaccuaagcuggacacuaauauuuugccaguaggaaccuuuuauuuuuugagacaguuucgcucuuguugcccaggcuggagugcaguggcgcgaccucggcucacugcaaccuccgccuccuggguucaagugauucuccugcuucagccuccugaauaacugggauuacaggcgcccgccaccaugccuggcuaauuuuguguuuuuaguagagacggaaguuucaccauguuggccgggcuagucucgaacuccugccucagguaauccuccugccucgugcuuccaaagugcugggauuacaggcaugagccgccgcgcccggccaggaaccuuuauaugguacaaugaauuccagccugaaaauuccccaaguucugagccuuuacuucauacauauuuaccaaauauaucaauuauuauauuaaacuuagaaugaagaaugacuguaagauuuauaaugacuaaaguuaguuugcauuauuuuucuucaagcguuauuaaaccguacuccucuuuaagcaaguuuuugggucacuagguaacuaugugauuugguuuguugaucaccauuuauuguuugacucacuuuuucaaaggcccaaauauuauauuuaaugacauaccaagcucuaauucaagcagugcccucuguuaaggugauuugcaucugacuugaagcauauuaaauaaaaucuacauuuuauuugaugcaaauguuuuauauuuauauaaaaaauuaaucuuggguaaacacaacuugauucuuaaauuagauucuuaauaacucaauucuaaaugauuacuuauuaaauuugucacaaaauaacuauaaagugaacgugaaugcuacauuacucaguauaucuaugcuauaauuaauaaacuccaaaaauuaguuguguauuauuuggacuacuauuucaaucauucagaaauuuguuuuaaaaaauccuugcagucuugcugcugacuucauagcgugcaguagugugauauggagaugaugcacugucuuucagaagccuuggcucuaugccuucuagcugggccuggggcaagucauuuagccucuguggaccccagcuugcuuauccauaaauugagggaauuggaucagagugaugaucucuaagaaccccuucaauuucuguaucccugaagucagugaaacuucucuuaaaguuaguuucuacuuucuucuuuggccuuuucucauuuucuucccacuccccuugguuucgucucucaucugacauuuauugaccauccuuuccuucuuggcaugguucauauuuaguuauggccacuuuacaguguugcaguaugcugcuucucugccuaauuugcccaguucccauuuuuacccugccauuuuaauuuuacauauaaauuaucuuggaacuaacacaaaaacuaguugaucaugauauauuauauauauaaucaauaagacuuaucuuuuggcccuguacacaaaaguuuuaaagaggcaauucuuccaguuccaagagauuuuuuuagacacacaaccuaaaacuuguuggaguauauuuuaaacuuaaguuucccauuugaaaaauccuaacuccuuaacuugcauuuaaguuuaaaagcagagacaguuucuuccucuuuuguauuccccucuccaccuugcacugggcugauuacuuaaaucaucucuuuucacuuaaucaccagcauuccuguuccuguuuugucuuugaaaucuuguugcuucagaaucacgguacuuaacagacaaaucuaaauggcgacaauuguuaaugaaagcgauaguuuuaaaaccuaaccaaaaaugcuaugucaucuuuauuucaaagaugacucacaauuaaaggaugauuuguugccugcacacccuaaauuuuauuucagaaauauucuuucccuugcuuaauggauaagugauguuguuccucuacucauucaauggacauugaguagcuacuuuuugccagguucugugcuagggucuagggauacaauaacuuaggaaagacaaauauuucacugccauuagcuuuaagugugccauguccaaaguuauuugauucaaagcagcuuuuggagccuaauuacaguaucauuuuguucauucaacagauauuuauuugauuaucugccaugugcuagacaguuuguugguacauauggaaguguauuuaaagcuaucuaguauaaaaugcuaugcauuauuuuucccuuaucaauuuauccuuuaaauaugauuaucuacauacugucauagugcucaaaauauauuucauugaugcagauuuagagaaauacaaugauacuauuuuaaacaauaauucugucuuccucauuccaaaucugccuugauguccuagggugaaaauaacuauucuguuucauuucaugugccauuguguucaagugguaaugacuaccugaguccuagguuggagaugauugugaagcuccauucaggcccaugguaaaagacugcgaugauuucuguauguugauggggcaguuagaugaggaaagcaaggaguagcuauauacaugucacauguuagcccuuccugccccaggcuuuuguauucaucaucacuaauuuuauuucacucucauugcauauucaguauauucacaaauucuuuuucuccucauauguuuggauugacaaaaauccaucaguguucucagcuaugaugacuaucucaccaaugucuuagccaaccaaaugagauuuacuaacaccucugugucaguaaauccacaguuguaauaauuuucacuguagagacauugcaaugaagacaauuaauagauaaauucaguuaaucaugaguaccaaaaauuuguccugaaaguuuuccauaacuggucauuaauuaugaaauauuuucuaauucaauuaaauauaaaaagaauguguaauuuuaaauuauaauaauuuacauauacguuaaaaucauuuuccaaguucuuuuuucuauuauaccucauuuuacccugaugaaacuccugauuuagauuaguucaauaucacuguccccacuuaacagaugaagaaaaccaaagcccagcaggugaaaugguuugcuguaaucacuuagcugccuaauaaaaauaccaggguuuuaacaagcccacugcucauugaagccuuuuauauuaauaauaacauagaaauuuaaagagguaaacuugaaaucaaaauuuggcaaaauuaagcauauauguuuauagcucauuuaaagaguuuuuuugaaaugcauucuagguauuuuguugcuuucaucacaucuuuaggcucaauucugcacucaguaaacucuugguuuuggcccuggcagaaggccuagcaacucauuggugcucaugucugugcaccagcugcuugccgaccucagccucugccucaaacucugagccuuuguccucugugcuuaagacucccugccugagcuucccaccuuagcuaaccuuccagaacuugacguuuccucaccuguuaacccaagucuugucauggcaccugcuuugcagaauagcccucuaaaagugauaucguuuagaggauuuaagauguaaaacuacauuugcauaauaaguuugguuaauuaaacagcgaguaaaucuuuucccugcauuccauuuuuuauuauuuuuuuauuuuuuauuuuuucaagacagggucuugcuuugucacccaggccggagugcaguggugcagugacggcucacugcagccuugacuucuggggcuuaagugauccucccgccucagacuccugaguagcugguacuacaggcaugcaccaccaugcccagcuauuuuuccuauuuuuuguggacacagggucucacuauguucccuagacugguuuucccucuacaugcuuaugaacaagagauaaaugaccacaugauaaguuagaagcagacuuuuucagaaaccuguuugaaaggaaugauccagguuuuaugaaaucaacucaagaacccacuguucuucaucugcaucaguaccaucauuacaguuguugacagugaaggcccuagagcacugcaguauucucauuugugcaugcaaaauuuaaucacauuuauuauguuguauuuauuaaagcagaaaaucgaaauaauacauguuagaaauauuuccauuucaauaggauuaaaagcauacuguuagcuaggaauugcuguuaaguaaaugacuucgcucccugacauucccaguuaaccaugguuuuguagcaucacugaggaacuggcaggcuaaauucugaauucuuacaugcagacugaauuauucuggugguuuuuguuguuuuguuuuguuuuguuuuguuuugagacagagucuuacucugucacccaggcuagagugcaguggcacgaucucagcucacugcaaccuccaccucccggguucaaguacuucucccacccuagccccccgaguagcugggacuacagguguaugucaccacgcccagcuaauuuuuguauucuuuggaagagaugggguuucacuguguuggccagacuggucuugaacuccugaccucaagugauccacccauuuugaccucccaaagugcugggauuacaagugugagccacugcaccuguccgaauuauucuguuucuguauuuauggccacagaaguuucauauuggcuaaaucugcacaaauuaucauauaguuauaaauauaaaagucagaucaauauggcuaagauuaucacagaggagcuuaauaggaguuccacacuugccuuuugccgggagaagaaaacaacaaugacuuuaauccacuuccucuacccccuuaagcaauggcaguaauuucagcucuauuuuuagguauuggauccccuaaaguuaucaggcaaucucaguggccuaguauaaagugcaaacagaacagaccuuggugucagccaguccuggguucaaguccaaauucugucauuuauugugaaauuuggagcaguuuauguaacuguauagaguugugagaauucauucaucauuuauuguauauucaucaaucaccuacuaugugcuggucaaucuuuaaaguucagggaauuauauugauaacaaaacauaaaguucccugcccucacagaaccuagaguaaaccagaauucucuuaaaaaaguuaaaugcaaccaggugcaguggcucacgccuguaaucccagcacuuugggaggccuuggugggccucacuugaggucaggcauucaagaccagccuggccaacauggugaaaccccaucuuuacuaaaaauacaaaaauuaaccaggcgugguggcacgcagcuguaaucccagcuacucgggaggcugagucaggagaaucgcuugaacccaggaggcggagguugcaguggcagcgagccgagaucaugccacugcacuccaggcugggcaacagagcaagauuccaucucaaaaaacagaaaguuaaaugccuucagguacauaaggcuguuaacgaaaugucacauaaucaaagcauuuaacaaauauuaguuaacaucauuauuaauucuucccaacccacgaaauggaugguucccuggaaaguauaacaacauuaugcaaaguucaaagggagccuccuuuuaccauaggaaccuuuagguguagcagcugcaagggaauugggcugcuuauaaucucauaaaacuguuuucagucaaauauaaaagugcacaauugugcaggcaaaaauuucuugcacaggaaacaaaaagcacuaacuauaagagaaaaaaacaauacauuagacuccaucaaaauuaaaauuuccuacucauccaaagacaccauuaagaaaaugaauaaacuauccacagacuggaaaauaauugaagcauagauuuauuccuggaggaaaucagaacagcuuuguuuuuuucuuuuuuuaaaaaaagagaaucauuaggcuguuugcaugauugagggaccaauugcugcagcgcuaaaaguauuacauucaccuacuuccuaguaccuacaguuuuucucaucuagaucuaccaucgauuuugaugguuuuuugccugaaggugucuuuggggguaauaugacacccucauuuuacaagagauaggaaaaauauuuguaugacuuugacaucauuuaacuagucuuucagaacuugaacuauauuaagugguacuuccacuguucagugucuguuuuucuuauuacacugauuuugcuucagaaucagugagauuauauagacgucauucagaauauuuguuuuuauccuucaacucgaagaguuuucucaccucuuuauuuucaaguugaaaacauuauuauaagaguauguuagcgggucauuugacucugaaaaaaauagcuuuuuaaagguugaucacacuuuaaucuucaauuucaggauaguaaagaaccauuauaauuuaggccccagugacugucauaaaacagcuuuuaccagaccaccaucuuaauacugauauuuuccucuuucauauuugaacuauauuuuuuucuauaaucuagcucuuagaacucuauuuuccuuugauacuaaugauuccucuugcccucagaaauguuuacaugaaacagcacaugacuguccuuuuuguugaucccaaaacuuuuuauuguucauucuagagaggcaaauaauguccuucagugucacuaauugaguuuuuaaaaggaagauuugauagcuaagaaucuguugucuuguaucaauuuaucauuuuuacaauugggucaagauauauuuaugcaauuuuuauguuaauagcauaauagcaguagcaauauaauguguggcuugggaguuucagagcuuuuuaaaaaaaacuaaguaugugccuaugcuuuuccuuuuuaaccauauugaauguguaauguugaguuagaagacacugugugagguaagaaauggcaguucaaggggaacaagaacauucguuuauucagucaacaaauauggauugaguuccucccauaggcccagcauuguacuagggaaauugcucacuauuuuuauuuuuccccucuaaccuaagguggagaugauaaugaauaguaaaauuacauguuuuagaugucuuuguauguuauagguggauuugggacagcaaaagccuuugguguguuucacuuggaauuacaaaaagaaguaaauuagagaaauaauugucugacuucugaugauaggguguuuuuguuuuuguuuuuguuuuuguuuugagacggagcuauucucuugccucagucucccgaguagccgggaccacaggcgcccaccaccacgccucgcuaauuuuuauauuuuuaguagagacaggguuucaccauguuggccauggcucgucucaaucuccugaccuugugauccacccuccucgcccucucaaagugcugggauuacagccgugagcuaccacacccagccuucugaugacaguuuuaauuuuguagaugaauuuggcaugacguggaugaauucugucaaggucauuauuguuuucuucucaaaaccaauagaauuuucucacuuacuuauuuuuagaauugucagguaguguaauaaaguuauuucuguaggaaacugggaauucauuggcuauuugacucugaauguaaccucuuuaaagcugaugaacgaguggccccuuauauuugaagugguaagguagucauaaguuaggcucccagacacuggcauucaacgugauuuugaagugugauagaccauguauacacuugauugugcaccaagaggcauaagguaaaaucuuguuuccuucccaccuguaaguguuaagugcaucagucuccuuucucuacuggugguguccuguugcuccacuaguagccccugauauaaaacccguguccuccauagauaauuagucaugaaucccuuuccagggcguguuguucucuauguggugauuugaagggagaaguuuugaaaugaaaaaaaaaaaaaagaaaaaagaaaaaugcuaagcaauuucugaugcuuuagaaggaaugucguguuucauuacaaugcauuuuaacauuuuuauuaagauauaauuuaauaaaaugcucagaucuuagcaugucauucagucagauuugaugaauaugaagacacauuucugucaccccagaaaguucccauguaccccuccucagucaacacucccccgacccugacuuccaaaagcaaccacugaucagaugucuaucaccacagauuaguuuuguguauucuggaauccccuguuaauugcauguauuuuucuuuucuuuucuuuucuuuucuuuuuuuuuuuguuuuggugacaggaucucacucuguuacccaggcuggagugcagugucacaaucucagcucgcugcaacccccaccucccagcuuuaagcaauucucaugccucagccucccaaguagcugggacuacaggcacaugccaccacgcccagcuaacuuuuguauuuuuuguagagaugggguuucaccauguugcccaggcuggucucaaacuccugagaucaggugaucugcccaucucagccucccaaagugcuaggauuaugggcauaagccacuaugccuggucugcguguauuuuucucuguuuggcuuauuucacucaacauaauaauuuugagauuguccauguuuuugagucugucaguagaguguuucuuuuauugccugaugauacuuuuuuaaaacaggcaagaaauaagcagaucgucacugaauaucuugauugacacauaacuacuauuaaaaucauggcagcaaaccuguaguaagaaugcagggggagaaaauacccucuuauauuaauauuaagugacaguacuucuaacauccaaacaacucucccaccuuaauuagcguuauaugcaucaagagcuacucuuuuggaagacucuaaauuacuaaaaacagaaccugaguucgcaucaggaauuguaauagccguaaaccuaugacuguuuccaucgcuuuauaguucugcuuugacuucagaaacuaguuugaaaaauaaucccauuuaaggauauucuuuuguuuuguuuuuuuuugagacagagucuugcucuguugcccagucuggagugcaguggcacaaucuuggcucacuguaacugcaaccucugccucccugguucaagcaauucucuugccucagccucccuaguagcuggcaccugccaccaugcccagcuaauuuggguuucaccauguuagccaggcuggucucgaacuccugaccucaagugauccacccaccucgggcuuccaaaguucugggauuaccugcgugagccacugugcccagccaaggauauuuuucuuguaguaucuccauuaucaaaacgugcuggaaaggauguuuuacuuguuuaucaauauggugaugccucaggagcuuuuaagcccucuuaaaauuauguaauauagaccugaugaacucaguuuuauuauuagaaacucauuuugaucuguaauuccaagcaaauauuauauaaaugaaacaagaguagauacaguaagagcagcauccagauugcauuuuucuucuuuugaaaguccuaauuaaauuguuugccauguuaugcaaagauucauugagauucuggggaguggcaguaaauuuaagcaaagauuauacugugauucuggggagccauaguaaauuguguaucaacaaaucuaaagggugaauuuuuacuuucugcuuauugucuuuuucaagaaaauucuauaguuaccaaaaagguggcugaauuuugacauaauaaaggagaagguugagcuggccuuuggcuaguccaccccuauucuuaccaucuccaccuucaagacugaaauaaggagcugcaggagcacaaagagaucccaaaacauugucacauaccaauagccacuuucuuacuuuuacaaaaaguuaguaugguguuuuuuuuguuuuuuuguuuuuugguuuuuuuuugagauggagucuugcucugucacccaggcuggauugcaguggggcgaucucgggucauugcaaccuccacuucccagguucaagcgauucuuuugccucagccucccaaguaccugggauuacaagugggcaccaccaugcccagcuaauuuuuguauuuuuaguagagauaggguuuugccauguuggccaggcuggucucaaacuccugaugucaagugaucugcccacuguggccucccaaagugcugggaugacaggugugaggcacugugcccagccaguuuucuguauuuguacaauuauucagccagaaaaaaaguagccauauaguacuauaaugcuuauaucacuucagugggaaaaaaaaaauaaugguacccaaaagaaauaagaaauauagccugauuagugagagaacacugauaaaguuucagauuauucccguucuugaaauauuucucauucgcuuuucuuauuucuuucaccuacgacuaaaauacacgugcuuuccuuuuccccuaucauacuuacuuuuuuguucagguuccuaaguuguuuuaccaucuucauauuucauucugauaauuccaaaaauacugaaaugaauccucccuuucacaugaccuacuuuaguguagaauuuggccuaagucauuucucauacaaaagcaguuacauuugaauuaccaagagaaucuuguugguauaauuuaacccagaagggcaacucacagugcugucauacuaagccucaaggauauaucuucucaagauugauaagugcuuuugagcaaucgcucaaaaguaugaauugaagucucuaaacaguucauuaucguuuugguuguaguaauuaauuuuaauuaaacugccgauaauguuuguuccagaugaaaaaaugaggauauggucuuuguucccacuugaauaugaacacugcuauccauuuaauguuagaaagauaaaagagaucucggccgggcacgguggcucacgccuguaauccuagcacuuugggaggccgaggcaaguggaucaccugaggucaucaguucgagaccagcccggccaacguggugaaacaccaucucuacgaaaaauacaaaaauuagccaggugugguggugaguuccuguaaucccagcuacuugggaggcugagccaggagaaucacuugaacccaggagacagagguugcagugagccgagaucaugccauugcaccccagccugggcuucagagagagacccugucucaagaaaaauaaaaauaaaguaaaauauuuuacaugguaucauugcaaaagaaggaguaauggugguuuaaagaaaacguuuaauacaguuauucaagaguuccaacacaucaaacuuuugggauuuaacuauccuuuuuuaaaagaaaauauauuuugaauacuguacagauucccaucuuaucagaggaagaaccaguuagcauaacauagaauuuuagggcuagaagagacuuucaacaucaucaagucuuaccucucgguauucaauaguucaauauaauuauuaucuuuuuacaggucuuagcuuuccugcccuaauuuccaaaacaaugaagaacuaguaguccccagauccccuuuguauauauguauaacugccuuuucauucccucugauagucuccauauucauguuaaugauugcagcuaugaggauuauuuccuugauucauuaugccugaauuagcuuaagaaaagaauagucuaccagaagcacaacuuuuaauuuaaauguuuggcaaagguaaagaugaguaauucagaguuuuagaaguaguuguaguaauagucaauugugucauugguucucuggaaaacacaucauauggauuuugccauagcgauucaggcgugaguaauacuacccuauucaagaguaauacuacccgauucaagaguaccacuucaagagugaguaauacuacccuauucuuuaagacaaguaauacuaccuaccacauuguaugggugaagcaaaaguggaccagcacagcuuuuuguggggguuagugguaggagaguguuauagugaaguucuuuguucuguuuucucagucucauuucucauucauucauuaaaucaauagauauuuauuuugccugugguaugagcuaaccauuucucugggucuggauaauauagcagacaacaagauccagucuuuggccccaaagagcauacaguacggguacucacaacauggacaaugcuagauaacugcccagagagcagagaagcuacaugagaucauuauaaaccugugcaccugaaccacugcacaagcaaugcauuaacuuugccuugcucauugggauauggugagaaauaacuguuauaauuaguugugaagcacuuuggaaaugaaaagagcuacaaagcaacugaaugaaagaaaacaauauuaaauuauaggguagaaaugauucucauagguauguucaguauuuaugucaacgauauaggacuauuaccagggaaaagcuauuuuagguaaauacaauugccuagcuuuuacaaagucaagaaaauacguguguguauuaacaagauaaauuguggaauguuguauuauuuuggguauuaugugagcuaaauauaguuggaauaucacacauacuaugaaguuucuauaaaucugcagcuucuauuaagaauuucuguauuucaauguuuaucggaaguauuucuccaauauuuaaaugcugaaacuauccaagacuauuauucacaaacaacggauuauauuuuaauacucagaaacuguaggaagguuuguuaaauaagaugaauauccugugauuaacuugccaguauguuggguucagugauuuauuaugccuggucuuuucugauuuuaguuaauguuuuuaaaguuuguuaauucucucagaagaugaggaugccaauuuauaucccauuauacacccucaaaagaugaauuuauagaaugggccaugucuuuaacaugcuucuauauagucauucuuauaccuaagauucagaugcucaaggaagggacccauuuagacaguuauuuaauguucuuugacuaugaacuaauccuaauuuuaauuuuaguacuuuuauguucuuaccagcuuucacccuaauuaaauggggcacuacaccgcagaguuuagccugugguguagcagagcccaggucaucugucacagagaaucguaaucuuacauucucucucuccucugaacaauagaauuuugaggugggggagaaucuuaguuuauaaugaggcaacucuaguuuuaucacacucagaaacaacaaaaauauucaaaauuuaacuuucugugcauuccauuuauuugcaaauauauaucaguaugauuauuacaugaguaagagaucuucauuuuuuacugucaucccugauuugccaaauuugauggagaaccuccacagaguugcauauuauuuuauuuguuccacauguuggugcuuuguucucuacuguccuuuugucauuauauuaucucugaacauuuccauuuaguguuucuauuuagaguaaagaaauagaagcaugaaaauuaauaacccaugcaucauauuuuuugcuggacuuuauaggaaugaccagcuaaggcuagaaaccucaguguuuaauacuguuuucaaaauuugauuguuacauauauugucauuucagugacuggagacaagauguauauguagacaaauagauaaaaacaggguaauuaaaccagugugguuuuuuuuuauuuuaaaggaaaacacauacgacuuauguacauugcauggcagaguauuacuaaaauucgccuaaacaaaccgucacgauguuuucagguuuuaugguaaugcuuugacuauauaguauuuggauuugaauccucauaaucacaaagucucuuaguuguuuaaaacaaaaaacaaagacuauacugauucuagaaaguaucaucuccuugauuauauuugugcuaaguguaugaaucugugcuauaccaguaugaaaaagguaaaacuguauauauauuuacauuuugaaaaguagcauugugcauuuuagaaaaauauuugucaacuuguggcacuuuggcaaaggaaugugcaauuauaaagguuaaugccacuuuauuuuuuucuaauucccaguaauuauucuuacuaggcuuuagagucaaaaucaaacccaauuuuaagacuagcacuuuuuuccuacugguaauuccuguuuuucuaauuacacaaaauguuuaacuuaaacuauucuuugcaaugaguuuuagcuuuccuccucuauccuaauuucaaaaccuuuaauuuaagaaccauuuaaaauuaauccagugguaaccagaagaauauuuuagguaucaugaccacuuaaucuugugccugauuuuaguaauuuucugauaaaaauaacugaauuccugaaaaagaauauucaaacuuuuuaauuaguuuucauuggucauaaauaauugaguaguugauguccauauagucauaauuuaucuaaacucuggagcugccaagacaacuaaguacacagaagugcuuaaaacacacccauauccccuaaagagaaaugacaagacuuggaagcaucagaauucuguauuauuaugaguaucacauauauauaugcuauuuuauauauacauauauacccauacacauacauucuguuagguuaccaguauuuuacugucaugcacccauggguaguagaaacaaaauaaaaauaaauauaaauguuuaacuuuagguguuggcaccaauauagauuaugcauaaacuguugcaauaaaagauacucauugugccuguaccugaaaaauuuaccuuagguuuucucuggccuuuuuuguuuaggccugcaugaucauuuuaaauguaaagauagcaggauauaugaaugaauggauaaaaugauggcccuguuugccaugggauuaacuauucuguugaauuuucugaggggcauuggcugcuguauauuacgccauaaacuauauuguucagaagcaacaugaguguaucacagcauuuagaaauuauacauccuucgcuuuccccacaaaaugaauucagaaucgacauucaaguuuauaauuuuaagcugcuaauuauaaaaauauauuaauaccuuagggauugaagauuacaugaaauaagaacuacaaaagaaugcuaauuaauaacauaacuccauaugcuaucaaacuucugauagcacugaguuucuuauaaagccuuaaaauauuuuaaugauaaauuaauuaccuggaaaagaaggcacuuuauuaccuugaacuagcuauucgucuguauagaauaugucaaaaaucccuuaaauuauucuuuauccuuuuauaaauuuauccuaguuacauguuuuucugaagccucuuaugguauaauguguuaauucaaaaacuauuguaacuuaacagaaaaauuguuaccaauauaaccaaugaacaauacagaaauaaaacucaagaauaacaaaaguauaugugauaacaagacuguuagucuaaguuagucuacaaucauuugagauuuuaaaauguuguaaaauuugaaggcuuuuucauugaacaauuuuuggacaguuuuuauuuuuaaaucucacuuuuaauugguacugccuugucuugaaauguugaucaaauguaaaggcaaucauaauuauuaagccaguccauuauaauucaauuuuguuuuaguugagauuuuuuaguguaauucuaaaacauuaaaacaucuguuuguuucuuuuuugcucaagucagccaugccuggugaacuaucaaauuuaaaucaucaacauggaugugcugcuguguauagcuguuuccucuucagaaaauuagugcuugauuuauacaaggaauuuaguucagcagaaaaagcauaggauaauuuuuucaaaaggguucaacccucucaagugaaaccuuaacaucuuucugacauucauaaggauaggcuuuuauccaagaaauuuuuucaacagaaaauuauuucaaaguggacaaacuccacuuucuuuuuugcuugaggggcaguacacuuuuacaaaaacacauuuuucuguaaguuuacuuaucuuuaagucauucucugugguggccauuuuuccaucucuaauuuuaaauguuuuacuaaauguacgugcaguuucauagacagucugaucauuacaugauuacagaaaggagucaaguuuaucagaggucuauccuugugaaggggagaccaaacacaaauuccaugucaguuguuugguuugguucuuuguuuucuuuuaaaaacaagauauauuaacccaaagguguguuaaugucauggcaugaacaaucuucaauguagaccuauugaguauuuugugaugcugaguaacagacguuucucaacucucugugaugcuaaauauuuuccuuaggaaguuuuguuuaauguuagauuguuguucugaaagauguugguccuagugggauuuuuuuaaacuuggaaaacaaauaaacgcauguauuacaaauauagaaauggugaauuguaaacuuaccauauaguacugauuucuauuuucaaaaauguuuugcuguuaaauauauacaacauaaaauugcugccguacuguaauugaguacuuuuuccuaaacgacccuguuaucacuauuccagaauuagaaggugggcagauacaugauugauucaugugucugcauagaugcuucaagguauauucuucucuuggugaguaaaauuauauuuuccuuggcaucaaugcauugagaucugaauauaccuguaucuaucaauccuuauuacacauuucuuaugcaguagcuucaaauaggccaaaauuggccuagacacaacuaaaaauugaggguuuguuacaugcuuucuaacagaaagguuuucaacgagauuaauuauggguuuguacugugaaaauaguggaacucccuugaaaacuucauguuugcuaaauucaaauuaauauuuuuucuuuagcucacaaauuaccccaaauccagagagaauaucaaccuuuuucacuguugucaaaucaagcauaaggaacagccccaugauacuacaaaaacaguugaggaauaaggaauaaaucucuuauguuacaccucagaauaaaggcauucggugaaagaaaugaacugaaguucaucaugaauguaaggccucaguacuugacauuccuccacggaagggaagacaaguaucaacaccacuggcaucauuuccaaacugaucuuauguugaauaauuuccaccacauugaaguaccuuucgacucuauccaguuuuuggguuuuguuuuuuuuaauucaucaagccuuucguuuucaaaccaccauuugucagccuugagguagagagacauauagauuugaaaauacuuucuuaagagaucauguaacuauauaacucugaauuuaaaaauugaggggggagggauaauuucaacccacugccucuuaccagaaacauuuuuuuaaaucuguaacugcuuuaguguuaacagggugcaaggugguuuuugucccguauuguucuuaaaagguucucauuuauugugauuguauuguacuguaugagaacaaaucauaaauugccuuguauuguuuauaauagaccauaccacguacuacuucaguuuuuauguuccaaguuuuucagugaugcauguuaacaguuagguccuaaaauucuguggugcuaauucucccauacccaauggugcuuuuguggaugcuaacugcacacaugcugaacaaagcuugaaguuuaaaacuuuccucccuuccucuguuuauaugaaguaaaaugaaauaacuugaauuugucucaaaguaucacugacaaucuaauaaacuuguuuauaugugugauuaguuuggauucuuaauuauuuuaaggaaagcaucucagcucuauugggccccaaaaguugauuuuguguuuauuucauuaugucauuugugcccccaaauucgugguaucuuuauaaauuucaaugcaguuugucuggcuuccaaaaucauguuuagguaggaucuauagaaacuagaccuaucagaacuggaaauaaguaaguugagaagaucaaaaaugugccaauccagucuauuacagugccuuuauuguaauuuauuaauaagguuuuaucaccugguugagccgggagauaacacuugcacgaaagcaaguaugccuucaaaaccuuuauugcaacucacaugacauugaaaaggccauuucuauaugcugauauuaaaaguuccacuucucauauaugaaaauagggacaaaaaaauuaauuuugaauuuuccaggacaaacugacaucauaugccagaaugucauaguagauaaacucaugacaaugguuuuauuggauuuuuaucuucugcaucuauauuaaaucacaacagaaggccaagugaaccugcuaauaucuucaugagggcagagggcuguuucuuccaagccagggauaaauucaauauaaaggcacuauguaaauuugcauuccgaccuugguacuuugccuaacucaaggguaauguuaaaauuugaaaagaaaaaaucgaaacaaauguauuaaaucuccuugagcaacaaucauugaccauaaauagaagaugaucaaaccuaucaaucagucaaagaaucuagcagguaugaugacugaaaugauauucccauaccacuaugguucuuuauuauauaaagaguuucaggcccaguaaauuuuugccucaaauagcuauuaaauugugucuaacuucuaacaucagaaaaugaaguuuagagaauagugccagugugaacccuaagcuugcuucugugacuaucugaaauaaaugcaauauuuacuaaaucacagccucucaccaaaga

SEQ ID NO: 15578 - RNA, 853 nt, Homo sapiens
gcaguacauugagcuccauagagacagcgccggggcaagugagagccggacgggcacugggcgacucugugccucgcugaggaaaaauaacuaaacaugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaggcggacaaggcccguuaugaaagagaaaugaaaaccuauaucccucccaaaggggagacaaaaaagaaguucaaggaucccaaugcacccaagaggcuuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaagaagaugaugaugaugaauaaguugguuguagcgcaguuuuuuuucuugucuauaaagcauuuaaccccccuguacacaauucacucuuuuuaaagaaaaaaauugaaauguaaggcgguguaagauuuguuuuua

SEQ ID NO: 15579 - RNA, 1642 nt, Homo sapiens
gcccagauuccuaaccuuugaacacaacguaggcgugacuuccuuuuggaaagccuuuugcaagccuucuggguaugguucugcaacacccuguguauaucucuaucauagcacucaggaacugcauuauguuuauuugcuuacagggcuaucuuucccaguuuuuuuuuuucuucuccauagaaccacaaagucggauaagcugaguuucuugaggacaaauucaguaacuuguaaauauuugaauauccaagaguuguagaguaccaaacuguggagcucaauaaauuucagaugaacuaaacugaauagucaggugggaugcuagauggaugggucaggaaaaagaauuuucuuuuuucuugcaaaguguugggauuacaggcgugagccaccgcgcuuagccaggaaauauaauuucuuucuuucuuuuuuuuuuuuuuuugagacggggucucauucugucgcccaggcuggagugcaguggugcaaacucggcucaaagcaaccuccgcaugcggguucaagcaauucuccugccucagccucccgaauagcuggaauuacaggcgaccgccaccacacccggcuaauuuuuguauuuuuaguagagacgggguuucaccauauuugccaggcuggucuggaacuccugaccuugugauccgcccgccucggccucccaaagugcugagauuacaggcgugagccaccgcgccuggccaggaaagauaauuuccaaguacgaaauguuguagauugggaggaccucaguagcuugggagaagugcacaguggugaguuauaggacggcaaugaggucauggaacuaugaagucaagguuaacaauaacgcgugcaggcaaaacugaaaaggggcggaacaagggguagcgggucuccaggaccuggcauuaggacgugcguguuagggggcagguauuuggagccaggccccacuuucgaguugucuuuccgcaggaaccagagacugcggacggggccaggaaccaggaaccguuagggagauaaggaagguguuauagcccacauucauccuauacggccacaaggccggggggcccaggcugccuccucacagcaucagcuuuuucuucggcuucauuucccucuggaaagcgcuuucucacagacgcugcaaagaccgaaggggcagccccugcccugcuacccuccagggagccaccgcucuagagcccaggcuccucuggacaucaugugacuugggggacgacuugccuuucuucugaaacacggcuacagacuauaacuuuaaaacacggggcuuagcucccccucaauaacgacacggccgucaguauuuaccacguuauugacccucucccagccggcccgcggcaagaagaguuccacuuccuucccggaaaacgcggccggaaggggcgggcuuuccgccugcaccaggcgcuuccgccaccauggcuucacgugggguuguuggcauuuucuuccucucugcugucccccuugugugucuggagcuccggcgugggaucccggauauagguaagugugacuuuuucccuucgacagucacagcuggguaauuuucacaggaauguugcauagaacgaccgccucuucggcugcguggcuucgg

SEQ ID NO: 15580 - RNA, 3501 nt, Homo sapiens
cagcagggcccggaucacaugaaccucauaugccacuggagaauuuuaagcuccuauccaccagcuguaaaaccucagaccaauuacuuaaucucucagagccuuagcuuucuuaucccaaaacaugggauggcaacacuucauaugguuugucaaagagcaauguuaaaagcagaguagacaccaacuccauaaauguuuaaucaauccauuaauaugcaaaaaccauuaaguguuuuuacagguuugauuacaucuggauaugcaccuggucuuuuuuuuuuuuuuuuuuuuuuuuuuugagacagagucucacucuguccaggcuggagugcaguggugcgaucauggcucacagccgccucgaccucccgagcucaggcaauccucccaccucagccuccuaaguagcugggacuacaggcacacgccaccacgccuggcuaauuuuuuuuguagagaugagguuuugccguguugcucaggcuggucucgaacuccugggcucaacugaucugccugccucagccuccuaaagugcuagccucaugaagugcuaagugugagccaccuggcccagccacugcaccugaucuucaauucucccacugauuuucuuaagcauauuaggaaaaguaagauugaaaagaaaauuugugcaauaaaaauggucucgucuauaauuccagcacuuugggaggccgaggcgggaggaucgcuugaacccaggaguuuuaagaccagccugggcaacaccacaagacuccaucucaaauaaaaacagguaaaaaaaaaaaaaagaaaaagaaaaagaaagaaagaaagauaaauaaauuuuaaaaacggucucaggguucacucuaacaauucuuuugcuuauuacugggaaaagucuuggagguccuagaaaaagaauuuggcuugggaagguaagaggagagcaguggaugaucuggucugggaguagcugacuagauuccagcccuuugcugauuuucuuccuucuacucagauaagcaagacccugaggggcagcaaguaccagugguuucaguccccugucaccaggcauccugcagcaggcacaggacggaaguacauguccucacucccaccuccccaaacacauccugccuggcugggagggauacuguauuuaaaaacagaugacucuuuggaaacucacacauuuuaagucccguaaaucacacaugcuggguaaaguaauuacacuuuuguagcacuuccccucugagcacaaaggaaauucugcuacuucuguaauuagauagcacuuucuguguacacuuucucccagggggggccuccacugucuauccuauaggugggcguaagaggaauuuucacaaaacaggauccugcggauucaagaaaaaaaaaaauuggguagucuuuaggauuucucuuagaacaacauuggccacugccagccuaucuacccuggugacaugagaaucugggaaaaucaagaggaacgucacaaaaaaaucaacucaugagaaauaaaaguuaauuaaaaguaaaguuguccuauaacuuauuugcagagguuggugagccagaccucauuuuggagauucucagaugucuccuaccuuugcaaaacccuaaaggcugacagaauggaacuggcuaagcauucccuuugcauuuuaaauuuguguaacaauacuguauuacaaccuggaaugugaauccaucuucucggugugacuggcauuuaucacugccauuuccuuuuucucuuuagcauuuacacaauaugcaccgucaccauaauaggugcaguagaguuaaaaccuaagagaaauacaaaugcaaguuguuuucuuuuuaaguuccuggacuacuuugagcugacacuuagcugggcugaaaaaggcagcaaacuuuuaaaguauaaauugaauaaaaugaaaauauggccaggcaugguggcucaugccuguaaucccagcacuuuggcaggccgaggcggguggaucaccugaggucaagaguuugagaccaaccugaccaauauggugaaaccccugucucuacuaaaaauacaaaaauuagccaggugugguggcgugugccuguagucccagcuacuugggaggcugaggcagcagaauugcuugaacccaggcaguggagguugcagugagauggcgccacugcacuccaggcugagugacagcgcaagacuccgucucaaagaaaaaaaaaaaagaaaaugaaaauauaacccacagauuagaugucuuugggcugcuggccaaaggcucauccuacucuuccuuuuccccaaaaaagucaaaaaagauaaaagcaacuuagaaauuuuuuccuguaaaaaaacucacgccucuccagauuuuaugguagcuugaucuuuccuuuuaggugcaggguuggcaaauggagaguuggagaaguaaaagccugggaauuaauggcaaguuugggagguuuauaaacagguuccugaguuuugagcaaagcaaaaaaaaaagcauaugagaaagaccauauaucagauuuuucuaagcucccccucaggcuuuccaauggcuaaguauaccaaacccuuuaaaaacaggcagauuauauguaauacauuuuuauguuccuaaauuaauuuuuaaguuuccauuuuucuugauuauuuucaauucucuccccuucccaaacacuuuuuaacaugacucuaaauuuucacuaaauuuuguaucucuuuccuugcuaacccucacaacguuuccuagaaagcaggaauuccauuuucugggcacucacucccaguaugcacgcuuucaauuaucagcucuauguucuugaauuguucugaaaaucguauuucaagaucagaccucuccucugcaccccagacucaguaacaucuucaucuccuagguaccuucuuuucuuacccuuuccacaucucuauuuucuauuccuacaaauacaaccgucacuuagcuagccacccgaaggagaaacccaaaaggcugcuaggcugucuccuugccuucucucccgcacaucugacaguuaucuaggcccugaacaccuggcaucucugccucaguugccacugccaggcugcugccucacuuugagaccaggacucuugcagcagaaaccucacugcaagaaugguucucaacaacuuuuccaaaauucgccacaucccccugcccauugggacguccuagauugcugccuucuggggcacauccacccuggugccccaucagaggacaaaguccaauucccuaaugcagaggcagcucuuccacccacugugggccagugcccccuccccaguuucauucuuccuuccccuucuucucuccugccaugccuugcuugcucuuccccaaaagggucuuuugaagccucuguguguucauucacagagcgauuuccuugccuagcccaucuuuuccccacugucugaacccuuuucucaucagucaaaaucuuaacuga

SEQ ID NO: 15581 - RNA, 3501 nt, Homo sapiens
ucaguuaagauuuugacugaugagaaaaggguucagacaguggggaaaagaugggcuaggcaaggaaaucgcucugugaaugaacacacagaggcuucaaaagacccuuuuggggaagagcaagcaaggcauggcaggagagaagaaggggaaggaagaaugaaacuggggagggggcacuggcccacaguggguggaagagcugccucugcauuagggaauuggacuuuguccucugauggggcaccaggguggaugugccccagaaggcagcaaucuaggacgucccaaugggcagggggauguggcgaauuuuggaaaaguuguugagaaccauucuugcagugagguuucugcugcaagaguccuggucucaaagugaggcagcagccuggcaguggcaacugaggcagagaugccagguguucagggccuagauaacugucagaugugcgggagagaaggcaaggagacagccuagcagccuuuuggguuucuccuucggguggcuagcuaagugacgguuguauuuguaggaauagaaaauagagauguggaaaggguaagaaaagaagguaccuaggagaugaagauguuacugagucuggggugcagaggagaggucugaucuugaaauacgauuuucagaacaauucaagaacauagagcugauaauugaaagcgugcauacugggagugagugcccagaaaauggaauuccugcuuucuaggaaacguugugaggguuagcaaggaaagagauacaaaauuuagugaaaauuuagagucauguuaaaaaguguuugggaaggggagagaauugaaaauaaucaagaaaaauggaaacuuaaaaauuaauuuaggaacauaaaaauguauuacauauaaucugccuguuuuuaaaggguuugguauacuuagccauuggaaagccugagggggagcuuagaaaaaucugauauauggucuuucucauaugcuuuuuuuuuugcuuugcucaaaacucaggaaccuguuuauaaaccucccaaacuugccauuaauucccaggcuuuuacuucuccaacucuccauuugccaacccugcaccuaaaaggaaagaucaagcuaccauaaaaucuggagaggcgugaguuuuuuuacaggaaaaaauuucuaaguugcuuuuaucuuuuuugacuuuuuuggggaaaaggaagaguaggaugagccuuuggccagcagcccaaagacaucuaaucuguggguuauauuuucauuuucuuuuuuuuuuuucuuugagacggagucuugcgcugucacucagccuggagugcaguggcgccaucucacugcaaccuccacugccuggguucaagcaauucugcugccucagccucccaaguagcugggacuacaggcacacgccaccacaccuggcuaauuuuuguauuuuuaguagagacagggguuucaccauauuggucagguuggucucaaacucuugaccucaggugauccacccgccucggccugccaaagugcugggauuacaggcaugagccaccaugccuggccauauuuucauuuuauucaauuuauacuuuaaaaguuugcugccuuuuucagcccagcuaagugucagcucaaaguaguccaggaacuuaaaaagaaaacaacuugcauuuguauuucucuuagguuuuaacucuacugcaccuauuauggugacggugcauauuguguaaaugcuaaagagaaaaaggaaauggcagugauaaaugccagucacaccgagaagauggauucacauuccagguuguaauacaguauuguuacacaaauuuaaaaugcaaagggaaugcuuagccaguuccauucugucagccuuuaggguuuugcaaagguaggagacaucugagaaucuccaaaaugaggucuggcucaccaaccucugcaaauaaguuauaggacaacuuuacuuuuaauuaacuuuuauuucucaugaguugauuuuuuugugacguuccucuugauuuucccagauucucaugucaccaggguagauaggcuggcaguggccaauguuguucuaagagaaauccuaaagacuacccaauuuuuuuuuuucuugaauccgcaggauccuguuuugugaaaauuccucuuacgcccaccuauaggauagacaguggaggcccccccugggagaaaguguacacagaaagugcuaucuaauuacagaaguagcagaauuuccuuugugcucagaggggaagugcuacaaaaguguaauuacuuuacccagcaugugugauuuacgggacuuaaaaugugugaguuuccaaagagucaucuguuuuuaaauacaguaucccucccagccaggcaggauguguuuggggaggugggagugaggacauguacuuccguccugugccugcugcaggaugccuggugacaggggacugaaaccacugguacuugcugccccucagggucuugcuuaucugaguagaaggaagaaaaucagcaaagggcuggaaucuagucagcuacucccagaccagaucauccacugcucuccucuuaccuucccaagccaaauucuuuuucuaggaccuccaagacuuuucccaguaauaagcaaaagaauuguuagagugaacccugagaccguuuuuaaaauuuauuuaucuuucuuucuuucuuuuucuuuuucuuuuuuuuuuuuuuaccuguuuuuauuugagauggagucuugugguguugcccaggcuggucuuaaaacuccuggguucaagcgauccucccgccucggccucccaaagugcuggaauuauagacgagaccauuuuuauugcacaaauuuucuuuucaaucuuacuuuuccuaauaugcuuaagaaaaucagugggagaauugaagaucaggugcaguggcugggccagguggcucacacuuagcacuucaugaggcuagcacuuuaggaggcugaggcaggcagaucaguugagcccaggaguucgagaccagccugagcaacacggcaaaaccucaucucuacaaaaaaaauuagccaggcgugguggcgugugccuguagucccagcuacuuaggaggcugaggugggaggauugccugagcucgggaggucgaggcggcugugagccaugaucgcaccacugcacuccagccuggacagagugagacucugucucaaaaaaaaaaaaaaaaaaaaaaaaaaagaccaggugcauauccagauguaaucaaaccuguaaaaacacuuaaugguuuuugcauauuaauggauugauuaaacauuuauggaguuggugucuacucugcuuuuaacauugcucuuugacaaaccauaugaaguguugccaucccauguuuugggauaagaaagcuaaggcucugagagauuaaguaauuggucugagguuuuacagcugguggauaggagcuuaaaauucuccaguggcauaugagguucaugugauccgggcccugcug

SEQ ID NO: 15582 - RNA, 774 nt, Homo sapiens
cuuuuguuuuuuuuuuuuuuacuaaagaacacuuauuuauuuuuaccaaaauuuuaucuugaggacauggcuaaacugcguuuccaucccccaccccaucuugaagaaggguuacuacagugaacguuauaaagcagauauaaacaguggaaggacuggaaccaacauuaauugaggaagaacaacuuccaucuaaaucaucauaaaaauguuuaaguaaaaaaaaaggaagaaaagaaaaaaagagggggcaacggggguuuccaaauggaaaaagaacuucacauuucaucuaauacagccaaucuuggcuagaguauaacaaaguggaaacaggauuacuaugauacaaaacuuccgcuacagcacaccguacucaccuguguuccaagcccacccccaaccccccuaaugcuuccaauacaauuauuuaucagccuguugagccugccgaugaagaagcauguagaucuucucuuuaauccagucuuuuuuuauaaggcugguaugucuggguaucagcucgguaaaccaggcagcugaggucugccagaucauugaugaaaucaaacaacugacugaugucauauuugauagagggacuguugggauucauucuuuucacaugucuucauacauuuuacaaacgccuuccaugcauucauucacagauucguagucagcauaaguucugccuucuggccucuugguagucuguaucagcaaaauggugugagacaucgcgccaaacucuuugcuacagccgcugccgac

SEQ ID NO: 15583 - RNA, 2011 nt, Homo sapiens
agaucgucuuuguuuagauucugaccccauuuuguuguagcaagauaaguggcaugauuuaugauucccuggauuauguaaagaaaagugaacccaagcauaaacuugcaagacauagcccagaugagagaaaaagacaucaagaaaacagcaaaaggaaugcaaggacagaaugaagaaagucagggggccccaaaagccaguguuggugcugacaaaaaagaguccagauucugcaguggccgggcgcgauggcuuaugccuguaaccccagcauuuugggaggcugaggugggcggaucaccuuagguacagugucuaagacuguaccaggaguucaagacagcgucuaagacugaggccaggaguuagagaccagccuggccaacauggcaaaacuccaucucuacuaaaaauacaaaaauuagccaggcaugguggcaggugccuguaaucccagcuacucaggaggcugaggcaggagaauugcuugaacccaggagacggagguugcagugagcaacaucgcaccucugcacuccaauccgggcaacagagcgagacucugucuaaaaaaaaagauucugcaaugacuucaucugcggugauugugcagauuuuucgugacaggauauaauaaacuguaacaacuuuuuggguuuuuuuagagacaagauuuugcacuguuacccaagcugaaguguaauggugucaucaucgcucaagugcagccucuaacucaugggcucaagugauccucccaccucagacuccugaguagcuaggacuacaggugugccaccaugcauggcuauuaaacaaauuuuuuuuuuguagagaugggaucuugcuauauugcccaggcuggucucaaacucuggccucaagugaucuucccuccuuggccucccaaagugcugagauuacaggugugagccacugugccuggccuaaacuuuaauaaguauaaacuuuaauaaaacaaaacaaaauccuaacucauaagaucuuaaagugcaguaguaaggaugaaggguggauauaaagauuuuucugaguuuucacuuuucgaagggaaguguugagucuccuuucucugucagccucuggaaugcuuccggguagcacgacccugugaaaaggaagguacuugucuugagaggaugccuagggcgcucuucuagauccuugacacuagguucacagcacuuuucagucagaugacguaccaggagauuucaaagauguccuugcuagccagacuuccaggacggucaggggcaggcgguggaauaccuugggagggaaucgcuugaauggagggcaucaaagagagguuccagggccacuaaggcaggaacugagauuugucuccaggccagggggguggcucaugccugcaauuguaggauuuugggaggccgagggaggaggaucgcuugaggccaagaguuugagacugggcgacacaccaagaccccaucucuaaaaaaauaaaaagcuaaccaggcaugguggugcaugccuguagucccucccagguaggaggaucacuugaguccaggaggucagggcuguggugagccaugauugcaacucuauacucacccugggugacagagagagacccugucucaaaaaaaaaaaaaagauuugucuccaagguggaaauuuacaaauuuacccuggcuccuucucccgugauucuuuucuucugaagaacaaaaggaaggccccagagugcaaacagcauggcuacuuuagguguuguguggggccuaccagaucggguucccuggagugacaucugcaguaauuccuuugcugugccguucuaagucauucuccccaaggugucccuucucuuucagguaccucuuucuccugacuggaggaggugcccuggccguggcugccauggguuccuacgccgugcucgucuucaccccugcugucugcgcuguggcucuccucuguucccuggcuccucagcaaguccacagguggaccu

SEQ ID NO: 15584 - RNA, 13838 nt, Homo sapiens
agggagagaggaaaaggcgcaguaaaauaaugugcgcaguggcucacaccuguugucguaaccgagcgaguuauagagaaacaccacacuuugagacuaauucaggaguccuuuauugccggcgaccgagagacgacuacagcucaaaauucucucggcccugaagaaggggcuagauuucuuuuuauaccuuggucuaaauagggaagggguagucuagcugaagcaauuuuuacagaagcagaacaggcaaagaguuaaaagauaaaugguuauagaaacaguuacaggaaaauaaacaguuccaggugcauggggcuuaaauuaucacaaagagauaaacgcaggggcuuuggguaccaucaaccgagcgcguucccaggagcugcugguacagcuugccucaguaucuuaucaguaagcacauuccuggaugugcuuggugucagucugcaccaguuauguccuuaagggagggggacaaggugcugcaagcgaagaaaccaaaauggagucugucccgcucucucagcuaagagcgagucaaucagguuaaaacaagguaggguaucaagcuguaaucccagcgcuuugggaggccgaggagggcagauccuugagcucaggagaccagcuugggcaacaagaugagagucucacaccccgcccugucucuacaaaaaacaaaacaaaacaaaacaaaaaaaagccaggcaugguggcucaugucuguggucccaguuacugcgaggccgacgugagagaaucacuugagcccuggagaucgaggcugcaguagccgugaucacacuccagccugggcgaaagagacccugucucaaaaaacaaacaaaacaaugugaaauuaagccaaaagccaucacacgugcauccaaaggacggccgcuacccgcgaccccuucccaacgcacgcgggagguugcgggaucagggacaggggcuucagcagggagcccccagaccggcccugacaggaauucaagaccuggcgccugcucauucccccagucggggcggcggcggcaagccucggccggcggcgaucugcacacccgcggagaagagaggcagggggucgaccccacagcccagcccggcgcgucccccgcgcccccgcgcgagcccgagucgccggcggaagugcugcgucgcgcacuuccggguguugucuggccgccguagcgcgucuugggucucccggcugccgcugcugccgccgccgccucgggucguggagccaggagcgacgucaccgccauggcaggcaucaaaggugggccuggguugcaggacgcgggagggcuggggccggcgggggaagaugggccgggggucccacgcggcccccgcacuuccccuccgggcucgcgcgcgcgcguggggucccugcgccggggaagcgacccccgccccggcccugcgcuuggcccggaggugggcgcggcgcccucgggcaacggacgguugcgaccccggcuucgccccgcagcccccacuuucugccgauuucggcagccucucucccacccaucgccccccggacaaaauaugaagugguuggcggucagugaggagucccgucgcgacuuggacggccacacacguuuugcaggaguuugcauccgagagagaggcaggcagagcgugggauugagaaggcugaggcugcuagagaugccagcuauggaaaaccagucauuucccaccgaaaggcacaagugcggucugcgggcgcugcacgggucugcccgaaaccucgaccccacguccaccccggccgcccgcgcccgaggcuuuacaggcucccgaaacgggugcauuuucaucugcggugucuggacccuagaguugauccuguaggcgaccccaaagugcuccuggcucucuucccucuccgcaguugcacccugaggcuuuuucaaauuucaaaauuuuucuuuuuuuccuuuuuuuuuuuuaagaagauaaaauacugguacaacuuaaugaaaaacuacuggcuuauucauguauuuucuuuuaaaaaaaggaauguugcauuuguuccaccuguuagguaguuuuguugucagugugaugagaagcaaaguuuucagcuacugcuuaacuaauuacauugauuucuugaccugccgcucuguagaagggcagucaggcaggaagcagguaacuuugggagcagugguuuucuuuguauuuuuucuucucuaaggaaaacuuaaucgaguuuuuuuucagggucacagucuuacuguuucuuguuuauuuucaaugucugaaaacauuucauuucccauauaaaaccuugucauuuaagcaacugggauacuuuguaaucuccuuuugaacuaugauagacucuaaacccuuaugugaaaggcaguuauugugaauugcugugguuuuuaggauguugcccguuucccuguucuucccuguuucuucagugucaauaaugcgggggucucuuaagaaaauagcuuuguaauuuacuucuccagaccuagggaaauacugcauuaaacugaugaaggugccucaggugaacugcacuuuugauuucagcaggauuuucugguuguuaugagucaguauguuucuuucucuuggccuaauaucuuuauauuaggaaggaguguugcuguaauuagagaccauuaggcauugcuugagccauuugucuauuacuuuuugauauauuggauuuucugguaacucccagguuagagaaguggucccuccuucuacucuaauuucuuuguaaucacagaaucagcaucuugucucuagagaguuuugcuagauaauugggcugcuccaugccuagccuagaggcuuugggaguagaacccagacuuaucuaagcuuugucuuccaaauguugcaucacucaauuacuguaugaauucuugccuuguugaugugucauuuaagaaacagcuuauauacaaaugaugaaguguauauauaaaucuuccuaguugccaauuucauaagauugaagaaacugcaaguuuugagaacacuuuuaagcaauuuauuuaaccucuaauuggcuaccuuauucgguaugacuggaagaugagaugucacaucaaacuguguuaugaauauuuaaaaaaaauuuaguauuuaauccuggcgcgguggcucacaccuguaaucccagcacuuugggaggccgagacggauggaucaugaggucaggaguucaagaccaaccuguccaagauggugaaaccccaucucuacuaaaaauacaaaaaaauuagcugggcaugguggcaggcaccuguaaucccagcuacucaggaggcugaggcagggaauugcuugaacccgggaggcagagguugcagugagccaagauuacgccacugcacuccagccugggcaacagagugagacucugucucaaaaaaaaaaaaaauauauauauauauacacacacacacacacacacacacacacauauuuaguauuuaauggaguagaaguauuaucucaagguaucuugauucccccaaacaaauguuauuccaguauucauauucauagcacuuacaauaagacaaucuugguuuauguuuuuaaaauuguuuuuugauaccugagccuuaucucauuuuagucccuugguuuuuuuuuuuuuuuaaggaaucauuuuucauuaacuuuguaagaguguaaucaaagaauuuaggccuucuuuuuugauaaaaacuugaaugacuguucucugucacagaacagccaccuucagaggcccucaugguccuaagguggcuugccucuugcggagauuaccgugaacaugcuuuuugagauuuuucugccugguuuaaauuuuuuuuguuguuuccucccuccugucaaagggcaauucuugcuuguaugcaacucuuucuccuaauucccauuuguuucagugugggaagauaaacuuagaaaauuuugugucacaagguauauagguaauagugauuacuuuugauaagagaaaguuccuuuucacuuaauuuuuguucuggguauaugaauuaccuauugaaaaauauauauaagugagcauagaugauucuuuaaaauaaaaauguguuuuacucugaauucccaucuaacaauugugucacgaaaaugaguuaguauaaauaagaacuuaagggucuguuuauagagaauguuggcuuuaguauaugggcuuuguaacaucuauuuugucucuuuuuaguggccuuuguuuucuccaggauucuaaguugcguauaaauggcuucugaaugaaugagguguuacuagguaguauuuauaguaauggacuuagcugucuuaacaguaccuuuaguguucagaaaauuaucugcauuuaagaucuaguccaacugucauuuuagagaaggaagaacugagacucauaaauuacuuggacaacuaguuaguaacuauuagggccuuggacccuccagagucucaguuccaugcugcuuccacucugcuacauucauuccacaaauauuuguugaguguuaagagccaggcacgaucaucacaacagaaaaacuugcucccuccuuucgugaaauggacaguugagaaggaaagacaaaauacaaaccaguaggaaaucgcagcugauaauugagcaaaggagaggcauucagugaacagaggaccucagcauacacgggucucugccaggaauacucaucccaaauacccacaugauuuccucccuccccucauacagaucuuugcucagguggugcuucaucagagaugccuucccuggccacuguaucuagacuagcacucccaucccuuacucuaccugacguuugucaucacuugacauuuauucacuugcuuauuaaaaaucauuuucuucucccacuagaacgugagagcaaaagcuuugauuguugucauugcucugucuccaguagcaagaacaguaucugacacacguuaggugcuccauagauguuuguuagaggaaugaauaaauaaauauaacagggaauuggucuaaucaggagguuuggaaaaacuucacugaggccaggugcaguggcucacgccuauaaucccagcacuuugggaggccaaggugggcagaucgugaggucaagagauggagaccauccuggccaauguggugaaaccccgucucuacuaaaaauacaaaaaaaaaaaaaauuagcuaggcaugguggugcacagcuguagucccagcuacucagaaaggcugaggcaggaggauggcuugaaccugggaggcggagguugcagugagucaagaucgcgccacugcacuccauccuggcgacagcgcaagacuccauuuaaaaaaaaaaaaaaaaaaaaaaaaaaccagcaaaaaaacacuucacugguugagcugagaucugaaggaaaagcaggaguuaaguuggaggaaaguagagaggagugggaaaggaccaugccucauucacuguuguaucccuagugcuugucacauauuuagugcucagugaauauuucuugaaugaaaaaaugucugaggcagaagggacaaagugugcacaggccacgugagugagcaagucugcugauuuccaggaaaggaaagagggccaguauaacugaagugaggguucagggacacuguaguagccuggugugacacgucacaggagaggugggcagggcccggucaugagaaccaauuuggaacugaagaaaacaaaugguaaauucaguguuuuccuuacaguuuauauugcauuccccuguaaacuugaagugccucguuugcuguaaaguaaaaaugcaauucuuuuccuguagcuggaaauagaaugguauucaggacuaagugauguguucgggguugccaugaccugcaucagcgaucuaaccaaaaaccaaaucugccaagccacuaugucaugggguguccuugauuaugacuguuuuaguugugcagaguauaucaguaguacuuggcaaaguuuaacuuguuuccuguucauuuugguuucucuauguuagccuuuguuuugguaacuuuuagaccuucuacaaaucuuucgaauuuuaacuuuugaauuuuaauaaaaugaccuaacaacaacaaaacuaguuauuuucuuagccacuguaacuguagaaauacagguuauauagaacucaaaauaaauuuaucauuuacuuauuuauuuauuuuuuuugagauggagucuugcucugucgcacaggcuggaaugcaaaggcgcagucuaggcucacugcaaccuacgccucccggguucaagcaauucuccugccucagccucccaaguagcugggacuacaggcaugugccaccacacccagcuaauuuuuuguauucuuaguagagacaagguuucaccauacugaccaggcuggucucaaacccccaaccucaugauccgcccgccuuggccucccaaagugcugggauuacaggcgugagccacugcacucggcuaucauuuauuucuuugcuuuagucuaggucauugguuaacuaugccuauucaagaaaguuguuucuauucacuaacgugagagcaccuuaaaauguacugcugugugugugugugugugucugugugugcgcgcguagcuuuagaaacuauauuucaccuguagaaugcaucuauugcuuauaauaacauguuaaaguagugauaccucagaaggauuauaacccauuguccuacagauuuucuaauguagauuagggaaggaaacccagcucuacuuuugcaaacuauuuaaagauuugcaacaaaauuaauugauuaaaaucauuaacuacagauauucucgggcauuuuuucuggucaguuuuaugcacauugagaguguaugugccagaaacaggagcugauuagaagagguuuuccuauaggaugagguuucuaaaguccaguaaacuugagcauguggaguuucuccacauacugcuuuucaaaacuguagugaucugugaaguaaauauaauucuaaugcccagaagagcauugagccuguggacuuugacucuuuagaaagggaaccagcgucuggggaauauggugggguacuagcaguagguuagagcuuuaaaaaucggugucacuggcuggaugugguggcucacgccuguaaucccagcacuuugggaggccaaggcagguggaucaccugaggucgggaguucgagaccagccugaccaacauggagaaacuccaucucuacugaaaauagaaaauuaacaggaugugguagugcauuccuguaaucccagcuuacucaggaggcugaggcaggagaaucacuugaaccugggagguggagguuguggugagccgagaucaagccauuggacuccagccugggcaacaagagugaaacuccaucucacaaaaaaaaaaaaaaaaaaaaaaaaggccagugucacuucauuuugccuugaagauaccacagaagacuuauucuaagacuagauaacuuacacuucugauggcaacuugcuauuaauacguuuuagggauuuuugcuucugagguuacagauaauguucagacugcugauauuaauaaaaauaauauuuaauuuauauuccuguugcacuuuuuauuugcuuugcagcuuugauuaguuuguccuuuggaggagcaaucggacugauguuuuugaugcuuggaugugcccuuccaauauacaaguauguaaaauguuugucuuucugaauauuuaaggguaaaauuuuucuacuuuuaaagcuuaaaaaaauguuuuuuuacuacuguaaaaguaaugcagagaaauguucacuuaccaaacacauaccuuuguaaaaaucaccacuuaaaguuuguuucuaaagauuuuaggacaccaagaugcaaauaauauuuuuggcuguuaccugcucuuucacuacugcugagucugcaguggcaagauagcuacacaguaccucagcccuccugcucaguuuuuaacaucuauugauaauacuaauuacaagaaaauuuaaaaugucuuuuugcaaaaaaauaccauaagcagucaaaacacaauuaaaaaaaaagagagagauguaaacaauuacuuuccggccgggugcgguggcucacaccuguaaucccagcauuuugggagaccaaggcgggaggauugccugaggucaggaguucaagaccagccuggcuaacauggugaaaccccaucucuacuaaaaauacaaaaaaauagccaggcguggugacacaugccuguagucccagguacucgggaggcugaggcaggagaaucgccugaacccaggagauggagguugcggugagccaagaucacgccacugcacuccagccugggugauagagcaagacucuguuuccaaaaaaaaaaaaaaaauuucuuuccuuaggauagaaagaacuucucaaaguuaacauuuuaacauuuagauaaauuagaaaaagauggacaacucaauagaaaaauaaauacaaaaagagaacuacaaauugcuaauaagcacauaaaaauauccccagccucacucaaaacuaaacaaaaucuauugacaaagacaagagacagggcaagcagggacucuuuugugcuguggggggaguacacauagauaguuuucuuggagauaaguuugcuuguagcucucaaaguauauauucuuugaguuagcccuuucacuuguuagacuuucugauacaaacccacuugcagauguuuacaaagauauauuuagugggggagaguauggauguucaagcagccuuguuuauuuuuugguuuuuguuuuuguuuuguuguuuuaugcguuauuuauaagagccaaaaaaaauucugaaaacauccuaaauguccuucaaaagaaaaaugguuaaauuauaguaaaucuuuuaauggaaauacuaggcagucuuaaaaagaaugaggaagagcuguaagugcuaacauguaaauauguucaagacauauuguuagaaaacugcagggacccauucauauuuuaaaguuuauguggaaauguggaagggucccugagaagcucaauaggaaagugggcaagaggagauuuggaacuuuuagucuuuacuuuuugugcuuuuguacuguuugaauuauuuuucuuaagcauauauucaauuuuuaauuuuuuuucuuaaaauauuuaggaaauggucaggcgcaguggcucaugccuguaauccuagcacuuugggaggccaagguggguggaucaccugaggucaggaguuuaagaccagcuuagccaacauggugaaacuccaucuccacuaaaaauacaaaaauuagccgggcaugguggugcacgccuguaaucccagcuagucacgggggcugaggcaggagagucacuugaacccaggaggcagaaguugcagugagccgagaucaugccacugcacuccagccugggcagcagagcgagacucugucucaaaaaaaaaaaaaaaaaauuuaggaaacauaaguagcugcuuaucauuagccucuguacaaucagaucuccaccaugauaccuauuuuauucuaugguaguuuuaagggcaucuauuucuuuuuaacuuuuuauuuugaaacaauuuuagauucugaagaaguugugaaaaucauacacagagguccccuguacccuccacacagccugccagagucauaagaucuuacauaaccauaguuaucaaaaccaggaaaugacugugguacaauacaguuaacuagauguagaguaaaagccaucuauuuuuauugugauaaauucuauauucugacugaaaguguucuuacuuuuagcuucuuuucuguauuuugauuucuguaauuugggaguuccucguguuguaagggaaguuuaggguuguuucagcuuuaugcuaagguuggguaucauccauuagaagucaagcgauugaaucuugauuuuuuaaaaagaccauauuuuguguguaggaaaaugacauagcaaaaauuacauuaacuuauuuuucuuuuucuagcaaauacuggccccucuuuguucuauuuuuuuacauccuuucaccuauuccauacugcauagcaagaagauuaguggaugauacagaugcuaugaguaacgcuuguaaggaacuugccaucuuucuuacaacgggcauugucgugucagcuuuuggacucccuauuguauuugccagagcacaucugguaagugaauauauucuuccauuaaugauuuuauauugaacauguguuacauuuuucucaagcaaaguuuuuguuaaugacaugaaaagaggugaaagacauaagagccuagaagauagagauuaaaaucucacuuuauuguuuguucuuguuaacuaauaaaagugauauuggagaacguggcuuggaucugcagcagcuguuggcuugcuaauacuuuuuuuuuucuuuuuuuuuuuuuuuugagauggagucuugcucugucgcccagccuggagugcaguggcgugaucucaccucacugcaagcucugccucccggguucacgccauucuccugccucagccucccgaguagcugggacuacaggugcccgccaccacgcccagcugauauuuuuuguguuuuuaguggagacgagguuucaccguguuagccagaauggucucgaccuccugaccucgugauccguccgccucggccucccaaagugcugggauuacaggcaugagccaccgcacccgucuggcuugcuaauacuuaacugucagaguugagcauaucaacucccccagugcugaacaacccaggccuauccuguaaaaccuaaaauauggaagaccugagaaggugcaugugcucugcaggcagaaaagcacugaagaggggaaggggcuggcuacggguacucaguucuuccucccaaacucacugauccacgcgccuucaucucuggggagguagagaagacagccauauggagaaggcaauuguuuucccaccccuucaaaagaauguacauggguguguuuccaucugugauaugcuaaaauuuaaucuacucuagauagauuuuuauauuaaggaagaguaagcacauuccuuuauaaacagaaacuuguagaauuuuaugcugcuucuucauagcccagaagucaagcuuguuuuugaauggucauuucaugacuuucuuuuuaaaggaaccaaagguaaaugaaaauacuaguauaaaaguaccacuuuuauacuauaaauauauuuauacuguauauauuuauauauauuuauacuauauauuuuuuuacuauauauauuuauacuauauauauuuauaaguauguguucagcacugugacaauuauuguuacaaggcaugcuucuuuuagaucauaauugggauacaacuagagccuugauuuuuuuuuuuauuuuccuuucguuuuucaugccuguugacugaguguaucuuauuuccauagauugaguggggagcuugugcacuuguucucacaggaaacacagucaucuuugcaacuauacuaggcuuuuucuuggucuuuggaagcaaugacgacuucagcuggcagcaguggugaaaagaaauuacugaacuauugucaaauggacuuccugucauuuguuggccauucacgcacacaggagauggggcaguuaaugcugaaugguauagcaagccucuuggggguauuuuaggugcucccuucucacuuuuauuguaagcauacuauuuucacagagacuugcugaaggauuaaaaggauuuucucuuuuggaaaagcuugacugauuucacacuuaucuauaguaugcuuuuugugguguccugcugaauuuaaauauuuauguguuuuuccuguuagguugauuuuuuuuggaaucaauaugcaauguuaaacacuuuuuuaauguaaucauuugcauugguuaggaauucagaauuccgccggcucuauuacuggucaaguacaucuuuucucuuaaaauuauuuagccuccauuauuacaaaaaauuauaaaaauaaguuuucagucagucaggaugacaucacucccaauguuaugcagacauacagacgguuggcauacguuauagacuguauacucagugcaaauauagcugcauuuauaccucagaggggccaaguguuaaugcccaugcccuccguuaaggguuguugguuuuacugguagacagauguuuuguggauugaaaauuauuuuauggaauugcuacagaggagugcuuuucuucucaauuguuagaagaauuuauguuaaacuuuaagguaaggguguaaaaacauuuuugagauaagguuuuuauuuauguuuauuauuguuagagugaguugcaaugugggaagaaaugacauugaaauuccaguuuuugaauccuguuucuauuuauaagugaaauuugugaucuccuaucaaccuuucauguuuuacccuguuaaaauggacauacauggaaccacuacugaugagggacaguuguauguuugcaucauauaugccagaaaaccuuccucugcuuccuccuuuugacuuauuugguauguuguauauauuacauaaaauaacuuuucaaauauaguuuaauaacacuuagaaguguuuacuuaccuggaaaauaauugcuaugccguacauucagagugcccccuccccugcaaggccuugccaugauuaacaaguaacuuguuagucuuacagauaauucaugcauuaacaguuuaagauuuagaccaugguaauaguaguucuuauucucuaagguuauaucauauguaauuuaaaaguauuuuuaagacaaguuuccuguauaccucugaacuguuuugauuuugaguucaucaugauagaucugcuguuuccuuauaaaaggcauuuguugugugaguuaaugcaaaguagccaaguccagcuauauagcagcuucagaaacauaccugaccaaaaaauucccaguaaccaggcaugaucaauuuauaguggucguuuacaucuaauaauuaucaggacuuuuuucaggaguggguuauaaaaacauucaaguuggucugacaguauuuuguuaaggauauuuguuuguauguuuauucaguauacuuacauaaaaauuauuucgccaucagccaaaacucaguaaucaugacagcugucuguuguuuuaugaaguuuauuucucaagaaaaugggaauaaauuugggauuuguucagcuuuuuuacuaaagaugccuaaagccacagguuuuauugccuaacuuaagccaugacuuuuagauaugagaugacgggaagcaggacgaaauaucggcguguggcuggagccuucccacuggaggcugaaaguggcuugugguauuauaauguucagauuucaagaggaaggugcagguacacaugaguuagagagcuggugagacaguugggaacucuuugugcuugugaucuacuggacuuuuuuuugcaggaagugcauucucugguccuucccuauuuucuguucuggaugucagugcagugcacugcuacuguuuuauccacuuggccacagacuuuuucuaacagcugcguauuauuucuauauacuaacugcauuggcagcauugugucuuugaccuuguauacuagcuugacauagugcugucucugauuucuaggcuaguuacuugagauaugaauuuuccauagaauaugcacugauacaauauuaccauucuucuauggaaagaaaacuuuugaugaugaaacaauaaagauuuuaaauaucuauuuuag

SEQ ID NO: 15585 - RNA, 629 nt, Homo sapiens
auuagcacaaacacauuuauuuauuaaccaaagggaugauccuaauuaauccaacacacuuugaaauagcugcauguaaaauguuuaugauaaagauaauugaacacaguaaugaaaaaaaaaagaaagaaacaguauggagauuugcucauugaacugagcuuggucauucucuuaauuaacuccuguccaaagugaugauggaauuuuuauucuacuuuuucauagauccgaguacaggugacauuguucaugacacacuccaccacuaauuucccaucuuucaauuuucuuguuauugugcuuuccuucccaucccacuccugaugcugaaccaaugcaccaucuguaaaguugcagacagucugaguuuuucugccaucagcugugguuucuucaaacuucucucccaggguacaagaaaacuguguuguuuucaaagugcucucaguuuuuauggugagguuuuuaccaucacaagugaugauacaaucuggcuuggccauugcgcccauuuuucgcaaagcuauucccacuccuagcuccuucauguauucaucaaagccuuugcuguccaccaggcgccaucuuccuuccagcugcugaacuguggccauggugggugcggg

SEQ ID NO: 15586 - RNA, 629 nt, Homo sapiens
cccgcacccaccauggccacaguucagcagcuggaaggaagauggcgccugguggacagcaaaggcuuugaugaauacaugaaggagcuaggagugggaauagcuuugcgaaaaaugggcgcaauggccaagccagauuguaucaucacuugugaugguaaaaaccucaccauaaaaacugagagcacuuugaaaacaacacaguuuucuuguacccugggagagaaguuugaagaaaccacagcugauggcagaaaaacucagacugucugcaacuuuacagauggugcauugguucagcaucaggagugggaugggaaggaaagcacaauaacaagaaaauugaaagaugggaaauuagugguggagugugucaugaacaaugucaccuguacucggaucuaugaaaaaguagaauaaaaauuccaucaucacuuuggacaggaguuaauuaagagaaugaccaagcucaguucaaugagcaaaucuccauacuguuucuuucuuuuuuuuuucauuacuguguucaauuaucuuuaucauaaacauuuuacaugcagcuauuucaaaguguguuggauuaauuaggaucaucccuuugguuaauaaauaaauguguuugugcuaau

SEQ ID NO: 15587 - RNA, 3600 nt, Homo sapiens
agcuaucaaggcacaagcucuguuuccuaaggaaagucaccccaaacagcuauuauauaaacuacaaaagaaguagauguggacauaauuaagcacauuuuuauuuccaauugaaauacaguuggaaacucuuuagggcucaagucaaaacuuuuggcuuuguucccugguccagaauucaaaacaauuucucucucuggaauuguaaucguuuuuucugaagauuauugaauucaaauagcuugauauggaacuaaucuagucuaguugaauuuuuggaauucuuuaaauucucaaaaagguugaauuuaucuggugcucaguagaugugaacgagcaacauccuaagguguucucugagcucagaacacccaaauuguuuucuuccuguagaauuguuguuaagcccugaggugcaaaauuuucccucccucccucccuccccuucuuuuucuuucuuucuuucuuuucuuucuuucucucucuuucuuucuuucuuucuuucuuucuuucuuucuuucuuucuuuucuuuucuuugcuuuuucuuuucuuccuuuuuuuuuucuuaaauuaucucauaguuuuucguacuuucagauggguaaauugaaacauuggaaggguaagcauuggacuugugucuuggucacaaacgcagguuuugggggacaaaggcagaaguaaaagacagaucuccuucuccaauucaaggcugugugaauucuacuacugagcccucuaugaaacauuaacucagugguucauccccugggggaccugggaccguaggaggucuuuaaaggaagcaagagagauuuuuaaauaauuuucauuuuuucaagaaguucaacagacuuugcacauuucccaaaauaaaagugcaugaauuaaccagaaugucaugguauuuuugcuuuugauuagaguuaaauuaauucaguuugauaacauugaauaucauccugaucugaagcuuugauuacaguuauauaugccuuaaaugauuaaaaugugaaaauagguuaauuaugucuuaauaaauucaguuuauuugauacauagaaauuuauaaaaccugaaacuaaucagaacaaaauaugacacauuuucacaacucccuaugaguaucuuaaacaaguagaaugcuaaggcauaugaaacucuaaaauguaucuauuucaagauuuuucuggaagauuuuauauauuuuuuucugucuagcugccuuaacaugaacaguauaaagccaaauuauucucucuuauacauuuaacauuaauuaugacaacaguucauugaccaauguccaccaaugauggacaucagcuguuuaggauuaauuauggguguauugacuuuucuaauccccacuuaagggguugaauaucuguagaugcugaucagacauuuaaaagaggguaacaacaccaguauuauauugagaaacaaugagaaaagcuaaguuuaauucaucauucugcuaaaagucaaucaauaacauuuuucauguguuaacaacaguuaauaaagacaguuaagccaguuuggaaaguauaaauggaagaauaacuuccugauuucauaugacucauuaggcucaucaaaagacuuuucuucgaggaagcacucaacuugcuucuuugagcuaauguuacagguugugguuuucauaaucaugccgugaucgcuguggcuuugggcgucacuuuucugacgcaccuggcuccaucuguuuuagauacacaguccagaguucacauugcugaagggcaaugacugagaucauuguuuccucaaggugugcccuuuaaaggcuaaaucgauggcgagaugggauaggcucuagggcugaagaacacaugauguguuaaguuuaggucacauucuuuccuagauaucuggacaccagauaugauuauggaguauuucuuuguccuaaggcaaggucgugcaugaccuccacugcugucugcaugcaggugcccaugaacuuggaggcaacaccagaauguucuaaguauuaucacucacaggaauucauauuuguaugauugcugaaugucuguuggagcauauuacauaaaauacugccggugacggaagcugcuuaaucuacucagaguccucaugugcaaaggaaggguaaggcagauggucccuaaggacuccccuacccccaggcucuggccagcuuucuguaacucuaagcuuccuugaauagaaagccucagaauagagauagccugguacgacacucuugaccaaguuaauaccagacagguggcaauuuacaugugugagaggcucucauuugaaagugggaaagcuaggugaacacaaaaccuaugccuccaaguauagauuuuaaccuuaaaaacagaaguuucacacacggaagacuauucuuuuccuuucauuguuuugugccaguguagaaaaugaccaauaaugacacuuguaaauaucuucacuggaaucuuguaucccugggacuuaaaggguuaacaguuagaagacuuuaauuguauaauuuucuggguucccagacaugccuuuaaaggucuucacuuccucuuugucuuucauucuaagcucucucuccugcacaagaccugcagggccuggcaucugugagcacuccaauaaguauuuauuacuaaauucaguugucauucauuuagaauguacucggugccagccccuguuuuucuaagccugucuuauuuaaccuuuaccauuaccucaugauuuacucuuauccuuauuuuacagaugaagaaaugcagauuuuugggaggcugaguaauuggccugcaguuauauaaauguggaaaagcaggcuucagacuaaagcacguuugacucgagagcuuguguuguuaaucacuuugccaucuugccccccuuccuuuuguuguauagaugaauaauaugugcucuuucacuuaaugaaaagugugguuuuggcagaucuccucugcuugaacacaucuucugugguggagaggaaggggcuuggagguaggaauucucucaccagcuucaccaggaaaauagaaauauagaaccuaguaccuaguauacgaccuagaaagagcagauuucacucaccaggagcaaagugucauguagggacauguagaaguuuaaaaauacauacacauaaagcaaauauccacauuuuauagggguacaaccaagcaaaaugauauauauuaaauccacuggaugguugcucuuggggguggaaauaggagugaagaauagaguuagaagacaguaaauaaauacauaaacaggaaaggggccuucuaagggucuaaugaugauaauguggugugagcugagaaauacaauuaacacaaccuuuuacacuugagcacgucuccucccucuuauaagauucaaagcaagggaaaaguagaucaagucaagacaauguguggaagggcuaggaagacaugaaugagugccuccuuuuucacauucaggaaucauuuacuuaguccuaagauggaggggcuuucauauaaacaccagcuacacacaggcauaagguuagcuccacugggcauugaauuuuugccagagaauaaaaa

SEQ ID NO: 15588 - RNA, 17804 nt, Homo sapiens
agaagugguugaaaauguauuuauuuuuuucaaaugaucuuuuucaagcaauaaauaaaaccagacauauugacuucuaaaaaacaaaaccaaacaaaaaaaaaauccccuaaacuauauacauccuacaggaauacaggcauuaucaaauguagaaaugguaucacucugaaagauggggcuauuuacacaaguuacaagaauugcguugcugucuuuaagaagucuccuccuugaauaacucauaaacucuaagggagagagaguacugguggggaagcgggguucaaagaggagacauccuccaucuuuauugauggacaagacagucucaaggaaaaacaucaauauccaaacaccguauugagucccuuaacaaggcuccacagaucagcuggcuuucaaaaagccuggaagggugcuccacucaggaacucccaagagaaaccaucuugucccucagccaggcugggacuggcagugaggccaugcugagccaguggcaaacccguggcugugguuuccacaagacaaccuggcucugugcugucacacccagccuccaacagcgccuugacauccaaaaagcauggcaguuucccaagcucggcugcacagggaaaacacccggggagcuacgaaacacacugaugccugagucccccaccuagaauugguugaacuggucuaggagagccuggguaucagaacuguauaaguuccccaaguaauuccaaugcgggaccauggcuuuacuacuacaggcuugguugauggccaauucccaaucuccagccucuuccugucauguuggagucaacuauccuaugucccucucuccaucuucccaagauuuaaaaaccuuucucauggcuucccaaauuggaaaacucucuggaauccagcguggaugagcaacugaacaaaauggcuuugggagggaaugaugggagcuggggccuaccagucaccugcucuucagccuaauacugcucugugggaaaacuugguccauuucccccagggcuccucaacacacaccccugggucagacguucugggagggaauaggcagcauuccucacucuacagaacacccaaugagcauccugucuuucauggcuaauaccaaaguugacaaucaaugagggucaaugcuuuccugucauuacagaaacuucccaucaccagaaucccuucaugggagggauggaugccuguugaaacucacugaccuauuggacugacgcuggggugguaucuucaucagagcuauuguaagucauccaaaaggcuucugacgaaagaacaauuuuuaaaaagucccucuuuucaaucaagccaauguccuauuuuauuucuaaaaguuuugggacucgugcuguuaucaaguacaaugaaaauggcuuuauaaauagcuguuuugacauugugauagaaggcuugaauucggaggaaagaugucgcuggagcuaguccugaguuccgacugucccuguggugggaauccagucugggaaagcaggacuguuuuagcaaacguguacucguucuauaaaaauggaaucuguucugcagguuaccgucccuccccgcccaagcauccccucuguccugucucucugcugcugggacccagggcuuuuucagcugcagaacccacuggacuuccaggaaucaaggaaaaaguggaaauguccaacuguguugucucuaaaugguuccauugucugggaacugaaacccuccaugcuucacccugaacuguuauuucuagaggaagcagggagccucuggcucuucuaaaaauugccagugggagcucuggccucacccacaggcggagcuuggugaagucaggaugaaugaugccgucacagguucaugguucauggaaggaaagguaaccaaccuuguccugucuaggaugccagaugagaaagaguaucccaacgugacggugacauugaggcuugacguuauuuaugggugagcaagaauguucauuagauguagacucucaaagggcuaaaaaaaaccaugcucucacuucuagacaaguuugcaacaaccucuaagcuggcacuccauaacaagacuguuccacaauacuacaaacaaaauagcauguagcuuguucccuccucccucccccccaaacccuccccacagaaaacgugucucccuccaaagccauucuccauuuagaaaggcccaacuaaggauucaaaauggcacccacgugccgacgauagauucaaaauggcgccugcgugcccaugacgcacgucacgggagccagcggccagcccccucaccagcagucagccccaaccccacccuggcgcuuugauuuccaguuugggaaauucauaccaauggaauccgauguaagcaauccaccaucagcucacugaugcucucuugcccuuccacacuucgagaagaccugaaaugugguguccauuccccucuuuauucaaaagaggaccuucaaaaauauucaccuaacuaggaauuuaaagaacacaagaaauuguugguauauuucacuucagguaacugcccuaaaauuaaaaccuccaauuuaugcaaaaaaagaaaagauggugcuucaauuuacaaaaggauucauuucaggguuaucucuaguugucugguuuccccaauggcuggccuugccaaaugauuugcuguaggaaaauuugaacugcacccaauuuuccaggagcaccuuaguguaauauggcauauugaucacagacgauagacaagucuuaggcagguuuaugcaaaaaaugcugcaaccacccagugaucaucggagggaaaaaagcuugacuuacuguggucuaaaauugcuucgguggccuacaugcccaugaaccagcuucaaaagcaauucacauuggucaugaugacacacaccugcagucccagcuacucaggaggccgaggugggaggaucucuugagcccaagagcuugagaugagccuuggcaacauagugagaugcugucuuuuuuuuucuuuucuuuuuuuuuaaaaaagcaauucaaaccuaauucuucccuuucuuccuccucccacccaacccgccugcuucucaagaugagccuuggcaacauagugagaugcugucuuuuucuuuucuuuuuuuuuuaaaaagcaauucaaaccuaauucuucccuuucuuccuccucccacccaacccgccugcuucucaguggcaacaaacucaaguugcucaucaugcuaccuugcacauaucuacaagacaccauuuacuuccuaacugccuugacaucugcaugcuacggugcucagcuguuugacaucaacauaaauauauucuaaauccacuguaacuagacuuuuuguacuuucauacucugaagaaagucuuaauaaauacuuuauuauuaagcauaauuauucaucuguuggugacugagaaaugaaaaccacaccuucgaagauuucuuuuaaaaaaugaaauuccuuuaacuacaacaacgacaacaaagggacaaguacacagaaccaggcacuucugggaaacuugucuucucaucccuuugcccucccuuccucccccuuuaguaaagcugguugggcacauuugcuaggaucuguggguuucaucacuucaagccuuacugcuuaaaaaaaugagguaagaaauuucuaucggaaaagugaaacugacacauaaaccaaaccaaggucuucccuggcugcugcggcagccguuauugcucuaaguuggaguguucuguuugcuuuuauuauguauucggaguccuuauugccauucuggcuggccucgucguuggccaaggagaaaugauggggaaggagcucggucgccugcucccagcugcucagucccaacuuucugcccgcaugcggcccguccuacccuugcugggagccagcucugguucuggggcccccagggcggcucuaacagcugggagagguggugauggggcugugcagguagggcaggcugcugggggccgagugcacgcccacggagaccggaaagcugaagacgaacugcgagguggggguggcgggggucuugccccgcucccgcaggggucccgaggggcuagcagccuccgcagcacaggacguggccagcaccugggacucgaacugcagcagcugccccaugaagcugaaguugggcgagaugaugcugcggcgcugcuuaacgaacucgaaggccuccuccagccucacccguuucuucaucaucagguaggccaggcagaugguggccgaccgcgagaugcccgccuggcagugcaccagcacgcgcccacggcaguccuucacggcaucuggggacaggguucaauagguuagugcacguuucugcagaccccagccccgaccaggggcaccggccagccccuggggucggggggcucugaaggaaggacuagccgugcuagaccaaggacuggagaggaagaaaacccauguaggcaggucucuagaaugcccccaauucugaggucuauuuucccgaaucacuaugcugaagcugguuaaauccuauuaucuguucaaggauuucccuuugcagaaacaaaacagugggguccagggugguggcucacuccuguaaucccagcgcuuugggaggccaaggaggguggauaacuugagcucaggaguucaagacuagccugggcaauaugaugaaacugucucuacaaaaauacaaaaauuagcugggcgugguggugcacuuguagucccagcuacuccagaggcugaggcaggagaaucacuugcaccccagaagcggagguugcagugagcugagauggcgccacugcacuccagccugggcaacagagcaaggcucugucucaaaauaaauaaauaaauagaaauaaaauaaaaacuaugacucaaugcuccuugugucuuccuccccguccaaaaacucuuaccaucuaggcacugaagccaugcaaggggaaggggacuggcucugcaagcuaagccuguguguagguccaucuucccuccucccucccaacccaacauccaauguauaagccuucccaaugaggaagagggggaauggggacccuuggauucagugccuccaauguccaccuucaacccaggcuuacagggguuccuuauccuucccacccgcccucaaacccaggaaccccagagcagggccagccuaccgauguacucuauggcuuccaugaaccaggagcugaugucggccuugugguuaucuuccacugggaugcacuuguacugauaguguccuucaaagugguuugggcaguccgaggagacauucaacagagccgugaugcccagggcguccagcaugucucuccgggcagcaugguaggcacugccgagguagaggaagggaaggaucuccacaggaccccccugcacagaaagggaaacaaaggccccugaaugacaugaggguaaagugcuuggcacagggaguggaagcuugucugagaagagcuuuccuuuccaaacccagggagaaugccugcugggccuggcccucccagccucccccuguagccuccuggaacucuuggaggggugauaggcccagugggacuucuccagccuuugcccucuacuugugagcagagaggccagggcagguaaagucuugugggacucuccugcaccucccccauggcaaaauaagcggcaggacaaugccggccuuauggcaccaucugugacacugaguuuauaucugcuaaucaucaagccauuugcugugugguuuagauacuuauuuguuuugauauguauucacugggcauaucaaaaacaggugugcaguggcucacaccuguaaucucagcacuuuaggaggcugagguggcaggaucaugugagccaggaguuccaagaccagcaugggcaacacagugagaccucaucucucaaacaaugaagcuggcaugauggugcacaccuguagucucaguugcuugggaggcugaaaugggaggaucauuugagcccaggacuuugaagcugcagugagcuaugauugcgccacaggacucaagccuggguaacagagugagacucugucucuaaaaauaaacaaauaaauaagcugaugcccucauggccacacagacaagagagaggaucuuggcaaaaugaggcaacaguggcuuaaauuuagcacaugagaugugggcagcagaguccaucuaacugaaagggcuggagggugggcuuauaagaaacacaguggcucaagcagguuuucuuggagggagggugggugaccaucuauguucauucggcugauacgugggagcagccugccugucggggacugagauguauuucauggccugcuacuucagaggagaaugaccucagcuucccagagagcaggucccccagggcuucuggaggccuccucacuuguccggacacgacguuagaggccaagccagggagucaugucuuuagacuuuuuucuuaggaggauauuuagagagggaaggggaagauuuccaagaaguaaauagguccuaccuaacaucccaccccaauacuccggguucaccgcauucuccccaaauugaggcauaacauucaaagacuuaaaaaaaucucaggauuggaugcaguggcucacgccugugaucccaacacuuugggaggccaaagcaggaggaucacuugaggccaggaguucaagaccagccugggcaacauagcaagaccccccccccccaucucuaccaaaaaccuuuuaaaauuagccaggcaugguagugccaccuguagucccagcuaccagggaggaucccuugagcccaggaguucgaggcugcaguaagcuaugaucacaccacugcacuccugggugacagagcaagacugucucaaaagcaaagacaaaaaacaccgucagaacucugaaaagaaggcauccacuggccccuacgcuguuccugccccccacuuccaagcccugccccccgagucuaccuggucguguaguggggucccacaggagcugcagcccagguccaagggcucuguggcacuggggggaaccgggggugggauggcugccagggccuugguuuuagaacagaauucuggguacucggaggaaaaccucucauagccgccuguaaaggagaaagaagcucagguuaauggggucacuaagccagcaggaagucagaaagaacucgacuccuacagacucaggcggacugcuaggaaggcaggggcuggcgugcuccauauuggccacuagguggcgcuguggaccuagagaauggccauggagugguuuccagagaugcagaggacacacucgucaggacugcagcaaagcuggaaggauaagcuuuauggacaagacuuggguuagagagguagacauacaaaggaagacgugcagggggaugugcagaagugacuguggaguagcuccucaggacaaugacaaaauagagaagcaaaggucacgcugggcuuccaaggacacuaaguaccuguagagacaccugccaccccugauuccagcccuuccucaggggagguucuccaaugugagaaagaagggaaaaaaugacccugguacaaacucuucuggaucucagcaauggaacagauguccauugcacguccucaugaauagcuguuccgucaccaagagaccagaacaagaggaaaacgggcuuaaaucuaaauaaaccccucaugcuauguacagguuuggggcaagggaguauuuccugaccugagaguggguaagcccuggaaugguuaucugugggaucaucuuccagagaagggagaucuuuuaaauaaaaaaagaagaugaugauaaauggccagcugagcugggguagggugagugcuccuaucuaggagggguggaggcaggugggauacagggagaggccacagggaggccauccaaaaagacaaccuuucaagcccuaucucuggcuuucuugugaucucugggacuuccuuuugcggccaacuuccaauccacagugcuaucaauguauggcccugcuuuuauuuuuauuuuacagugucuguagggccagaaauggauucaauugauucaguagggccugugcguuggagaaccaccauuccaacaaacccauucaacugacuccaaugacaauuuggccaacaguccuggaugucgcuaccuuugcggucuucaugacagugacauaggaccucugugcccuagggccauugauagaaauuuuccaaugugcagacaugugacggugagucagucacuugcgccaaaucccaacccuaaagacugcuuccuacugagaggaaggaaacgguucucuaccacaucaugaggcuuauagaaacaggguguacauuuuuuccucucugaccggaggcuucucuauuccccuccucucccucccucaggauauaaauggaucucucucuggucacaggcccuuguuccugcugagucacagugaccagccucccuggauggaaaaccugcugguggggcugguaccgucagccucggucaugcugguggccucggcagccacuucaucacagaagcacccccucccucccaucauaaaccccuuuccuuauucggcugccaccacugcugcccaaaaugcaguaauuagaggaugagggaagaggaaggaaauaucugucugcagcugaaguccuucaggggcuucugugaugggaaacuucaguccaugcucccuuucggagaaaguggaagggaaacucauucauuaacagugguugaucacuuguaucccaagccaucacuuguuacucuauauacuucucuaggauuugaaaaaauucuaaguacaugauccuuuugucuauuacauaauuugagcuauuaaaacacauuuuaaaacaacauguuagacacaggugguguccugcaaaaacucaccaccaagacagacaagcuaucgccugcacucaaaagugaaugguuggguggcccaggagugccagggcaggccccacggucacagagcagaguggcccucagggcuggagaagcaggaagagcccagagcagcugagaggauguugucuccauugcugaggguauggaacagggcacuggagugaaguuccgaaagggcacaggcucugccaugagguugcaccccacccugagcauguaucaccugugcagcccgggccuccugaaccucucggagccuccuccucgucuguaagugaugaaaguccccugcacaaaggccuaugaggacugguucugacagccaggcucugugccuggcaucagggagacagaucaugaaguuuucccuucucggugccuacauggaggggugcccucggaugcccucagcagagauccucaaaggccaaagaggaaccggggacaggguaaugcugguaagguacugggcauuugacagccugcucuccuggaaaccugucucuugguuuccggagaccuccagaccuccaucuucucucccaggcauggccauggcugccacucagcagaacccuugucagggaccuggcaccggcugcuggccauggagugguguggggggcaaggagggcccaagugacccauuugguggggaacaggcuagauguggccugagagggccauucgucaucucccccaggcucaucgcaacugucuggaaaaggcaccauuagaaggcagcagaaaaaugauuacagaaaagucaguucccucugagggaguuuuaaagaacaagcaaaaaugaacaaggugagcugggcgcgguggcucacgccuguaaucccagcacuuugggaggccgaggcggguggaucacgaggucaggagaucgagaccauccuggcuaacacggugaaaccccgucucuacuaaaaauacaaaaaaauuagccgggcgugguggcgggugucuguagucccagcuacucgggaggcugaggcaggagaauggcgugaaccugggaggcggagguugcagugagccgagaucgcgccacugcauuccagccugggcgucagagcgagacuccaucucaaaaaaaaaaaaaaaaaaaggaacaaggugaagaagcagauucgcucaaggggcagaaacacuggaagguucucgucccugacagugguggccagcuuuugggggucuguggcugguuucacaagaugccacacuaaaggggguuccuuuuggugggcccugggcugcacucaggccagcacucaugggugagaacgauauguucugggcugguggagcccggaggacacagugaaggugaugcgggaggaugcaugcaaguuagcauuuauccaucgguggaagaagcugcucaaguccaccccccacagggccaugccccaguaagucaucucugggugucagucuaugccaccucugccuuccaccccuuccuggugggcccuucuccagggggcacugccugcagguuucaucaagugaagacagacuuuucaugcaaaaacagaacugauccaaauagggcacugcugauauuucaccaaacucugcuucuacccauugguuuccuaauccaggcugucauuaaagagucaugacccacauuuuuaaaauggaauacaauagaauaggaauuaggaggaugcacugcccuuaaagaggauaucauuuuauggaacuuuucuucagaugugcauguaucccucuccugggucacaauauaaauuaaaauguguuucuuacugugggcaggguuaaaaaagauuauucuaaggugacuuccacucagucccuccuacccauccccaaauccaugcaaguaccauagccacagcccuuucaagagcuagauuuagaucaccuaguuuuaucccaaaaaaucaugaaagggaaagcuuauucucauugucuacaaaggggcugggcuccuucccgugccccuagcaggugugcaaggagaaguggagacagauccagguguaaguccaacucaacuuguggaacuuggacaaguauguucccuccucaacucugguuuuucccacucucaaaauguaagaauuucugauuauaaugaucuuuaaguuccaauauccucugcuucuaaauauccaggaucuacuuauuugcgugucaguuuugccagcucugaagcagcaggugccuaaaaucugcauuucuaucuccugaauaauuucauuaucaaaugugccauucugaaugaaugaauucuguuuuuccuaugcccuuugaauguaugaaaugaauguauugaacgugucuguguccuacugaauguaauuccauaagagguuucuuacuaauuucaaccuguuuuucccauguccuuauuuaagaauauauuuucuauuccuaaaucucucauuuuaucaccuuuauuuuacaauuugaaagucuggaagaaaaaaaggagugugauuuucaucagacuuacuuaagaauaacuccaucuacaguucaacuccacugugccuccuccuucucacauccucauacagggaggcaauuuuccaaguuuaguggaaaugaggaccccucauuagaagcccuccaccacacucccccgucccuugcaggaguaggagauaauguauguaaaaguacuuuacaaagggcagauugauaauaucaccauaauaggacuguuacugggauuugugauggggaagacuguccuuugguggugacuauggucauggaucuuuuuuuuuuuuuuuuccccagacagggucugucacugucacucucucacccaggcugcagugcaguggcacgauuauggcucacuguagccuugacuucccugggcucaagcaaucuccuugcuucagccuccugaguagcugagauuacaggcacaugccaucucgcccggcuaauuuuugcauuuuuuguagagaccaaguuugccauguuguccuggccucaagugaucugccugccucagucucucaaagugcuaggauugcaggugugagccaccacacccggccuuggucaugaaucuuaauguggcugccacuuuuuccccauuaugcccccaacacucagaauagugccaggucccaggcagggcucauggccuugcucuugccagaaaagucaugcucuugcaagaaagucugggguuguuugaaggccauuugccuuugggaacucuacuuuaugugacuguugacuuaguaagcaccuauguaaaugcugagcuguauuuaaaauccaacuaagugaacuucucaccuugagacucugaacacagacaccuggaccuuccugccagcuggcugacaccuaacgccaugcugggggcucgaacugguuugcagucucucccaguccuccugggcgaucugcuauguucagcaaacuggcuuccguuggagugaacuuuucuucccaucgugcuuccucuucguuagccaggaacugccucccgguaaggaaaucggcucucugguuucagauguucugauuuuuuuucaaggaauuucuuggcucgggaaaguggccacccuuucucucucccucauuuuucugagcaguccauuuuuguggguggagcccaccucuccuauaagcacccaggauaagcccaaggaaguugugacggucuaaagggucaaauuucacucucaauuuacaccuacaucugucuuuaguuacuuuuguuaguuggagacauccaauguaaauggugucuaacauagugaguuugcuucauuguaaaaaaucaccuguaagaccuagcaacuuaugcuuccaguccuuggcugucaugggcauuguauuacauuuguaagcagaaacuaccauauuugcaagcagaaaagcgagucauuuucccuuuagguagaaaagguaugcaauauugacaucccccagagcugugcuguuugaugccauugcccuccuggggaacugaagacagagagagcaaugguggggcuagagagagaaaaaacagaaaaaugucaccagaguuuccagagcuguuaauuguguuccucuccccccacauucaucaguggccuuagugacuguuuucuacagaaaggguaauaucaugggcuguauggucaggcccugggcuauuggaugcuauccgguacuauagggugaguggaaggagaaacuggaauaucuagaugaucuuccccauuucuccaacagcuccaggacagcuuuuaaauuagaacugacaaaggcugagggaaguuuuagguagguggaaaggaagguaauguuuuuauaccugcaaucuuuuugcauaacagauuauuuuguuauuugggguuaauaaaggcaaagaauaggguaagaaaaagcucuuuuugucuuucucuaaugaccaggggagucucaaacucuaauccaaggauuuacgaaugagagagaaagggauuucaagaaguguauugugauaaaaucugaaaaacuaaaauuuccaaacugacucuaaaaaugccuuacaagauuuuaaauuaaaugaguuuuaaaaaaauuaccccacuggaaauccuuuacuagcaaagauagaaaacauuagauuuuucguuauugcuuuuagcaaaagucggguaaucugaggaaauguaaaggcuaggcuguacuuucuugauauuaagcgaaguuuaccuccugccaccugcauggaguaaccaguucaacgugguugaaguaacccuucaacguggcagaaauagaaaaacugaauuuuaaaaugcaauuaauagaauuagauagcuuuggcuggacaugcuacuaucacuucugaaaauacucuuguugcuuuuacugcuucuccuaaccccuccaagaauggcagacaccaaccaucaagccuuccacuggcuuccuguccugcuuuacagacacgcacaggcacaccugaaaugagacauacauacauucccucgcuggaaaauaaaaugaauuacuccaguaggaaacaaauucuccaacccuucaccaauucaggcauuuacuaaagauaaucuaaggggcuuuuucuuccuuugcuucucaaaauuccccuuuaggucucugccccagagcccccucccgggaaaccacauuugcuccacugcacuggcuuccaggcauggaagggagguguaucuggagaccugggagacaccuugauuuccuuccccagccccuucccgcagagcugugggagcagauacugacuuuuuccuucugaccucucuagggaugccuuuccauuagagggcaaagaggaagaagaggaacuggguuaaagauggccucugcugaacacauaugucaaaaucagcuaagcuaaaccgaauagggcccaguuaaccucaacgauguucaccacaacagagcaggcuggaagauucccccaccucucaauuuuaggugcuugcuuccaagggcaggcucccuuuggaagcagaagcugaacuucuggcuaggaggggcuauucuagaagagaccgaagcuaaaucuguggcccaggccugcacaccuccaucugcaaggauguccacuuugagaugcagaagaugauucucccugcccgcgucggggccgacuacgagaggcagugcaggcuccaggaggaaacagcccuuaaaguacuucucuuauguuggccaggcaccucgccacccaccagagggcugucauuuuaccuagaggccuguacuacccagucacuagccucgcccagaaucuccagggcucucgaaucggucuggcuggggaaauggaggagguuggggagggaggacucucaacgggauucacgagggacagggaaaugccgcgcgcccuggggauaaaucuuaaaaaauaaucccucucuccccgggagcggggccuaaguggcugcacccccggaagcccaagggccgagguccuggagcugccgcucuagggcgguccccucgggauuucuuccaggaaggaaagcaaaacacaacaaaacaaauccagacuccacguggggcuggaacccagucccagcccugcuguguucuagcuggucccggguuuggacgccagcgaaggaaggcgcgcccgcgcucuccaucggggggacucgagggcagcgccgugcggggaacaucccggccagccccggccauucgaggggacuugcgucccagaggaauugcccucaucucucccaccagcgccgacaagcucaaacaauggcgcggacgcccacccugguggccuaaccaggaccuggccccgcucagccgccaggccuuccgggacaagccccuuccuggcacuuucucuuggagcgcuuuggggagaagggagggggacugggcucauuuggaggagcaaaagacagcccucgcggaaaaagaaagaaaaaucagcaaaaucgccuuagcaguucaaccaaaggucaacagcagcguuuccccagcagcugacaggucaaaugggcaggaaacaacugcggggaacaaagccccccgcuguccggcaggggcgaacccggcuccuccgcacugaacaguuuuguugugcuuuuuggaggggagagguuuccgcccccuuuccagcucccuuccucccggguggacaggucggaagaggagcggaaaggaaaggaagggagggaggcggcgaaggcgccugcgggggggaggagcggcucuuugaugggugugggggggucugaacugccuaccgggcucggaagcgcagacccuacccgcgcggaagaaugcgcggaaugcggcggcgggaggcggaggcgcagcgcggcggggggcgcccggaccccacgcgcccugcccgcucccuagcccgagggccgcggacccacccugcccugcagguguggcgggcgccaggucccuccagggacucggacagcacgcgauuuuuccaggauuuccgacuaccaaaugugacaagacagucucgccgccgagaguuucgccagggcucgcuaaaauccggcacgcgccgccaucagauagucgaaaauccgggcugaacaaaaggugaucauucuccgcugcccggauuugcaggcgcuagaggaccgguuccgcccggcgucccccagauacccaguccuucagccucccgcucccagagccuggaucuagcccgggacggggauuggccaccuuccaagcugagcuuggaguugggcagcgggaacgcagauacagaucgcucuacacagugugugcaacccaaucucccuuucugcauuugccagggucuuguuuucagugaaacuggcaaggccaauuguaccucggcgcccaccccucuucaccuuuucuccaccucugggauucucccgguccggcucaguguagggccccagcacgccaaaccaacaggccuaucuuguccccacgcgccccgugguacuuggaaacuguucccgggacucaagauggaccgcgcagaggagucgcuucauccucgaggcuaggaccguuaaugucaauaaacggggccucgcuaggacggugcggaauugcaggugaccggagaaacccguccgcacuuucccugaggacuugaaccucgcacuugcacagaaaccuugcaaaccccuacacaccaacacacacaaaggggcgcgcggggauccccgcaaccacgaaucacgccggggacuccuucccgugccaauaaggcgcaggccgccaagacccccuccaucuccccgacuccagcuagcgcccggagcccucguuuaccuuugagcaggcagaugucggugcgcucggcguugcggcgcagcgccugcaccaccagcgacacggugcuguccucgcggaggcucucggcgcgcgggcugcgcucgucguagacgaugaccgccgaguagaggccggagcgcaagcgggcgcguaccuccuccucggcgggcaggaucugcuccaggcucacggagcccuuagcccgccgccgcacgaugguguuacagcgcacguugaccgaaccuaggauguagcccgcgcugugcgccaggaacggucugcaguccagcagcaggcacuugccgccgcucggcagccccagggugccguggcugccgcugccgcccgcgccgccgccauucucgucccgguucaucagccuuuugagcacacugcaguccaucucccgcagcuccuccaucgucaccauggucgccgggaaccgaggcggcugggcgcgcgaggaagagaagagaacccgggccgccuaggcugcagaaaggggcgggcgagagcuaagaagggacgccugcagaaguggccgcaaacuugguccucaagggcucccgcgggagagccucuucuucccuguccccuuccucccgcagccucgcggucacauagcagucggagcggccucgggcgcccagccgggcggcgcgcagagcggagggggaggcgccgguggaggagaguguguuuacgagagaggaccgcggacucuuuucggcgacggccucccguguauuuuugccggucgcgcggcuccugucgccacuggcgccagcgcugcccugccuacgcuccuccggcgcucagcgcacugccccagccagaguuuucuccucggcuuagagguuuauuaaugcuccuccgcgcucccgggggagggggcgcuagguacuaccccgccaggccccgccccguuccauuccgggccccgcgccgucccccgccccccgcgcugucccccgccccccgcgcugacuccccgcccccuccgggccccuccuc

SEQ ID NO: 15589 - RNA, 226437 nt, Homo sapiens
cagugacagugcuaggggaguccgaagauggcggcgucgcgucgcucucagcaucaucaccaccaucaucaacaacagcuccagcccgccccaggggcuucagcgccgccgccgccaccuccucccccacucagcccuggccuggccccggggaccaccccagccucucccacggccagcggccuggcccccuucgccuccccgcggcacggccuagcgcugccggagggggauggcagucgggauccgcccgacaggccccgauccccggacccgguugacgguaccagcuguugcaguaccaccagcacaaucuguaccgucgccgccgcucccguggucccagcgguuucuacuucaucugccgcuggggucgcucccaacccagccggcaguggcaguaacaauucaccgucguccucuucuuccccgacuucuuccucaucuuccucuccauccuccccuggaucgagcuuggcggagagccccgaggcggccggaguuagcagcacagcaccacuggggccuggggcagcaggaccugggacaggggucccagcagugagcggggcccuacgggaacugcuggaggccugucgcaauggggacgugucccggguaaagaggcugguggacgcggcaaacguaaaugcaaaggacauggccggccggaagucuucuccccugcacuucgcugcaggucagagacuuuugaauuguuuauuaaggguuauggguuugggugcaggguccgguuaggacaagaaaacagguuauugugaugggacaaagugggggcgugguuaugguucuucaucaccucaccagaagacuggagguuccuuucuuuugguggugccugggugaugggggcgugguugggggggauaagugaauccaaggaauucuucagugguugcacaguacucauuacaaaacucacuguaguugguagucucugcauauggauauauuuacacuuuaguuuuuggugugcaggaauacaguuagauuuggacagcuuuagaguaguuuugucguuugugugcuaguuuauuuuguuuuuacaaggguauguccuuugaggacaguccagaccaaaagagguuuaauacaacccaacacauguuugaggaucuauuguagccuuaauaacccaaugaaagacauaaaugaaguguuugaaaguuucccuucuucuaaagaaguuugcagucuagacggggagaccaaaauaugccaaugugaaacaacuggagaagaauauuuggaugcauuauaugaugauggaagaaauauaggcuuugauguuguggccacuauuauuuguugucuagcagaccauuuaccucgugucaguugccucaguuuucucaugggcaaaaaucauaaaaugauguugugcgagcauuuggugagaaguaucuggcacaaaguucucccucaaaaagugugaauuucuuaagcucuggaccccacacuugucuuuuuuuuuuuuuuugcaaguaguugaugauuuucucucaaagacaccuaauaauauguuuauaaaauaaagagaacuguaaaauaaaaacaaaggaccauaaucucacugccuggauaccuauuguugauauuuuaaaaauguagguaauaauguuuuauacauuagaaacauuauauuggaaauacauauauuguacguuauacaauucaaauaggacagaaaaauacaaaaugaaaggcaucacacagaaacaucagagauaacacaccagagauaacuucuguuaaguuucuccuauauuucuaauauauauauauaucacuucuucaguuuguucuguuaacaguaaaacauguguugacccacuguaguauuuauuuuuaccacacuugggagauaugauuaaccauuuuacagaugacaaaagugaagcauauaucgaucgcuuaaauaaguccaaauucagucaggaaauaguggaaauugaguuugaauucaggcaguuugauuuuagagcuugugaaaucaaacuuaaacugucagaacccuggauuaaggucacuuuucauuuuugugaguaauugaaguguagaguucccaauuuuugggagaaguaguaaugcggaggggcuuauaugcaagagaguagcuuucacauguuuuuuauuguagcccauacuuagaaauacauuuuacauugucacauacgcaacugaaucaaaaguuucuggaaacaauacuuucccuuaauacauguguuguccucugauauuuuauauuuuauucuguuucauuuuuagcaaaugcugcuugugauccauuaaugggucgugaccagugguaugagaaacacuuaaaggaaaucauuguuaggucacuggauucauuauugauauacagacacuacuuauuaggaaugcagugaauugaaucagaaacagacuuuugccuauuuguuugcucaagggucuugcuuguuuuagaugaaauagcauuucuuuuuccuuaggcuaaaugaaaggccuaagucugauuuuauuaaucaacagaggugucuacuuuugcauacuuuauuccaaguuugccuauuuuaacaaauugcgucacaaaucaugucauuucucaccaucccacuuuaugcguaaucaccaauaaaugauaguuauauuuauguguauuaauguauuuaggauaagucacacaaaauagugcuuguuucucaaaucacgugucuucuauuugccacaauaguuacuuguuauucuguuucagaguuuuauguauauccagauaagcuagaagauaaacaaucaaacaguaccguaauuauguuguaguuaugacaagcuaaccuugaauuggcuuuuuaagaaaguuuuuagcucaguuguggaaaacacaguaauaaaauucucgauaugaaaacauaauguccuguagucaguuugccacgcuuccgugauugaauucguaacauuaaaguuuuauuaaacuuuagucuucuuuaucauguauaggcugagaaaugaaaaaaauuaucaguugacugguuauuaugauaguaauugaauugucacggaauagcuguuuuaaagaugagaaauugguacaaucccuuggauggaaaaauuuaaaaacugcaguuuauuuguuccagaaauauuuuagugugcuuagaugaucggguguuaaauacugacacaauuguguaauggcaagcagcccuuaacccuuauggagcuuacagucuaguggggaagcauaaacaacaacaacaacaaaaaccuauaaaguaucuagugucuaaucuagagugauaggaaacguauauuauacugucugucccaauauguaauaggagcucuuauccuuguuuuagagcaguuaaggaagucuuuguagguagauuuuuuuaaagcaggaauuaaaagggugagcccaagcuagccaagcaaagguuggaagggacgauguuaacuaaugcuuuuauuuauuuuuaaaaaugaguuuacaguucuauagaaugaaaugaaacaauuuuuuuuucuuuccaacuuuuagguucagggauuacaugugcagguuuguuacauggguaaauugugaaucuugggggcuuuaguguacagauuauuucaucaccuaggcaaugagcauaguagcagauagguaguuuuuugauuuucagccucccccaucccuacccuccacccuuaaguaagccccaguguguauucuucccuugucuguguccauguguacucaagguuuagcucccacuuacuuaagugagaacaugugguauuuggaaaucauuuuuaaagaucucagaugugguaugaaaccauauuuaaauccuuaucacuuuauuuauauuaccuuaagaauaaucauauucuuuccagcaguaaaauuaagaauccuuuguauccuaucuuggauugugauaauuuguuuagaauaugguuuagagacuguguuaauaauggaaucauccuaucugcaguuaagacaaaaucuuguuuccauuguugauacagguucucaaaauacuauuuuugaugccuuuguaagauggcuuuguaaagaugagccauucuuuuauuguugacuagaauuuauaugagacuuuuucuucuacagaugugguccuugacccugguuuucuauuauuuaaaguauagcagucaaaauaguuuuauaaauaguaccaauuuagagugauaccuccuuaggaugguuucuaguagugacauauuuuuguuaaaggacccauauauucugaagacgucucuuuuuauagaaaaguuuaaaugaggucuuuuuuuuauuaaggccuuaguaaaacauuaaauucugagauuuuauaguauuuacaugaaauugaagaaaucuugaaaugggcuuccuguuaguuaacauauacgacuuggauuaugauagguaaugugagguauuuuaaaauaaaaacuaguuuucuuuguuggguuuuguuuuuaaugguaucuacuacaauacauauuuaacaguacagagauuuuucaacucauuccugacucuucucuagauuuuucagcauggccauacuugucuuuuuuuuuuuuuuuuuuuuuuuuuuuuuucauuucucgccuuuguacaaaugucguuccuguuaauaauagaagucaccauauacucuagauuguugccuaucaguggguaauaaaaugagucagaaugcugcagucuuggagugggaauuaucuuacacuucucguugccuggcaagauccuuuauauuacuuguaagcaaaugcccugucugaggauguaagaagggucuaauuugguaauagaagaaagggaccuaguuucauaaauaucuucccagacuuaaaauuguugauuauaaacuggauuaccuuuuacuuaguguuuucuuaaaaccuuaacacuuuucugaagguaccucuuuaaaaaaaaaaguuuacagagaacuuuuaguuagaaagaugugcaaagugucucuuucuuuuaccucaaugauacugcucuuuggaagcaaaugauuuaaagaacaaauuagccauuuauaagaugauauguaaauuuauugcuaauagcaaaaaauuuguaacaagccaacuguucaacaauagagaaaugcuuacauaaauuauaauacuguacaauuucuauuacauguguauuccuacauauauguucuuuuauccgucaaucaucuuuuuauuaaagcaugugaguguaaauaguaggcaucugugcagcuucuccaaauaugcuaauuugcauaucauuaucuaaguucaguauuuguguaaagauuuaucuuuuagugugaaaucugugcaaaucuuauguguacauucacugaguuuugacaaaugcagauacauguguaacugaacuuaugacuuuccuuauagaaacuucagaaaguucccucauaccccuuaucucaaucuugucacuaccccuuuucccucaggcaaccaccauucugauguuuuuuccacuauagaauaagaguugccuguuuuagaauuucauauaaaugcagucauacaauauuuagucuuucuguaagacuuauuuugcucagcauguuuuugauuuuguaacguguaucaguaguuucuuuuuacugcugaguagauuucauuauaugaauaugcugcaguuuguguaucccuucaauugauagacccuuaagcugauuccuguuuuggcuauuaugaauaaagucgcaaugaacauucuuauaaaauccuuuuuguggacacggauuuucuuucucuugggcaaauaccuaguauuagaaucucugggucuuaggguagguaaauguccgguuuuauaagaaacugccaacaccuuuccccaaaguauauguaccauuuuacauucccaucaacgauuuuugaugguugcuguuugauuuugcucuuguugcccaggcugucguauaauggugcgaucuuggcucacugcaaccucugccuccucgguucaagcgauucuccugccucagccuccugaguagcugggauuacaggcgcccaccaccacgcccagcuaauuuuuguauuuuuaguagagacgggguuucaccauguugaccaggcuggucacgaacuccugaccucagguguuccauccaccucagucucccaaagugcugggauuacaggagugacccaccacgccuggccuuauauaucuuuuaugaaguuuuguccuuuuuuuuucuacugggcacacuucaguuuuauucaguuuuguuggguuaucuuuuauuauuaaguuuaagaguacuuuauauauucugcauacuagugcuuugugggauaaaugugcuaauauuuucucccaggcuaugaauuacugauuaauuuucuuaaugagagucauuugaauagaaauuuuaaauuuaauuuauauauuuauuuuaugguuauugcuuucucugacucaucaccuggauaagaacuuuuaucuggccccaagucauagaaguucucauacauauccuaugaaaaucuuuaugauuuuagcuacauuuuaucagaugugacuauauccacuucaguauucuuaugcuguguguggcauuuuucuauucauucacuuucaaucaaucugccuuuauauuuaaagugugucuauuauagacaguauauaugugaguguugcuuuuuaagacauucugacaaucugugucuuuuaaucuaccucauuaacuaauauugauacuuccaauucaaacucagaacuauaggguuuuuacuuaccucuucuauguugcaucuggccaucauuucuuccauaccuaaacuuuuauuuuucaaggaccugcuaagagcuguuaauguugaaggucugaugagaaugggaauuuccuucccuuagccuuuuuuuuuucuuucuagaugggcaaaggauuuuuuuuuucucuuccauuaaagaccagauauucuauuacaguaugucuugguguucguuucucuagauagauuuucucagguaugugguauggcuuuucuuuacauaguuucagaucuuuuauuucagaaaaguuucucaaauuauacuuuuuauuauucguucuuuucuuuuuauguauauugaaacuuugccucuucuaaauuuguuacuugcuccauuucuuuaauacgauauauguaaaauuuaccauuuuaaccauuuuaaguguacaguuuuguggcauuaaguucauucgccauguuaugcagccaucaccauuguccauuuccagaacauuuuuugucaucuuaaauaagcucuuguacccauuaaacuaugucuaucugcccccaaaccccugauaacugucacuuucuuuugaauccuauuaaaaaauauauaucuucuuuuuuuauuaacuuuuuuucuccuuucaucuucuauuuuucuuaaggcaggaguuggaaacuuucuguaaauggccagauaguaaauauuuuaggcuuuguagccauauggucccucucauagcuacucaguuuugcuuuuauacugugaaaguuuccauagacuauauguaaaugaaugagugugauuguguuccaguaaaauuuuauuuaugagaauaggugaugggccagauuugguguauggguuguaguuugcugaccucuguuauaaggcauuauauguggcauuuuuuccauuuuguguucuuucuuuuguaguccuuucuugaaauuauuuuuucuuuuauuuugaauuauuuucugaacucucuccuuuuauuucuaacucaggcacaugcuauacguucauaucuuguaucauucucguauucucuuuuagcuaguguuaaaauaauugauuauaauuuugucugcuuugugggcauuuuuuucuguuagguauuaauugucugcggggauguuauucuccaaauucuucuuguaagaauuuuguauguauuugaccucaguuacuuucguugcucauuuuuacagaaauuaauuacuaaauaauuucaaggauaaaaauaaaggucugagauaguuaagguaauccccccugucccuuuuuguugugcuacaccugcagcucuggccuagaauagaucaagucucucaguaaggucugcaggaucaucuuuuacaguaguagcauuuaaauuaugaaacaucaucauuuuauaccucuguuuauauaaccuaugagacauuuuuucaggaaccuuaaccggagacauugugcuaagggcauuuuauagauaaagucucuuccugauagauuacuauuuagucuuuuugguaaguguaguccagucaccuguaaagcauucccuaccccaucaaugaauugaauaggucacaggccagguguucuuuccugacgggaagugauucuuugacaguuaacaggccagagaaauacauugggaggauaggaggcauaucaucaaaggucgaguugugagcauaaauauguuaaaaaaaaaaaucucaagcuuagaauccagaagaaaaguaaucaaggaaugugaauaauucugagaaaauaaauuuuauuguaauguuagguuugguuuuggaaaggaauaaacaugagcucugugaugacaugagggagaaaacacuauaguaguuuagucuuuaauauuuuuaacagccuccuuuugugucauagacaaagaaucuuuggguagcuuacuauaaaauauugcaguagauaaaauugaaggcaguugcuucuuaccuuuuuauuuuuccccaugucauuguccuugaagcuacuuuggcuuauguuuauucuucugauagcuaaguuuugguguagcccugcucuugaggcaccuaauaccaugcaucauuaauagauacuuauaguaagaauugaauaggauuaguuaagauaagauggguuggagucugagggcuaggugcagccuccccuuacggggcuuaauaaaaccaaugaaacauacacgagaaagaaacauucagaaauggacuuucaguuucuuggugaauaaaaagcauuauaucuucaagaaaaaaugaguaggguggguuuccuagggauuucuacuaaagccuaggagcucaggauaaccccggggcucauuaaaaaaaaaaaaucacuuugauuucaaguaauugaggaaaguuuuagguguuuuguuuuugugugcccguuguuuuucuuuuaaggcuucaucagaugucuaaguuugcuuucaccagagcgaguuacugaguucucuucucgaaucuuguuuugccaguuuguucagguaucuguuuauagaauuaaagcagcgugaggguaaacuuuuuuuuaagcuguuuuuuggagugugucagcuccccauucaauuuagacaaguuauuuauuuauuuauuuauuuugguuuuggaagagggaaaauaacgugauguaaaauuuuuucucuaucccuuuugccuuuucaguagaacaaacuaaacugcugguagguggcagauguuuggacuuguuuauuuuuucuucuuugguauauuuucuuuuaaagugaggaagcauuugguaguuagcagaugauuuccaugaacuacaaguccaaacugaacaaaauuuguuuuaaauuuacugauugacucaaaaaaccuuaaagcuauagucucugugucauuaguucaaaaauaaacuaaaccagccaggcgugguggcucacgccuguaaucccagcacuuugggagggcggaucacaaggucaggagauggaggccauccuggcuagcacagugaaaccccgucucuacuaaaaauacacacacacaaaauuagccuggcgugguggcgggcgccuguugucccagcuacucgggaggcugaggcaggagaauggcgugaaccccggaggcagagcuugcagugagccgagaucacgccacugcacuccagccugggugacagagcaagacuccgucucaaaaaaaauaaaaauaaauaaaaauaaaaauaaacuaaacucccugaugccuuguuaaaguguguguauacacacuuuuuugugucuacauguauauaacuuauuauauaugucaaauuauauguugacauauauauuauauacauaguaaguagacauugaaaaguucugaugcccucauucugauaauacucaucaaccguagaaaccauuuugacauucucaucagucauguuaauaagaugugcaggucuccucuuccaaaugcuuggguuauucucauguugacuguggaaauuugguauuuucaaaagaaaugacauagaauuacacuuaguuaauacaucuuagcuauuuuuuucuaaugucuugagguaccaacuuauguuuuucuucuuugcaggaaaauauucuuauuuggaaaaagaaaacuuuuuggauaaauuuuugaaacuuugagcaagcuaucaaaaguugucugccuccuccuucuccccagccccaaaauacacagacuuaacaacagaaaaauauaacuguuauccuauguuaauuuaugaaagcagauaaauaugggguauauaauaagauaauuucauuauuuaauucaaugaauugcuuguuuuagugcucuguaaguauuugaacaaguaaacuuuuugaguuaacacuucugauuucugaucuucugacauucuuaaguacauaaauauuaauccucguauauuagcccagucuuuuuuuuuuuuuuuuuuuuuuuuuugagacggagucucgcucugucgcccaggccggacugcggacugcaguggcgcaaucucggcucacugcaagcuccgccucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugcccucaugauccacccgccucggccucccaaagugcugggauuacaggcgugagccaccgcgcccggccuagcccagucuuuugucaucagaguccaaggucacauagcuagcuuuuaaguaauggugccagauuuaaacccaaucugguugucguaaaaucauuuggucugugcuacucaaauggaaaguugauagcaaugagaaauaaaaucuguauuuugugucauuuuguaaucugacgauucuuacugcuuucucaaguugguuuucugguaauaaacguaacuuuacaaauuuuggaaaguacaguaaaaaguagggcaucaucuucccaccccaagggagcuacuagugauuuugacauauucccuccaguccuucucuuaggcauuuaaaguaaaacuuuuuuguaaguaugguauuggaacauuugcaguuacuagaauguugggacuaucuggucuuuuguucaguugauuguuuuuauaaacauaaaaagugugauuggaaguaaucuuugaagaaccucauaacuaaauggaagaaggaaggauauuuuagcaacugcuuucuuauuuauuuauuuuuuuuuugagacggagucucgcucugucgcccaggcuggagcgcaguggcgcgaucuuggcucacugcaagcucugccucccggguucacgccauucuccugccucagccucccgaguagcugggacuacaggcgcccgccaccacgcccggcuaauuuuuuuuguauuuuuaguagagacgggguuucaccguguuagcgaggauggucucguucuccugaucuugugaucugcccgccuuggccucccaaaguggugggauuacaggccugagccaccgcacccuuccagcaacgacuuucuuuaaaagacuauauagaguuguuagaaaaucucguagauaaauuuugcuguauguuuugacucauggaagaagaaguuaaaaauuuuuugaacaguaacugaaacauauuggagucacagcaguuugaaaguauguaaugccacugaacucuacauuuaaaaaugguuaugauggcaaauuuuauauuauguguauuuuaccacauuuaagugaaaaaaaagggggguaucauaguggacauuuuagccucucuauuguccuggagcguuucuuaauauuacuaacacgaaauauggaaaauaguauauuuaauagacugaaucucugcaguuauguugaggauacucuuuucaucuuaucuguugauucacauuuuuugagagugaccuguagaccuucucugucaguaugaagcucagcauuaaugaaguguuuauggaaauucaagcaagcugcaugcaacuuguuuaauuaacauucacuggggcaauuccaugguguguuuuucccccuugguuuguuucucagggaucuggcuugagcuguaagguuuuugaguaguucaguaacagcucgagaaauaugagcaagauuaugggaauggaauguuuccugcccuuaagaaagcuuauaguaaaaaugcaguguuucucaaacuuuuuggucucacugcuuuuucacacucuuaaaaauaauugaaauaauuuuuguuuauguggguucugucuauggagacuuaccguaugaaaaauuuaaaaugaauauaauauuagaaauuuuaaaaauaaaaugauaaacuccauuauauguaaauauguguaaacaacauucuuaaugaaaagaagcuauuuucuaaaggaaauaaugagaagcagcauuauuuuacacuuugcaagucacuuuaaugucuggcuuaaaaagagauagcuaauucucaucugcuucuaccugccaauucugguauauuguuuggguuaaaguauaugaagaaaauccuucuucaaacagaaaauguuguuggaaaaggaagaaauauuuuaauagcauugucagauaauuuugccuuuuuucucuuugauucuguacccacaguugauaaguaauaguuuccuaaggguuaguugcaacguagaaucugaagccaaaucagugaauuuuuuuauacuucugcuguguuagaauccauuguuagaauccagaaacggguauaccuguacuuguuuugagcauuuagaaaauauugguucuugaagcugugcagauauuccaaauguugacacauuuuacuuuguaauaaaaauaauaagcauaauuguuaauauugccacuaaucucaucagaaaaguauuuuagaauugggaaacuguuaagcuuauagcaauaguugcaaguguuacagaauucuaguauuuccuugaaagcucagauuuuaucauugggaacaaauaccguuugguuuccuaaaagauucuaauaauuccugucaucacucccuggacgacaucagcuauuaccauaguuucuuaguguggacauagcuccauagcacacacacaucauaaguguaccgggaggugaauuuuuacaaagugaacacaccuggguaacuagugcccugcucaagaaucagaacauuaucugcaauccauaagcuccuguccuaugucuuuugagucguuaccccucuaacacucauagauuuugucuguuuugaacuugugauacaugauacuauauagucaguacuauuuugugggagauucaucuaucuuauauaguuguaguuuguucauuuucauuguuuguauaauucuauugugggaauauaccacuacuuacccauucuacuguugaguauuugggugguuuuuauguguguucuauuaugaauagugcugcuaugaacauuuuuguacacgucuguaaacgucaacauugaaaacuuuuuaguuguuugauaaaagcaauauuuaguuaauuugcauuucuuagucacuguuuuacuuuuaaaagacaauuggcauucacuguuuggcauuauaucucuucguauucuuuuuuucuuuugccuuuuggugucuuuguuaucugugcuuuguuaaagucauugugaauauuuuccuggcuuguuuuaaaauuuuaucuguaagcuuuugaaaucuauugccuuaaaaaguguuuuuuuaaucuauaaacuuuucaaaucuauugccuuaaauuuuuuuuguuuguuuucuucuauugcuucuccuauucugagaucaugcaacuguccacuuaauuuuguuacgguuucauuuugacauuuuacaccuuaaucuauuuuaaauuuauuuugcuauauauuaagagguaaauauuuuaaaaauuguucuuuuuuaagcagaugccagguguuuuuugaaccauuuauugaauaauaaauauaggccaggugugaugguucacuuguaaucccagcacuuugggaguccaaggugggaggauugcuugagcccaggaguuugagaccagccugggcaauaaagcgagaucccugucucuacaaaaaaauuuaaaaagcuagccagauguugugcuguaccuguauugacuguaauggggauagcagcagguucaagaggccaaaaaagaucccugagccaaugaaugaaacauaauguccugggggcuaaaauacagggaagagauuccaguggcagugggcugggcagaaccaccagucccuugcuggcgugguggacagaauuaccacauggcccaguggcauuaggauggguagaauaaccaacugcuugcaaaaagcaugcgguuaguacagcauuuucacuugacagccucccccagcaaccucuaccuggcaaccuuuaacccaaaacaaagggccucaauccucuauauggcccauguuccauucuacaugaugggcuugggacucagaugucccuuguagauaaugaauggaucuccugguuggccacucuuguauucucuagcucggaacugugaccacacauugaggugcaucugccauacagggucauucucaggguaugcucaggcuaagucauugcugucaugugucuacuguauacccagugugguggcaugucuguagccccggcuacuagagaggcugaggugggagaaucacuugagcacuggaagucaaguuugcagugagcucugaucaugccacugcacuccagccugggcaauagaguaagaccugucucuuaaauaaaaaaauaaauaaaaaucaaccauuaaaaauggagguagauuuuguuuuuuaaaaauuacauucgggggcauuuugcugcauuuucauuugauguccaguuacugugauucauucauuguacuauguuuaaccuuuuccucccuacuguggccuuaagaguaauuucuacaacaaauucuauguugaauuuaaggaagcuacaccaaaaacuaucagcagaauuucaagaauccuuguagccuuuuuuccuuuuuggcugccaagauugauguauauauagguaccuaucuauauuuagcaguuucuuaaccuguaucuaaguucacauagcagaaauuugaauucugucgcuuugguaaucgucuuagucuucacacugacauacauaaaguaaaggaauuguaguuuggauauacuguguuuguuuugagggaugaucugcuuaucuucaugauuucuggggcagaaaguuaguugauuccacguuuuuuucuuuuuuugagauggagucucacucugucgcccaggcuggagugcaguggugcaaucuuggcucacugcaagcuccgccucccggguucacgccauucuccugccucagccucccaaguagcugggacuacaggugcccaccaccacgccuggcuauuuuuuuauauuuguaguagagacgggguuucaccguguuagcugggauguucucgaucuccugaccucaugauccaaaagugcugggccucagccuaccaaagugcugggaucacagacgugagccaccgcgcccggggauuccauguuguugccacuuuuagucucuauuucuuucucucuguuugaaccguucugaacuuuuuuagguacuugaauauaaagaguuucucaccucuugauuuacugugccuuacucucuuuggaacauuuaucccuauccuuuugucugguaaauugcuuauuccuuagaucuuagcucauaauaucacuuuauuagggaaggucucuaucccagacuugguuaaguuuucuuuguaacccuauauuguaauuauuuguuagggugauuauuagucaguguuaagucuugagacaggauagauuuguacugaguuaauucaugauauauagacauaagcucacacacguacuacugaauucauuuuuugucaugaguguuuucaaccaggaucuuucuguguucaccuuagagauuuugcauaucugagauuaauuugacuuuuacauggaaauaaaguuagcuauauaugaaauuaaguaugaaagugucuuuucucauaguuaagguugacuucagucaacugauucuuuguuuuuuguuuuuagcugauuuguuuucuuucugaaagacuauggccuuuguuguuguuagacuuugcuacaaaguguccaugcuguuuggcacuccaugaauauauuaaucugaacuuuuacuucuuccuuuaauuauuaaaaguauugucauuauuucuacaauauuuccucucuucccauccucuaucucucuuacguuuucucuuauucucuucuguuucaugucacuagucuuucccuaauuccuaguuucgggacuaucacuauagcagauacguuuucuccaugaaauauaguaaaacagaaaacuuuaaagaacuuuagaagauagaccuguacgagaaagcgaguagaauuagaaagucauguugagauggggcugcugugcuauauaccccucuauaauuuugaggcugccuccugcacaucagccaagauacaggugucauucgauuuuuaauagcaaaauugugaauuacuguguuuaguggaccuuuagagauacucaaaagugucuggaaccgcuaguguuaaacuagugaauggcaagucuguuggccgggaaaaaccuuuuuuuuaaacucauagguauugcauaaaugugucauagcugaauuuuguuucauugaaagcaauauuuucauuguuaagaauuuuuguuuugcuuuuuauuuuggaugaaaguggacugauaauacuuaagauagggaaaguaauauuuauguuauauguauauauauauauauagcaagccauucucauauuuuagauucuaguuuuucuuaauguuucuaaagauaaugaugaacaagucacauuugucaccaagugccuuuuuaucuuucccaacucagcuucucugauuuccuuuaugucacauauuaaaagaaaaaccuuagucaaauuaaauuuaacaguuaaauugagcaaagaaugauuggugaaucaagcagccuccagagccagaauagguucagaguaauuccagggcugccacauggucagauaacaauuauggauagaaaaaggaagugauguacagaagacaaaaguaagguauagaaagagcuugguugguuacagcuuauuguuugccuuacuugaacacaguuugaacauuuggcugccuuuagcugagucuuugugauugguacaagaguagguuacauucaguuuacguauccaguuagauguauguaugaagaaaccuuuaggccuaaccuuaaauauguaaggaggcaacuucaggcuaaauuaaauuuaacacauagauguauaugagagaguuccaugaguuauuuuccuagacaaccccaaacuuaguuuacaguuacuuuaucuguuggguguaaugggaucuuuuuacgcuuaaaaagcaugagagauguaauauaaauguucucauuugguauauaaguguagguuaaaagauuaauaguucaagugauguacagugguuguaguuuugcugacagucuaauuagggggaaaaugacuuuaagaugugauuuugcugccauagauaaaaacaucaguuuaaaaauauuccaaacaccucagauuuuucucuuuuauuaaauuucagaagucauaguugucaguuauaugauuuaauauuggccaucguuccauggaagcuuuaauuuuaggcgggauuacaaugcugaacauaagugaauggagaauagauaccagugaccuuaaauuugauauugaaauauuuuugaaaggccuuaaucaacucuuugcuauuagaauaaggaaaauuguuaaguauauugggguuaggcuauguguuaggaauuuggguuucuucacugccagcacaccacauaguauauuuuuaaauugcuuugaauauguaauauaauguuauuuuuucucaugaacuguuuggggaaagaaugugcugaaauuuauacauuauauuacuugauauaguuguugcagaaaagcaguucaucgggguacacuucuuguugcuaccugcuuugccugacccuuccucaacuggcgccucuaaaaauagaguugcuuaagcuagaaaucugagagccagucaucuuugcuuuauaaccuauccauuuuucucuucuuugacccagcuguacuuucacuguuuuuuuccaacccacuaucgguucuugcccagacuacugcagaauuuucuugacuagucccucugauuuugcucuucacuugucuguuuuucacauagcugacagaugauccuuuuaagauuuaaauagaaucaaguaauuucccuaauaaaugguuucccacauacuuacaaugaaacccaaucuucuuacccuugacuuacaaaguugugacaaauacuguugguuauguaccccaaauuuauuuucuucaaauucuucacuaacagaucuuagauuucguucaaggcaguagugugucuggcuaugaaagacuugauuuuuuagccuuuuuuguuuuuuuugguagcuggacagaugacacauuuuuggccaaugaacuauguaugaaaguaucuggagaugccauuucuuccuuaauuauaaaaaagucaagagagaaagcucccccgcgccccccuuuacucacucucccuucuugucugagaaccuagauaugaggcuuagaaauauagcacucuugugacugugagguaagaagcaaguggagaugcuaagaauguggaaagauucuaaggagcuccuaauaccguugauaaacugcuaugugugccuggauugccuuugucuugacaaauugugugagacaagugaaucucuccauuaucuuuuuauuuucuuuugacacggagucucgcucuguugcccaggcuggaguauaggggcgcgaucucggcucauugcaagcuccgccucccggguucacgccauucuccugccucagccuccggaguagcugggacuacaggcgcccgccaccacgcagggcuaauuuuuuguauauuuaguagagacggguuucaccauguuagcuaggauggucucgauuuccugaccucgugauccgccugcuucggccucccuaaauuacaggugugagccaccgcgcccggcggauaauuuuuuaagaggaacaaggugggucaacucuacccuacuagauaucuagacuuauucuaaaguuauacuaacaaauagacaaacugaccaaccaaaaagaaaagauaaggaaaaauaaaaauaaaaauuucaacucacaccauaguuacaaguuauuuaaauaucuaaaugugaaagaauuauaaucuagaagaaaauguaggaacaguacagaaauaggaaagguuuccuuaaauuuuauauauaaaucacaauccauguaggaaaagauuaauguucagaauauguaaagaacgccugcagaaucauaagaaaaagacaaauagcccaaaagaaaauggccaagacaaugaacugacaagaguugaaaugugaaugcuuaguaaacauaggaacagaugcuuuuaucaauuugcauggauuuaacuaugaguauuuuaaaacuucaacugacuuaaagccuaaggacauuuauuuuccugcuugauaagaaguguagugguaggaaauucaagaguugguuucaguucugugaacguaguaaggguucuaugccagcauuuaaaaaaauaauucuguugaauuuucuaacgguugggaggaagggugagaggagaaagggcacucuuccucccacaccuucuguagaagguguagaagagagaaacauauuuccagaagcuucuagauuuucccaucuguccucauggccagucacugacagagcagaaugaaauuaccugauuggcuuaauuaggauuccuccucuggacugaggaagggauggcuuucucuuaguauauuauuuccugcccaauucccgagcaaaauugagucugagcaaaauugagucuuucuguuggccaguguauuaguccauucucacacugcuauaaagaacuaccuaagacgguaauuuaugaauaaaagaguuuuaauugacucauaguucugcaggcuguacaggaaacaugggugggaggaggccucaggauauuuacaaucauggcagaaggcaaaggggaagcaaucaugguggggcaggagagagacagcagaaagcgggaggugccaccaccccccucuuuuuuuuuuuuuuuuuuuuuugagauggagucuggcucuguugcccaggcuggagugcaguggggcgaucucggcucacugcaagcuccaccucccuguugccaccuacuuuuaaaucuccagaugucaugagaauucacucaugugacagcacuagggugauggugcuaaacuauuagaaaccaccccugugacccaaucacuucccaccaggccccuccuucaacacauggggauuccaauucaacaugagauuuggguggggacacagagccaaaccauaucagccagaagaauggauuaugguuaucaaccuuccacuaauauagauugaaccauaugaaguugacaaaaauaaugugaauauaugaaauauauucuaaucacauagaauaugaaaugcauaauauacaaauaauaacaugaaauguauaaaauauaaauauagaaacacaaguguuuaaaaaacacacauugaaaaguauauaauuugcaugauauaacaaacauugaauuuauguaauaguaccucuggggaagcaaagaggggacuaggauugaggguaagaguucaacuguauucauauauuuaguuuucaacaguaaaaaagcaaauaucugaacugaaaaauguaaauaacaauucauuuuuuuuuuugccucuuuguaaagcuuuuaaaugugcacggaauggucacgaggauuuugguugaaaaugaaaauugguagagggcaacuuggcaacaugugaaauuuuaaauguauaccuauugaucuaguacuacuacuuugaggcauuuaucuuaaaugaauaggacaaauguacaaggaaauuuauuuugacuuuuuuuuuuaguaaugguaaaaauguuuuuauaauggcuguguuaguccguucuugcauugcuauaaagaacuaccugagccuggguaauuuauaaagaaaagagauuuaacugacucacaguuuuguagacuguacaggaagcauggcuggggaggccccaggaaauucacagucgugacgggaggugaaggggaagcaggcaugucuuauauggucagggaaggaggcagaggagagcaggaggaggugcuacacacuuuuaaacaaccagaucuugugagaacucacuauuacgagaacagcaagagggaaaucugccuccaugauccacucaccuaccaccaggccccucuucuaacacuggggaucauaauuugacaugagauuuggguggggccacaaauccaaaccaaauuuuuuggucccuggcuccucccaaaucucauauccuucucauauuucaaaauacaaucaugccuucccgauaguccccaauagucucaacucauuccagcauuaacucaaaaguccagaguucaaagcaaagcaagucccuucugccuguaaaaucaaagccaguuaguuaguuacaagauacagugggcguacaggcauuggcuaaauacucacauuccaaaagggagaaaucaaccaaaacaaagggccugcaggcuccauggacuucgaaacccagcagggcaguuguucaaucuuaaaguuccaaaauaaucucccuugacuccacggcucacauccaggccacaccaacacaaggggugggcucccaaggccuugggcggcuccaccccuguggcuuugcaggagucagcucccauggcugcucucaagggcuggugcugauuagggaaauggaaguuugcacucaggcuuuauucagauccguagagaaggagaauaauucaaccuuccugggucaggacagcacuuauggcccaguggaagaguagggcauugaugguagagggaaggaagucgaaguuagagaauuaaagaaaaccuaacauccguaaaguucugcagguauuuaaaaaacaaaaccaggaacccugguaagaugcugacaguuuacuugagcauguacccuaugcuuuuacugauucaguuacuaauacaaaauugaucuuuucaccuaaaauuaucagcuuaauuuuuaaggauauuuucuacggaaaccucauucugacuuuguaauacauaucuguggaaauguaugcuuuacuuuggagacuuuuucuuagagccugcuuuucuggaaugaaugaauuucuauagauagcauggaagacauaucuugagauaaauuucuuuuuuccccuuacucuuuuccacaugguuuuuauuuguuuaacauaugcccaaaauaaaggaagaugugacucuuuuacugucuuuuauuuuuauuuaagaugccauuuuguaacaguauuacacaauaauaguagagguagugauaccuaguuaauaagaccuaauacaauuuaaagugggaaagaaucauuaauuaagauucuagcuugugaauauaaaaaugcgaauauuugcgguuuccuuuuauaacccauugcaauuuaguuuguaauuuuaccacuauacuaaaauuaguuuaauauuaccaauggccauuguuuucuucuccguugaucucauuaaauccucaugguacuggacuuugcauaauguuguuguuccuugacuuccacgauguugauguugugcuuucuuaguauuucuuaccuuucuaaguguuugccucauccuuagacuacuugagacucuuucugacucccccuaaacccccauuuuugucugaaaacugugauacuucuuauaaaauucugguuuuauauucccaagugcuuguauucccacucauuugccauaucguuuccucaaacuaagugaauccaagcuugaauuguuccaguucaccacccauuucauauaguuuggccacuagccccaagaauagauauuuuggcaucaucuuuaguucuuccuuuucaaaauucccuuugaccaagcguucaccauguguuucucauacccauacauucauccccaauuucccuaauacaaugcuguguguugugauuugucuuagauucgguuaucagcaguauuuauuuauuuauuuuuauuuuauuuuauuuuauugaggagucucgcacuauugcccaggcuggaaugcaguggcguggucucggcucacugccaucucugccucccagguucaagcgauucucgugccucagccucccaaguaggugggauuacaggugccugccaucacgccuggcuaauuuuugugguuuuauuagagacgggguaucaccauguuggccaggcuggucuugaacuccugaccucaggugacccgcccaccucggccucacacagugcugugagggugugagccacugcgcccggcuuaucagcaguauuuaaauaacccuuguuucuaugaauguagugaugaguuucuauauacaguuuuguguugugaagccugaggggaaagugaguuccuggauaagucuugucauauuuauuuuguguuucuagcacuguugcacagcacauauuaaguguuuagaaaauguuuuuugaaugaacagcccaaagacuaaaggaagagcuuccuuaguucuaaauucugugaaaugagucaguuugaaugaagcuaauguuucuuuuguuuuacaccauuuacuauagagugcaguacuucaguuguucauacuuguugauauuguuacagauauucuaaugguucuuuuuacaaaaucaaauauauauacaagacauuuuuucguuucuuuuuagguuuuggaaggaaggauguuguagaacacuuacuacagaugggugcuaauguccacgcucgugaugauggaggucucaucccgcuucauaaugccuguucuuuuggccaugcugagguugugagucuguuauugugccaaggagcugauccaaaugccagggauaacuggaacuauacaccucugcaugaagcugcuauuaaagggaagaucgaugugugcauugguaaguaucauuugaugauaucuaaauuuuaaauaaagguuuauucuuacuuuuuuugugguacaaauaguguuuccugagaauagguaaggaaggguuuauugcuucuuguagaagcaguucuuuuccaucaaaagguaaacagagagaugguaaucuaaaguuacuuaggggaagacucacaacauuaacuuuccaaaugcagucaaaugccuauugauguggaacucaauuuuaauggauuacuauugucaaauuuaguuaauuuauagucucuuuuaaagacuggacauuuucuauccuaccaucaaugagagccauuauaaaguacaaauucuacugaguuggaugacauuugaacacuugagguugauucaaggaaacucaucuaguauaguaguccccccgcuuauaugggguuuugaguguuuugaauacaguaguucagaacuuaaucguuucaauaugugccauagucuagagaaaaagcaauuucaaacaaauuggacuuuucaaucauuuuagguaucuagaugaaacgaagcuguauucaaucagcauuuuguucucucauauauauucacauuuugcuuugcuguauacaauuuuuuauuuugaaaucuaaaaagcuucuagagggcaaguauaauuucucuugaguguaucaucuguuuuuugauacuugagaugauggauguuuguuuagccauggcagguugauuuacguaauugucuucccagaugucauccacuucagcauaaucaguuuuuuaaugaugcaacuaaaauauacaugacauuuuaaaagauauagugguggugcuuaguaaugguuaagauuauuccuccuuauagccaucuauugcagcuucuaauauauuuuucaauauuccucaaauuauugcaaugccugauauaaaacuauuuuuuaaaaaaaucacauuuucugucauuauccuuugcuacuugagcauccacuaacaugaccuuuggauauccuguccuuucaguuuuuugacaucuuccaguuucaacugacucucccauuuccuccuaagucucucacuaacauagccacauccuggaccaagucauuacauaaaacuaccuugagaagcuucaacuuauaacauccucucucugacuacaaagccucuuauguuacuugcuuuuguaaaugauaacuauuauugagcuuggaauguguuuccuacguagucuucuaggcuuucaucuucucugcuguaacugcuucuugcuucaccuuguugucacagccacuggauuuuucucagucauuagucagaauuuuauacuguucucacuuucuuaaaauauuauccuuuccaggcuucagucuucuguuuuccugccucuacaucugaaguuuucauuuuaucaguccuuugaauaucuuauugaaauuaguauuucucgccuccuccucuuaaucccucuuucaaaaguccauaauguaaaugcucuuuuuaucuagguucuauugaaauaaaagacuagauauggggcuugaauuuuuaaugaauggaucccugcagcacucuacuuccucaguucacaguaggcuuuggcacauauugucuucauucuguuuaaguucuugugccuuauaaaaguugagggaaggggaagggcaccuuugaaacuauacucaaaauauaaaugaggauauaguugcuauuaaaguauguaucauaguuauuaugggagucaaaauugguuguaaaccccgguauacuuaauuagcuugcagaaaccucuuaggagguuuauucugagguucacugaaaccuguaauagcuuauauaucuuauuuucuggaguugaauaugguuaaggaauucugagauuuuucucuguaaggcagaguucugcuuugggauagcuggauaaaaaaagugggaagccuuguuuuuuuuuuguuuguuuguuuuccuuuugcuggagucuaguaguuuuugagagauuaguauacaaaauugauuuuuaaaagguuuuugccuagaugaugaaauacuggccugauuuuuauaaagauuaaucauaucucuauaugugggguagaauagcaaauacauuugauauuuuugaaaagcuagagcccagccaagccacauuaccaccagcuuacaggagacaucagggcagguugcuguagagcacaugcuccaggcuuauacccugaccccaccaguuuccagcugugugaggccaugggccacuuucuuggccucugucuuuccuuacauguaaaaugagaauacuguucuucacaguguuccugagaggauaagcuaguacauauaaaauauuuagaagaguaccagguacaguguacauucagugaauauuaauugccauuauuaauuacuauuauuauuguuggugcuaaaaucucagccugaauuaugcuccugugugguacagaauucccauuuccucuguuuguccuuuguugacauuucuuaaaaauguccauuuaggggcaggcgcgguggcucacgucuguuaucccagcacuuugggaggcugagaugggcagagcacgaggucaggagaucgagaccauccuggcuaacacggugaaaccccaucucuacuaaaaauacaaaaaaauuagcugggugugguggcgggcaccuauugucccagcuacuuaggaggcugaggcaggagaauggcaugaacccgggaggcggagcuugaugagcugagauugcaccacugcacuccagccugggcgacagagcgagacucugucucaaaaaaaaaaaaaaaaaaaaguccauuuagaaaucuugaacccauguguuucuuucauagaugcuauuuaccaucaaaaagaagaaaauucaaacugagauuauuuuaaaaaucaacuugaaaugcuuguauaauuaaacaaacuacuuaagacuguggucuugggaauguugaugacaguuuuuauacuguaauguugaauugaauuuacuucagaaaucaauacauuuucugccuuuagaacuuauuuaucuuugcuucucccuaccccucaaauauagucuccaaaaccacuaaauagcuuuucugaauauaugcuauaugauuuuuuuuuuccuuuuuugagacagagucuugcucugucaccaggcuggagugcgguggcgcgaucucugcucacugcgaacucugccuccuggguucaagugauucuccugccucagccucccaaguagcugggacugcaggcgcaugccaccauucccagcuaaguuuuguauuuuuauuagagacaggguuugaccauguuggccaggaugcucucgaucucuugaccuugugauccgccugucucagccucccaaaguccugggauuguaggcgugagccaccgcacccagccuguaugguuuuuugagacuguuagugcuugagaauuucauuuuaaaagcaaauuauaagcauacuuuucauggagucugauauaagaucugggagucggagggugcgguggcucacuccuguaaucccaguacuuugggaggccgagauggguggaucacgaggucaggagauugagaccauccuggcuaacacagugaaacaccgucucuacuaaaaauacaaaaaauuagccgggcgugguggugggcgccuguagucccagcuacuggggaggcugaggcaggagaauggcgugaacccgggauggggagcuugcagugagccgagauuacaccacugcacuccagucugggugacagagcaagacucugucuuuaaaaaaaaaaaaaaaaaaaaaaaaucugggagucacaauggauauuugugauuuuuuucauuuugacuaauuaguauccaauucuuuuucugauuuuggagauuuuaaacugugggcacuccuugcugagaggaaugcggaaacugguagugucagaucuuccuuccuucuacuucuuugcagucagggauugucuugguuuguccagucaugcacuucauuuuguaaauguagaauuuugaauacaaaaucuuagcuauaguaaggaaucauauauagcagcagauuuuugcuuuagugugggcaguggccuggucauaauguuuccuacuaaaagacaguugugcuuccuacucuuagcucuacagcuucuuauguguuucuaagguugguccucuacucuccugucauuucagucuaagauagacaaugguuucuguuacuugcaaauuaguauaauugauaacagagaucuugagaagguugcuaaauggaaguugcagaauggggcuucuaaacugauaaaucucuugaaucuuuauuuaagucucacugcccucacacaguuuacauguauaccacaccuccaucucuccuuauucucuacaauucucaagagugaaggagacagaguauguucccuuuggaggccucuuccaggugccucucauuagggaagagacagcuugcuggcguccacagcaaaucauucuaaagauaacagagguguaugguguuccaacgcaugugggauugucacuguggaauaccccaacaucuagacaugaagcccagcaaaccaagugaaaaauaacagcccaucucagccagaagggaugauuaagacaacaaucagaauacauauccaggacugcuaaaggagucagguaaauaccugaauaaaaaaaaaauaucucccagagaaauuaaaguauaaaguggggaagaaauuuccuggggccaaaacucaaaaccgaaauaaaaaaaaaauccaccaccuaauuuuuuuuucagaggaaacaauuuaguagaugaauuaaagaccauguuaguagccuggaagcuuacgugugagauguacagagacaaauguugaaacauggaaaucaugacgaaaaagguaaauaaaucugggaacaucaacgucauuuuaaaccuuacacgugauaugaguuucagaggcaggggaaaaaagaaaaaaaagucugauggaagagaucaguaauaauuaaacaaaugauaagaaagagaaaccuaucuugagauugaaaaggcucagggagcuccauaugagauugaugagaaaagauaaacugaguaagauguauauugcacuuuuccagaaagaaggaauaaguugccuacagagggaaaaaaauuaggcaaaggacuuuucauuuacaauauugacagcuugaagacaauggaauaaccuucuaaagccugcuggaagaaaaggauuaaguuguaauuuccuugauaaagaacaguucugcagccuuuugggaguaagaaaggcugaaucaagcaagugacauuacauuagagaaacaaagcuccugcaacuuucuuucucuauacuuucaaacaauucuugguuuaauuugucuuauaugcagagacugaggggauccucacugaauaucuuucuugggagcgcaaaauucaagcugcucuuuaaaaucuaacaauuaggacuuaaaaaaaauaacuguuuucuggcugaauggcauuacguaauagugguuggagucaaagagaccuguuccuugagugaguuguuuacuucuuucagcauuaaaaugggaaugaggguaauagcuguaugucauacaguuguuaagaggauuaaaugagauaauauacgugaaacacccuuguacaauagcuguauauuuuauauauaauaauuagaaaguacaugcucauuauuuggcaacugcuuuuauuaucgugaaauaacaugauuagaaauaguuuucuucuuguauuacauuauauuguuccagauacuuuuauauuuacugaaaaugcaagaaaaaauagagaucugaugguauuuuucuaaaaagucucuaagcaaauuggcuucuuaggggaaauuaagcugacuauauaaagauaguauuauuuaauaccauaauuaaaguugguuaucuaaaugaacuaaugaaagcaauuuguuguaauucccauuuuucccaucccaguucagaacuucaauugauuauuuaauauguaauaggauuucugcuguuuuuuuucccauuauuuauacuucagggacuccuuguuauaaaauuauauuuuaugauucugcugagagagagcaaaaauaaaauuaugcuuuaucucuucuucccccuccuuugccuuggaaaaguaggggacauaccuuagcuugugauuauucaacuagguaaaacucagauucauucagucaaauguaauauaucaacccagauaagaucuugguucagaaaaaaauguuaaaacagccaguauuauagaauuuauauuuaaauuauaauauagucuauauaauuuauaucuaaaacguguguguguguguguguguguguguguguguguguguguaugaaguuaggugguaaauaauccaauugacuuguuaaguuuugggcuaauaauaugcagaguuaucagcaauagggaagacugaagacuuugcuccucuuagaguaauugagggucaccguggucugcugcgaagaacaaugaaacaggagucggcguaccuggagaguacuguugggucucccguuagaaagaaccauauacauauaauguuaugcuuuaaaaacuuuuuauaagaaguuacaugcuauaugugguaggcaaauaaugguugaaagauguucauaucuuaauuccuggaaccugggaauguuaacuuuacauugcuaacagaaauuaagguuacagauggaauuuugguugcuaaucaguuaauuugagaugggaagauuaucauggauugucuugguggacccaaaguaaucaccagauuccuuagaaguagaagagggaggcagagagaaagucagaugauauaauuucagauggauucaagccaccauugguggcuuugaaaagagagaaaggguucccuaaacuaaggaauggggguagccccaagaagauggaaaaggcaaggaaguagguuuucaugaaagucaccaguaaggaauucagccuugccgacaccuugauuuuuuuuuuuuuuuuucuucaaauggagucucgcucugucgcccaggcuggagugcaguggcacagucucggcucacuguaagcucggccuccuggguucacgccauucuccugccucagccuccugaguagcugggacugcaggcucugccaccacgcccggguaauuuuguuuuuguauuuuuaguagaaacgggguuucaccauguuagccaggguggucucgaucuccugaccuugugauccgcccgccucggccucccaaagugcugggauuacaggcgugagccacugcgccuggccgacacuuugauuuuagcccaaugagacuuacgucagauuuaggaucuccagaacuguaggagaguaaguuuguuguuguuauuguuuuaaaccacuggauuugugauaauuuguuacggcagcaauagcaagcauauauuauaaaaacaucuuacagcgguuuugcaaaauuuaucuagguugagcaucuccugaaaagaguaguagaauguuuucaauacaauuaaaacugcuuucuuggaaaugcuuaaagauuuggucacugaggauaaguagcaguuuuuuauguuggcaaauauacaagaaugauacuuguaagaauucuuaaaauaauuauaaaaaagcagauaauguaguggacucauauuugugcuuaaaugauuguuucugaaguauuuugagauuugggguaaauuaucuuacuaagaaacuuaaaaaaaauaaauuuugugucaaauuagguguggagaguccuuguccuuauacacuuguuuaaacugaacauuuucuuuguaaucuuuguaaucaggugccacauaaaaaauguuugaaagacauguaacuugacaaccaaauugcuucuuuuuuuuuuugagacagucuugcucugucgcccaggcuggaguacaauggcgggaucuaggcucacugcaagcucugccucccagguucacgccaugcucuugccucagccucccgaguagcugggacuacaggcacccgccaccacgcccagcuaauuuuuuauguauuuuuaguagauacaggauuucaccauguuagccaggauggucucuaucuccugaccucgugauccgcccaccucggcguuccaaagugcugggauuauaggcgugagcugccgcgcccggccccaaauuguuucuuuuaucuaaaaaggggaauuuuauugucugcaauaugaggcaugauuaaacauuuuagguugaacugaagacuagggccccaauauuucuuucuuuucuaccuuuuaauuccugugacuuugggcagauuauaaggucugugcuucuggugagucuguuucugaaacacguggccauuuauaaagguuuacugugugaagugcuuucagacuguuccaucucuaaugagcugcuuggccuaugguucuuuuagugaccaggaaaacaaaggaaaagugauauugaaaccccauagccuuauuucaaauuagacuaggaagaagaagcuuauccaaguugagagggauagguuaauggguuaaucggaguggggaaagaugacagcauucagcacaucauggauauuauugucauagauaauugaauauaugacaaacucgauugguaugggaauuuguccucauuaguguuugugacugaaaacgggauuauuucccugcucccacugaaccuauugacaugagaaaaaaucuauagcuagagauuuugcucagugagaagccuugaaaccuguauuaaugaaacaauaaucuacuuucacuugaauaaauguaaucagaaaguaggauacuagaagcaggacauacauucugggccaaggguagcagcaggaucagcuugacuaggagguucuagaaccuaguaguggaguuagcuaaugaaagguauuguuuauaaacuagaggucucuuguaaagcaucagauaaauauuugaaguuauaguaaauaacugcauguaaaguuggagacagaaacacaccagucaggaaaaccaagaauuuugaaguaaacaaccaagccagcuccaagaacuuuagcagcagagguaugucagccuucucauuagaauccucccuuaaaguugcugugaggucuuggcuucaaguccacucuuguugcuaaaccugagaugcaaagaaucugaugccccacuuugaguuagauguugacccuuaaucaguuagcuuuagucucagagacguuuccuaguguggacuuggccccucgggccucaccacuauacauaggaaucuacaacugagaguaaauugauauagcggggcugggagccacgugggugaggaagagaagaaaguaaaaaugagcuugauuuugauuuuggaucccuucgaaaauugauuacuguuaauauucuuugaaccaucucaugccuucaacgaagaucuuaauacucuuugugaaagaagucuucugauaauauguuucuauagcuguccacaaacucuucugaauuaauucuauaugcauauacugccacccaacacgucuccucuguucaugugcaugcuccauucauugucccguugaauguuacguacaaaauacaagcuaagagauaagauugcuaagaauuucagguggugacagcagagcauuggggcccugugcaacugcacagcuuguguguucgcgaagcugcccaugauuagaucacaguaugugcguguuuaaaaaugcuccacauaauuccagguguacuuaaguaacacccggacucaucuucagggcccuccuuggucuggcucccgucuacaucauggacuucauccucaugucccuguaauucccucccuuucucuccaccuuccagcuacaauggccuuuuugucucucuaaugcaccaaacuuguucugccugcgguacucuuuccccagauuuuucacuaauaauguuaauucaucugaguugugcccugacaaagcugucauaauuucuugcccugcccuguuuguuugauuacucuuuuaucauguuuuauuuuacaccauagcacuuauuaccuggaauuauauccuuauuuaaucauacauuuacuuguuuguuugccaucuguguacucuucccaacuuugugccuuaauauaaacacaggaaccuacucugccuuacuuugcaccacaucccuggcauaauaaagcucugugcuugcuccgaguaaaaugccuacucugugccagaaccucagugugguuuuaauugcauuugccugauaaguaaugauguugagcaucuuuucaugugcguguuugccauuuguauguauucuuuggggaaaugucuauuccuaucuuuguccguuauuaaauuggcugucuuuucauuauugaguuaugauagauaaaaguuucuuacuagaaaaaugauuugcaaauacuuucucccauucuuuguguugucuuuucauuuucgugauauuguccuuugaagcacagaaguuuuacauuuuggugauuugauuaaugguuaacauuaaaaagucuguuucugcuuucguugcuugugcuuugguaucuuaucugagaauccauugucgaacccuagaucaugauuuaacucuguugucaucuaggaguuguaacugaaauguauuuaggucugaugcauuuggaauugauguuuggagaugaugugaggugaaggguccaacgucaugccuuugcauguggcuauccaguuuucucauuuaguuguucauaauauuccuuuauaaucuuuuauuucuguaagcuuaguaauaauuuacucccuuucguguaugauucuaguuaauagaguugucuuuuauuuuuucccuagguccauuuggcuaaauguuugugaguuuauauugugugugcauaucguuaguuuuuuuguuguuguaugguguuucauuguauggauguagcacaguuggugguuguuuagcuuguuugcaguuuguagcuguuauaacgcuggauguaugucucagcguggacauguuuuuucacuucucuuggauggaucccugagagugggauugcuggguggaaugcuaagugcacauuggacuguaaaagaagcugcguugcccuaauggcugagcauguugagaauauuuuuauguacaguggucauucauguauauuuuuugugaagugugcauaucuuuuggccaucuuugguuuuauuuuuauuuuuugcuguuacugauuuuugagaauucuuuuugugcuguaacaaugggucuuaguuggauguguguauugugaaugcuauuucccaaucuuugcuuugcuuuucguuuucuuaaugguaucuguauacaggcaaagguuuuuaaguuuggugaagucugauuuaucaguuaaaauagcaaaguauuugguguuucaucagcguuggaauaauaagauuucugcuugacaauuauucuuagguuaaaagcaguauauagagaaauaacauuaucguuuuaauuacacuguggaaauucaggaaagcaguuuccggucugagggcugcugcuucaaaugcuuucuaacaacuugcuuaggauauauuuuuaaagauuaaaaugaaagaaucagcuauuucaugugaaaacuugaauauauuauaggacucauuuuuaagauuuaacaguaaaagccagguggacuuuaacuaauuagaaaauaauuaucuaaaauaugcacaguuauuucugagaugacauuguuugccuacuauuggcaaguauauuuccaaaauuuagggaaauaggcuguuuuuaauagcuuguugccugaaaucuuuccacaaacgaagacuuauuaauucccaauacuuaaauuuuuuuugguuuguguuuuccuuuaauguguucuguuagcauugugaacauuaucugcuuuucaaggaucaaaagacucacagauguucuuuuagcuauuucuucaucuuacuggcuuuaguagaauucucauacuuuucauauucccgguauuaggagacaggaaauacaaacagauuaaagacucaaagacuggucuuuauaguucuaguauauuguaaacuuccuguucuucuuggcgucuagaaguagaguaguucucugugcacugaguauguuuacuuucuaacacagccacaggaugaggugccagauucuuaaacugaaucagguaaggugugaaguuaagcauguaccacguucucugugguaggaacuaacaauaaucuuguccacuuucauacguauucuuauugucuaucacugaugucuaauuauauucaagaaacgugugugaagugacaaagcaguucacuggaagaaggcuugauucugucugacuuuuuuuuauauuacucuguguuacauggauaaggaagcugaguaauuuucuacuucuugauuaggugauaucuugagauuccuuuauuuuaaagcaaugugaacuugcaguaugucagacacuucaauauucauauacaaauauaaaacacauuuuauagucauaugcaaauuauguuuagauuaucuuccauuugucaaguaacugcuuauucuucauuaggaugggcaguugaauauugauucugaucaugcauuaacuuuugguuauaauggguuuuccacaaaggauaguaaaacauuuuuucuuguuaacuuacagauuaaacccaugaauugccccucuugggagcugaggaguugagguagggagggauaagaaaaaauaaggugauggugguaaauuuauaaaaguugcuguggauaguugauacguaauauuguaaaggguuuucccucgaggccucucaaaggacuuagccaagcagugucacuaauauuuguguccugugugugaggcagaugauucagauuaccuaccaguuuaccagugaagaaggagaaaguuguuacuuugccacagucuguagagcugauagaaaguuguuauaauggaaauguuuucuuaauugagaaaugaagguucuguucacacagugggcuucauuuaagaauacaucauacauauaaaagguuaauuucauucuguaagucugccaaauuaauucuuuuaaauuauuuuuagcuuagcuuuuaaaaccguaucauauuuagcaaacuuaagguggaaaauaaucuucaccaaacccccuuccccccaaaccaaaaaacuaaccugucuacaaaaauuuaaaccaaguguaacuuacuccuaaaguaauaccucucuguuaauuuccuuauaacuuccuuuugugugucugcuauuuagaaagauauguuucauuuccuuuuacaaagucuuuuaguuuaaaaaauuaucugaccacuuccaugguuacuuguccuuugaugaaguuaacauccuggaacuuggaauggcacgggauuggggaugggggaaagaaauguggaaugaguguucaacugccuuugguacauucuuaucccuugauauuuauuuauuuauuuauuauuauuauuauuauuauuuuuugagacggagucucacucugucacccaggcuggagugcaauggcacgaucucagcucacuggaaccuuugccuccuggguucaagcaauucugcugccucagccucccgaauagcugggacuguaggaacccgccaccacgcauggcuauguuuuguauuuuuaguagagaugggguuucgccauuuuggccgggcuggucucagacuccugaccucaggcgguccaccugccucggccucccaaagugcuaggauuacaggcaugagccacugcgcccggcuaucuccuguuauuuuaaguauaguauuuugaagguuaacaacuuucuggguuuuuucuuaacagcauuauuagaagugauaguugcccauuaaagaaaaaugagaaaauauacugaugauaacucucacaccuuguuuuuugucuauuuagacuugcaugguccagugugauagccauuaaauuaaaaucaauuacaguuuuaaaaauuaaaaauuuaguuucucaguugcacuagccguguuuuaaaugcuuaaugaccguaucuggcuaucgguuaucguaauggagaguguagacauagaaauuuuuguuaucacagaaaguucuguuggacagugcuguuagacccagugaaccuguguauacaauccauuuuacguaaaaugagaucauuccaccauauuauuuauuuauuuuucuacuuuauguaguaacauauuuuauugucagugaauauuuuuauauaaucucauuuuaaaggcuucuaagaauuauuuauauagaaaucaucauuuuuuaaaaucagucaccuguuguaggccauuuaggcuauuuuuguaccauuuuauaaacaguaguauaaagaauauccuuuucauuacauauauguauaaaucuuaauugcuuuaggauaaauuccuggaaagccacagcuucuuaauaaggaccaaagaaguuuuagcuacuggagaacuucacuggaccucuugauuuaguuugucacacugucuauuuauauaucauuuauaaaugagcuagguuaagaaaagucauuucucacaccuucuuuacuguuugcaaaaauuaguugaaaauucagugaagccuugaaaaucugauucacuugguuuuguuucauuaaugucuuuccuuuuccugccagaauacuucccuucugcauuuuuaccauuaguuguccauauaaaaccugaauugguauuuuuuuuuuuuugagacggagucuugcuguguuguccaggcuggagugcaaugugugaucucggcucacugcaaccucugccucccagguucaagcaauucuccuggcucagccuccugaguagcuaggauuacaggcacccuugaauugggaucuuuuaaacaagucucaguguagcauuuucauaaaaaacaaagaugacaaaauuccauacuuguauccuuaaaacagagaagagaggcccagaaugagagucauugugccuuuggaaauaaucuccgcugacacugaguacucuuaacguugaugacuugucugcuuguguuccaacugcuuucaggaagguuagaguagugugcauuuaccugauaaaauugggacuguuuuaacaguuauucuguacaauagugguagauauacacauaacauauauauauguuauguacuuauuaauuguguuuuauuagaauuccaggaaaagcacccguauggaagcuuucacucuuccaaggccuuaagaaauacauugaagaugcuuaaauuagguggaaaaagcaaaaaacuagaaaaaaaauuuucauauacuuuuuuacagugaugcaaggcuuuacuuaaugcccaggucugucugucuaauaaaagcauuacacauuugcauuuacuuuuagacucacuucaauuguucaaaacaaucuauggguuagguuaggugcagugacucauaccucuaaucuuggcacuuugggaggccaaagugggaggauugcuugaguucagaguuugagaccagccugagcaauaaagugagauccugucucuacaaaaaauuuaaaaauuagcugggggugguggcacacaccugugguccuagcuacuuggaaggcugaggcagaaggaucacuugaguggggagguacagguugcagugagccauaaucacuucaugggacuccagucugggugacagaggggacccugucucaaaauacauauauacauacauacauacguacauacacacauacauacuguaguuuucagugagauacauggcuuaaguuugggguuguaugaaaaugguauuugagacaaauggguuguguaaccaggcagauuuugcuuugcaucuuuaucauguuaucugaaacucauauauuauuagaaguauggcuucccuuuguacaguuuuaauacugaaauguggagguagguccauauuugagauaaagauguagggaguccuucuuacuucucauucucaacugaccaagcuagaaaacuauuaaguauaauaauuguauuuauaggcuuuacauuuguacuuuacuuuuaaaaaacguagugucuuguauuauuuaaaucugcuaauuaucuuuuuaaaaauaugguggguauuagauuuuucauauguaagcagaauccaagauuaagaauguuaaccuuacugugaguuauuucauauucuacucccugauaugaccauauaaauaagacuuaccaagcauucccacuguguagccaaagauacauuuauuuuggaucaauacaucugaaaucugaauaacucuuucagacuuuugugucaagccugaaaauuucuaaauuuacugugguacacauaaucauggcuagagauagagggcacaucuuuuguuuugccuguuuaugacacagguuugagugcuggucuuuugaaagaauaaacuugaguucugaggauugagggaaccaggccaggaaauguucuaguggguccccuaaaauggaacucucacugucauagguauuuuucaagcguucccacaggggaacugugaugggcuuauuaggaagaggacauugaauauaggagugguauacgagguauuaaggacaaauauguagauaugccuuuuagaauuuacuucuggggaagaaagcuugaguauuguucugggauaaucuuagcuugcauuuauauggaauuuaagauagcaaauaagugcuuggcuuuacaauuaaguaugaauugcaauguaucacauacagacugauuuuacacauuugcuuugagcuucaguuucuuaauuauaaaacggacguuggcucuacugcauaaaauuuuuaugggaaguuaaaugaaagaauauagagaaagcaaguagagucucaguaaauacuuguuucuuuccacuugcuuucuucuuguaugcaacaguaagguugccacacaagacuauuuuuguauucugacacaaagcggacacucaaucaaagcucagugaagggcugacauucccauaagcugcucuuuguuaccaucagcgugaauuuguguuacauucuuuguuuaguauccuuuguaauuuuguaaacuugaguugugauuugauaagacaugaagcucuuuuuuccucauuguaauuuagauucuuuuaaccuagugaguggagauauugcauauaggauuauggagaaucguuaauguaacuuaaacauuuuccccacaaauauuucaauagcagggguaucgugguuugcuguaaccaaauauuaaguguaugaaauaauugguuaauauuuuuuaaagcagauuacucaugaguaagcagcucucuuucaagccaagagacaucacaguugcuguuucugaaaauuguaacccacuaggaaugagacaaggaaaaggacagaugaggaauuauguuaaaagaaaaagguggucuuuuccucaaugugggggaaaaguugaggugggaagugaaauaugugauucaauacuaucauucagaacaauugauaauaggauaaugugucaaaucccauggaaacacaaaacucaguuuauuuuuuuaauuauuugcuuuuagcuaaauaacuuuccuaaggaaugagaauucuuuaaguuauauucuuuauguccuuuagauugaaaguacagcagaauguuggcauuucagucuguugaaucaguugucagaggcauaggaaaauaauaguaaugauauauuuaugauauacuuucuccuccaggguucacgccauucuccugccucagccuccugaguagcugggacuacaggugccugccaccaugcccggcuaauuuuuuauauuuuuuuaguagagacgggguuucaccguguuagccaggauggucuugaucuccugaccucgugauccgccugccucggcgucccaaagugcugggauuacaggugugagccaccgcgcccggccaguaaugauauacuuucuuaggagacuaaaauugaaagcagaaucaaauuauuacuauuaugguacagguuuaauccuguuuuccuugggagggaggauguuuuaaauauguaaguuuaaaccuuguaacuagugauaaaaauauuaauugccaggcugggcaacauggagaaacuccaucuuuacuaaaaacagaaaaauuagcugggcaugguggugcaugccuguaguccuagcuacucgggaggcugaggugggaggaucaacugagccagugaugcggagguugcagugagcugagauugcaccaugccacugcagucuagccugggccacagagcaagaccuugucuaaaauaugugugugugugugugugugugugugugucuguguguguauauauguauauguguguguguauauauauauauauauauauauauauauauauauauauauauauauauauaugaaugaauuggucuucauguuuuacacacauaagaaauuuaucuggaaugcuaguaaguccgugaggccuugagagagaggaaguagaguuagcaguuuagggaaagauucacaaacacugaugaaguguuucucauguuuaucccuucuucugucucauaaacagauugggaagcaccuuuuacauguggucauugucccuuagaguugugcaagcuuuaugauccuauuauaaauuucccuggucagauuguagagauacuugcuuuauuccuuauggacauuucauuuaguugaaucuagucaaguuuagaaaaaguaaucuaccccuaaauaaaaagaagcauaauauagcaguuagguguggcacaaaugaauucauuguuccuagggcuauuaucaguuuaccuuuauuucaauccagcagaucuucuguuagcacuguauaucuauuuuugaaagacagaugaaaagauucucauugggauacgagagaguguuuauugaguucuuguuaugugcaaagagccaagccgaguuuguauauauugucacauuuaauuguaacagcaauucacuguguuagguaguguuuuaugaaagaggaaauuaagauuggcaguggugaaguaacuugcccaaggucagacaguuacuaaggauugagcaguauucuaaaacugagguuuaucugauuccugggacagaacuuucagucauuauucucuauugaguuuccagguagaaagagagauacuuuguuacacucaaucuuacauuuauuccaguaucugccuuaucuuguaauaaauuguuaugugagcagauaauucugauuuuacaaauguauuguguccuggauuaacuuuguucauugcaaaaaggauaaaauugaucugggauauaaaaaucugcuauguauauguacagaauaaucuauaccuaaguuacugcagaugugaugugccuuuuuaaaaaaaaaaagucuugauuuucuauauuuauaaguaaacuugacaacaggcgcaaaauugaauuggaagauucuuuuauuauuguaaaauuucaugccagaguuuguccauaaagauugaaggagaugcauuuaacucauuaagucauauauagaagaccucucccauguaaaacucaguaauuuuauucacauggaugaauuuuugaguggguaauuaaauauuuuuuaauaucucuaaaaauuaugugcauaggcuuguuuuguccuaacagcccuaugagauagguacucuaauauuaucuccugauuuacaggcaaggaaauggaagcugagagagguaaaggaauugcuagggucccacaaguaauggcagcagaacugguauucuagccugugcaguuuggccccagaagccagccucugaaguacagcuguguucuuaacucuaacuauggcauauugccauggcagacuuuguagugaacuuuauuuuuuugaacuuuuaagaauuuuaauuaaaaguugugggguuuuuugagauggggucucacucugucagucaggauagaguccaguggugugaucauggcucacugcagccucgaccuccuugacucaggugauccucccacuucagcuucccaaguagcugggaguacaggugcacaccaucaugcuuagcuaauuuuuguauuuuuuguagagacaggucucgccauguugaccgggauggucuugaacuccugggcucaagcgaucuguuggucucggccucccaaaaugguaggauuucagaggcaugagccacugcgccuggcugaacuuuuuuuuaaaaaagaaaugcaguuuuuauuuuuucccacugacguacuuggaaaaaaaaguuacauguaaugagacacauaguucacuggggugaaauuaauuuguuccaaguaugcuagucccagauguugacagaauucugaauuuugggucacuuuuauaugaaagacaaagacuuucauauaugaaaguaugacuaaaacccuggaauuuuugaaauaaucccuucacuauuuuacucaauuuguuucuacagucagcauuauuacagaaucuaaauuaauagauuuauuucacauuugucuuauccauugcuguuaccauauuuaauguuagucauuugauaggaagaaugauccaauuuuucuuuauucguuacaaaguaauuucuguaagcaagagcuuuuaaaaagcauuguuuugcacacauauuaaacagcaugcauaaagaucauuuuugucugaggaucaauaucccauuauaaaaauaacacauauauguaauaaauacuaaaacaguguagaaauguauaaaauagaaaguggaaaucccguuuauuucacuuucagauauaacacuaaauauuccuguuguuaagguagcugaaguaguuuuuuuaucucuguuaugaacccauuugcacauauaaaucuauuuacauauuuuuaaaacaugaacuuuaaauuuaacacguguuaaaacuuugaauuuaacauguauuauugcaguagcuacucauugagauaucugcacaaguacucuuugcugagaaccaaugccucuuuccccaucaucauuguuuguauugccucuucuaguuccuuggccaaacuuuuuaaguccagaaccagaugcugagccaagcuggaccaaauucucuuucaugauaauuuggaacuaagauugagauaauacaggcguauguguuuguaucucaggggaaugucugggagacagagaaagacagcaacaccugaauuuugaggcacauuuuugccuuugcguucaauggaauaccucuauucuuuaauaaauuuuccuguuauuaagguagcugaaguaguuuuuuauccuuugugauaaaaaagcucuauuugauaaagucaguacucaaagauauauuuauagaccacagcaccuuaaauuuagaaggauacuuagagaucaucuuuacuauuuacuacuauuaucuuuucuacuuauuuacaguuuuacuuuauugcuuuacuuauuucuuauguuuagaaaccacauaaaucuuucuucaaaugaaauauaaugcaguagcccaauauauaaaagcguucagaggcccgggagaagccuugcauguguaugaggagguggggacggguccauaggaaccuaaagaguagacguucucaagcagggacaguuuuaccccuuagagggcauauuuagcuauaucuggggacauguuugguuaucacaguuggggaguguuaauggcauccaguggguagagguaaggggugcuguuaaacauaacacacaggacagcuccccgccguuaagugcauucaacagacaagccguggcaaaagcccgagccugacuacuuaggcuguuaaagaugcaacaagccacuuguagguuuagcuaguugauuacuuacguagacagcaaaaagaaggggaagcuaaaaguaccagcuccccauggucuacguaucgcaggaugacacugaaaggaaaagggccaaaggacugcacugagaguuguggaauacccuguuuuggaagagccaguagaagagagagaggcagaaagcccacgccuccucacaaaugggaagugaugagauacugccucaugacagcuucccauccucucuuguucccaggguaucacaaggcauugagccaccacucagauuaacugagguucaugucuuuaucauuguagccugugaggauacuagcggagucuccagagcaccugguggagccaguagccuacaccuacacgcccagcaaagaauuagcuggucaagaaugucaguaguucaaauggagacucuauauuuuagaguagcacuguucauuagcaauguaaugccacacauauauguaauuuaacauuuucuauuagccacauagaaaagaaaugugauaccaacuuaauaauguuucauuuaacucaauguaucucaaguauuauuucaacauguaaugugucuaaaacaauagugagauuuuuaacauuauuuccagcuaaaucucugcuaucuguuguauauuuuauacuuaaagcauaucucaauugaaacaacguuuucaugaucaauacuugaucuauauuuggguuucauaaaauuuguaguugagaaacuagguuuacauacacaagguguccuaaauauauuaaacauuuaccaauaacugaaucaacuaucaauuuuuaaauuuaacuaugacuuuuuuuuuuugagauggagucucgcuuuaucgcccaggcuggaguacaguggcgcgaucuuggcucacugcaaccuccaucucccaguuucaggccauucuccugccucaggcucccaaguagcugggauuacaggugcacgccaccacacccagcuacuuuuuuuauuuuggguagagacagguuuucaccauguugaccaggcugggcuugaggacuccugaccugaagugauccgcccgccuuggccucccaaagugcugggauuacaggcaugagccaccacgccugaccuuaacuaugauuuuuaaaaugcaacuaaaaauucagauuaucaguuucucuagucacguuucaagaaugcgauacucacauguggcuaguagcuaccauauugggcagcauaacucuagaacacugggaaguuacuaaccauuuuauugcuaaagagaacaggcuaagaccacacaaccauuacuucuaaacuuuucuccugacacccaguucaguucccuguucauuguacuagaauaccuguucuuaaaucucuauuuuagaagagcuuuaugaguaaggcacaauaggcuguacaugauaugaugagguucucauagguuccuccaaaggauauuaauuaaguugaaagaagaacccugguuuauuaagugaaugucaccgcucauucagugcugaagauaccauugugcaucaaagaaauguuuaucuuauguucucaagagaaacauaauagcacgaggauauuaagagagaacagaacucaucacucuuuuugugucucaaauuuaaucugguauacagagucagugauuauuuucuuugaaugguagaagucaaagaacuucaaugaguaguuuauucagaggugaaacucuucuguuaaaaaaacaaagauguuaauaauugaagaggauucuaaaaagaaauaaaaagaggaaguaaaauucuuuaaaaaugcgaaauuuugcaaaugaaaauaaguacuacauuuauaucaaagaguuuugauuuguuuuuguuucucugauuuggcuaaucagacauagauuaugccuuaguugcaggauacuauauaugcauuauaggcacauuaccucaguguagauauauuauguucacuguacauugagcucaucauguuuugaaguuuuggagauuucaucccuguuuuauuaccuuuuguacauauacuacuguauguacaaaaccuuugaguguaucuacuuuacucuugccauuuauuuaaaauauuuuaaacaguguaacauaauuuaauugauaucaccaaacuucaaucuauuccaagaauaggaauaugggguuuuuacagcugcaaaauaauugcuuuuugcaaguugguaguagaauuaaauagaauucaauggaaauggaauuguaauuaaguaucugccuaacauauauaacguauauuaagcuaggcucacuaaaauuuucuuucuucaguguaguuuauguacuauuaauuucuuaacuugcaugcuuucucuugaguuagcuaccuucuuauaguuguuguuccuaauuuaugugugaaaaacuuuuucuaaaugauuaaugaauuuauccuguuggugcuucuugaaccuguagauuggggucuucuauuaguucuaggaaaaucuguggcauuagcucuguaaauacauacauauguauguguguauguauauauauauuuuauuuuuauuuuuauuuuuucuuuucuucuaagacuaauugcagcauguuaggccuuuuaguuuccaucuuuuauccauccuacucucuuuuuccucuguauacuucaguacuucagucuuggaaauacugguugucauauuuuccaguucagcaauuuucucuuuagcuguuucuaaucacagucagacccucuauaaagcuuuuaaaauauuaguuuuguauaacauaaaaaucaacuuuaucaaguuugaaguaaugaaauaaaaugaauauauuuugaguauacauuuuaaugagguuugacaaauguguauacccauauaacuaccacucuaaucaaaauaauacaacaguuuuguuuacuccaaaaaguugucuggugcccaucugcagucaauuuuucuucuugucagccauccccagucaacaaugaucuauuuucugacauuauagauuaauuuucccuucuagaaauauguucuugugugucuggcuucuuuugcucaucauguuuugaaguuuuggagauuucaucccuguuguaugaaacgaaaguuuguuucuuuuuauugcugaguaguauucuguuguaugacugagcuauaguuugcuucagauuuuuuuucaauguuugacuauuauaaauaaacauaugaucauucacaugcaagucuuuuguguggacacauggguuuuugguuuguuuccuuuugaguaaauacuuaagacuaaguauguaugcuaggacauacaguaguguauauuuagcuauauaaggaacugcuaaacugauuuccaaaaugguuaaaccauucauuuguaaugcccacaaguaauguguuagaguuccaguuuagaaucuccucauuaacacuugguauugccagucuuuuuaguuuguauuuuucuguugacuaauaauguugagcaucuuuucauggacuuacuaguaauuuauauaucuucuucugugaaaugcccuagucucuugcucauuuuucaaguuguauuguuugccuuuuaaugauugauuuguagaaguucuuucucuaaucuagaagaguuuuuugucuuacauauguguugcaaauauuuucuucuagauuguguuuugccuuuucauguucuuaauggugacuuuugaagaacagaaguucuuaauuuugauaaaacacaguuuauugguauuuucuuuuaaggcuuaguuucuuuuucuccuaagaaaucuuugcaucccgaggucaugaagauuuuucuuucauguuuucuuuaacagauuuuauuaagucuuuuuuauguuaagucuuuuaugucaagucuguaguccaguuugaguuaauguguuuguguggugugcgguaagaguuauuuuguguuuuuuuuuuuucuuuucuauauagagaauccguuguuucagcaugauuuguugaauaggcuauuuuuccaccguugaauuacugugcuuccuuuguugaaaagucaguugacucccuauauguugcuuuauuuaugagcugucuucuguucuguugguuuacauacccaagucugaauaacauaguuuuucaauuggaaguuaugcuucauaacacaaaguagcuaguuuaacuugcaacuccaauaauugcagaaguccuauuauaucuauauguauucuuauucuaguacugcacugucuugauuacuagagcuuuaugauaaaucuugaaauuagguagugugaguccuucaacuuuuuaguuccacaguuucccacuugauuaucagaguaugucuauguuucacuucuuaagaccauacuuuccuuuaauucuuggaauuuauuuucuuuaagucuuugaaauuuuuuauaauugaugcuuugaggucuuugcuaacuaacccuaacacaucugggauaugcuggguaugauuuuuaguguuuuuucuugaccagaucacauuuuucuuucucucuauauguuuaauaauuuuuuauucaguaguggacaugguagucacucugugauguuuauuaucuuccucugaagaauuuuuauucuuguuuuagcagaucaccuuauugcugguuuaaaaucacccuuaacuuauggagguuugguuuuaagcuuuguuagugcagaucuguggaaagcccaagguguuucccauguuucuuuaagauugucucuucugcagaccuuguuuugccucgguuuugggcuuuauuaguauuaugugucuagacuagggcuuauucuaggggacaaguucucaaauguuuagucucuuuuugcauucuuaaaaauuauugagcguuccacagagcuuuuaugggggucaugcauauuguauuagauauuaaaaaaagaaguuuaaaaaauuauuucauuuagcaaauagcaagcuuacugcauguuagcaugaguaacauuuuuugaaaaauuguuuuccaaaacaaaaaauaauccuaagaguggaaucauuuuacauuuaugcaaauguuauucauauuugacuuaauugaagacagcaggauucucuuuucugcuuguguaugcagucuuuucugauaggcuuuuugggguugaaauaucugaagaagaucuacauuuauaguuagaaaagggaagaguauaucaauaaccuuuccaauaauuguggauauucuucuuugauuccacaugcaaacuggacaaaugguaguuucuuagugguuagcugcaauguggaaucugaaaccaugucaugucagaaaaccuuuugcacucuguaacaucacaauccacuggucgucuuacacuugcaaagcaucuuugccuauguaccuauguaugauuuuguaaugauuuccauuugucguaucaaaaauacucguuuccuaagugaggccuaacuuguuaacauguuguauuauacuauauaaaauaauuacauuuguuauuuuauauccaugucagcagaaaagucuaugaauuugggagcccuuuauaaguacuuucuaauucuucacagagaauauuuuaaagaaaucuaauggucaauauuuaauaaaaugcaguaauuuuacugcuuugucaggggcauucuaaugugaaacacuccuuuuuuuugacugcauauauguuuuauagugaagaauguaauaaucacuaauagauguugaugacaccgccuugauuuguguuauuuuaguuuuaagacaggguuucacauugucauucaaguuggagugcaguggugcgaucauggcucacugcagccuucaccuccugaggcucaagcgauccucccaccugagccccacgaauagcugggaccacaggugcgugccaucacgccuggcucauuuuuuuacuuuuugaaaaguccaggucucccuauguugcccaggcuggucuuaaacuccuaggcuuaagcaauucuuccaccucagccucccaaagugcugggaauauaggcaugagacaccaugcucagcuuguguuaucaguaguuuuuuccucuguugcaucaucagugcaaauguuaauauaaugaaacaaaggaauaauaucuuaauguuaucauaaaaauaguuuugacuuuguagauccuggcucucuguucuaggucaugcugcuuauucauaacuaacguugaugcuaaggugcgucagguguguuaacaaggcgauuuuuuuuuuuagguucucuuuacuuucucaaggcuagaauugcaauuucuuucagcacugcucuuucucuagcaccuugcgaccucuacucacuuuguugugcucucagucccuagcagcuauugccaaauaagccucagggguuuuguccugcacagguacagcccagcccagccaugugaucccuggggacuccuucacagacaucuggggccugcucucugcacagauccuucuucucuaguuucccauccugcagacuccagccaauucuucugccuugaguuuggauuucugucuucucaguucaguguaaccaccauguucugcuuugacucuuguuguguuuaugugguuggcaaauuguguuaggcagagaguugggugauuaugguacccaucuugugaguuucucuucuuucagggaucacuguuuacaacugcagcuggcuacugccugcaguuaguugcuucaucuauuuucuccaauuucauaaucgguuaugucagagagggaaagcuagucugauaccaguuacuccauuauggcuggaaacuaaaguuuuauuuaaaauuuuuucguuauauuuuuauuucuaaaaguucuguuuaauucuuuuauacauuugcccuauuauuuuuuauaguuucaucuuuuuuagaucuuucagcuuguauuuuauuuuauuaaacacaauaagcaugguucuuuuuguaauacaugucuuguaccucugauaucugaaguuuuuaugggucuguucuugaguugucuauuucugcucguugcagguuuugcauuuuagauuauuuaugugccucauuaucuuggcugugcacuggacauuuuaccaacuguuuauuuauaggaguuacugccaaucuggggccaccuuaaaucaaauucuaggcuuuagauaucguagacacccaaaguuuccaaccagagcuguaauucuguacuaggaccaguucacaucuauuuuauccucauccugagguaucacccuuguuguguggggaacagucucguaauaguccuuacuuuugggggccugugggcuuuuauugcucuuccccugauuccaugagacauugaaaugacagauuuuauuuuucuugaucaguaauugccuucagaacaaugacagcuuccauacacguuuacccucuagauuuccuuugcucuucaguuuucagcugguaauucuuuaacugucuuguuagcucauagaugauuuuagaaguuguguuuuuguuuuuguuuuaaaucuaguucuguucauuguuuacagccuaaggguagauuuaaauaagcuacucugccguuacugaaaacagaaaauugugccauuugaauucuaauuuaaauucaguaagccauccuauauagggauagcacugguuacuugaauuuucuuuuuuucuuuuuuuucuuuuugaaguggagucucgcucugucggccaggcuggagugcaguggcacaaucucagcucacugcaagcuccaccucccggguucacgccauucuccugccucagccucccgaguagcugggacuacaggcgcccgccaccacgccuggcuaauuuuuuguauuuuuaauagagaugggguuucaccuuguuagccaggguggucuugaucuccugacuucgugauaugcucaccucagccuuccaaagugcugagauuacagacaugagcuacugcgcccggccuugaauuuucauaguuacuguuagugguaaaucaacuucagauaauuugaaaaauaaaauacauuagcuugacuacuuuuaugcuauaauaaguaauguguauuuuggaugaaaagauaaaagaguuuuuaaaaaaucuauaauauauauauacuguauuauuacgguauaauauauacuguagcauacuauauaugauauaauguauacuguauaauauaauggcauaguuuaugccauuauauaauauuauaccauuuuaauauacauguuuguguagaagaaauagugcauaaacgcaaggaucuaucguguuucaguuuauaaaaauaguuugucucuuaaagcucauguguauugguaaagaaucuuauacauugaaggcuguacuguagugaaaguuuaguccuuugauauuuuucuauaaaauuaaaaauuuucuuugcuuaaaaaauucaacgaacuugguccuuuauguaauccuauuuuugaaacucagucuaauaaauguauaucucuuuauucuuaaagcauuagaugcuuauaauuuuaaaguaaaaacuuccuaaaacaucuucugauaauuuacucuaaaaagcuugcuacauuuuuagcuuggaaaauucacauuguuucuaugucuugugucuuuuaaaauuaguuaauaaugccugcaguuaaacacaauuuauuauaauagcacuuuguaauuuucuaggaauuuaacagaaugagucuuuguaugaauguagaaauauuuuguuuuuauuugcaauaauuaugcaaaugcuuaacuugaauaguuuuaaaggaugaaaugaaacaacauagcuaaaguaauaccugcugaauuuggcucccuguggcugaaugccuguaccagaaaugggaaaaucguguguccuucuugacauagcucauuugaaaaugguguuugaauuuugugacccuaccuuaauuuuaacugucuuguuaugccagcugcuacauuuucuccgcccgucuuaccucgaaaggagaugaauagagcugagacgcauuaguaaaacaauuagaaaucacuuacucucuggaauuugagguuuaauaaugucccagugguuaaagauaguauagggggcuuugugaauggccauaguacccuugaauuuauguacugaauguuacucagauuuuaguuuccuucuuuuucuuucaaaccuuacuuuguacauuguugguguauuuugggaacuuugcuucagguauuugugcuacuuuuuaaaaauaauaugacacuguaucaucaagcaaugugguacuuuuucagaaaaaucuguuuuauauuagugugcuaucaaugcguauugauuuuacaagauaaauuucuaauuuuauuuuguguuaauagucacauuuuauuuuucuuuuuaauggcucagaauguugaaaacaaauuuugaagcauccagaauugagucuuagaugacaccacuuugaguacaguguggcauucuugaaaacuauuguuaccuuugccucauguaugugccauucuucugguauuagaaaauagucccacauaaauccccauagagaacagugugaaggaucagauuugaaggcacuuuaggaugaaauucuauuugagaaauugcuuggggaauauuguaguuugggacauuuaagaaugugucugauaaccuucagugcuccuggucucaacuuuuaguuuuguuuguucuuuuuaaagaguuaagauaaaugaaaaccuuucuguuauuauuuuuuucauuuugauucagagggugggagaagaagagauucuauuugaagcagcuguuuuuuauuuuuauuuuuugaauauuuuagaucguaaugcuucaggucuuuggcuauaacuuuaaaagcauuaucagagauuugagaccgcuccuaaaauauguagagaucaccuuaucaaguuuagccccuuuauuuuaaaagucaugagaacugaggcccagagaauuucuugugugcccuggcucagugcuucucaaauugucuaugguagagaacuggguuuucuuuuuuccccaaugcaugacagaucaauaauuuuguaaaauauaaauaaaaagaaguacuggagaagguaauuuugaaacaacagacauaguucuaaauaccuucaguuucaguucuuaucucaauguagauggauuguaaacaguucugggaaucgaauuuuauauaauaugcuuuguauagcauagaccugggaauggaacuuuguauaauaugcuuuguauagcacagaccacauuuauauagcacugcccagggucaggggucagcaaaaugguccguaggccaaacccagccuaucucuuguuuucguauggcuugcaagcuaagaauuguuuauauauuuuuaaugguuuuuuaaaaaaucagaagaagaauauuuuauaaauuuuauaaaauuuaaguuucaaaguccuuaaguaagauuuuauuggaaugcagccaugcucauucauuuaaauauuaucuguggcugcuuucacacuauaaugguagagucgagggagggaugaggacccuugaacaaugcagggguuaggaccguugaacaacgugcaguuuaaaauucgaauguaacuuucucccacaaaauuaauagccuacuauugaccagaagccuuuucgauaacauaaacagucaacacuuauuuuguauguuauauguauuauauauuguauucuuauaguaaagcaagcuagagaaaagaaaacauuuuuaaggaagauaaaauguauuuacuauucauuaaguggaaguggaucuccauaaagaucuucauccucaucgucuucccauugagugggcugagaaggagggugaggagugguuguucuugcugucucagggguggcagagacaggcacacucaguguaacuuuuacugaaaaaaaucugcauauauguggacugaugcaguucaaacuuguguuauugucagcuacaguugagacagagaccaaauaguccguaaagacuaaaauauuuacuaucaggccuacuacagaaagaguuagcugaccccugcccuagagcaaagcauggaauuagucgucacugguagaguugagaguacacauuuuaacaugugcuuuaaauauuauggugagcugauggggauugucaugcucccugaccagcaccuuugcuugucacuuuauguucuaauucaguccuccuggcaaucuuguaaucuuguaugaaagcuggauaaguuuagaccccugcugaucuaaugagggguuagauaccuucuccuaaaagucuuaacuuuacugaguuuuuaauuuuuaauucauaugugaugaaugaaauaugguuaaauauuuucuaaugugaauuuuguuaucagcaucugguuuagaaaguucagcugcuucuuuccuguugcuacauuacuuugcuguagaugugucuguguucaggucuaauuaaagagguaggcauggcccaaacauauuuagaaaacaucuauuucaaguaaauguuuacuucuuuuaaugucaccuaaaguacaacaaaacuacaacuaaacuguaauggcacauuucuauugcaaaaugggcaacauauaguaguuaaaauacggguuaaaacaagaaggauugagguuuuaggugacuuuggagaaacagucagacuuucacuauuuuacuucuagcacucauuaaaaacuacaaaaugaaagcucccaucauuuaacugucaaacucagauaaaaauauucauuuacuucuuguuuaaagcagguucugcaguuccugaaguaugcaguuaaacucugcuuuucaugguagcuauuauuucuucuguuuucuuccccuuugcaugugaucacucagcaacuaaauaaaguuagagauaguuaucagcuugcauuugauacuugagucugcuuuaugauaaagaccuuuuauaagccaaaucuucacguuagaauuucuuccugguauuaaaaaaacauguuguuacaauagcuguacccauuaugaugaaagaguaacuacacuuugauauuguggcacucgccauuuuauucuacugacucuugaaucaguuuauaaacaucuggaaaacaauaauguucauuguuugcauucacauaggaaauaacacagaaaggcuuuguaagaucucacugcaucuucucaagccauagcugguuuuuauugucccaagucugaaacuccccaaaauguaauguaugagauguacaggcucaccuuccuggcagcuguguccuaguucuggauaaggcuguuguuuguccauuauaacaaagccauugauuuuauggcuaauacauuaaaggaaaaggaagagcuuuguaaacagaaggacuuacggcuugguaaugugugaguauuaccuuccaaauauugcuaaagaauguaugugcuuuagcauggaacugucaugaaugaaugaaaauuugggacucaucaacgguagugccucauaacuuacaauugaauuuuacuuacuggaacaacuuuuuaauacauucauugauuuaaucauuguuuggguaguauuacagcaacagucuccuccucuccugcccucuccacccucccuacguauacacaccacauaccagauguggcugauaaaugcuuuggauuaauauaucuggauuuuacuuaaacagugauuuuuucuuuuguaggaaccuccauauuuaagaauucccaguagcuacuuuuuacccaauauggcaggcauuacauucgugccuuaggauauauuauagugauugaguuucuguuucuaaacauuuuugauggaaagaaugaguauaagaggcaguuccuuuuugcagcuccacgccaggggaccaggguuacacacauuacuaugucuguuaaacuucuuggaagccauccaguauguuauggugaguuucaugugcaaguggugagccacuaaaaggcuugcacaguauuauaacuauucugaggagaggaggcauuuggaaauucagcaguaaagcagcgacagcaacaagcagccacagugguaguaaagagagggcagguucacaguuagcauauuucacagugugagccagcgagcacauagcuucccauacugcugcuugaaggaggcaaaccaaaacucuacauugcaagauuuuucuaguuucauguuuaugauguuaagucaugugauaauauuguaccauaaguugccaacuucauuucacucuagagaggcuccuuugcugcagugcuuuuuugcuuuuuuucuuuuuuuuucuugaaagagaaaaaauuugugcaauguauguuuaugccuacaccaugccgagacgacacuuaccaguaaauaaucucuguauccccgagguaagauacuguuucugcuuucccugcacagugcugcugcagcacggagcugacccaaacauucggaacacugaugggaaaucagcccuggaccuggcagauccuucagcaaaagcuguccuuacagguaagaagacagagagcuaccgaaugauuauaucuguguaacuccuuacuugauuuuauaaaaucuuguuaugcugaauuuuucuuuucacugaugaagcuaagcaaauauaucugccauuaucuacuacuuuauuauugauuugauaucugucucauuaauugcuaugcugucguaagcauaagcaguaagauuguuggucuacuuagaaugauagcauuaaaucauaacaucuuucacucguauuuuagucauuuuuaugguuuauaucauaauuuuucuguaucucauccucucaguuguuuaagaccuuuacuguugagcaagcaagggcauuuauauuacuauaaaaguaguuuugauuggaaagacaaccugcugccugcugccuuauuucuuggaucgauagucaaauaaaauaugccgcugccucucccuugccaccccguuuauacuuuaaucauauguuuucacuuuuaccaugauagcuaaguuauuuuuaacugaggcguuuauuaucuuuuuacuucagauaaugcaaauuuguggcuuaaauauuaguuuuauuaaagcaaaugccaagaaccagcaaagaggaaaugcuagaauggaaaaggucucucauaacaauauagaaaauagugcucuaaguguuuucauugaucugcauucucaaaaugcugcauuggaucuauuuuuguuuuuauucuuagcaucugaguccugcugccuuugcccucuuuuacuuaacugaccuucguaaugagccucugucacugcagugcuaacaguauuguuuuagguuaugugaaaguaaaugacuuuuaacuaccuuuuaaauuugcccauggucgaagaaaauaaauauuuuguucuuguuuaaguuuagaguccauggugugaaaauuuagcaaaaauacugaggcgaagggaaaacguuuauguacagaaagcuuugaaaaucuauggaauuuugcuuaauuacucugcauagaaaaacaacuuugcacugugcuaaaaucaauauaauuauugcucagaguaauaugacuuuucucaaucaaagauuaguguauuuaguugcuggauaacaguaacauacacuagaguaauaaaccuacuuaaauuaguguagauaagaaauuuaaguauaaauauauaauuuuaaguagugaaauuaaaauacauagccucgggccugcucagauucuacagccuuucagucucuuaacaaagcccugggcaacaauagcagcuuuagaguggucucugaccaaaggagaaauacagugcauaguaacagggguagguuauaaaugcugagcaagacucuuuguauaucuaaauguccucccucugacguuuccuucucuccaacucucaacacccgcuuuguccauuuguuagauacauuuaaugcaacaacgcuuuuagaucuacuuucacuuuuuuaaaaggcaaaauuuaauauaaguuauuaacaagaaacuauauccuaauuuguaaugaauuucaggggagauuauauuggauguuguuaguuugggaaagagcuuuggaacaaucacuuguggagacacaagauuccuggaggacagauaucacaucuacuaaaauugacuuuaaagccaucuaacacuguacuuugcuuagauaggaauauacgaaauucuuggucauaauacugauuuagagucauuuguucuuuucaagaauaucucuagagucauuuagaguuaauuguucuuuucaagaauaucuacuuuuuuggaaaugaucuacagcuuuucagaugugauuuaaaaggaaaagucuaguaauaugguuaauuuuguuggaauauaaaccaguucuguuucuacauucaugcuauauaaugcagugaaauaacacuuaggugaaauguauuccaaaauguuuuucugcccauacagguucucuaauaaguaauucuuuccaguggaauuauggugaaagaauuauuuccagagcuaaauuuaaaagauuaaacauuaauuuuuuuaaaaggguuucuuuugaaaggaaugccuuagaguuauuagagaucauucugaguaauaugucauucuuuauuuuuaugccagaugcaauuguaguacccuuacuuaccuugagagugaaauuuuccuucuuaaauauuuuuucuuuaggaauuuacuugcugcaaaugucuuuccaguaucucaucguuuuauguuauuacuuuugugcauuagucuaaacuguguacaaguauuuauguguuuuccuuaaaggcaauuaauaaagugacaaucucuuuuuugguuuuuuuuuuuuuuuuuuuugagauggaguuuugcucuguugcccaggcuagaguucaguggaacgaucucagcucacugcaaccuccgucucccggguucaagcgauucuucugccucagccucccgaguagcugggacuacaggcaugugccgccacgccuggcuaauuuuuguauuuuuaguagagacgggguuucaccaugcuggccaggcugaucucgaacuccugaccucaggugaccugucugccugacagucucuuuuuauagaacauuuacaaauaugugacuaauaccaucuuauacauaagaaugcauguuuuuuaauaaagcuauacaaagcaacaguguacccuuaauuuugcaauuaagggacccuagcacauggccauugguuuuggauagcacacuuggauauuuaaaugagaagacuuacucagagagacucaucauccucuuugcugaauuauuguguaagugaaugguagacuuagaagaaaucuugagggcuuucuuuuguuuuucugcuaaugacugaaguucuggucaauaaacugaaggacuuggagguauuuagauuuuucguuuguucauuuuuuguuuuaaauagggguaugaaaagucaaaaacagccuauguaaauguuauugaagagcaguuuuuguguguuuugauuauaaauuuuuuaaaguaacauacuuuuggccuuuucuuucugauuguaaaagaaauacauucauuuggaaauugagagaaacaggaaaaggaugaaaaagaaaaaucauuuguaauuuugcuacuuagagauaacauuuugguguacuuuauuuauaaccuuuucuucugugagcaucccacugucuuauuucucuuuaaucaaaucagccuaauguguuauaaacugcuuaauaguacauauuuuuguaauuuaguuacauaaauguucccaaagacauuaaguacuuuucuacaaccugaguuuauaacaacuucacaguacccuucuaugaguauauuuugguuuuuugagcgaauucccuaguguuucacauuuagguagguuguuuucagucuuuauucuucccugugaauuuagagucauuuaaucaauucuguuggaagugugcuucaucacauucagucuuagcauccauggacaugguagauaccucuguucuugacuuugaaguaaggaagcuuuggaaaaugaggagcuuucuuuuuuaaaaaggcugcgcugcaugugguauuaugggagagccacauuuaaguuaaaggugguugacaaagggaauguuuguugaaaagggcuagaaaguagggucuuuguuaauuaugugaaggagauucucugggcagaguggaaaggauagagggagcaguggaaaauugaaucaaagaaagagguaagagcagauugagccugagaguuuggaaaaggauagauaaccaaaggaauguuugucguugucaggaccaaggaugauggggauguaaagugagugaguuuagauggucacagcauugcuaagaugguugauccuaguguuuuccuaguguauuuaggguuaaggggauguggaaggaggauauguuugcauucaggugucucaagaauaaauuagcuuuaaccuggauucauugcacuucuguggaaauccaaaucuaugauuugauggguagcccccagucucucuauaaggaaucagcuguggcucaggccaccggcaauauugaggugucugguguguucuugcugagacuggcuuaguaagucagcaaaauguauccgaaauccuuugcuuuuuuuuuuuuuuuuuccugcuaacugccuccugcugcccuucagauaagaccaacaucuuuagcauaaccagugaggacuuaaaugcucuguacccugaccaccuagcuuugacuacuagauuuugcugaaaccaaaauuuggaacucuuuccuuauuuuuauuuauuuuuuuuuuuugcgacggagucucacucugucgccagguuggagugcaguggcgcuaucuuggcucacugcaaccuccgccucccggguuuaagcgauucuccugccucagccugccaaguagcugggacuauaggcaggcgccaccacgcccagcuaauuuuuguauuuuuaguauagauggacuuucaccacuuuggccaggauggucucgaucuccugaccucgugauccgcugccuuggccucccaaagugccgggauuacaggugugagccaccgugcccggccgggacuccuuucuuugccucacacuuuguauccaaccuaucaguaauucaggucuaccguacuuucaaauucccaaucugaccguuucuuaccauccucacugcuuuagcccugggccacaccuucauccucuguuucacgacagcaguagccucauaauggaucucucugccacuacuuaaacuucgcucaguucucuucacugcagcuagaauggucuuacuaaagcauaaaucagcucuauaaucagaaaauucuuuaguauauucccacagccucugaauaaaauucagauucuuuaacaguggccuguccugaucuggcuccugccuugcauuuaucugaucuugucuucuacuguauucucucuuggucucuuugcuucagcuacagcuggcuguuugcugccccucaagcagaugaaaccuuauucugugucugggcuaacauaagcuauuuacugaaacuggaacacuuccccaguucaucaguuaaaucucuaguucaaacgucugcuccucaaagacggcuucuugucccuggugccaucagccuauuugauuuccuucauggauuuauugguaucuggcauugcauuguguuguuguuauuugucccaguagaaugaaagcaucauaaggguuuggacuuuugucugucuuguuuacuucuuuauccccaggacucaaaagaauacauaaaaugaucaaucaaauaaauaugucuaagguccgauuacugauaauugggggcagcauauuuuccaggucauauaaauacucauuaaccauuaauuauuugacauuuuaugccaauaguuuuaauaaauuuuuagcuuccuaaaaauaguuuugaauugcauauaguccuauacauuucuuaaaacauaagugcauuuuaaaaauguuuuaauugguaagauggaugagguuuacugaguuuuuaucaacagauuucucagauggcucuuaugauugagaacauuccaauucuggaaagaugaagcugccugcagcugucacaucagacauccagaugucaaaccgaggccuuauuuuugcuuuuuuuuuuuuuugagacggaguuucacucuuguugcccaggcuggaguacaauggugcagucucggcucacugcaaccuccaccuccuggguucaagcgauucuccugccucucagucucccaaguagcugggauuacaggcaugugccaccacgcucagcuaauuuuguauuuuuaguagagaugggguuucacuauguuggucaggcuagucucgaacuccugaccucaggugauccacccaccucagccuccguaagugcuggaauuacaggcuuauuuuuguuuuuuucuuuuggccauuguucuguuaguuugcuguuuugcacguuagcuauacuauaaccuggcauauugcauaccauguguaauacauguuuuacugucagacuauaugauuauuuuucucaugcuguuaaucugaacuuaaagaauuacuuaucaguuauuagaaagucuaauuauacagacugcauccuagaaaauaaacuacaagcagaaauaaaucuuaccuuacuuauuaagaaaaguuguauauuuaucuauaugaauuuuauuaggggaaguuauuuuuauaauaagaugaauuucugauuuuaaaagauugccuuuaguauuacagcaaaggaaguuaaaaggcguuacugcugaaacaaagcaaugugaauacucauuuuaaauauauguuaaaaaguuaauuucuugacuaagaaaauuauacgaauaguuuaaucuuguauaauuuuggacaugagcaggaaaauuuaaaguuuuauauuaaacgugguugaaagacuuuuuugaaauuuuuaaaauaugaagacaauuuaggagaagaauguaaaacucacaccuuuuaaaaaagauuauaucugacguaagagauuaauuucaauuuucaaguguuguuugcaccgugaaggaacagcuaagcuaguuucuuucuuuuuucuuuuauuagcagcagguauuuguuucauaguucauacugaauguuuagauucuugcagcaagcaaacaacuuagcguuacauaaaauacagugacaauaauaauagcugacaccgccugaauccuccuuugauccaggugcuauuucaagggcgcugaauccucacaaugaagcugugaaguagauauuguuauuguacucauuuuuacagauggagagguuaaguuacuucuaaguucacagaaccaucaagggaaauuacaggaauuugaauucaagcaguuuggcuccaggaucaaugagugcucuuauaugugcagaaucagacuuuuuaccuguuuguucauuuggaaggacauggcauggccuaaaacaaaaauaaaauuagaguggccccuaaauauaaacuccagggcuuaaaucuagucuguuaauauaauguucuuuuuuagauuaaagauuauuccuuuugaaagacaaguuaccuaauauugccaguaagacucaucaucauauuauuauaauaaaauggauuaacuugguaauaaauugauucuuugaacuuugcauaguaaccuucccuuaucuguggggauacguuccaagacccccaguggauaccugaaaccacagauaguacugaacccuguacagacuaugguuuuuccuauauguacauaccuguaauaaaguuuaauucauaaauuaggcacaguaagagauuaacaaccauaccaauaauaaaauagaacaguuauaaugaugaacuguaaugagaguuaugucaauguggucucucucugugucucacaauaucuaauuguacuguauucaccuauuuucagacugugguugaccggggguaacugaaaccacagaaagggaaacugcagauaauggggaauaucauaaacgaucuucuucagucuuugcucucuagucacuaggguugaugaacauucauuugaaaccuaaaacaacuagacucuguauggaaagauguaguauuuaagguguuugaucuauugauagguaagagguagaucaaauaaugucaauagaccuuaaguuaguuauagauacuaaccuguguacaggcauaccucagaguuagugcagauucgguuucagaccacuaugaagaagcaaauauugccauaaagugaaacacacuuuuuuuuuuuuuuuuugguuuccuagugcuuuugaaaguuguguucguacuauauagugugcaguagcauuaugucuaaaaaaaguacuaccuuaauuaaaaauacuuuauugcuaagaaaugcuaacgaagugagcacaugcuguuagaaaaauggugccaauagacuugcuggaugcaagguugccacaaaccuucaauuuguaaaaaauguauaucugcaaagugcaauaaaaugagguauguuguuuauggagugggagggaauagaaacuaacuuucugggcugggugcuguggcucaugccuguaaucucagcacuuugggaggccaaggcaggcagaucacuugaggccaggaguucaagaccagccuggccaacauggugaaaccccgucucuaccaaaaauacaaaauuuagcugggcgugguggugggcgccuguaaucccagccacuccggagggugaggcuggagaauugcuugaacccgggaggcagaaguugcagugaaccgagaucaugccacuguacuccagucugggugacagagcaagagacaucgucucaagaaaaaaggaaaaacaacaacaacaacaacaacaaaaaacaacuaacuuucuguuuggauaaucucaccacucuaguacuucaaguccuuccaaugaaucuuuuuguguaauuaaagccaccaggcuuacaucauuaaaaaaagugacauauuugugaagcaugauaacuuguuaguguauacucugagagcagcugucauuuucccuaguaaauuauagcaacucuguaacauuuguauugcaauuuggauuagaacuucagcuacaaccaaauugguauuuuaaaugguucuuuaaaauauaauaaauuacuguuaauauuugcuuucuuaaaguagcacauguaacauuagaauucauuaaugcuuugcuauuguaaugguuacuagcucuguucuucaagauuuuuauuaaacuuuuauuuugacauaauuguaaguucccaugcaauuguuagaaguaauaaaaagaagucccuuguacccuuuuccuaguuuccccuagugguaacaccuugcagaacuguaguguaacaucacagccaggauauugacauugaugcagucaagauaugggacauuucugucauagaaauacauacauacuguuuuguacuuuucucuacuuauaauaccuuuaacuaguuuuuuuaauuaggguaaaccuggccuuauagaaugaguuaguuuuccuuuuauuuucuggaagagacuguaauguguuaguaauacauucggcccuagguguccucagggguacugguuccaggauccccugaagaugcagauguucaaaucccuuauaaaaaguuacauaguauaaccuauggaggcauauccucccguauacuuuaaaucagcuuuaguuauaauaacuaauaccaagucagugcuguauaaguaguuuuguuauacuauauuuuauuuguauuauuauuauugcuauuuaaaucuguaguugcuugaauccauaaaugcagaacccacagauacauagggccaacuguauuucuccuuaaauguuugguagaauucacuagugaaaccauuugggccuaaucauuucauuauuauuauuauuugauucaauuuuaaguaggucugaaacuaauuggguuauuuauuucuucuugugugagucuuaguuauuuaugucuuucaaggaauuggucaauuucaucuaaguugucaaauuugugcauagaguuguuuuuaguuucuuuuuaucagauauuuggugccugcagggucuguaguaauaaucccguuucauuccugauauugguaauuuguguuuucuccuuuucuuugucaauuuuauugaucuuuucaaauaaccauuucuuuauuucauuauucaaauucuuuuucuguuuucaauauuguugauuuuuguuuuuuauuauuuccuuuuuucugcuuauuuugggcucauuuugcucuuuuucuggguuuuugagguaggagcuuagaaaauugaccuuuuuuccccuuuuuccuaauguauguauuuaauguuauaauuuuucuuuuaaguacugcuuuugcugugauucgcacauuuugauuuguuccauuuucauguucauucaguuaaauuuuguauguuuuuaaauuucucuugagauuucgucuuuaacccacagacuauuuagaguaugguuguuuagauucuguuuggagauuuuucugcuaccuuucucauguuacuuucuaguuugauuccauugugcuugaacaauacucuguaugauuucaauuuuuuugauuuuuaaaucuuuauuuggacaaagguaggacaaaguucauggcucaggacauggacuauuuuuguaaauguuccaugggcaugugaagagaauguauuuucugauguuuuuggauggaguguucuauaaaugccuguuauuaauagauucuguugguugaugguaucauugaguucuauauccuugcugauuuucugucugguuguucuaucaguuguugaguagugaaguuucuaacuauaauuguagauuuaauuauuucuccuuuaacuucuaucaguuuuuguuucauauauuuuguagcuuuguuguuuguagcuuuguugcauacacauuuaggauuguuauaaaugugauugacccuuucuucauuuuauaaaaacucuuucauaauuuucuuugcucuaaauuccacuuuauaugauguuaacauagccacuccugccuuuuuaaaauugagauuugugugacacagauuuuucgauucuuuuacuuucaaccugccaauaucauuauauuugaacugaauuccuuuuagauggcauauuaguugagucauuuuuucucauccaugcugacaauuuguuuuugaauugguauacuuaggcgcugugagauuuauggcaaauuccucacgucuagaacuguaagguaauaaauguguguuguuuuagcuacuaaguuuaugauaauuuauugcaguagcaauaggaaacuaguacaguaucuauugguugucuuuuuuauucaguuugagaucuucauaguucuugguaugacaagugauuuucuguugaaaccuaggcauguugaguauuaugcuguaagacccuggaucuuacgugaauuuguuuuagcuggcuuaauuugacgcacucaugcaggagaauuguggggguuggggaaggacacugccaccuuacagucaguuguggguagaagucuagguucccuaucuggucacuuuugacacccaugagggaguuuuuaauuauugcugccucuccugucaguguacuugcuugggaaugcuauaguauuuauuaaucgcaauggcuauacuauaaaauguguuuuuggucuucaaccaguuuccuggcauacaauuccuaaaaauauuuagaaucuucgaagucaugucuuuuuguaugcuaaugaguuuacugaugccuggcagucuccagguagcuucaggauggaggcuggucauuggauagaccagagcauaauuagaggguuggacuuucagcccaaccacugaggaagggagagaggcugaagguuaaguugaucaccaguggccaguaguuuaaucaguugugccuauguaaugaagccuccaugaagacucacagaguuuggagagcuuccagagagcugaacauguggagguuccuggcagcuggugcuccagggauggcauggaagcgccucucccccuucccaucccuugccauaugcaucucuuuaucuguauucuuuauaaaugcuuuauaauaaaccaguaaauguaaguaaguaaguguuuuucugauuucugugagccacucuagcaaauaaauuaaacccaaagaggaggucaugggaaccccaauuuauagcuggucagucagaagcacagguaaaacaacuugggauguguaauuggcaucagaaauggcagguagucuuugugggacugagcccucaacuuguggcaucuaaugcugucuccagguagugucaggacugauuuggaggccauccugcuguugccuguggcaaaauugcuugcuugcuugcuugcuugcuugcuugcuugcuugcuugcuugcuugguguuuggggaaaacuccccacacauucagucacagaaaucuucuguguugauugugguggugccagagcagaggcaaaacuguuuguuuguguuuuuccacucacuguuuggccuauuuuguugccguaaucaagaaaugaauguagccggaaaaaagaaaaauacauguguaauugucagauuucacuuuauaaucauaaccauaaaucucaaguguguuuuuauccuugccucagccauuucuuuuuacacauuuaauuuuuuccucucagcuuauuacuuuuuucauauuucauugaaaaaauagaugccaucaaaaagaacuuauugcuaucaccaauucuaccaacuuagcugcagcugcacucguguacaaugcuuuccuucuucauucaauggagaaacauccugcuucuuucuaaggccaccucucgucuacuuuuugcucuggauuucauuccaucucaccuucucaggaauuuguuuccugcagcuaugcucugcuuacugguuuauauccaucugcucauauguauugaauucugguagcucacaucuuuuacaacaauaaaauaaaaaaaaaaacauucuuuugugucaauucuuacaccacucuuuagucacuuguuuuucugcuucccuuuagaguauacggaacugcccaugguugcucacuacuuucuuacuuuuuagucugaacuaaacucaccugguacuguuuucaucccuaacgacuguacuaaaaugccuuuuugcuguuguuauuguuuguuuuuuucucccugaguuuuuuaagaaacucugucuugcauauccguuggccacuuucucguggagccucucagcagcauucaacaaaauuuauuacaacuuccuuuuuuaaauggucuucuaaugacuugcaagguacaaauuccuccugcuuuuuuuuuucucucauuucaucgauagaucuuucucaugaugauucuuucucuucugcuccacauccagcuaugagaaaggcccagguuaaguccuaggauuuuuacuccuccccaucuaacuuuggggugauuucaucgaguccauuuuaaauggcaucuaugugcuaaagaccccucucguucagaccuccuaccuuccaguuuauagcucuaguguugcucugcccucuucagagguacauauccuacuaccuacuugacauuuccaaaugaguugucuggaugucucaaccuuaacauggccaacacagaauucuuuaucucccuauccaacccuauugccaugcccaccaaacuugaaccccauucuuucccucucgggaaauauuaccacaagcuacccgguugcuccagccaaaaaccuacaagucggacuuuauucuucucuuguugucuuaccuuguguucaguucaucauccaguuuuguugguuuuaccuccaaaaucuauuccaaauccauuuuucuuaguuguuguaacugccagcaaacauucugauuuauacuaggucucaccaacguguagucuguaggcugguuucaaugaccuguuuguuucuggccugcaaugagguaaggggcuggcacuagaauauaaaucaaugguaucacuaagcacaccuuuaguuuacuugacuucuuuuucuaauagcaagacuuccuuguugaaaaagcaguacauucugaugcagacuccuaaucuugccgaggagugacauugcagcccagcuguagacuaauagcugauagcccucugacugcuguacgucaggcuuccuuaagucuguucucuacauagcagacagaaacuuuuuaaaaauguuaacuaguuuauuucauucacccccuuaaaaaucuuuucacuuggaaaaacauucagacuuuuaaucuggccccuaucuaccugucugacugcaaugguuagugcuuuuccuguugcuccuguauuccagccauaguugccuccuugcuguuacucaaguugguuucucucuuggguucuuuuucuaccuuucuucucuucccaguuugcugguugcuuuguuugaaauguucuuuuccucaaauuuuugcuuaacuacuuucucuuuuugguuuuguuuguuugcuuguuuguuuuuugagacgaagucucgcucugucgcccaggcuggagugcaguggugucaucucggcucacugcaaccuccgccuccccgguucaugccauucuccugccucagccuccugaguagcugggacuacaggcacccaccaccaugccuggcuaauuuuuuguauuuuuaguagagacgggguuucaccguguuagccaggauggucucgaucuccugaccuugugauccgcccgccucggccucccaaagugcugggauuacagacaugagccaccguguccggccaacuacuuucucuuaauauuuaggucucagccuaaaaaucaccacugcuaauaagcucuuccugaccucucaaaugggcuaguaucuaguccagccaccagucacccuguauaucccgugucucccacugucugcagugauuucauuuacuuacuguuuuguuuauucauggccugauucccaccccugacuuucaguacuggcuucauaacaagucgauuuuuuucuccuuuguucauuguuaugguucccgcacucaauaaauauuuguuaaaugaaugaucauuccgccagugggugcuucauagacuagcacuguuauauuauagcagcacaacaugguaaaaucaaaacagcauaccagcaguauaaaauguacaagaaauauuagggaggcaagcuggaauugacaaugagaagauuugaaaagggaccuuugauaaguugucuugucuggugguugguuuguuuguuaaaucuguguuggucugugggucucagaaucugcaaguucuacuuucagcugcucuuaaauaaacuaacagacuuacucuucaaauaauuagauaguuacaaaaaaccccagcaaauccccaucacauuaauggggggaaaacacuucuuauuuauaaauucaugcuauauaaaauuuccuauaauagaguaugcaaugucuggcccauacuaguacuccaauaauagccuuuguuauugaagaaaaauuacagagaaucacuuguuugcagacugcauucagaauugucauuagguuucuguagucuaggcagaaucaucguaaaugaaugaaauaacauaucaagaaagagauucuaaaacuuuucuauucaauugacauuuauugauugccuuaugcucuagaaacauucucagaucuuuaaaaaaauuaaauaauuuuauccagaaauucuuuacuauaucuaauguaaagccuccuuuuuacuguauuuucuccuugacgaagcaguacauacauuuucaugaccuuuucuaaaaucuucauucauuuauagaauaccuuuauuaauuugcuuaguuuuaaacaaaacaagucucaauucucucacaaggcugcuuuuuuaaacuagauauucuuggcuaaguauuagaagccucauaucuacaaauguacugauuucaaauaucucaucuaaccguuaacuaguucauaaaguaguuuuuauaacauuaugauuauaauaccccaaaucuuuacauagcuagaauccuccugugcuucugaaggacaucaaaagggaugugaucuucucacguacccagccaugucaaucaugagccauuuuaggguguguaggcuggacaacagauuaagaacuaucuaagucuuagaauaauccugcuccauugaguuaugauuuuugugaguauacuuucacaucaugcuuauaagucauaaaauguacugaugaaaaagaagccauugguaauuauucuauaaaauaaguuaucuaguguaguagaagaaaauuuacuaaaaacuaaacuaauuuggcauucuaucauuuugauaaacacucuugucucuauuugguagacuuaguuaucacaaucaaauuugucuucugcuuuagaauauagggagaucaucucauucauucuagucuacagaauuuuaaguuuuauauuugugagccuauuuguguuuaauuuuuccaacucuuuuuuugacuuuccaucuuauuucuucagucguaagucuuuuccaaaauaacgcugcaacaaaaucugacaugguugguugauuuuuuuuuuuuuucaagaaaaagugucaaguuuuuaagaauuucaacaugaauccagcaacagaaugcagauauagcuaagaaauggcagcugagauggcagugauacaugcuuuaaugguuuacucauuuacaaaccguauggggaaagaggagauuaacauuggcugguaucuucaaaaguaaucagauucuucauuaaaaucaaauucuucauuaaaaccuuugacaaagcuuucagcagaguauuaauggcaguuuuauuuguuauuguuguuuguauucccugaaagcuuaaugauauuaaaagcugaaacuuauaauuagaccuuugauaaguagaaagaugccagacuucauguauuaaaauacaaagaaguuuuuacuucuguuuaauucaaauucaacugcaguuuuugccucaaaguuguacuuuaaaccacuaagucaguugagcuauuugaauuuuaugagucauaugucauugcuaaugucaagcuucccuacgacuguuucuccaaauuuuuauuauuuguauuuugaaaaauuuccaacuuacaggaaaguuuuaaaaaauacuaagaugaauaccuguauacucucgcauagauucaccaauuauuaacguauuucaggguguauuucuuauucuuuucccucuauauauuuuuucuucucagcaauuaagcauuaauacaauacuacuauuuauuggacaauucaucuucuuaccguuucaugaaaaauuucuucgcuuuugaccuuucccaucaauacuagguaacucuuucuuucagcugcuuuugagcugcuugaacccuaucagagacacuuagaaauugguauagcauuucaccucuacuuagcugucaccucuuuucuacaggugcauuucaauaucuacugaaacauuugcuuguuuucuuuuacuucuuuuacuuuugguuuaaugauguuacuacucuauauuguucuuuccuuuuuugagauggagucucacucugucgcccaggcuggagugcaguggcgugaucucagcucgcugcaagcuccgccucccggguucauaccauucuccugccucagccucccgaguagcugggacuacaggcgccugccaccacgcccggcuaauuuuuuguauuuuuaguagagaugggguuucaccauguuagccaggauggucucaaucuccugaccucgugaucugcccgccucggccacccaaagugcuggaauuacaggcaugagccaccgcacccggcccucuauguuguucuuugcagagauaguugaauacaaguuuuggcauuauggaaaaugguacauuacugcuuacauuaggcacugaagaaaugcauggugaaaguguuuuaaaaguuaaauuaagauuuuuuacucuuccuuccaaaaauguacuacuaaccuucucagaggaguuuaauucauaggugauccggaacuggauuuucuaaguuuacgauuuucaacaauaaaaauauauaaguaauagguuauucauuguuuguaauugcaaaauauuggagccugccuaagugcccaaauauaggagacugguugaauaaucuguacaaauacacaauagaguauuuuacaucuguacaauagugaaguucucuagaacuacugauggauuacuuucuaagauacauuguuuagugaaacaaaguacaaaagauuguuuacaauaugccauccuuuuugucagaaacaauaagugauaaccagccuccaagaaggugcccaaucaaccugucuccuaguauucacguuuguauaguccccucccacauuguagaagaguuuuucugugugaccacuagcauauggcagagcugaugauaagccauuuucaagauggucauaaaaacuauggcuuuuauguugggcuguuuuucucauucacuuggaucacuugcuccggaagcagcaaacugccauauuguaaacugccuuauagacaagcccauuuggggagguacugaagucucuggccaguagccagugagaaacugaggcuugucaauaaccacaugaagauucuuggaagcagauuuuccagccgcauuuaagccuugagaugagauaugauaguccccauguauagcuuggcagcaaccuuguuggaaaugcugagucagaaucauccagcuaaccauucccagauuccugacccucagaaacuaugugaaauaacauucauucuuuuaaguugucauuuccagauguaauuugcuaggcagaaauagauuacuaauacacuauaggaauuaaggaaaaaaaacucauuuaacugcauauauauauauauauauauauguauauauauuuuuuuuccaaaaauaagcacaagaaggauaaaccagaaaacauugaaauugauuaccuauaagaacgugagaacagaggguagauaagacauuaaguagaccaugccauuuugguauaauuuuaauuucuggaggcauguuaaugugcuacauauuaaaaaauaaaauuaaauugaagaugggggaaaaacaccuaaaauuugaauguaagcagaaauaaaugagccaccuauauuucaaacaaccacacugaagaaaguaaagaacuaaucuaaguaacuuuugaacguaauucuuugacuucauauucuugguguaggaggaaagaaaagggaauuucaaaccaacuuugacuucuuauuaaguuuguuguucuuuguuuuuugcagugugugguguaguaauucugcaacuauuuuauguauguuguaggauuaagcaaauaaguaaauguguugggagcaagggcucuuacuguagaagaagaagauacaaauguggaagggggaagacagaggagaaacuuguggauuuggauugaaguuguaggcaucagaaucacugcgggaaacaaaccucuauuucugcuacagaaaagaccuagaagcagugagaccccaauagcaguggagcacaccugcuuccaagagcuugguuucuacaugccguuuauuaaaagacaccaaaacuuugaaaaaaaaaugacugauuucaaagcuaggucggggaagguguaaaaggagccuggaacaucuucugugcuagaaaguaaugaacugcucggccgggcgcgguggcucacuccuguaaucccggcacuuugggaggcugaggcugguggaucacgaggucaggagaucgagaccacggugaaaccccgucucuacuaaaaauacaaaaaaaaauauuagccgggcgcgguggcaggcgccuguaggcgcggccacucgggaggcugaggccggagacuggcguaaacccgggaggcggagcuugcagugagccgagaccgcgccacugcacuccagccuggacgacagagcgagacuccgucucggggaaaaaaaaaaaaaaaaaguaaugaacugcucaaagaaauaauggagacacaugaaaagaacauaggaaccauccugaaggggcucccaaugaacauauccgggauaguuugacuaucaaaguguaucauaauagugauggauuguauagcccauuguaugaaauaggaauucuucagugguaauacaugaacgaauggggagggacacuuucuuacuguagaaugccuacuaaucaauguggagggacuguuggaauuggaaaaucaccauuugcaaccaugauaguaaagacugguuaggacaacaaucguuaguggaugccaaaucucaggggcaaaguuugaugagcagcuguauaauuauaugauucucagcaugauugcucauagauugauaauuacuugggagaaacuauacauugacaaaaucugacaauacuuuuuuuggauaucaaaauuaacaucacuaaugagaaugaauuaagccugugugcuggcagauguaauaccugagaaggucacaacauuucuuauguuguauucuggcuagggaggcaugacuaaaucucaugagaaaacauuaaacaaauuccaauuuagguucauucuacgaaauagccuguauuuuuaaaaaaugucagugucuugaaagacaaaggcugaggaauuacuccaaaucaaaggaaacuaaagagacaugacaacuaaaugcaaaauauaugauccuggacuagaggagaaaaaugcuauaaaggcuauaauaggaaugacugacaaaauuggagcacauacuguauauuagaugaaaaguauuguaccaguguuacuugaauuuaauuacuguacugugguuacaugaaaaaaguauuguuuuuaaaaaauaggcacugaaguacuaaacgcaaggagaaauaauguaucgauguauugcagccuucucaaauggauaaaaaauugguuguuacauauaccuaugugcauaaacauaagcgagaggauauaaagcacaugggcagaugauuauaaguaggugagauggaggauauggaggagccccuuguacuaauuuugcaaauuuucuguuugaaguuauuucaaguaaaauguuauucaaagugaucaugcugggcauaagaaagaaaaaggaaaacugauugauguuaauaaguuauguggucaugccaucuauacuagcuuuucugguuuucugaccuuagacagccucuuuuuugaauuauuaguguuuauaaagagcucaagacuuuuuuuuucuuuuucuuuacauuuuacuucuaacugcauugauggucuuuucuauugauuauuguuucaaaauuaaaugucuuuuuuucuaugaauaaaguuaaaaguucccaggccucauuucagaucagagcauuuuaugggcauuguuauaauuguuaacucuccuugcuuucuaucuuguucugaagaaaacucuugggcauuacauccagugagguuguuuugaagcaaaugauaucugugucauuuugucuugccuuuuccauaagaugacaauagauucaguguuccuaauuggucaagagugcuuucacuucacucuuugagaauacguuacguuagauggacaccagaugaguacuaacuaguucccagaaagcuuauuagccaaauuagccuucuuagcuuuguauauaugacugcaauauguaaguaaucacuacuuucucuucuuugggaaaacaucaggccuacuuagaaugucaguaauuuagaguaccuuaauauuguauguuugaucauuagccucuugacaguuuuaaaauugcuagaccuuuauugauguggauguuggaaaucaucugaauugacagcuugaguggacaugcagaagaauacagugaagaauaugcucaaauuuuuuugaaugaaaguggaaacugcauaauuaucucaaaugacuaugaguuaucguucuagauaugggaauuucucuuaaaagaaguaauauuugggaaauuaauuagacaggaaaucaguccuagauaaggaaugcuuuucaaguguagacuguccauugauuuguggauuaucagaacuuuguuauugccugugaguaucauguuguuuuucuuucugacgauacagacugguucuguguaccaguuuugguuuccguuccuuccuucagguucuuucuuuguggggaaacauugcucuuuauaauucuaguuauauauauuuggcuccaguauuugaaaaugggccccaggugaauaaaaaauacucuuuuuucucuauugguguuauaaucuuuccauauguuguuguuuuuuauuauucuauuacccuuuuaaugcacugagagugaaugauaaauugcuuaugaugggacauaaaaaugacucuuguuuugaagaaguuauuagaaugccaguggcaaugacagacagcaaugggacaguauccuuuucuccaggagagcaacaaauuuugugaauuuguuuacaaaauaagucuucuuauuuuaaaaaccuaauaagggaaaguaaaaugcucauuugcuuauacucuuuguaaaagaaaaacaaaaacacaugaaguagaaauauuaaugaugcuuuauaggagagaaaucuagccaggaauaaagaagggaaagaaacucaauuaagaaugcaagcaauguuuaaaccacuuuauauguacuacuaucaccaaaaguuugugauuuuauuuacuccuuuuucuuaagguuauacuuuaaugugugcccuucugaauauuugaacucuuuuuauuauuauuauuuacuuauacauuuucuagagaugggaucucgcuuuguugcccaggcuggaguguaccggcaugaucauagcucacugcagccucaaacuucugggcccaagguauccucccaccucagccucccaaacccaaguagcuaagacuaugggcguacgccacuauaacuagcuaacuuuuuuauucuuuguagagcuagggucuugcuauguugcuuaagcuagucucaaacuccuggcuuuaagagauccuaucaccgcagccuccuaaagcguugggauuacagauacaaggugcugccuccagccuaaauucuuauauuucccuguguuugccuuaaucauggcuuccaugucaauguuacuuacuuucucauuaguuaaaguauaccuugggccaaauguuauggugaaauguugugaaugcuacuuugaauuauggcugguuuuggaacuaaaaaucuucuguuuucuggagaagaaaacagcuaugcccaugcagcugcauccauauauaccuacauguguauacauacauuuuaccuacuuuuuuucuagauccaaggagauaaucuugaaugacaguuuauauacuuuguuucugaaagaaaagagaauaggagaaauuauucuaaguuuauuuugcuuuaaauauuuaugucauucuuuucagacaaaaaugauuaggaaaaaguugaaaugauauuuuaaaacauaauuuaaccaaagaguggaaguaaagauaguuucccuuaagaaauuuuugaaaaaugugagguagaaaauuauuuuaaaugugugaaaagccauaagauccaaaaggagacugguaucuuauuuauaauggaaaaaaaauaggaugaggaugaauacaaagcucuacaggagaacugaguguauaucuauuuuucaaauuggugcccaaaugacagggcaaaagaaccuaaaagagugaaugauuccaagaacuuucuauaccuuaauuaaaaagcgauggaagugaggaugggggugucuugaaaauuguauuaacagaguuuucccucaaaacaaauuauugucuaaccuacuucuguuauuaaauuaacuuucuuccugugaaccuugacuugaaaaguauuuagacuuuuaucaucauacucugccaauagguuugcuauuguccaguagugugauauaauugaaucugaauauuuucuauguuauucagagcaaauaacaguacuaccuuguaaauucuugaagcuuaagaauucaggaaaacucguuuauuuuuuaaaguagaccuaucuuuaauuggaaugaaaaccaauuaagcuuugaaggaaugcacauuuacaaacugucaguuguuuaaacauaaggagaguagcuuaugaacaguuuauugccaggauguaagaguggcuuucuuuugauuuugaccacucauuucucugugggcuaaaaaaugaaacauuuauuuuuuauugaaaugaaaaaauaaauauggucacuuuaaaauguauacauagauaauuuuguuuucacuauauaaucuuguuuaucuaagccuuuuuuuuuuuuggcuuucugguuuuuccugaguagcuuucaaucuuguaucuuuucauuauguaagagacuguaaaauauauuuacuauguuuuagauauuuauuguaguucaguaacuuuuguauuuaucccugacuuaauuaaauaaacuuaauuuuaacuacugaggcuauuccucagcaacugugaugaguucuuguuaucuuaggggauucugguuugugcuauaaguguauuagggugaaaggguuaguugaaaaguguggggaagcaaaagggcuucuuugaguauuugcagcucuauuagacucuuucauucacuuuccuuuaaaacacauauauuucuacauauaucuuccaguaaauugugugaagcuuauguuccaaaagacuaaucgggacgguucaagaacagugggaauugugcuuuuacuuacucaacgaaggauaauuguagaaaagcaucgugggcugcuauaaaucuuuuccacuaugugugaacucuuuagcuaaaaagugccuauacagggaauauaucaaggggucuuucuggcaauuuugauagucucauaucuugauuauaccaaaguuaggguuuccuuaaauaaggaaauccauuuuguguugcuguaacaguauaccauagacugggugauuuauaaagaaaagaauuuuuauuucucacaauuucucacaaauuuggaggcugggaaguccaauaucaaggagccagcaucuggccagggccuucuuacuguguuauuccacggcagacggcaagacagaaaaauggcauuaauccauucaugagagcggagcccucaugaccuaaucaccucuuaaaguuccucccucucaauacuguugcacuggggauuuuuaacauaugaacuuugggggauacauucaaaccauaucauaaagcuauacuauuugagucacuuaauggguaauuguuuacccagagcauuuuuagucagacuauaaugugucuacugaauagggaaguaaauaacuaucugacuggauccauuauauucaagaaccugccuuaaguuauaugcacgguaaugauuaagaauuaaauuugacauagcaagaguacucugaagacagguucaucauuuuuaucaauuaaauuccuuuugagaaagaaaauagcaccuaauguaggagcuggccugacauagcuaggucauguuguucucugguuggaucugaacaauuucauggaauauaaauaaucagaucaggucaccugagaccaugauuaagugauaugaaacaagaucacuucacaauuuuaucuaagcacagaccuaaacaaggucacuguguaacucacaacauacccaacauccuucucaccuggcuaaugugaaugacagcuacuuuuuugcccagucauacauugccccucauuuucuaauagcauccaauccagaacaaacaucuaccuccuuagcccgucucccuaaaucucccaaccaaagcccaaacgcuuuaauagauuauuucuaacacccauuuaauaagaugccccacuguucuccaugguguguguucucccucacugcauuaaguaaugcacccaauuuauucaguuacagguguguuccuguucaguuacaaguauggccuuuggcuggagaacauuaacaguuuccuuaaagauauuucuuaaggugcaaauuucauccccagcauuuaggaguugaauguguuguuaacuuuuuauauaugcauaugcucaauucagaauuuuuuuuuuuuuuuuaccacuugacuaucaggcacuuugauaguuguucaguauauaaggauaaaaaaggccugcuaggaaauuucaaacuggguaauugagauauuuccaagugauaauaaaaaugagucugauuuauuuauaaauaucucugcuucauacacuggacucauuuuaguauauuuuaauaagagucaauaaaaauacuugagaauuucuuaauuuuguauaggauauggaauucuacuuaccauugccuaauacauugacagaacuuguguuuuuggaauuuauucacaaaaacucuagugccauugaguauuucuaacauuauuuuucagaaaaacauuuuucugagaauguauuuuuuuuuuauguguguguguuagaggaauagagacacacagagacauuuacuuugcaacucaauaauaaugauuuacauagaaccaccugauggccaguuaugaugauauauuaugugcguuuuguaaaagaauuucuggaauuacuguuaguuucaucaucugcccuacaauauaucuaucugcacaagucguuuucuguaagauaugaaacuguagaucucacacaaagcaaagaaugaauuacuucugagagaaugaaguguuucuuaguuuugcuuuuuagaaaguaaccucacaaagccuugucuuccaaggcaaaucauuggacaccucgaauuucaauuuuuugcacuucugaacuacaacaguugcuucuuuacaagcuugauguagaaguguuuggcuuaaaucuuuuaaguuuaucaagaugagaaaacuuuagcgucuaaagaaucugaaaauagccuggugaaauuuuguaccaacugcaaaccgcuuagguagucuuugcuaccauuccuagguaauuauuugcagacgccauuauacaaauggcugauucuaucaauuaaaccacauuuacucaaaaugaaugugucguuucuuuugcuagcacagaaugagaaauuauguaaagagagaauaguuuuuaguauuugaacggugcuaguuuuccuuaauuauuguauucucuuaaauauaugacuguuuuuacauagucacaaauuagaaaugucaauuuauuugaaacaguuuucuacuuuugucacacuaggauuuccacauauuuaaauuuuauuucugucuaaauacuaugugggcugaggacaaauaauuugaaaugguacaagauaaagcagaaugaugucauccuucauaaacgugaucagucaugaaccauuuaguuacauaauuuguuagacuuuuucauaauguuuuaaaguaaaucuuucaguguucuugaaauaagauuuuaguuuaauauacugcaguuuagaauauugaacaucauuuuucuuuuuuuagcccuaaauucucaucagaucuuugcuguagauacuuuaauucucuuaaagugaguaauuggacguuuaguaaaaacaugacaccucuuuuaauaaauguacauacuucagaaucucauaaaaguucauguaaacucaaaauguagaaaauuauuuuaccucuguuggagaacuaauaucauaauaacagcuugacuaaaaguauguaaguacuguauuucuuuauguacuauuguuauaaaguaacugauuauacucuacccccauaauaguaaggagagauuaauauuuuaccuaauuuuuauauacuuuuuuaagucaguggaaggaaaacccuaaucuacuuuauugaauauaauugaauaugagaaauuacugagaugggguugcccguguuuuucacucauuuauaaaagcuugagaaguccauuuuuauuaaaaauuuacucauuagacauaaucuuggaaagaaauacauaagaacuucggcagugccaccuugcacccauuaggauggcuauugccuuaguccauuuugugcugcuauuaauaguauaacacagacugggugauuuauaaagaaaagaaguuuauuuuuuucaguucuagaagcugagaaguccaagguugagggacccgugucugguuagggccuguuugcugugucaucccaugguggaaggcagaagagcaggagagcaagaagggacugaauuugcuuuuuauaagaagcucacuaucgugauaacuaaauggcuucugcgauaauagcauuaauccauucaugaggguggagcccucaggaccuaaucaccucuuaaaggucccgccucucaaaacuauugcauuggggauuaaguuuccaacauacaaacuuggagggacacauucaauccauagcagcuacuauuaaaaacaacaaccaccaccaccaccauagaaaauaaguauuggcaaggaugaggugaaauugggccccuugagcacuguuggugggauuguaaaaugguguaagcacuauggaaaacaguauggagacuccucaaaaaauuaaaaauagaauucccauaugacccggcaauucugcuucuggguauaugcucaaaagaacuggaagcaggggcuugaagugauauuuguacacucauguugauagcagcagcauuugcaguaaccaguagguaaaagcaacccagguguccaucaagagauaaaccgauaaauaaaaugugguauggaauacaauggaguauuaaucagccuuaaacagaggaagggaaucugacacaugcauagcauggaugaaccuugaacacauuuugcuaaauggaauaagacagucacaaaaggacagauaauguggauuccacuuauggaguuacuuagaauagccaaacucagagacagaaaguaaacuagugguugccagggccugaagagaggggggaauggggaauuaguguuuaauagguacauuuucagccuugucaguugaagagugcugugaauggaucuuggugaugguagcacaacagugugaguaugcuuaaugccacuguguacuuaaaagugguuaaggugauaaauuugggugaggcucugguaguggcugaggugaugccauaaauaaauaaaaugaacauuuuuucauccuucugguuagauuuuuuauucuauuggguaaaguggcaauuggcucuuuccaauuugagaagacucuguuaucauuauaguuuaguuauauucauuugauauuugcaugcugcuacuugcuugaaccuauauuuucacuacuucauuggucaaauaucugaaagagaaauuuuaacguuucccacuagaacuuuuucuuaucaagugcuuccauuucuuggacuuuuuacugaaggcuugucucccauguuguuuggaaccuguuuuaguuucuaguggcuggcauaauuuaaacaaauuggguggcauuucuuuuggcguaccaccauucaacccacaacagcaccuucaggagcuaauuugcuuugugcguuguuccuuuagcaauuaaauaugaaauuauauacagacaguccucgacuuauguuaguuugaccuugguuuuuuuuacuauaugauggugcaaaagugauacacauucaguggagaccauucuucagaugcccauacaaccauucuguuuuucauuuuuaguacaguauucaauaaauuacagaagaucuucagcaguuuauuauaaaauaggcuuugugugagaugauuuugccccacuauaggccaauguaagucuucugagcauguaaagguagacuaggcuaagcuaugauguaucauggguuugguguauuaaauauauguuuuuucuucaccauuuuauuacacaaaguuaaaccagaugggacugguucugugguugcagaaaguuggaugucacaagacaggcguaagucaccuaccccaucuuaagaucaggagaaguggugaaugcaaaggggaggacggguaagcagaaggaucuggucuaaggaggacaagggugggggauggguugggagcagggugggguuuguagaaucccaagaucagggagaagacauggucucuccaggauuguggcuaccuaugaagagaagcccauucauacuggaauggugugaauucaccacaguggucagaguuuucaaagaccaugcugcacagagauguuaguaaacaguuuuaugcaaggaaaaggcaggaaaggaguugucugcauagucugaagggauaaagacacacaaacaggacgaaccucagaacaauuuuaacagaaagagacacgagccccauacucucacucugacgucuaaauuuaccuggguggagagagugaggcgaggauuuuaaaagauuugcagggaccucagauuccagguauauuagugcugggggacuaugaggcacauacuuaaucuagguagaggggaaacaggcaucauggucuaaauguauuuucaacuuaaaauauuuccaguuuacaaugagauuauuaggacauagccccaucauaaguugaggauccucuguguuugaucuuauuccugucauuuuaacuuuuucuuuaguauuuuuugaaacuuacuuugaugauuuaaacaaguuucuuucuuguguuuucccuuccugaaaguucuguuuuugaaaauacaguuuugacucauaguuaucuuuucuuuaacagccauauuuaaauucacauuguuucucugauuugacaaaauaaaauaacuguguucccaagacguuuacuuacuauuucuccauugcccuacccucaacccuucucaguucuucaauuucucauaguugaggauuuuaguucuagacuaguaguauauuauaucucuucauuuuagaaauuccugcuuaacacauaauuuccuucugcauuaucauuauccauuugggcuuacuuguauauugcaaacauuuauugcuugcuugcuuacuuacauugcuugcauucuuggucuucucuugcucuugagauuucuuuuuuuauaguauuuuaaaaagauuuccuuguuuuuuucagauagaauauaugaauguuauuuuuuucgcuuaguucuugcaugucuuucuuuggccuccaaacgaauaaugccuuaccugcaauauauuaaauauaacuuuuuuauucaccuuuuuaaauucgaccuucagugaucuguaguuauuauucuucauuuucuagcuuguauuauugcaaauagaaaucuguuucacaucugauuucauucucauuuuuuugguuucuaaauauuugagauuuucucauuuuuauacagagaaguuucuaauuuuuuugaagucacauugugugauuggugacuucccuaaucucauaacauguucccuuuuaaguggaaucaauauuaaaugacauguauuaagguuuauuaucagaaacucauggaaucucaagguuaaaugggaccuugaaggccauuuaguccaaauaaucauacagugcauggauauuucaguaccauuaucaaguaauucucucauucaugcuuacauagguuuuuucuuuuccaagucaguuuaguccagcuucuagguuuuggugcuuuguuaggucucuuuccccguuaguccuaauuuuauccuuugggguccuaugaguaaaccuaauccuuuuguacucuggcaguucaucaaguauuugaagagcacuauuaugcgacuuuaaaacucuuuuauaacugucuuuagaaaaagaaaaauuugggaaauuuuauaucccuuaguagaugauggcagagagguagcagagcaaagauggcuaaacuaaaacguggaucagauuugcaaaacuccauuuucuagccaauaucauaggaaaauuaaagaaaagagcacuugcuaucuauuacugucuccagaaaaaaccuccagcuuuguuaaagguauaacuuuaaaaagcaacaacccgcaaacacgcauagaaacagacacacacaugcaagcacacuucuacccucagucuagacaauacuuaccuuuguucacuuuuugcguaaugauucugaucauucagugccucuauuugguaucuguuuggucaaaugauacuauuguugcugaguacaagggauagaacaguuggauuuugccccuuuuuguuuaguuuguucauugcauuuauuuugcaccaagcucuuacaugacccagcaguaacuagagagugaaauugaauaagaucauuugguuuuagucuaggccauaugcuuuugccacuguugagcaaaaauacggaaaaguaaaauacucuaaauggaaaaauacacaaauguuagaaaauaccaagccuuuuaagaggcuagagaacaacccagaggcaguaacugcugaguucauagcuuuaguaauuucugcagagaacuaauugcuucuuccugugugcuccauaacacuucagacauuauauuaagaaaaucauuugugggucugucuucuugugugacuugugccccuugaagucaggggccauaucuuauauucauuauauuucugggaaugcucugcguuuuauugaauacagcagaauauagucaugcaucacuuaaugaacgacauaaguucuaugaaaugcgucauuagguaguugucauugugugaacaucauagaauauacuuacacaaaccuagaugguauagcguacuacacacauaagcuauaugguauagccuguugcuccuagaguacaaaccuguacagcauguuacuccacugaauacuguaggcaguuauaacacagugguaagcauuuguuuaucuaaacauagaaaagguacaguaaaaauaugguauaaaauaugagagacaguaugucuucuguagggcacuuaccauaaauggagcuugcgggacuggaaguugacucacugggugaguccgugagugaguggugagagaaugcgaaggccuagagcauuauuguacacuacuauagacuucauaaacacuguaugcuuaggcuacauuagauuuauuuaaaaaaauuuuuuuucuucaacgaugaauuaaccuuagcuuccuguaacuuuuuucacuuuguaaaaguuucauuuuuuuuaacuuuuugacuguuaugauaacacuuagcauaaaacacauuguacagcuguacaaaaauauucuuuacauaugcuuauucuauaaacuuuuucugauuuuaaaacuuuuuaaacuuuuuuuguuaaacauuaagacacaaaaacacauguuagucuaggccuguggaggguuaggaucgucauuaucacuggcuuuccccuccccaugccgucccacugaaaggucuucguggacaauaaaccacuaacauauucauuuguuaucauuuucaaguauuauguauuucauguauuguaugugcaauacuuuuauacaacuggcugugcagguuuguuuacaccagcaucacuacaaacgugaguaaugcucccacugugacauuacuaggugauagaaauuuuucagcuuuguguuauuaauguuaugggacuacuguuguauauguggucucuuauugaccaaaacgucauuauguggcacaugacuguaccuguuccccucacuuucccauucuuagagucacauaccuuaaaaagaaugucucaucuuggggaaaacaccauugcgaugacagaggggucuguuauaucuaggcuuagaacuaagaaugaaaguuauuacaggauuguauaggaaauuccugggagaaaaaaaaaaaaacagugggauagguuuaggguauagacuuagaaaguagugucauacauaaacaggauuaguaaacacaguuuugguguggcuauuugaaauugcugaaugaaauuguuaugcuacuaauucagugaagaaauuauuauaaucauauacauauaaacauacuuuucauuacaaaguuuggugugcuauacuuguuagauuuuaaaaacauguuucuuaucccugaaagcaaggcagauaguuuugagcacagagcuacuugaacuaccauaggaagaagaaaaaguuuugacagcagucagucaaccaaucaaauauguagccguuugugcuaagcaaauaacuuauuuucuuguuucuccagagaauacuggacaaauuauacauggcgaauaagaugaggcaaggaguuuucacguuuuuaaagaucauauccaggcuauuuaauacacuucacuaguagaauauaaaguaaguuacacugaagaagaaaugaauaauaacuaauggucuuuaauuuuuuaauuuuuuuuucaauuguuuuugggggacagguggugguugguuacacggaaaaguucuuuagugguaauuucugagauuuucgugcaccuguuacccgagcaguguacaguguacccaguguguagucuuuuaucccucaucccccucucacccuuccccccaaguccccaaaguccauuaugucauucuuaugccuuugcauccauauagcuuagcuacuacuuauuagugagaauacacgauauuugguuuuccauuccugaguuacuucacuuagaauaauggucuccaguuccauccaaguugcuacaaaugccauuauuucauuccuuuuuauggcugaguacuaguauuccaugguguauauauauaccacaguucuuucuuucuuuucuuuucuuuuuuuuuuuuuuuuuuuuuuuuuuuuugagauggagccucacucuguuguccaggcuggagugcaguggcaugaucuuggcucaccgcugcagccuccaccuccuggguucaagcaguucuccuuccucagccucccaaguagcugggauuacaggcaugugccaccaugccuggcuaauuuuguauuuuugguagagacaggguuucaccauguugcccaggcugguuucaaauuccugaccucaggugauccacccaccucauccucccaaagugcugggauuacaggggugagcuacugugcccagccuauaccacaguuucuuuaucugcuugucgauugaugggcauuugggcugguuccauauuuuuugcaguugcaaauugugcugcuguaaacaugggugcaaguaucuuuuucguauaaugacuuacuuuccucuggguagauacccaguaaugggauugcuggaucaaaugguaguuguguuuuuacuucuuuuagucuccacacuuucuuccguagugguuuuacuaguuugcauucccaccaguaguguaaaauuguucccuuuucaccauauccacaccaacaucuguuauuuuuuuauuucuuaauuauggccauacuugcagaaguaagaugguaucucauugugguuuuaauuugcauuucccugauaguaauguugagcauuuuuucauauguuuguuggccacuuguguaucuucuuuugagaauuaucuauucauguccuuugcccacuuuuugaugggguugguuuuuuuucuugcuuuguuugaguuccuuguagauucuagauguuaguuagucaucuuugucagaugcauaguuugcaaagaucuucuccugcucugugguuugucuguuuacucugcugaugauuucuuuugcugugcagaagauuuuuaguuuaauuaggucucauuuauuuauuuuuguuuuaguugcauuugcuuuuguguuguugguugugaauucuuugccuaagcuaaugucuagaagaguuuuucugauguuauuuucuagaauuucuguuguuucaggucuucgauuuaagucuuugauccaucuggaauugaauuuuauauaaagugagagaugaggauccaguuucauucuuuacaugugccuugccaauuauaccaacaccauuuguuaacuacgguguccuuucuucaccguauguuuuuguuugcuuuguugaagaucaguuggcugugaguacuuggguuucuuucuggguccucucuucuguuccaacuaauugucuuuuauuuggaguaguacaaaauuuuaaauaaaaauaaaugaaguggggcucacuucuguugguuuuuuuaaucuuuaauuguguaauauauauaaaaauagcagcuaaaguuuauguuuauguauucaaccagcauaauaacuuuuacuuuaauauaaggauagaaaauauaggaaagugauugacauaugcauaugucuuuuguugaaugccaucggucaaagaccaccagaaacauaucugugauuaacaaaguuaaauuuauuucgcuuguugccucaagggaggacacacccagaagagcuuugagagaauuuagaggaggacuuagaaggggcuucuuguagggucuagacuuguacuaaauauuucuaaaagggauuugggaagcugggaucaguuccagauuggauacucucaagaaauagugcaauucaguaguucagaaauaucuguucgggaggcaggaggaaugaagccaggcuggugaugucauuagucagaaagcaagucacuaggaggaaaagauuguuggccacuuuucuagcugugguaugggcuugcauaagaacauucuuuuaugugggcuuguuccauauccuguuggaaauagucauuaucagccaggcaaauugguaguuccucaauauuuaacauacugcugauccuagguuaauuuuuuaauuuaucccaaacuucauacuucaaaauacuaauguacauauuauccuucacucgaguuucauaaggauuauuacacugcaggguugguacauuucuauggcauaaaaauaugccacaaucaauaugcguuucaugcagucauuguaugcauaauuuaaaguaaaugugaaguuuaaaauuaaugaaaaaugacauguauuaaauauagaaacaaaucuuuacuuucaucauagcuuuuuauaauuacugacauauggauauacuugaagcuguuagaagucaauaggucaccagcuagaauauuaagaacuaucagauagauauuuguaugacaggaacuuauuaccaauauucuuucuuuuggagugagguucuucucuguaaugaggaaguggauauuuacuccugguaagguuuuaucgaucucaauaagguucuaucuuuuuugguauagaggagaaaggaaaguugaucugcaugauuuuucuaauuaucuucguuugaauacauuucacuuuuucuuggaaauuauuuaaggcccugucuuuuuuuagccacuguuuuauuaaugugguaaaucaauuucuguagcuucucacauugggauuauaacuuucuagggaugcaggaaaauauuuaggauaguaagauaaaaaauaccucuccuuuuuguuuaaauaaaauauguuuucuuauaaaguuaguggaguguggagaaaucuguuuucucagcuuauuuaaauauuaauucuuuucaucaaaauuuuuuucacugacauuaaugaaaaggagguccugucuuccuggugauucacagagagaaauaagaaacaauuguuaguaaaucaaauacuuuaagauuugaaucacauuauuaucaucaucaucacuaucaucuuguguuagaguuuuucugugagucaaacauugaguguuuuauuuccauuaucccugacccucagagcgaccacagaagauaaauauuaucuucucuuuuuaaaaaugagaaacaugaaacucagaggaagguuacaugauuuggucaaacuuacaugguuagauaauggcagagccaggauucauuuaaaaugucuagcccuagagguuauccuccuuguuagaacucaccagugauucccuagccaggcacaggccacaccuccaaagacguugcuagaggguuucaugcaguuuccauggacauguucaccugcccauguuuaggaugaaagucauaaaguuaggggaagggaagaaagauuaaagacugcuauagugaaguaaugagggagaaagaaauuaaaaggaaggacacaaagcacauuuuaaacaugcaugaaucaaauuacuguuguuuaugcugacaguguuuguugcuuaaugaacuaaccacaucaagcaaagauagguuugacuucagggucugcuggaucuggggacucaaacuguaucaugcaucugacugucucuguuucuguaaaacauugucuuauucugccuucuauugcuauaagugaauaaucaagacuggguaauuuauaagggagagagguuuauuuagcccacaguucuggagaccaggagguccaagauugggcagcugcauuugaucagcuucuggugagggccucguacugggucuuaacccagcagagaagaagaaggggaagugggcacaagcaaagacgccaagcaugagaggcaaccacacuuuauaacaacucacucucgugguagcaaauucagucccaugagggagaacucacuucuacuccaaugagaaaggcacuaaucacucucacaacaucaucaccucuuaaaggccccacuucucagcaucauuauauugccaacuaaauuucagcauaaauuuugguggagacaaaccacauccagcccauaacaacuacccaccuucuuucugcuucauucucugcccuuucuuucugcuggcuccccucacucuuguuccuuucccuuucugaucuuucucuccuauucuuucuccuucccuucugugcucccucuaguccuuucccugcuaccagaugacuucagccucugugucuccauuuccugucugcaucugcaugguuuuuguuuccuuaggcucuucaugguuugaggaauauggccauuagcagcucugggaccacagcccuuuagcugcagaggucuuucccaguugugcaguaaaaaauuucaaggaacaauucugagcuguuucagccaaauaucuauaccugcauuagucacuguucugcagauagagugugaugauuagccagaaguggagcaaggugcugugauugggaacugcaccagaaucacaagaucucaauagaggagagcaauuccccaaaucauacuugagagaucacuggaagauucuaacaggcauuuggcagauaaaaauaacaugccuacugugcuuuucuauuuagauuuauauuuucuauaguuuauucuuaaccuacuaguacugcuaacuaaaaaucgaguguuucuuguguuaaaaaaaacaugcuuuuacaaaaaaaaauuaaauuuuaauaccuuugcaacugaaaggagauauaaaugaggauauucagaauuucagcauuaauguuuaaguuucagaauacacaaacauguuuuuauugguuaaagaauguuuuucacuucauugcaaacuuaaccaaaaagaagaguaguuguuuuacuuuagauguucaucauauauuguucaaacagcuucuuuuucaaaagaaagucuaugucagguaaaauucuauuuguugcuuugcaagcuguaccucuagaugauagauuucauguaucuuagaauuagauuucuguguucuuagauuccuguguuccuagcaacuuguagggaauaccuuaaaaaguaucuacuuggggguggagccaagauggccgaauaggaacaucuccagucuacagcucccagcgugagcgacacagaagacgggcgauuucugcauuuccaacugagguaccggauucaucucacuggggagugccggacagugggugcaggacagugggugcaacgcaccaugcgugagccgaagcagggugaggcaucgccucaccugggaagcgcaaggggucagggaauucccuuuccuagucaaagaaaggggugacagacggcaccuggaaaaucgggucacucccacccuaaaacugcacuuuuccaacgggcuuaauggcacaccaggagauuauauccugcaccuggcuuggaggauccuacgcccauggagccucacucauugcuagcccagcagucugagaucaaacugcaaggcagcagcgaggcugggggaggggcgcccaccauugcccaggcuugaguagguaaacaaagcagcccggaaacucgaacuggguggagcccaccgcagcucaaggaggccugccugccucuguaggcuccaccucugggggcagggcacagacaaacaaaaggcagcagaaaccccugcagacuuaaaugucccugucugacagcuuugaagagaguagugguucucccagcacgcagcuugagauccgagaacgggcagacugccuccucaagugggucccugacccccgaguagccuaacugggaggcaccccccaguaggggcgcacugacacuucacacggcuggguacuccucugagacaaaaccuccagaagaacgauuagacagcagcauuugcgguucaccaauauccgcuguucugcagccacugcugccugauacccagacaaacagggucuggaguggaccuccagcaaacuccaacaggccugcagcugaggguccugacuguuagaaggaaaacuaacaaacagaaaggacauccacaccaaaaacccaucuguacgucaccaucaucaaagaccaaagguagauaaaaccaccaagauggggaaaaaccaaagcagaaaaaccagaaacucuaaaaaucaaagcgccucucguccuccaaaggaacgcagcuccucaccagcaacagaacaaagcuggacggagaauggccuugaugaguugagagaagaaggcuucagaagaucaaacuauuccgagcuaaaggaggagguuugaaccgauggcaaagaaguuaaaaaccuugaaaaaaaauuagacaaauggcuaacuagaauaaccaaugcagagaaguccuuaaaagagcugauggagcugaaaaccacggcacgagaacuaugugacgaaugcacaagccucaguagccaaugcgaucaacuggaagaaagaguaucagcgauggaagccaaagugaaugaaaugaagcgagaagagaaguuuagagaaaaaagaaaagaaacgaacaaagccuccaagaaauauggaacuaugugaaaagaccaaaucuacguccugauugguguaccugaaagugacagggagaauggaaccaagugggagaacacucugcaggauauuauccaggagaacuucccaaaccuagcaaggcaggccaacauucaaauucaggaaauacagagaacuccacaaagauacuccucgagaagagcaacuccaagacaccuaauugucaaauucaccgaaguugaaaugagggaaaaaauguuaagggcagccagagagaaaggucggguuacccacaaagggaagcccaucagacuaacagcugaucucucggcagaaacucugcaagccagaagagagugggggccaauauucaacauucuuaaagaaaagaauuuucuuuuuuuuuuuuuuuaauuuauuuuuuuauugauaauucuuggguguuucucacagagggggauuuggcagggucaugggacaauaguggagggaaggucagcagauaaacaagugaacaaaggucucugguuuuccuaggcagaggaccccacggccuuccgcaguguuugugucccuggguacuugagauuagggaguggugacgacucuuaacgagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaggaauuuuucuuagugcagaacaaaaugaaaagucucccaugucuacuucuuucuacacagacacggcaaccauccgauuucucaaucuuuuccccaccuuucccgccuuucuauuccacaaagccgccauugucauccuggcccguucucaaugagcuguugggcacaccucccagacggggugguggccgggcagaggggcuccucacuucccaguaggggcggccgggcagaggugccccucaccucccggacggggcggcuggccgggcggggggccgacccccccaccucccucccggacggggcggcuggccgggcggggggccgacccccccaccucccucccagacggggcggcuggccgggcagaggggcuccucacuucccaguaggggcggccgggcagaggcgccccucaccucccagacggggcggcuggccgggcggagggcugacccccccaccucccucccggacagggcggcuggccgggcggggggcugacccccccaccucccucccggacggggcggcuggccgggcagaggggcuccucacuucccaguaggggcggcugggcagaggcgccccucaccucccagacggggcggcuggccgggcggagggcugaccccccuaccucccuccuggacggggcggcuggccgggugggggggcugacccccccaucucccucccggacgggguggcuggccgggcugaggggcuccucacuucccaguaggggcggccgggcagaggcgccccucaccucccggacggggcggcuggccgggcagggggcugacccccccaccucccucccggauggggcggcugccgggcggagaggcuccucacuucucagacggggcagcugccgggcggaggggcuccucacuucucagacggggugguugccaggcagagggucuccucacuucucagacggggcggccgggcagagacgcuccucaccucccagacggggucucggccgggcagaggcgcuccucacaucccagauggggcggcggggcagaggcgcuccccacaucucagacgaugggcggccgggcagagacgcuccucacuuccuagaugugauggcggcugggaagaggcgcuccucacuuccuagaugggauggcggccgggcggagacgcuccucacuuuccagacugggcagccaggcagaggggcuccucacaucccagacgaugggcggccaggcagagacgcuccucacuucccagacgggguggcagccgggcagaggcugcaaucucggcacuuugggaggccaaggcaggcggcugcuccuugcccucgggccccgcggggcccguccgcuccuccagccgcugccucccaggcggcgcucgccggcgcggcggcaaagacugagacagcuccgcugcccgcugaacuccauccucccggcggucgggcggcggcggcugccaagaaaagaauuuucaacccagaauuucauauccagccaaacuaagcuucauaagugaaggagaaauaaaauccuuuacagacaagcaaaugcugagagauuuugucaccaccaggccugcccuaaaagagcuccugaaggaagcacuaaacauggaaaggaacaaccgguaacagccacugcaaaaacaugccaaauuguaaagaccuucaagacuaggaagaaacugcaucaacuaaugagcaaaauaacuagcuaacaucauaaugacaggaucaaauucacacauaacaguauuaaccuuaaauauaaaugggcuaaaugcuccaauuaaaagacacagacuggcaaauuggauaaagagucaagacccaucagugugcuguauucaggaaacccaucucaugugcagaggcacacauaggcucaaaauaaagggauggaggaagaucuaccaagcaaauggaaaauaaaaaaaggcagggguugcaaucguagucuuggauaaaacagacuuuaaaccaaccaagaucaaaagagacaaagaaggcccuuacauaaugguaaagggaucaauuccacaagaagaacuaacuaucauaaauauauaugcacucaauacaggagcacccagauucauaaagcaaguccuuagugaaguacaaagagacauagacucccacacaauaauaaugggagacuuuaacaccccacugucaacauuagacagaucaagaagacagaaaguuaacaaagauauccaggaguugaacuccgcucugcaccaaguggaccuaauagacaucuacagaacucuccaccccaaaucaacagaauauacguucuuuucagcaccacaccacaccuauuccaaaauugaccacauaguuggaaguaaaacacuccucagcaaauguaaaagaacagaaauuauaacaaacugucucucagaccacagugcaaucaaacuagaucucaggauuaagaaagucacucaaaacuacucaacuacauggaaacugaacaaccugcucccuaaugacuacuggguaccuaacaaaaugaaggcagaaauaaagauguucuuugaaaccaacgagaacaaagacacaacauaccagaaucucugggacacacucaaagcaguguguagagggaaauuuauagcacuaaaugcccacaagagaaagcaggaaagaucuaaaauugacacccuaacaucacaauuaaaagaacuagagaagcaacagcaaacacauucaaaagcuagcagaaggcaagaaauaaguaagaucagagcagaacugaaggagauagagacacaaaaaaccguucaaaaaaaucaaugaauccaggagcugguuuuuuggaaagaucaacaaaauugauaaaccgcuagcgagacuaauaaagaagaaaagagagacgaaucaaauagacgcaauaaaaaaugauaaaggggauaccaccacugaucccacagaaauacaaauuacuaucagagaauacuauaaacaccucuaugcaaauaaacuagaaaaucuagaagaaauggauaaauuccucgacacauacacccucccaagacugaaccaggaagaaguugaaucucugaauagaccaacaacaggcucugaaauugaggcaauaauuaauagcuuaccaaccaaaaaaaguccaggaccagauggauucacagccgaauucuaccagagguacaaggaggagcugguaccauuccuucugaaacuauuccaaucaauagaaaaagacggaauccucccuaacucauuuuaugaggccagcaucauccugauaccaaagccuggcagagacacagcagaaaaagagaauuuuagaccaauauccuugaugaacaucgaugcaaaaauccucaauaaaauacuggcaaaccgaauccagcaacacaucaaaaagcuuauccaccaugaucaagugggcuucaucccugggauccaaggcucguucaacauacgaaaaucaauaaacguaauccagcauguaaagagaaccaaagacaaaaaccacaugauuaucucaauagaugcagaaaaggccuuugacaaaauucaacaaccuucaugcuaaaaacucucauuaaauuagguauugaugggacguaucucaaaauaauaagagcuaucuaugacaaacccacagccaauaucauacugaauggacaaaaacuggaagcauucccuuuaaacacuggcacaagacaggguugcccucucucaccaguccuauucaacauaguguuggaaguccuggccagggcaaucaggcaggagaaggaaauaaagggcauucaguuaggaaaagaggaagucagauugucccuguuugcagaugacaugauuguauaucuagaaaaccccaucguuucagcccaaaaucuccuuaagcugauaagcaacuucagcaaagucucaggauacaaaaucaaugugcaaaaaucacaggcauucuuauacaccaauagcagacagagagccaaaucaugagugaacucccauucacaguugcuucaaaaagaauaaaauaccuaggaauccaacuuacaagggacgugaaggaccucuucaaggagaacuacaaaccucugcucaaugaaauaaaagaggauacaaacaaauggaagaacauuccaugcucauggguaggaagaaucaauaucgugaaaauggccauacugcccaagguaauuucuagauucaaugcgauccccaucaagcuaccaaugacuuucuucacagaauuggaaacaacuacuuuaaaguucauauggaaucaaaaaagagccugcauugccaagucaauccuaagcugaaagaacaaagcuggaggcaucauguuaccugacuucaaacuauacuacaaggcuacaguaaccaaaacagcaugguacugguaccaaaacagagauagagaccaauggaacagaacagagcccucagaaauaaugccgcauaucuacaacuaucugauuuuugacaagccugacaaaaacaagcaauggggaaaggauucccuauuuaauaaauggugcugggaaaacuggcuagccguauggagaaagcugaaacuggaucccuuccuuacaccuuagacaaaaauuaauucaagauggauuaaagacuuaaauguuagaccuaaaaccauaaaaacccuagaagaaaaccuaggcaauaccauucgggacauaggcaugggcaaggacuucaugucuaaaacaccaaaagcaauggcaacaaaagucaaaauugacaaaugggaucuaauuaaacucaagagcuucugcacagcaaaagaaacuaccaucagagugaacgggcuaccuacagaaugggagaaaauuuuuugcaaccuacucaucugacaaagggcuaauauccagaauuuacaaagaacucaaacaaauguacaagaaaaaaacaaacaaccccaucacaaagugggcaaaggguaugaacagacacuucucaaaagaagacauuuaugcagccaaaaaacacaugaaaaaaugcugcucaucaucacuggccaucagagaaaugcaaaucaaaaccacaaugagauaccaucucacacaccuguuagaauggcgaucauuaagaagucaggaaacaacaggugcuggagaggauguggagaaauaggaaggaacacuuuuacacuguuggugggacuguaaacuaguucaaccauuguggaagucaguguggcgauuccucagggaucuagaacuagaaauaccauuugacgcagccaucccauuacuggguauauacccaaaggauuauaaaucaugcugcuauaaagacacaugcacauguauguuuauugcggcacuauucacaauagcaaagacuuggaaccaacccaaauguccaucaacgauagacuggauuaagaaaauguggcacauauacaccauggaauacuaugcagccauaaaaaaggaugaguucauguccuuuguagggacauggaugaagcuggaaaccaucauucucagcaaacuaucgcaaggacaaaaaaccaaacaccguauguucugacucauagguggguauugaacaaugagaacacauggacacaggaaggggaacaucacacaccggggacaguugugugguggggauagggggaagggauagcauuaggagauacaccuaaugcuaaaugaugaguuaaugggugcagcaugccaacauggcauauguauacauauguaacaaaccugcacguugugcacauguacccuaaaaccuaaaguauaauaauaauaaaauuuuuaaaaaaaguauguacuuuucauucaaugaaagagcaguauuugagaggcaucauucacuguuguuaaaaauccucaaucugccauuuacuaguugugguaggcagaauacuagcccccauagaugucaacauacuaauccccagaaccuguaacuauguuaccuuaugggauaaaaagacugcggaugugauuaaguuaaucuugagauggagagauuaucuuggguuaucuggauaggcccaguauaaucacaaggauucuuuaaaggaggcucagaaucagagacgaucugaugacagaauuagaggucauagugaugcauggccacaagccaaggaaugugagcaggcuuuggaagcugaaaaagacaaggaaauguguuuuccccuagaggcuccgaaggaacacaucccugcucauccauuuuagacuuaugaccuccagaacugugugggaauaaauguguguuuuaauucacuuaguuucugguauuguguuacaauaacaauaggaaacuaauaucugaaguguuugaccuuuuguugcccaguuaccucagagcauuauuugaggauuaagugaguuuauucaaggaaagugcuugucaaauacaaacacguguguguauauguauguguaaaggaaaagaaaccucuuuuuuguuuuacugcuuauuucacuucuggucaccaaaauuugcaaguuuuuccuaccaugagcacucuuccaacagcaguuagguguccuauaauuugauucuguucuaacacugucugcuuggaauuaacgucagauccagugaguuaaaggcucagucccagaagacuacaccccacuuuagaggcuacucgcuaguaguagguugucaucuauacuucuuaucugcuggcugucaauuggggguucccaugaccucuucaucaaguuuaauuauuugcuaguggugcccacagaacucaggaagauauguuuaccaguuuauuauaaaggaauuacaaaggcugcagaugaauggccagaugaggagguacauagggcaaggucagugggcaggggcaaggagcuuccauacucccucccagugcuccaccuuccuagcaccuccacacguucaguaacccagaaacacuuucaacccugucccuugggguuucucuggaggcuucacuguggccaauugauuauaucauucccucccuggagaucaggcauggggcugaaaguuccacccauccagucacaugauuguuuccucugguaccagccccuaucuggagacuauccaggagcccccagccaucagucgucucauuauaucuuaguccauuuaauguguugcuguaaggaauaccucgaggcuggguaauuuauaaagaaaagagguuuauuuggcucacaguuuugcaggcuguacaagaagcauggugccagcaucuaugucuggugagggcuucagauugcuuccacuccuggcagaaggugagggggagucagcaugugcaaagacgacauggcaagggaggaagcaaagugauggagagggaggugccaggcuguuuuucacaaccaacuauugaaggaacuaauagagugagaacucacucacacuuccuccccgugcaccuuccaacgcaaauuaaauuauucaugagggauccaccuccaugacucagacaccucuuacuaggucccaccuccaacauugggcauccaauuucaacauacauuuggaaggcacaaacauucaaacuguagcacguuaacauauaaaaauguacuuaucacuuaucugagacacucaucugaaauuccaagagauuuaggggcuaugugccaggaaaggaagaccaaauacauauuucuuauuauaaaucacucacaguacauauacagguaauguacauaaaauuaugaacugcauuuagagaacugaagaugguucuaaugaagaucagaaaauaaaaaacgcaugcauguguaauuuaaguucaauuuuauauaauuaacaaguauacaacuguuaauaaaagucacacguucaugacucuagaagagaccuuaaauuuagagguuagcuaaucuaaccuuuuaccccauaaggauuccguacuauauuacuacacggcauuucuauaccauaucccuaugugcugucugccauuaguccauuguuggguaacuuaaaugguuagaaauacuucuaugcauuaagccaaauauaguaacuucuuuuuggaacuacaucguauaaggauguuuuuccuuuugagagcccucucugaaauacugacaaugcuaaucaagaccuuuccuauacucaccaccuacuaucacuucaagcuuuuguacucuagacuaaguuuuccuccccuccuuuuuaaaauucuguugacguaaguuuccauuugcuguuuugaaauuuguuacauugguuuccuugagcuuccugucaaacuagcuucaaaauauuuuuacuggggcuagucuggagucaguuuuuagucuuucuucacuuacauauuugaacaguugacuguuuuugaggggagaagggcucuaauagcaggacauugccuuuauccugauuaaauguucuugucaaucaugugaugcucuucagcaguugccagggagucaucauucugaaaaccagauuuacuuuuucuguuuuuuauucguauuuccacuucuuuuaaguuagcaggaagaaaugcugaauucaccaaugccuuuggucccuuguccaggacuucagagucacuagaaauggucuguauuucuuaugguaaaguugugcaucucuacaagauuccauaaaagggauuaguaguguguuugaccuguugucuuaagcauacucucagucaucucuuggcauauacaugugaaugagguagccucauaauaaccuugugcugccuuuucaggagucacuguuaaccucuacuggucucuuucucuggauacuggagcauggugcaaggauucuucaacucucaugaauucacucucgugaauucccauuauuauugcaugcaccuuuacaagcccuagaguaacuacuaagaaaggccucauguugccuuaugagucucuaagccuccucagagucuacgcaccucaagaauauuuuuauuggauccuuuuccccucccuaaccucauuccuaccucucuuuuuacuacucuucucucuucuuccuccccuccucuuuuuuucucucuguccuccaaauaaaugugcaaagucaugcucugaaacugaaguuccuuguaccuaggagaauccucaucuuacucagcgcaaauuugcuccuacuguaguaacagcuuuugcugcugacugauuacaaccguuuuacuguuguaagcuuccagcucaugaugguuuuagaugugcacuguccagcacaaagccacucgucacagcuggcugcugaacacgcugccacacguugaaaugguaauauuguggauauaguaggguaaauaaaacgugcuauuaaaacucaugucuuuuuuaaacauugcuacuggaaguuuacaauuacauaggaagcuuauauuucuacuggacagcacuuuucaaacauucuaaacuaaaaggaaauauauaaagagauuaauuuaugcaaaggaaaagagagaaauaaauuacguauuaaaaaguaaaauauggcugggugugguagcucacgccuguaauccccgcacuuugggaggccaaggcuggcagaucacuugaggccaggaguucgagaccagccuggccaacauggugaaaccccgucucuacuaaaaauacaaaaauuagcuggcugugguggcucacgccuguagucccagcuacucgagaggaugaggcacaagaauugcuugaaacccaggaggcagaguuugcagugagccaagaugguugcauugcgcuccagccugggcgacagagugagacucuaucuaaaaaaaaaaaaaaaaguaaaauacauagcaaucuugaaccguuuugaguaaguacaaaugucccugcacaucucaguaguccagagagcauugcuauauuauuccaaaggcugguggagguucauaauaauuggcccugaauugucaagaagaguaaaauuauguuuggagugaucuguuuuucaguguauagagguauguaauauauuucauaaagaaauucuaucaagaaaagagaaauuaaaaugcuaaauuagcaguuauguuaaaaacuuggcuaucuggaaugauuuaguucuugaguguuccgauuuuuaugguagcaguauucuaauaagacaaagugauaauuuuuauaugaggguaguugauaaauuuaugggaggaacauaagucauucaacaaauagaaacgacagaauacucaaaaacacuuucuucagagauucuucuuaauauuuguauuauuuuuaugugaaguauuuauauugaaauaauuauuucagaaagaacucauuuuuguuuaaaccaguaugccaauaugaucucuucauuuaagaaacugcuguauauguaguagcugcaaucucagaacucucaggauauaugaacaaagcguauugugauuuauaggaaccaggccauugucugugaaaagaaaauuacuuuccuacagcccuugcucuuaucgggaugcuuggccccuggaugcguaagccuacugagggcugaaguuuugggagucgccuauucagggauugccugaccucugcaucuuauaaccauaucauccugaggaauugcagacugauguggaggcaugugacugcuuuuugaaugaugucagaacugucuugucuuuguugugauuauuguguaugauugcauuuuauccuucauagucugucauugauuuacaaaacgucucagaaagauguagugagugcaauuaugguuuccucaagaagcaccaauugugauuuacuucuucagcugcacacacuucaguuauuuuuuucuuauauuuucccaaaaguaucacuaaaucucuuacuguguuagauuucauugacuuuagugaagucugauuaauauccuuucucauuuaagcccuucuggguuuuuuuuuuuuuuuuugagucucauucauuuacuaguucucuuugaaucacgucauuuauuuuuucauuuaacaaauauacaggcacuguuuacaauaugccaagcacaauacagcacugauacagauaacagaaaucuugaauuguuggagaaagugauggaguuuagagcuagcaugcuagcaguggcaccaaaccugcagcaacuuguucauuuaguagacugcagggcccagcuguugcugaugaaaguaaucacccgugugaacauuaucugucagguguguugaggaaaaaucauucggaaucauuucuaagaaauaacagcgccaagcacuauauucuuaaagcuuucggagauuuaccauugguauguaagggcuguuuguaucaguuuaugucuguguaaauaaaagauuuagaucagagaaaugaugguuccuaaccuuuuuugggucauggaccacuuuaaggagcuaauaaaagcaccuuuagauccacuccuuagggagaaaauacauugcacauuugaacauacacucaaauuuugccucuaguugucaaguauuuacagaauuuuugaauuccaugaaauuaccagagguuaagaacuucugauguacacauaaugguuagaaauauaaucuuagaacaggcuugacaagauaaacuaguuugauauccuuaugauuaagacucagaauaagcaaauaacuugccuaaaauuuuaaaacuguagugucaaagcuaggacuggaaucugugcccuuugacaguguuuuuaacugaaaugguguggagugauuucaugaaggaaguuauguguaaguuuggccauauguuuguggcaagauuuuaacaagugcaaaugauuggagcuuagaucauugucaacaugagcaaagacauucaggaaaaugcaagguguauuuggguaaaagugagugauguagaguugauaguguguguugagaagguaagguggaauagggaacagugaauaauaaauugaauaaauuuagucuauauuuuuaaaggauuuugacuauucagcuguaggguugaacaccauuuuguaagacagguauggggacucauacauuuauacuauuuugauuauuauuauuauuauugaauaggagaauaaacuaauuaaagcagaaauuaauguaacugaauuaagggcuagagacaagggauuaaggaguaauuuagggauuagcuacaggacuguuauaggaggugggugaaagaaaaaguacauaaauaaauuguagcaauaagaauggaaaaaagggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugcgcgacagagcgagacuccgccucaaaaaaaaaaaaaaaaaaaagaauggaaaaaagaaaguagggacaaggcauuguauggauuauaauguagcagaaucuguauuuuaauguguuagguuaauguguaacuagggauaucauguuacauaucuguaaaugagugguaaaaguaaaaauauuuacauuuauauuuagauuaauacuuuguccaauaaucuuucugaacauaguuauagcagaagucacaauugauucagcuuggacuuaauggauauauuaccacggauucagacuucacauauagagaaaugcucauuaauuuggaauaaccuaauuaaauaauguaguucauuuaguaaucuaguggcuaaaauuuaacagucuuuacuucuuauauagccaguuucaagaggguucgcaauuuggucaggaagaguuucagacguuuuaaagaaaauauuauccaaggaaagcaauuuugcuaaauauuauaucuaaaaggcuauaaaaagggcuauugagauauaaugucuagaaaaccaguuugcuuuuucuccuaagcguaauauuagcuucaaaaaaagugacucagugcaguugaacauucacuuacuaaacauaauuaaccgucucuuauuauaaaguuaauacuaugggcuauugugaugucaugauugcuuuugguuuuaacuugcuucauuuuaccuugaucuccuuuccacauuucguucaguugaaaaggagauguaugaaaauguuuauuaugauuucagaaaaauauggaggacacuuuguaaguugaggaaaugaagaaggcauguuagugguuuuuucaaaaguuaguuugugguauuuugcauuagaaaguuguuucaagucugucuaaauauaagucaggagaacauuuuuauucgaaguagcaggagaaauggaagguggagauguucaaauuuaggucaucuuaaaauuaucuuauugggaaaccauucgccuguauguagagggcaugaagccacauaucagcuguuuauauuaauuuucuuaucugaauauauuuaaucccaucccuaaugucagcuuuauuguguaguuucuucuuauuuuaaauaccuaguaaaauagaguaucaacauuucuaccuaaaacaauguuauauuaaugaaauuggagucauuccuccucuuuugggugugcugguauaaacuugucugccuaguuaccacuucuuagaggguagauuuuagauauauauaauuuucaguuggugguguuagcuuuuguuaggugagaacucagaacuaacuuguuccucuugcuuuuuagaaagcugcuuggauuaacuugugauaaacaucagacuucaugcauacaaagccuugcuaugauguaagacacugaugguaauaguuuuuccaggguuaguuuuuaguuuauguguuauccagaacuuuauuguagaauuuguccauaauaaauguuuaccaucauuucuaaauauauauggaaugccuauuacccugaaccuaagauagaaaaugcugguuuuuuguuuuguuuuguuuuguuuuuaaugcagauaacaagugagaaggaaagaguuaaaagaugugcaaauuaguucaggccagaugaauugccccuauaugaggcaagguugguaucugcaguggugaaauuguggcagugccaucauaguucucaguaguuaacuuuuucucuuuuuuuucuuuucuuuucuauaggugacaugagaauuuuucagauuucaaaaaagacaugguuuggcuauuucuuaacaagguuaaacagauacuuaugauauaacccagcaaccccacugcuagauauuuacccaagaaaaaugaaguuauuuguccauacaaaaauacucucuguaaauguugccaguagcuuucuucauaaucacccaaagacauuugguaacaacccaaaugucuggcagcuggugauuggauaaacaaauugagauacauccauauaauggaauauaacuuaacaauaagaaggaucaaaguaccgauauguccaacaacauggacgaaacuuaaaagcauuuauacuaaguaaaagauacuagaaucagaaguuuauauauucugugauuccauuuacauggcauuccguaaaauaaaacuggggacagaaaucauauccaugguuaccauggagggagggggauuggaguaggcgauugauuucagaggggccugacuuuuuggugugauagaaauguuuccugucuugaaguguaguguucacacagcuguauaaguuuuucaaaacccacagaaccaucugaaaaggugaauuuaacuauauguaaauuauacuucgaaaaaugaauaagaaaagacacaguuuaauaguagucaccccuuauccacaguuucacuuuucaagguuucagugaccuguggucaacugccucucaaaauauuaaguggaaaauuccugaaauaaacaauuuauaaguuuuauauggcaugaugcucugaguauggugaugaaaucucacacagaccugcuguauucugcccagggcgugaaccuucccuuuguccauagauccaugcugucuacacucucugcccguuaggcacuucguagccaucucagugaucagaucagcguccugcuauugcagcacuugugugcaaguaauccuuacuuuaccucauagugacccagaagcacaagaguagugauauuggcauauuguuccaauuguucuguuuuauuagagauuauucuuaaucucuuacuaugccuaguuuauaaauuaaaauuuauaagggguauguauuauuggaaaaaacauauauaggguagguaccguccgcaguuuuaggcauccacuuacauaaugggggaccuuggaauguauccccugugaauaaugggggcuacuguacaucuaccauauauuacaaaacaccccccguggagacuggggcuguacuauguaacagugauauuuuuguagugaaauauaugacagcugugcuguguagcuguguacacuaaaugggucaaguuuugcugccaucugaguuuuuagagcuuuuuggguuucagauuugcaaacaagggagugugaauugauggcuguagaaaaaggaccugugauauagaacaaaauguaaaaacuauugccaaguuguuuuggaucaaauagggaauuuacuuuuccugauuuaaaucacuuuuuaugcagcagacacugugaugguaaaaaaaaaaaaaaaaaaaaaacacauacacacacacacacacacacacacacacacaaaaaaaaaaaaacaaacuaauaucccacuucccccagccccuagcugccauuaacacagauaguugauggcuuaaauaauagugguuguccugagcucccagacugaacacauagcaucauaaccugccaugcuuagagaguucccucccuccuuccgucuuccuuuccuccuuuuuuguuuucuuuuuaauauaucaaaaaguucuuucauguguacuguggucacaaaggcuguuuucuuuuaaaguaccggcacacuuugcagaaagucccacugguuaacagcuucuagaggaacaccucuuuuaccuuuuaauauccaauuuaaagaauguauguauuugauaauacccucuuuuuuuggccgauguguauuuauugagacaccuauugauggcuacaauugacaccacaucagaaacaaguacaaaugauuggaaacccugcuaagugucaggaaaugggauguguaucuuagauguuacucguacuaagagaggucauauuacugccuccugcauaaagcuuuuacaaagcuuuuauuauaugaguguuauauuguguuuuugaaauguuuuaggacauugauugagguuuuuguguugacauuuaauauauuacaauuuuuaagacaugaaaauaauauauaaauuuuaugacauaaaauuaugacauaaaaauuuuaauauaggauaauagaguuguauuuggggccuuuuaccuuuuggauuuuuuuuuuuuuuuuuuuugagcaggagucuugcucuguugcccaggcuggagugcaguggugcgaucucagcucacugcaaccucugccucccagguuuaagaaauucucugucucagccucccgaauagaugggauuacaggcacgugccaccacgcccagcuaauuuuuuuguguuuuuaguagagaggagguuucaccaucuugaccaggcugguauugaacuccugaccucgugauccacccuucugggccuccaaggcgcugggauuacaggugugagccaccgcacccggccuggaauuuuuuuucacagcugcuaugcaggggucgggggguucauuuccguuuuccuaaagaauuggaaagcuucucaaauaauaacuucguaguuugucucuaguuccauacuuuggugagcuuuuuuucuuuuaaaaaaauguuguaacaagucuauaaagauuagaauuauugaaaaaguaacuuucuuuugaaagagcugguuuuuauuuaccuucuaguuaaaacauuaccaaaaguuuagaauuguuaaccaaguagauaguacagguuggguaaaauuguuuaacugcuuacucuacaauuuucagguacuacuuuuuauaacaauuuaguagaguguuuuuucucaaauaacuuuguuuuguuuuaagucuguuuaaagcaacauuaaaaccaucuuagaaaaacugcuuaccaauacuaagaaucaaauacaggauggaaguuuaagaguugaaacuuuagaaaucguuuaaccuguucauuuuccagaugacaguaaaaugaagguucugugaagcaugaagugguuuacccaaggucacacaaguaaacuaguggcagagcuagaacucauucuagaucuguuauucaguccagcauuuuuuauuucacauguuucaugguaaugaaguaguuguuugguguucaguaaggaaaaaaaaagcuuauguuuugguagugauaauuuuaagaguaaagaauauggaaaaugguuauuaggguaaaagguaacuucuuauaugcucauuaaaaacacugcaaaguuucgugguccaauagaaguuucagcucuucuggugaauggucucucugcaauguucaguauagagguacuagcuaguuaccugugccuacugaauaccugaaauauggcuggugugacugaugaacagaauuuuuauuuuuauauaauuuaauuguaaguguugaggggaguggcuaaaauauuggacaauguagagauuauguugguacuaagcagagugauguuagcuaguuuaaaaggucaagguuccaggagacaaggaaagggucucuaccaggaaaauacucuguucaaacuuagaauuuaaggacaacaaacaacuguguuuagaauggauguucaguguuuagauuggccaugauucuagacuuaauuggugguauggacuuugaagccaguaucauaaugaguagaaauaucugaugggauuaaaaaguacaaagaaggcauugagagcugugauaacuuuguaauuuaccccaguuguucugaauauauuuuugaaagauccuggagcaaaauaauacaggugugucuggagcccauguuuaaguauagcagaguaucagucugucugaauauugcuuugagaggaagaccuaacucuaauucuugagauuagauuacuuccuggugcuuuagcugaauuccuuccacagccacauagcugguuuuuaauuuucaaaucuacuagugaaaacaugauggaauauauaaccuaaauuaauauuuuauucuucauauagguugucaguuuagcuacaagaaucaauucaucucuuaauuugcugguaccuugaugagaaaacaucuauaucaguguuaucaauucaugguacuacuuagcacucuggaauauaagaguccccacauuaaccugagaauugagauucuagacugaagucuuuacauacuucuucccuugagaugcuugauaaguucagaaauuaagguaugcuauggaaaaugcaaaauggauucaucauuggaauagaccucagugaauuuucuuuauuccugaaauucccuuggcccaauagccuuugcuugcaagcucaucuguaaauuuaaaugcuuuaaaguaguuuugaugaacauuuuuugcuuguuauauugaugugauuaaccuaguuaaagcuaauaauugucauuauuuuuuaaguuguuugauuguuauuacuauuuguuacucucuccuuuugcuuacaugucuuuuuccagaacucagauuuguuaguuugugcucacauuuuagccuagugcagggccugacagauaauggauaauacuuagugaaaccuaagacaaucuguuuaacugccuugacaccaauuucagaugaucccuuaggagagugguucugaaauugggguugaggugacacggagaaagggugacuuucaaaugacauuccucuacuuuuauauaaugcaaaguguuacugauagguuuggauaccaugcauaaugguugaaagagaaaagucagaauuuuuuuuuuuuuuuuuuuuuuugagauagaguuucucucuuguugcccaggcuggagugcaauggcacaaucucagcucacugcaaccucugccucccggauucaagagauucuccugccucagccuccugaguagcuggaauuacagcauccaccaccaugccuggcuaauuuuuuguguuuuuaguagagaugggguuucaccauguuggccaggcuagucucgaacuccugaccucaggugauccaccugcuuuggccucccaguguguugggauuacaggugugagccaccaugccuggcccagaauucuuuuuuagccucucauugcuuuaagaauuugugguucuauguucauagucuuuccaugcuauuccaucucaacaaaaccaaaugacuuauuuuuacaaaacuaagucuaccuucauccugucaguuucugaaggggcaaaagcacuuacaauguuaaaauugagauaagucaguaaucaugacuucuccuuagugauuuaaguuuucuucauuuuuacucaaaaaguaauuuugccuuuacacuaagugaaagagaagcuguuucugacuacuccagaaaaauaaaaagagcuuuauuuuucagcuuuguuuuaauaacauagcucuuuaacacauaagccucguauuucucccucucucucucucuguguguguguguguguguguguguuuguguguguguauguaucuuugcuucuuucauaucauuacuauuuuaccaguaaaaacaauuuagauuuuggaaaguaaacuuuuuggcuuacuuucaaaaauuccauuuacuuuuauuuuaauagaaaauguuuuaagccaucuauuuucuucauuccugguugcuauuaucuugacuauaauugccuaguuuccuuucuggcugaucuauuacuagucuuuaucuggauguuauuaaagaauauaaaugcuccauagagcaccauagucucagccagaauauuuucagauucucagcuaagaugaaagagaacuggugcuuuggcuguuaaguaaguagcucagauuuguuaucagagugugaggggcucuaaauucauuauguuagcuguuccugggagcuagcguuugaaaaaucgcuucagcuguuuauggauugugguccuugggcaccagauaguggaugcuagaauguauugcagaaaagcugauuaaaguacuaggaucucuagcaggaagaguagaaagucauuuguaauaccugugucugacucuguuggaugcacuuaauauauuuccuuuugaaagcuuugguuuauuaucagcuuauccgggaaggaauagcauuuuugcaaaaaugugccuuuuggugaaaacaucaauaaacuaugcuugaugagaaguucagguagggagagacugauuugaacuuugagguuccuaaauacuuugcgguuuuauuaccacucuuauuggagucauguuucacuacgacuuaaauuucaauaguagcuacuuuuaaguucacaguuuuaauguguuuuuacugucuaucagggaauuuauacuuuaaaauguagacugucagaauuuacuuuuuuuuuugcccaccuuccucuccaacaaaaguuugcugaaguacaguauggaaguauuuuauguaaucacaaaacuugcagcuuuuuaaguauacuuugcacuacccuuguuaaaauauugcaguauuuucucauuacuuucaaaguaaaguucaaacuucuuagcuuagagagacauucaugauguuuccauuucuucucugucucguccauacccauuccccugugaguguccuuugcuucagauacacagagcuacuuacaaccauuccccuucuccuuucuuucacugugguagcuuccuucucccugacccugcuucaccugaggauuacuuguccuuccuucaaaacugcucaaguuuccccucuuccaggaaggcuuccuugacccccaacuacccuuccaaucauuaaucccauuuacacuggcugguaagcucucuaacauuucauacaauuucuuuacuguaaucauuuauuuauuugucugucuccuuuaauagaauaauauuccuugaggucagagaugauagugucuuucgcguuaaaaucuggcauacaggccuauugaagaaaugugacucuacgaaauuaauacauuuuauagauacauugcguaauuugauuuacuuugauccugguucuguagacauuugggggcauggguuaugccauuuuccucacaaggagcuuuuaaaguugacucucuaacuuccauauugcuaccuaaaauguuuaacaaagguaggucuugggcuuugggaaggcaggaacuuaaauagauggaggauauaaugaaaugaccuuuacucugucaguuggcuaaaaaaucugaaauacaauuuaugggaaauuagaaagaccaacucuaugaccaugaaaucauauauucuagcuuauauucuuaaacuuauaacuuuauugguauacaaaguucuuuuaagagaaaauagguauuuaacaacuuuuuacuuugaaaauaccugguuauaguuuucagauuuuaaccuaaucuuaauccaggaggcaagacaaaauuaaagcuaaagaauauuugcuaauaauggguuauagcauuuaaguauguauuugguagccuugagaugucuuuguaauauuugcaucaauauucugcauucuuuagcaaaacaaaaugcgaaguccauauuuacacauaagauuuuuuaaaaguuacuuaauauuauuucauaauagaauaacauuuucauuuagucuaauguuuuauuauaugagcacuuaguauuugcuuucauguaauuauuuguugagauacuuuguauaauuauuucuuuagugauguagcaaacuaagucaguguauuacagcugaaucauaguccuggcuguucuuuuuauuuacugaaggaacaaacacuguauuauuaacauuccuuguccuucaauugagcuugcaaaagaaauuuguuuguuagaucuugaauacccuaagaaauguauuauggaugguuuuuaauuauauuucuauuuucaucauuugauauauuuuuaaaaucuugugauaaaauagaaugggggaaaauuacccaugucgcaguaguuagauaucugcucauucucaaagaccccaaccuccuuuuaaaaaauauuuuaagauuuauuauauguuaaaauugguauugaauuuauaugaaguauuaagauuacagcaugucagaauauuauugccauuuaagaauguauucacuguuuugguuuuuggagcaccgccuccaagagguucauggcauuugguacguaguucacguauuucuagucuacagaccuugccuaucgagucaaagccuucgugguucugauauuugcauuuucuacugcuauaaagcucaacaauaguaauuaauguuuuuuuuuuaacuuuccaugucauuaccaauaaaacuucaguuuuuagaagacuaguaauuuguaccuuuaaagagccacauuauuuugcuuuugucucagaauguauuaugcuucccaaguauacugugacagccugaauagagaaaaggggggaggggacauugucuucagcuggcaugcuguuaucagagggaauguguuucuggacacgagauuuagcauucauugguugucugaagaaagcuauuucaucugaggauuggacaagaagcugcgucaauuugcugcccgucuccaaggcacuggugaugcugccuucacaagcuggcuaacgucacggcuccaucacccagcgggguguggacucucuuuuucuguucuucucuauuuaauucucuauuugcugccuacugcauuucuuaaucugucuucugccaaaugcuaacagcaugauauuuugcaaucaucuaggugaauacaagaaagacgaacuccuagaagcugcuagguaagugauuccauucauuuuaaguguauauaaugcauuaaggaagagaaggaggagggcagguggaggacuauaaaaaauauaacguuauugucuugcuuggauuuuaugcaauuaugcagauacuaaaucuuuauguacuuuauaucauuauuguauauaauaaaaucuuuucauguggugaugauuauaagguuaauuuuauuuggaacauuuccuaagguaccuguaaacccuaguugcccagcuuuuccagcgauauucuuggaguauuuaaauaccuauaucuucauuuucaucugaagauuuuucuagcaaagcuugaaugaagagcaaaaaguaaauguuaaaauccucaucuauuuuuuuuguguucuuggucguuuauaauuuaauugauuagcucuuuacagcauuuuguauguauuuuuaacuccaacguuuuagucuauuuaucagaauaaaguuuguuuguaauuaagaagaugacuuuauguagauaaauaaaacaaaaauguagaaagcuauguuauuuaagauauaccacuauaggguaauuaacaggaauuaauuagaaauauauuaauugaauugaauauugcaaaagagauuuauugugauccauguaaaagaaaucaaagcaaacccauauuuuacucucgugugaaaaaauuaugcauaaauauucauaagaagcuuuguaauuuuagaggaauugacuuacuaccuuuuuauaggagugguaaugaagaaaaacuaauggcuuuacugacuccucuaaaugugaauugccaugcaagugaugggcgaaagguaaguuauuuuaaauacaauccucuuuaauugcaaugcuucaaaauuuugugaauguggcauauauauauauaagcacguauaccuacauggcuuuauuuuaacuggcaucuuuucacuguaaaugaaaugcuacuauaucuguuauuggcaguugugacacauucauagaacuggugaagcauggaucuuaaguaagccuuuucucuuaaaugucagacacagcaaguuauuuguuacaugaaacugcaguuuugucggugauuaaaauuacagcauaugcucuuuucuggguaugauaauggaaacuggaaauaugaguguccuauuuacccaucuuuguuaagacauuuguguuuuugauuucuuauuuggcagaagaagauuuguuugcuagauaccaacacuuuuuccauuaaagcugagaaauugcuguuaaugauuuuuuuacaucuauguaacagcucugcucuuuuauuauuauuuguacuggcuaaguuuuaguuguggaauauugaaagaaaauagauuaaaacagagaggaauauucuauauuaauaugcaguugccauaaauguaagguaauauauaaaauauacagcuggcagcuucauuaucuacuuuguauucuugcugaagauagacugaaauguaauccuuuauggcuuugguaauugcagaguuuuguagugauuuacguaauagacauugaaaaccaaugcacucuguaccauaaaguugguuuuuuuuuaaaugagaguuaauuuuuuaauguuaacuaaaaaccuaaaacauuuuuaaagacacauuacaaaaauugaggaaaauuguaugucugauauuuagaaaugaauucuuuugaaauuauuuacagugaaaauguuacggcaaauaucaggauggaugguaccccuuagaaauaauaaauuauuuugcuuuuaaaaaauuacuuuucugugagugauaauuuugcagaucagauuuuugcaagcuuccccacuuuuucucuauuuuaaugaaauccaaaaauaguggcaaggaauugagucccucggaauauaauuuacguucauuuguuuuuguagauagcuuauauaucguuacauggcccagugaguauuuuguuucucuggguaauuuggggagagacuucuacuuucauagaagguuaaauuacacauaucaagccauaaacuagcaaagauuuacucagcacuauuaguuacucuugggaaguguuuuuaaaugguaacuguucauuuuuccuucaguuuugaaguugcuuuagggaauuucacacucuugugugcacuugaaacuccagauuuuauuuggauucuccaaguagauaaagugauuucuaucacuguguagaaaagggccuucuuaucugugguuaaaugcagcuguuuuuuagacagagcuuguuucgcccggccuacgucacuuuucuauaacuguuuuaauacuacagaacuuaugugagauuucuacagccggagucgauuucugucacagccucguuuucccuuccuuacccuucuacuuugacagccacauuccuagugcaauaaaucauaauaauuaaggaacaugaucccugauauuuaacaaauucucucuucucccugcuucaucuccuacacaaauguauagaacucauuuauuuuuccuuuuccuuaaaggagaauauacuuccuuuaacuagaaccaauguauuccucauccaaauucuuguggcuccuuuucuauauuacucuguggcacuuagaguuccuuaaaguucauaaauaucuuuuucuuuuacuccucuacuagcucuucuuguauuuugcaccaggaccaaggcuggcacuuugcauauagcagaagcuuagaauagaacuuuguuguuccuugauaaacauaauuuuauccucugagugagaaaaacaucuacccuuugccauuuagaaaauuaaaucagaaguaugugaaugcgauauuuuauguuuuuuguuauuauuacuaauauuauuauauuaauuuauuuugggguacuguuaacaugagggagaaccguauaauuuauaauguauagaacauuuuuaagaacguaccucaagcauuauuauuguaccaaaagauuccuaaaauauaaauaaugcaauaauguuccaaaauguacucauacuuuuuuagauuaucaggguuuuuuucaaauuaaauuagauagaaaaaauuaaacuuaagcauuuauuagguuuuagugcuaugcauauaagaaauaauuaacaauugcucaucugugugguuugaauugaauaauuccuauuuagauauuauucucauuuacggcacagaguaauucuuauuaaauguaccaguugcaguaaagccacaggguguuaaauguucugggugcuaauggagauugggacaagaucccuugguuaugucaguuuguuuuuauuuucuuccuguuguuaucaagaaaacaaaucuagcugcuaaaauuacaaguaucuguccuaguagauauguaguccuuuuuuagaacauuucuauguguuuauuuagaauuagaaagucagauuguguauuaaugagaugauaaagguacuuuuucauauguaguaaaucaggcauauaaaguuuauuuccugaauuucauuuuagaacacagcguagaagcgaauccuuuuuuggaaguuuccuaaauuacuguauuauugcuuaacugagcccuuuucuuaguuuuuacuacaguuccugguuuguaaauuuaaaaagcccaugaaaauguuaauuuugaaauguuuuuggaaaagaaaugucucuuauacagugguuaguagguggggaauuugccuagagauauguggggguuugagacuuuagguuuuuuuuuaauguaauaugugggauuauacaaugagaguguaaauuuuaaguacucuuaauucuauacugugacuugaugauuaucuaauuagguaauaugugagaaguuaauauuuuguuucccaaagacaauuguuuuccuaaccuuuagaauucugaaaauuauaaaacaucaauaagguuuuauacaguuuauauuguuacuaugcuuuuauuuuacacauaaaucaaaauuggcuccuggcuacacuagaaauuuuauuggcuuuuuuuuucccuaaaagcagaauuuuuuuuuguucuaaaaugcuaccuuuuguuguugcucuaaaaugauacuuuuaugcaauuauauacguguuauaaugaugaccacuuuuagaaacauagggacauagauguuauuuagucaucuucuaccuucugcccaguaugauuagucauaacaguccacaauucauuauugccauuaggugaaccagaaccugaaaauagguuguugccuuucuagaauucuuuauuccuuuauuuucaaacuuggauuuuuugaucuuuaaucucccuuuacaguguuuuauaucaguaucagauguuuuauuagcuauuauccacauguucuggccuuguuugauaucuaaauuuaaggugguaauauucucuuguuuuccaguguuaauuuucguaaggauaccuuuuauaauaaaugaaaauaaauauuugaauaaaauuaguccaacagucaacucuuuugagaguucuuugugguuccucucuguguuauucuccuuuucuaggugucuuuauccccuuccaaaauaaauguccaaaauuauccauuccucaucuuaauaggcaauagguagggguuagggacuauugcacauauuuccaaauagaaauaauauguaucuuugaauauaucuacucugccuacuguugcuacuaguauaugucaccaauuaaaaguaacuaauauuugauaggugcuuuuaaaauaacaucuccaauguaauuuugaguauuucagguuucccucugcuccuuucauucauucauuccaccaacacuuaauaccuaccaugugugggucacugugcuuagugucaugggagauaacuauaugguugaugguacugguuaacggggagcucaaacauugguagaaugauuaagacauuauggaagacauugaagcuaaugcauuaaaaugauacaguauuccuuuugcggugauacaguuauaaagugcugauuuaaggugacaguguuuuuuccuggcccuuuuaguuuuaacgcuuuaguauuuaguauacccuucuguaagaaaccacaaauuuagaugagcagguaauuggaggaacaugauuuuaauucagaaaacuuaaggauuucuuuaagugucaacuuucuguaaauauuugcuuccaaauaguuaauaaugaagaugacuggaaacagagaaaaguaaaguguuugaaaacuacuuucaaaaggaaaucaaucagaaauaaaguagaauuuagugaauuuagugcuguaccuugaagacaccauagaaaaacugugauagggcaaauagacuguaaggucagagggauuggguucuauucugcuuuccaagugugugucuauggcucuagaguuuuuaauuuacucacucucaaauggaaauaaccauacccuuuccacaaggcauuugagaggauuaagugaaauaauguggucaguauaccuaguacaguuuguagcacacaguaaccuuuagaaaauuagauuccuacuccuuugauaauuuuuucugaaacuuucaaauguaucuagaauggacacuuacauacuuuuaaguacuccaguguuccccuucucuccacuuaaauguccuuauuguccaagcucugucccagcugccuuuggauaaaauaaccuauagauugucuuguaaucuauaaagcauauaauuuaauuaauucaguuggagcuuggccuuccccucucuucacccagugucacauuuaauaaauaaauuugucuaaauuagcagcuuauaaauucagaaauacauucuugagauauaugcccauuuuuaaacacguguugauuaaaaauuaauaucuggcugaaaauaaugccauauauggaauuccauaaaccccauccagugaagaacaagaaagauggaggauuaguguaauucuuuguaucuacauuuaaguuuuaggguuguagaguuucucauuauucuugaucaguacccccgucucucaguauaacuuuuuuccaaauacuguguuuggccaggauuuuaacagucuuuaugugguagguuguuauuuggagaugccucaauaaaccgucccuuuuauuacucaugcccuugucuagcccccugccacacugacucugggcuuagccugggacugcuuugaauaaaauaaggcgcaagugauacucuguccuauucaggacacgccccugaguuggccuggcagcugcuaguuucuuuuuuuguaauucuucuuggaacccagcugccaugucauaaggcagcccaagcagccaugugacgagguccacaugaagaacugaggccccuagccaacagacccaccugaguucguauggaagcuucuuaaugauucuaacuauucacacgucccagacaauuuaaccccaucugaguucccgauccaucuuuagggugacaucagccauccuagcaccguagcucauaccacauagagcugaagaccugcccagguaauucacugcuguuggggugguuuguuauguaguaauagauaacugaaauaccugauuaaaagaaaauauaacucaaugcuuauuaucuauugggcaagaaagauuccaucuuuuuuucagcuuuauuacugaaaaugauucguugauaguuacuuggaagaauaagugaggauuuuaaaauaucuucccaaauguauuuacgucuuuagauauguucaguucuuuugaauuuauaucuuacaauuuaaguauuuucccccuugaaaugcaaaaacauaauuuuaugugcaucuuuuggggucaugguauugugggaaaaagcaggaacuugaagcuagaagaucugauuuuaaguuucagcuguuauuagccauguguucauggcaaauuuuaucauaucucugaguucucaauuuuuuuagccuaaaaaaaaugaagaauuugggccaugugagcucuaaaguaccuuucgacucuaacauuucaagauuauaauauauuuuguuacuuauuuuucagcagaguuaguagcaauuacccauaaugcagaauugaauuuccuaagugacuguauccucacacuggauagaacacugauggcaucugcagugaaguuuauguagagcccuuuuccccuuuaagaaaggaaguguuagcauuaccuggggguacauaucuggcucucuauggccuauagugaccuuuaucacccuccauucuugccaaaucuugguagauaaaaggucauaccaguuuuaaauuuccaacuuuuauggauccuagcucagaugcuacuugggauuacaagaaggucaaaaugcaguaagucugcauuagggaacucuucaaauacuucagguucaauuauauaucuaaucaagucacuucuucggaguacgucuugcugagcaaugcauaucuuacuguagugccaaaaucccuuagagcaaguuuucuugccuccuuauguugggauauauuguauaaaaucuuuaugcuuauguauauucauuuuguaccaaugaggacuugaaaaugucuuuuuuauuuuucauuagggaauugcuucuacgaaaacaaucucuauuuugucaagcaugacauuucuacugguaaggguaauuaguaccaaugccaagugcgcuguuuucucugcuggagaaaugaauuuuuaguagaaggggaccgaccacagugcuaaaaagcagcaagaugauaaaacuuaguuguccauuuaccucuauuuagccacucuccuagcuuugaauuguccugccuuccuauccagaagcacaaguuuccugcuguuuuccacuuuagacugcucaagggaccggaagggaguugguacuaaauccuuuggccgugagugugagucauuauuaaaaauuuagaagccaaauuacaaauaugauacuucagcaucuguuuuuaaaauuguuagaaucgaaguuuaaaguguucuuucugccuuuacaaguaaaccgaacuuuacauuaguagaguggauuacaacuacagcaguagcuggaaaaacacccaugucacagaggggcaaaggaaaaagagcaggaagaaacacacaagacagcuucugugguauugccgaugucccauuucuccaacugaauggaugcuggaugauguuuuaauauaugcuuuauaacuuacauguuucuauggauuaaauauuacaugauaaagauauuuuaaaauaucucuguaaugauuaugauuugaguacccuuugguuugaacagacuguucaguuaauaucauuugacaguagaguauucuacaaaaaguuauuuaaguaaaagacuauauuguguaaaaaaaggcuuguuuaggugcaaacagaagucugauuucaggaaauucuuccagccugaugagaaauggcaaaaagaaagugaugaguuaauuauggauuuaagaauucugaaauuaucuguaacuuugaauugacauuauuaaaacaauuguuuggccacaauauaaaaccaauguaaacuauuucuuaauucauuguauaccauuucuagugucuuagucagcuaggauugccauaccauugacaggguagcuucaacaacagaaauuuauuucucacaguucuaaaggcugggaaguccaagguuuagguuccagcauggucagauggucuguuucuggugagcaaguuuuuuuucuuuucuuuucuuuuuuucuuuugagacagagucuugcacugucgcccaggcuggagugcaguggcacaaucucagcucacugcaagcuccgccuccuggguucuagcgauucuccugccucagccuccugaguagcugagauuacaggugcccgccaccauacccagcuaauuuuuuguauuuuuaguagagauggcguuucacuauguuggucaagcugggcuggaaguccugaccucaggugauccacccaccucggccucccaaaguacugggauuacaggcgugagccacuguucccggcccagcaaguuuuuucaugucuguacuuagaagggcacuaaucuuaucaugagguucccacccuuaugaccucauccaaaccauauuaccucacaaagacccugucuccaaaugcuaucauauuggggguuggggcuucaacauaaauuuuaggggaauacuaagcauucagucaauaaaccugguuauuuuuucuuuaucacugccuuuuuuuccuuuuauuaaagagauuaucacucaagcuugcuucucugucucacacauaugcauauuaauccauucacucaucucauucaguuaaauuaggauuguguuaugaaaacaaauuucuagaaguaucaaaaaucuucauauuauucugccuuuuaaaagaauguuuucagugacuaauuuaaagaaauguuuuucucuacuaagaaugccaucaagaguaaagcuucaagaaagcacuguaaauacuaugcauaaucacuugaaaugcauauuuggauaacuaaacugguaaauuuggaaacagaccaauucuaaauauaaaauguuuuauauuuugauuuuauaaaaaaaaugcuuuaauuuguuaauaguaacauaauacccuacuuuugaauauuauaaaaaugcuccauaaaauaaucuacuuucagacaguguucaauacccauuagaauugggagagaaggcugugggcagggaacagaacuagacgucucugcuccuggcuguuuuuggcugccacauucauuauagaaaugcagaaacaacaaagacuuuaucacuuaaggaacuuugaggugacagcauaucugcagaauccuagagcucuuagccacauuaaaaucagcugaaggaauuugucacuuucccaguuugcaguuaaaaugacuaucuaaugaucuaagguggaccgauucccuccuauguaauuauuaaaugccgaucagugcaagugguuucuucuuuccagaagaccucuaucuguuguccauuacguagaaucuuugaugcuuagauaugaaaaccuaagauugaaaauauuaguuacaaaaaggaauuuaugugcaguuuggguagugugaaaauuuuucuccuuucaugaagugugaaacaucaaguuacaucagaccaagaaaccuuugauuuuuuucuuuucauaaaaucuaccagcuauuucucauucgaugaugaaaaccuaauguugcaccuugagaguacucagcauuuuuguucacacaaaucuugugagagcaugcuagaaacucauuuucaccacacguuuuaauucuucugcugauucugaggcuggaaaagagaaacacaaauugcuggccgcugaaaaauccccuugaagauuccacaaugauaaugugacguuaaaauugaauuaaguuggcauucagagcuuuauucucacagagauuacccuauggauuucuuguucaaucuuaucugcucuucucccuucccuucucuuucucuucuuaauacauacauuuaaaauaaagauaguccuuuauauucucacuuuaaaaauaaauuuuuggccaagcaugguggcucacgccuguaaucccagcacuuugggagaccgaggcggguggaucauuugaguucaggaguuugagaccagccuggccaacaugguaaaacccugcuucuacuaaaaauguaaaaauuagcuggguggcaggcaccuauaauccuagcuacacgggaggcugaggcaggagaaucauuugaaccugggaauaaauguaaguaaguaaauaaauaaauaaauaaauaauguuuacuauuuguggcaacuugaauuacagaaaccuuguuuuauauuucauaaauucuuuagcuguuaaaaugccuuccuaaagaugaguacuuccauuacuuuggaagaacauccuuucugaggcuaugaaauaucaauugcuauuuuaucucuguucauguaaucuaucuaggauucauagaaucuuacuuggauggggacuuaauggcaacuaguucaaccucccaaugcaguguuagaaccuucgcuaugacagcucugacagguucugcuuaagagagagagagcucgcuuguuuagaucagaccauauuuggauuuagugcucaauuuagggugucacauuuuaagaagggauauugaccaaccagaguguaaccaagaagguagucagaaaauucuucucuaauaagcaguugaaguaacugcaggggaguuuaguucaagaagagaccaagugacugucuguuagagauaucuagaaaaauccugcacugggaaggaggcagaaucaauuauucuuuccaauuucaauauuguuauucuuuuuuuguccugcuauauuaaacuauuuuuaggcagcuucuguuaugaaggaguuccacauuucuggggcgcuuauccaauggaacagucacacugucauuauugauagaguuuaaugucuacugaccuauggaucagaaugcuaaaguugucagaaccaaggagaucccugccugccaagaguaauucuugccccucagcuauauuaguccauuucugaacauccuaucuagaaccugagcccccacacaaaggaaaauuagaaaugcagaaugagaguuucuaagucagacugccuggauuugacuccugacucugcuuuuaacuugccguguuaaucacccuguuccuuaguucccucauuuguuguguggaaguaauaguguuucuagcuaagguaguugcuguauaaacaaguuaauacauauaaugcacuuagaaaagugcuuaguacauagaaaaugcccaaauuuuagcuguuauuuuuaauaaaauauugguauuuaaaauuuuuuguauaugcuaugucauuuuauuuuauuuagucauugcuuauguuuucuauuuucuacaucuugcacuggacacuggcuuagacucaguacagauugaagaucuuuuaucaaagucaaaauaauuuauuugauauauagagagccacacuccagcuaaugaauuauuguuguucauuuuacagcaucucagauauaaaaaauuugguugcauccuacaugucuuuuuuuucuaucuuguuccuccugucccuuccucugauucuuguuguccccccuacuuuuauuuuagguucaggaguggguacauuuacagguuuguugcuuggguaaauugugcguuacugaggcuuggcuuacgaaugaucccaucaccaagguagugagcauaauacccaacggguagccauccggccaacuccccucucaagcaguccccggugccuguuuucccaucguuguguucagguguauucacuguuuagcucccucuuauaagugagaaccuguguuugguuuguuguuccugcauuaguucacuuaggauaauggcuuccagcugcauccaugucgcuguaaagguucugugucauuuuaaccagaagacaacuuugugaggaagucagcacuguugucacccaucucccccauuacaaaaaccgugaauuaaagacauuaauauguuaaacagccuuagguuuuaggaguaguaucaugccaugauccacugugaugagacuauaucugucguuagaugcguuuagcucuaagaacagugcuugaaagaaccgcugaccaagagguccaggaccagagagaaagacucguaaugggagagaaaacauacggcuauuagagaaucuagucaugucaucugcagaagagacaaauuggaggagucauacuuuuugauaaagaagugaauaaaacagcuuuuuuccuuucaucucaccucguuaaucaauauuuauuuuccacaagguuucucuuuuaaauuaucauucuaguguuccaaaaguuaaguaacuucaaugagagugccugaucuucauuaugguacuacuuaaaaaucccuuugaaagacagcauuagcaaugaaauauauuuauuuccauggacucaugccuauaucgauucucuagcuguuaauuuguuuaggguucucaucuaaauaucacucucucaaagagcuacuaagcucguugcuucuuaguuucuuagcagauuaaucaugucucugugccugauagaaauuuaauaaagcuaauuauguguuuauuguauuuuccuaagaauuccauuuuaauggcuaauguaauauuuuauuuuuagaagggaaacuuauugaucuuaaccaaaugauagaucaaaugaaauauguuuugauaagacagagcaaaaguagaacauuacuaaauaauuaugguacagccacacaauggaaauacuguacagcucuuacaaagaauaagacagacagauauguacuaauauuaagaggaaagaagcuaaucauagaagaauauaauaacauuccuauuugugugggaaaaaacagcaacaaaaagaacucagagagaaaacaaauacauguucauauacauggaaaaauaucugaaaugaucauugugcaacuguaaauagugauuacauuugggaagagggcuuguuuggcuggagggaaaaaauaauaaacguuuauauuauaguauuuucucuacuguuugaauuuuuagagggaaugugguaauuuuauaauuuaaaaaggaguuauuggggagaggauggugaauaaauguaaaguaacugauauugagacugguuaaacugagaaaauacauauacaauacuuuauuugugaagccagaccuggacacagaaagaugcaggaaguuaaaaaaaauuacaaggaugauauguagaacacaugaguucagagagguaguacuuaagaaaacugauuacaaaacugaugguacauugaacaaucuuacuacuaaaaguagaguacaauaugucaccugauagcauaugcacacgcacacacaauuuucucauucuggacagauccagaaacaaagaaacugauuuacauugccuggcuaagguagggugaccaaccgucuuaguuugcugagaucaauggguuuccuaggaucaggaaaguacugggcaaaucaggacaagucagucaugguaaucuagaaagucccaaaggaguuggucuaggccaaacugguucuucaucuuacagaaaaacaaaauacacuguaugucacaguuuagagggcucucugaggacuuacagcuucacaguugugauuuuauucuuccuuaggaaaugcaucgaacaucacacaugcuuguauugaagugucaguguaaauuugucacacaaauuuaaauucaccaugucggauuauccuuguccucucuugaccuuuagaaauguaaaucaaaagcugacaauaacucucauucauucuuuuuuuuaaaaaauacccuauuauauguaaggugcuuuguuaagccuuuaaaacauaaaauuaaggaauguucucuuuucucagugaacucacagugaguuaggagacagauacacaaguaaauaacuauuauuuuggaacauguguaagaguaaaagaucguggcaaguguuuucaggaccagucuuuuuucuuucaaaaaguauuguccaggcccggcaugguggcucacaccuguaaucccagcacuuugggaggccaaggcagguggaucacuugaggucaggaguucacgaccagccugaccaacauggugaaacuccgccucuacuaaaaauacaaaaauuagccgggugugguggugggcgccuguagucccagcugcuugggaggcugaggcaggagaauugcuugaacuuaggaggcggaggcugcagugagccgagaucaccccacugcgcuccagccugggcaacagagcgagacucugucucaaaaaaaaaaaaaaaaagauauuguccaaagacagaacaagaagaaaacagguaauuauauggaacauugguauuuuggaaucucauuuaaaaauuuuguucaauaauaauaauaguccuaagaaauuaaaaauauuuauauuuuaugcuuuuagaugaaaggugagcuagaugcuaggcuauucugucuagaugguaguuauaacuugaaaaacuuccccagcauuaucagagcaaggaaaccuuuucuuauguacccagcagucauuugugagauaacaacauauauuuuauauuaaaauguaaaugcuaaaauuccauuuggauuaaguaugugauaauacaucuagacauacugauaguugucaugauuuuauugcucaguggggaaaucaaaagauguagucauuaaauuuuuguguuccaggcacauaacaguauauaggucuuccaaagcagauagcuacauuaugaauccauaagaacuuuuaauucuaauauuaauccuuaggaagauuuuaccuuccaucauuguuuggauuuauuaagaagauauguaugaaauuaaauauucauauuuuguuacugacuuaauuuuuucagaaguuacuuuaauucucagugguucuagcuaacugauaauuguggcauuugaguugcaugaaguggaguggagugaagaaaggggagaggaaaaggugaaguuggaaaguugugggaugggauguagucagggagauugcuuauggccuucuagaacauuuuaaacacuucaguuucuucuuagagugagaugaagacccacuggaagauuuugagcacaagauuuguauaccuaacuuagguuuuaacaggauuacucugcugucauguuguguuacucuaaggggauuauacuggaagcaaggagaccuaguagaaggcuguugccacuagccagcugagagaggauacugucuucaaguaggugacaguagauguggugagaagugauuggauucuggauauauuuuggaggcauagucuccaagagaaauagucugauggguugagcauagugugugggaaaaagaugggaaugaagaaagacucccaaaguuuuuggccugaguaacuaaaaggauggcguugucauuaacaagaaauucugcagcauauguuucaagggaagcacuagggggagcuccauuuuagacaggagaaaagcaugagaagucuuacauauaucauguagugaugucacauaggcaguuggauuauagcauaugacuauaugucauuuacuccauauaguaaccaguaaccuccacaguauggaaguuagcaaagaggacuagguuggagauauaacuggggaguugucaguucaugggugcuauuuaaagcuacaagacugcaugagcucaccaaaggaaugaguuagacaauguagaaaagagguuuaaggacagacuuuuggaguacuccaaugucaagagaaugaaaaccaaccagcaaggacugagaagggguaaccagcuagggaggaggaaaauaaggaguguggugaacuagaugccaaggaagaaaacauuuuaaggaggaagaagugaucaucgauaccaaauaaugcuaauaaggucagauaagauaaggacugauaaaugaccacuaagaaauaacaugaggaaguucuagcuagagcagucaggcaagaaaaagaaauaaaaggcaucuggauagggaaaaaaaacaagucaaacuaccucucuucacugacacuaugauuuuauucuaaguauaaaaaaccguaaagacaccaccaaaaggcugcuagaacugauaaacgauuuuagcaagguuucaguauacaaaauccauguacaaaaaucaguggcauuucuauacaccaugagcauccaggcugagagucaaaucaagaucucaaucccauuuacaguagccacaaauaaaaugaaauagcuggggauauagcuaucccagagagaugaaagaucucuacaaggaaaacuauaaaacacugcugaaagaaaucagagaugauacaaacaaauggaauaauauuccaugcucauggauuggaagaaucaguaucauuaaaguggccauacugcccaaagcaguuuacagguucagugcuauuccuauccaacaaucaacaucauucuucaaaaaauuagaaaaaacuauucuaaaaaucauauggaaccaaagaacagcccaaguagccaaagcaauccuaagcaaaaaacaaagccagaggcaucacacuacccaaauucaaacuauacugucaggcuacaauaaagaaaacagcauggcacugauacaaaaaacagacacguagacugauggaauggaauaggaagcucagaaauuaagccacauaccuauaaucaucugaucuuccacaaguccaacgaaaagaauuaauggggaaaggauucccuaugcaagaaauagugcugggauaguuggcuagccauaugcagaagaaugaaaugggacccuuaccuuuccucauauacaaaaguuaacucaauauggauuaagaauuuaauuauaaaaccuaaaacuauaaaaauucuagagaaaaaccuaggaaauaccauccucagcaucagccuuagcagagaauuuuuggcuaagucuccaaaagcaguuguaauaaaaauaaaaacugacaagugggaccuaauuaaagagcuucugcacagcaaaagaaacuaccagcagaguaaauagacaaucuacagaaugggagaaaauacucauaaacuaugcaucugacaaaggucuaauauccaggaucuauaaggaacuuaauucaaagcaaaaaccagucccaucaaaaaguaggcaaaggacaugaacagacauuuuucaaaauaagacauacaagcagccaacaaacaugaaaaaaugcuuaucauuacuaaucaucagagaaacgcaaaucacaaccacaaugagauacugucucacaccacucagaauggcuguuauuaaaaagucaaaagacaauagauacugacaaauuugcagagaaaaagcaaugcuuauacacuguggaaugcaguuuggaaauuucucaacuuaaaacagagcuaccauuaggcccagcaaucccauuacuagaucuauacacaaaggaaaauagauuaucauaccaaaaagauacaugaaguuguauguucauugccaugccauucacaauagcgaagacauggaaucaaccuaggugccuaucagugguggauuggauaaagaaaaugugguacauauacaccauggaauaccacacagcccugaaaaagaaugaagucaugcccuuugcagcaauaugaauggagccagaggccauuaaccuaaacgaauuaauguaggaacagaaaacuacauaucacauguucucacuuauaagugggaucuaaacauugagcacacguggacauaaacaugggaacaguagacauugcagacuacuagagcgggcagcacagguucaagaacaaacuaccuauuggguaccaugcucacuacuugacugcaguauacccauguaacaaaccugcacauggcccccuguaucuaaaaguuaaauuuuaaaaugaaaaaaaaaaaaaaaaagcuuaaguauauaagcaacuuaauaagaugaugauaaauaauaacuaucauuuguugaguuuuuccaaugugauaaauaccguauuauguacuuuguacaguuaucuuuaaucuguaaaacauuccugugugauagggauuacacuucccacuucacagauguuggaagcccggacgcagagacguuaauaaauuaacacaaauaccuaguaaaauuuccaaagccagaaugcaaaaccaggauuuaaaagccuuuauucauuuuugcaugccaugcuuccuggacuuacguugaagccacagcuuugcaaaaggcuuaucaguugucacuauuuuagcuaugccuuacaugcaugguuguauaggaaaaauuaaaacuaccuuaaaugcuuuauacugcaccgcaaaucuauaugagaaaaggcaaagauagacaaaugcaaguuuguuuuuucuuauagccugaauccaagaagacaucuuuaauuuauaggacuuccuuaagaccuuuuuuucuguuaacauuuuaugauaugaagauaucagugauaagauuuaucuuacagcagaauaauauuuagauagcuuuuguauuugugucuguuccauaauuuacuuuacauguuugucuuuuaaaaugauccuaacagaaacgucuguuuuuagaauaaaucagagguguagaaacuggcagugauugcugugcuguguauguggauguccuaaauguuugaugcuuguguuuacuaguuuacaaccaucaucaaauuacguagcaacauguguauuuuagaaauggggcugccuuauuuaucuaaaacaaaugauacucuguuaauuauccuagcaauuagaaaauuacuuuuaccauugcuuugccauuuggcaguugagauauaaauuuggcacuaugugguaaccauucacuagguuuaguccuagggugugugauuuuuuugcuuuggaucaggagacagcauuugguaaauagcaguuguaaauuucuuuuuucccaaaguuugaaaaaccucagggcuuuuaguggcaugaguuugcgcaaaucauccuuuuuuuucucaauuugucuguucuuuuucucuuugcagucugccauuuucucaaauuuauugcaugcauuuuauuuauuucuaugugccuucuagugaugcuauauaaguugcaggauuagcauucacaugggaaugaugacuuggaaagucucacccagcuuguucugcacucacccuucuugugaauucaccacucucauagcucagcuacuccuacuuagaugcugcugccacuuugcugacagcgucaucauuucucucuuggauuaguccuguacccuucuguucaggccuuccugccauagaguuugcucucucucuucagcuuuauucuccacuuaguaacuaaagugaucuuuccaagacucuaaucuuaaguaauuuucugcuucaagucuuucagugauuucucauuauucuuaggcucuccccagucucauacacuacacuuagccacugaauuuuucuuaaguuucucaaauauaccuuguccacugaauauuaacauggauucuucacacaaccuggaauaguuucuuauucuuuugccucagugauucuguuuauccaaagucucagcucagaaagcguuucuucugagaaucuucccuggccccguuucccucugcuugccucuagagugguuuagaccagcauccuccagccuucccggguguccugaacuccccuuccaugggauuuguccacauccacagcauuuauauuguauugccugcuuucucuagugacuugacuccuuaaaauguagacuucuguuuccucaucuuuuguccuucugaauaaagaauucauuuauaugcauuuccuuuagagaaucaaacuuggugugauuuugagaaagaagaagauccauaagcucaaaauacugauuucgcuuuccuuguuuucauugcuaucccuagcacuuaacguggugucagauacgugguagaaauucacauauuuuaggugaaugcuagugaugaccagauuuuuguuuuagccuuaaccucuucugaauucuagugccauacguguaagucucucucucugacauuaccacugggguaucaucuaggcacuuuaaauucaguaaacccagaccucacauuauuucccucugggcucuccuuucccuuacacucccuucuuuuuuuuuuucuguuguucuucugucauuggcauuuccaaccuggaaacuacucuaucucucacuagcuagaucagucauuucucagaggcuaucaauucugcuuccuaauaguuuuugaaaacucacccuucaacuccauuuuuucaccgacuuccugucacuuucuaccuuaauuacagagccugcuaauuuauuugaguuauauaaauuucaguaguuuaaaaacuaaauauauuacuguuuucaaagcauuguaaaucuuacaauuaaaugauuuuuuaaaaucugaaaacuaguuaaauuuuucuuauguuuugcccccuuuuuuuuuuuuuuugagacggagucuugcuuugucgcccaggcugcagugcaguggccccaucucugcucacugcaagcucugccuccuguguucauaccauucuccugccucagccucccaagucgcugggacuacaggugcccgccaccacaccuggcuaauuuuuuguauuuuuaguagagacacacaggguuucaucguguuagccaggauggucucgaucuccugacuucgugauccgcccgccucagccucccaaagugcugggauuacaggcgugagccaccaugcccgaccugcccuuuuaaauaaacuguagguuuucauaugcauucauucauuugagaacuuuuguucauuuucaggaauaagaaauaaaaguuacugaaugaacuuuauacaaagaaaguuguguaaaagauaauacgaaaauggagcaucuuuuuguucauaagcaagaaagaugugacccuuuuuauguaauauuaaauauuagcuaugugcuauacuagcuugcugacuuacugaccaguccuccaaagcaguccuugucuguggaggaaguuuucaaacugcaaugaaaaguccaauucagucaugaaagaauccaagauagaauaagagggacuagauuuaccuugcuuccugaaacucugagaaaaauagacaaaauguaugaaacagugguuuucagacauugagcaucaggcaguacaugguaauuaucccugagagaggguaacaacuccaacuuaccgccuccaaagaauuuccaggccuuaacacaaggaggggaaaaccaggaggaaccugauggucucccugaguugaggagaugaaauugggaguuuggggagacuaagguggaaggaguuagcaaggcagugggccaggaaagggagauacacacaggggccccuuacaguguucagauaaguacugaguaacacaugggugaggagacugcuugaggcuaguaaaagaaccacacggaaagaugagagguaacaagccuaggaacucacacagagucuguaauaguuucuguugccaccagccauaguaaaaagcccucauaauucacugggugucaucaaaggacaaugccucaguaguaggggaaaaucuguccuacacuaaaggcugcucuggcccugccuaccaaagccuagaagcaagcuuugaaauuaaccuaauauuuguguaauugaagucccuagugggaauaauucccuagugagaguaauaggagagggagcagaaaaaauauuugaugaaaucauagcuaaaaauuuuccaaauuuagugaaaacuauauaggucuaagaagcacugcaagcuccaauugugggcaugcaugcgugugcgugcacacacacacacacacauacacacacgaagaaaacuauaccaaggcacaucauaaucaaauugcuuuaagucagugaaauauuaauguagaggaaauauuagcguauccacaggggaaaaaacacauguacaaaggaacaaagauaaggguaacagauuucuaggcuugaaacaaagcaagacagaggacagugguauaacauucuuaaaauauuaaaggaaggaaaaaaguuaacuaaacuucauuauccagcagaaguauucuucuaaaaugagagugaagaguccugaaaguaaguugauacucccugacaguaucauuugcaguagcauuugacauggaucucaaagcagaaacuuagcuggacauguuugaugauaaaaaauuuuaguugccuauuuuuacauggcauuuuacauuuuaaaaaagcacaguggcucacgccuguaaucccagcauuuugggagguggaggcggguggaucacuugaggucaggaguuccagacaagucuggccaacauggugacaccucagcucaagugaaaauacaaaaauuagcuggguaugguggugcgcgccuguaaucccaaauacucgggaggcugagacaggagaaucacuugaacccgggaggcggagguggcagugagccgagaucaagcgacugcacuccagccugggcaacagagugagauuccauccaaaaaacaaacaaacaaaaaagaaacaaaaauguguuucuguaugggugaaaacuuuacaguaguuuucccuuauccucgggagauaacguuucaggagcccgguagaugccugaagccucggauaguaccaaacccuauauaugguuuuuugaucucauaacugagauggcuacuuaauuuguagcaucuucaguguggauaugcuggaggaagggaugauucccauccaagguggcacaaagugggcagauuucaucaggcuacuuagaauagugcucagcuuaaaacuuaucaauuguuuguuucuggaauuccacaaguaauauuuucagacuaaaauuaaccacagguaagugaaauuguacuguauuuucacagguuuuucagauagcgaggaugagugauuuuaucuccauuuuauacaugaagaagcugagacacacgaguagcaugacuuccacuggguugcauaauaaguuccaggaauguagucagguuuccugacuuccuguucaggacucuucuaaucugaauggucuccucguugauagcugugcauugcucaaaauauuuucuaaacuuagagacugacagaauauguaaaauguaugaaauaucucaaaagcaauaguaguacaguguuuaguacuucuuuuguaucuucacaucuggaauaggugaagcaaauaaauuaaaaaucuuauuaaaucucaagaccccaaauagaagacaggaaaaaugaaagggaaugcauuaaaguauauuaaagccuguaugaaaaacccguuaugguauuuaaacuuuaaauuagcaaagguggaaaauugcuaugguugcagagaaguuuuuaauuaaagugaaguuauuucugauucuuaaaaggugagaaguuugauuauuuuaauuaccauacuaaauuuuaguagagaaccuucuaauaacuugacucaaauuacaauguggcagaaauuagcugggaagaaacuguauuccucucuugucuuuacacuguguaugugguacauaaaauggaagaauuaaaugcuaccuugguauacaucauugcacccaguguagcaaauuaguuuugaccauuacuagccgccguacagaaugaauaaggcccauuguccuuuuuguuuccauuaaaguuuguucaaauuguucuuuagggauguuuuucaaucuuuccuauuaaagaaauuuugagagcuagaucuuuagauaaaguuuuaugguagaauugggauuugaagguuagaaauugaaaggaggacaggauuuaaguaggauaaggaagaauguuuccaauuauaggaaacaugagcccuggugugucuucucagaacagugagaauguuucauguuggaaagaaauaggaaaucauguagaauagguaggguaagguuugauuacugauggccuuaaaaaaacaaguaagugaaauagguggauggcacuaaaguuaguauugacuccugagggcaguaaauuaucucuccuuaaguuaugaaaugugaauuuuugacauuucagcgcaguauuuuugugucaacuuucauuguguuuaaaucugaaauggcaaagcaaggauuuucuuuguuuguuuguuuuuaccugaaaaggggauguuuuucuuuucuagucgacuccuuuacaucuagcagcgggcuacaacagaguucgaauaguucagcuucuucuucagcauggugcugauguucaugcaaaagacaaaggguaggucuaucaguuuacuuccugucagugcuuuguuuuuugucugauacucuaaacuuuuaaaacacuagacaaagucauaugucccauuuguuacggcuuacauaacguuuuaagaauguucauaacucugguuugaggcuuuauuuucauguaccuacuuaauuaaggauacuucucauaauaauuucccaaaucaauuuaauuuuaucaccguucuguuacuugaaguugaaauugugucucaguugcaguuaggguuuuucaacucuuaaauugcauuuuagaaaaauaaaacaaauugaaaauuaugaaaauccaguagcauagcuaucagauucaacagauaguaaaggaucauccuuuauugauaaaccaaaaucauaaguauacaauaccaaauuuuuuuucuggugaaaucuuggacaucuaaacugagaaaaccuagaagguugaugugaggggauaugggugguaacuaaaaaagcaguuaugucauuuauuuuaccaguaggucauuuuugaaaacuuuguaucaguuuccuguaaagucuccagagauauacgaucauuggguuugcuguccuaugugguggacuaacauuucucauugccccacuuuaagaucugaaagauaauuaacccuacuacccagguaagguagauuauguuacagucuugugacugacagcauaaagaagagaugcccuagaggagaguuucuuucacuuugucccuccccaagucaagaaacauaaaaaugaacucaaugcuugagacacuuaccagaagaauucuuccauuuccaaucugcuuuuucuggugcuguucucuugccugcaccagguuuugugccauaugugaauggugucccaguaguauaggggcauaaaugccugaugcucuuguacaucucuauuuccuugugcaugucugaaaacagauggguguacaauaggugagucaucaagagauguacaccacaaaaaaaggguuuuuuugguuuauuuagaauacuuugauaugcaaguuauaauaguuuggauauuugauuauuuugcuagaaauuaccauuaaagugaauuaaaaugguggaauauuucaguucacuaccaauuaacauuuauuucuuguaaauacuuaauauauaaugcaugcauuugucaauuagcauaugaucuuccuuucgccaaaauguucuucuauuugguauuuuuuucauuaucuucaaggauuauauacaaaaaacaagauaaauacaaaaggugugaacauaagcuaugcuuugaauucuuuuauuauuuuauuaaauacuuuuaaauauuuuaaaauaauuguauugggauuuauuggauuuuauuucuuaguacgacauggauaaauaaguuguuugaaauuuaaguauuuuaauuugccucuuuucauuuaguggacuugugccucuucauaaugcauguucauauggacauuaugaagucacagaacugcuacuaaagguaagagaaauucagaauauugagcaucauuuacuuuuuuuuuuuuucuuuaccuugucaugacuuuccauacuuucggccucaugaaaguuuguuuaguucuuugggguuuuuuguuuguuuguuuugagacagggucuugcccugucacccaggcuggagugcaguggcacauucacagcucacugcagccucaaccucccaaguucaagugauccucccccucagccuccccaguagcugggauuacaggggugugccaccacgcacagcuaauuuuuauguuuuuuguagagacgagguuuugccauguugcccagucuuguuuuuuuagauuuuaagagaauaaaauacguuuuuaaacauauuaccauugccuuaaaauuuuuaaaacauugaauuuaauuucagcuguuuuugaaaggugauauugaagaaauuaaaacacuuauuugaacaaguuauaacugaaauuuacaaagaaauaaaugucuuuugaguuuuauuugauccagcaaaaugauuacugaccuaaaauguuuuuuuucucaauucagcauggagcuuguguuaaugccauggaucucuggcaguuuacuccacugcacgaggcugcuuccaagaaccguguagaagucugcucuuuguuacuuagccauggcgcugauccuacauuagucaacugccauggcaaaagugcuguggauauggcuccaacuccggagcuuagggagagauugacuuguacguauuuauaucccgaaaucauuaucgcauaaauuggaauauuuaauuucuguugaguuuuaucuaccuuaaauaauaaccuuccauucuuacaagcagacuaauucauaauccucauuucuaauuguauacuuuucuucaugaauuccaugggaauguuauauacagacacuuuuuguauauauuguauuuauucgagccuaguuuuaauucguauguugaagcuccuuuuuugguuuuuugaaggcuaaugaggaugagucaaucagcauccauuucuuggauacuugcaauguggcaggcacuagaaauauagcaguguacaaaccauuaaaaagcucugagcuucuggggcuuacauucuugugcuauugacagugauagguaucuagcauuauugaaaccucuuaugggcuuacguucuugugccauugacagugacagguaucuagcauuauugagcccuccccauuucccgagcccugcaaggcugcacaaucauauuuuuauuugucauguguguuaugacccaaguauaaucacuuucccauauuuaagugagauuuuaaaaauaauuagguugaggucaucuucugaauauauuaccaauauauacaugcaaauguuuuuuaaauaaacuuuuuguuucagcauaguuaaagauauaaaaauauuggauucucauucaugcaauuaauuuagauacagcuuuucaaaaaaucucucaccugguuaugaaaauaauaagcuauuaauuguucuuugaaaaauuuucaagcucugcauuucucccauauuuuaguccuuuccuuuucugugucaagaccuaaucaccauugauauuuugguaaauauuucuguaaauguuuucuauaccauuacuuaugguguacuuaugguggcaauaguaguagcaagaguagugacaauaccaaaaauaaugcaucagccuguccuuucuuuuuugaauuuucauguaccacuguauacuuucaugucaguguauguagaccuaucucuuguuuaagagcuagaaaguguuacagcauaugugcacacaaauuauuuaacugguuuccuuuugguggacauuuagguuuccuguuucaaaauuuugcugcaauaaguaucuuuauagguguaucuuuaugacucugagagugugaaacagucuuauuucagagcauacauacuucacauuaaucuacauccucaucuuuugcauuuuuaucaucauauuaucacauugcugcuguuguuaaaauagagaaauucauaaaauaauaauauuccuacuuauuuauaaucaugcugaagauuuuuauacauuuuuacaucuuuuuuuaugucaaccauuguuucauugacagaugaauuuaaaggucauucuuuacuacaagcagccagagaagcagacuuagcuaaaguuaaaaaaacacucgcucuggaaaucauuaauuucaaacaaccgcagucucaugaaacagcacugguaagauuuuauuguuaaucuauucccugugucuauaauaauaacguaagcacaaaauaugauuuucauuucagaaaccuuaaaguaacuuuaguaucugaaaugccaggaauuugcauguuaauuuugguugcauugauuuuuaaacuuaguuuggggggugauucuuuucaugggugagagaauugacauuugcucaaccucaauuuggaaauuauuuuaccuuugucuuccccaccucauuauaacaaauccacuuuuguggccagugcuuucauaaacuacaagauaugauuuuucaauagaauuuuuuuuucuuauguuugcuagauaaauacuagauuuccuucuguagaagauuaaaguauauuuuuagauauuugcauuaucuuuuugagcaauuguauucaaagaacugauuauauucaugguagaaaaauggcaagaucaugaauuuuuuguuugauacuauacaaauuauucuuaaaacuauccacguuuuuuucuucaaaugcacuuucggaaagauuuauuuauuuucuuugucauugacacauuaaggcucagcuagagagugguuagugaucgcuccuaaauucagaauuuaagcauaugugaugccugcaucacagaccuuaaauauaccuaauuaauauucuuacguauauuugacacaaaagaucaaacguuugucaguaucugcauaaaacaacauuaaaggauugaccaaacugaaauaggcuaacuauauguacacuuaaauacaugucucucaaacuaggguugagauagauucaagcuacacgguguuaugcuaggagauauucauagccacagaauaaaccugacccacuuuuuuggaguuuucauuuuauuuaguugaaaguaguuuuuuauuuuuaaauuuuaauacgaauauuaaaaugaagcagaauaaaaaaguuguauaaauauuauguuaaaaccuaaaauuucugagaauauuuuucucuaaacugcuucaguucuaucauuuucuugcuuauccuugggcauauaaacgucuccuguagugcugggaguaccucuguagaagagcuuagaaauacugacuuguguggcugauggccuaaugaaagauugaguaacuuaguuauagauuucuguagcguugcagaggcauacguauuaugaugcucuccauggaauauauagugaauauuuauugauuggcuaagccaaaagaaauaagaucucucuuaauguuuaagagcauaauuucaccuugguuuaaacgcuuacguuuuguauuuccacuauacguagaaagaauauggaucaucucugugauauaaaacauauacauauguucugauacucugagauaacaauguuuuaaauggucagcagauacuguucaauuccaagagcuacuguacauauggaaguguauuuuauuaacuugguuuuguuuacuuuauagcacugugcuguggccucucugcaucccaaacguaaacaagugacagaauuguuacuuagaaaaggagcaaauguuaaugaaaaaaauaaagaguaaguauaauugcagaaggaguuguucaguuccuaaagaggaaaugcaauaaaagagagacaauuaccuuuucuuucuuuccucuuuucuguaguuucaugacuccccugcauguugcagccgaaagagcccauaaugaugucauggaaguucugcauaagcauggcgccaaggugaggcacacaccugagcagagugccagacucagcacugagcagccagcugcucuuaacacugcuucucucucuccgauuuuucugaagaaacuaauuuuauaaaggacuauuaguucguacuuaaauucauggauucuccuauaaagcugauuuagaucuuguuucuaauaaaaauaauuacccguguuucuugauccuuuaaugucacccuucuguaaagcaacaaaauauagcuauagucauuugaaauagauuucaucuuuacauuacuuucaguuaauacuauacggauauauuuugauaguguccacuugaauaacaguuuaucagaaaauaaauuauguuaaaugauagcaucagaauagcucuacuuauucuaaaaaacauuuguggccaggcacaguggcucacgccuguaaucccagcacuuugggaggccgaggcagguggaucacgaggucaggagauggagaccauccuggcuaagacggugaaaccccgucucuacuaaaaauacaaaaaauuagccgggcgugguggcgggugccuguagucccagcuacccaggaggcugaggcaggagaauggcaugaaccugggaggcgaagcuugcagugagcugagauugcgccacuacacuccagccugggagacagagugagaaucugucucaaaaaaaaaaauuguaugccuucagauuuguaauaauuuucucaaccucuacacuaaagaaauaugacauauuuaauaauuuuuacuggcauuuucugaaugguguagucugaaacuuugucaagcacuuaagagaggaaagaagcaaacugguuguuuuuuagaggugacuugaaauuauagauuuuuucauucucaagaauguauauuucaaagcaguugucuccaaaguaggguauagacucccuauggagcauacaagaugcccuguuggaaaaauccuagcauuucaauuuauaauacuuuuauuuaagaauaaggaaauucagauuuaccaauauugaauacaaagaugaugccagcacucucacuagguccacgugucagccauugugacucgugaugucaagguuuccugagguaagagugggacuuguuaguaucgagggauugacaguggcaaacucacuuguuuguucccuuucagcauauuuuggcauaguguacuuuacuuguguccaaaugaguugaauuuauggauauuauccuaaaugguagaacuuuuauaaauaucauacuugaucagaguagugacccugacaagggacacagggagugacccugacaugcuuuuauaguguaaaaagguggucugguuauuuugugaaguaguauuuuaagguguugucauaguuguguucuuuuuaaugaaaauaaaaggguucaaaauuuguuaauaguucucugaggacaaaugaccaugacuugcauguagauacccuuuaaaaaggaaacauaaucagauccuuaaagguaaaaguuacacacuuuagguaaaugauaaaauaacugcuuuuuuaaaagaaacuuuaaaaaaugaagagaacguuuugaacauagauuuuuagaaaauguucacuuuucugugauuuugcugaaaaaugauauaaaugaaucacccagccgucauaucuacauaauuuaaacacauaaaaacagaauuuucucaccuguucaaaagccuuccuuaauuugguuuuaggguagauuuugaaucuauucaaaacauuguaaugcagcacuuccuaauaacuucgcaagaacaucaguaaagauggaauuuuacuacagaauuucaaugaaagccuuagcauaauuaguaaauuacauuaaaauuaggcauucugauugaguaggcauaguuaacaaugcauuuauuucauuggcuccaugaaucuguaugaaaucuuugcaacuaauauagccauucaaacuaauuaucaaaaaugaacuuagagccacguguaguggcccguaaucacuccuguaaucccagagcuuuaggaggcaaaggcagaaggauugcuugaggccaggaguucgacaccagccugggcaacacagcaagacacuaucucuacaaaaaauuuaaaaauuagccagucgugguggugugcaccuauaguccuagcgacucgggaggcugaggcaggaagaucacuugaucccaggaguuugaggcugcagugagguaugaucauaccacuguacugcagccugggcaacagagcaagacucugucucuaaagaaaaaugaaaugaaccuaaaauuaaacccucaaauuccuaauaucacaauuuuuauaaguuuuuuuaaauguuuaaacuacagucaauggauauuuucuagcauaaguaauuaaaauauguuuuggacagguaccauagccuaugccuuaaucccagcacuuugggagacugaggugggaggaucgcuugagcccaggauuuugagaucagcugggcaacacaggccaaccccgucucuacaaauaauaaaaaaaaauagccagaugugguggugcauuccuguagucccagcuacucgggaggcugaggugggaaaaucacuugagcccaagaggucgaggcuguagugagcuguaaucaugccacuacacuguagccugggugacagagcaguacucuaucucagaaaauaauaaucaugaaaucuuuuuaaauuuuuaauuauuucaucucuuucucauccuucauaaauucucuuuguguaaguuuuauaauaguauagcacuucuugguuauaauuuacaaagaaauucauauauauauauuaaguguucucaaaacuuuucuaccuggagggugugugauuuaaaaauuuggauaucacugccuuaaaauggcacuuuauguuuuuaauuuaugaaaugaagacaaaguggaauaaaagggaacagaguucuacagauguauuaccuauuuuguagguacaacuacugcauuauuauauaaguagcaucuuguugcucuuucaagcagaaaacacuaagcuaagugacauuucugcuacacuuaggagcuuuguacauuuaucuuugacccguuuuugcaaauaucuaaugacauuuauaaugcucuugaaaaauuaggaauaaugcccuucauuuugggaaaauaguaucuauuuauugucucccaucaggcauuuuaguuuauaaagguucaauggaaaauaacauuaugacuuguucuagucagccuuucucuaggucugugguucucacucuuuauuugcccuuuaugugcacaguacauuuucaucaguaacaucuuaguucauuacuagcccugucaaugacuuagaagaacuucuagacuuuuguguucauccuagucuuuccacuguaguucaucuacauugauaacgcuugcuaguaggcacuuaaaaaagaggagaguuauauuuaaucagaguuaugaacccauagauaucaauugcuaucaguagauaucaaaugccguagcaacuccuauuuaccccaucccaaggcaggaugcuguuccucaugguugguguaucuggugauuaauguguuguaaaaaacucccuguaagaaacucacuuagcuauuguugggcucccauuuuuucuugcguaguauuucuuucugaggaacucaugguuucuguaugauuuucaggcaacucaugguuuccauuugauucugaacacacuuucugaacaagcagcaccaguuuuuaauuaggauucagcccucuuccacugcuucuagcacccugcugccuuccccuacucuugaugaaucaauuucucaggcaaaggcagaagaauuugggaugaagaccuaauuaucauuaaguaauuugccuuacuuugacagaacuuagugguauuuuuauaagccaaaacauucuuuugcccaaaaccugguaauacauacaaacuugagguuugcuguuaauguuaaacuaaauguacgccauauauaaccuagacaggcaugcuuuugaguuuagaauccuccacuuucuaguuuugugaccuugggcuaaauuucccugagucucaguugacuaaucagugauaugugaagcaaccgcccuacaggcuuuuuuuuuuuuuaaucaaaugagcauauguauauaaauauguaguauagugcuuaacacacagauaauguuuugguuauuugugaauaugagccuuuuuucccacauuugucuuuucaaauguguauguacuauguauuucccuuuaauuaucuaaauuuuauaagacacauaucuaaucccuuuauaauuggguuugauccacuaacuccauaaauauuggcaugcaaaauaaucaagacuguaguagauacuguggaaaauaccaguuugaaaguuaaugcaguuaccaaacuugaccucaguccugaaucaauuuagcagcauuaguaaugaagaaggaagaggaagauaaaagccacuuaugaaggaguaauuauauuaccuggaaaugaauuggguguuagaguggacuuagagaaugguggugcaauuaauggaaguaagaaagcuacagagaaacacugguuuccuacgccuugauaaugauuuucuacuugaaguugauauuacagaaagacauuuaauaaaaccagcaguuggaaagacagcaucagaguauaaaagaguuuaagauuagaaagaucuacugagaauucacauagugauucuacauuuuaggagcaaguacggucccugguagagaaagcauggaaagaagggaguuaaggaaagauccuuugaggauugcccauguuuauagagcgguggugggaagagaaagcuggaaguucuaucacagugucuacagaguacaggaggaguaugaagaaggagcaggugaccagugccacugagagaaaucaaggcagacuggggcauuacuuagaccguuuuuauaugagggcuuugguaguuuuugaaggagagauucuaaggagauagaagcagagauauaucucaguuagggucuucgcaauaaauggcacacuuaaaguggguaauuugaugaaaguuuaauaaaggaacuguauagaaacgugggcaagguucaaggaaaguagcaaggaaagagguuguacuagcagcagggggggcggguaugaucaucucuggucugaagggacaaggcaaaggagagguucuuggugcuggaagaugguagcuguauggaaaaggccaccugguaccaccuguagccuuugaucaaaggauguaucuaauguuacucuucauuguccugcuguccucuaucuccucccaguaccccccaucuccucccagugcccgugaccaaauucaacaaaacagugaagaccaaaagagucuguugaugugguucauacaagugauuuucucaggacccagagcaagguggaggauggcuguggcucuagaggggaauaagggcaauauucagcaaaagauuagaaaacaaauugcuaguaaggagaguuacaagaacauuggagcauuacccaauucauuugaaaaauccucauuuacuaggaguaaacuuuuguuccuuaaaaaaaaucaauaauuuauuauccccugcuuuuugggaguacuauaaagucuaaauaggaaagacaugaagacuuuauccuucauguggcaauuuuuucuuuauuaugguuagucugcccuggcauucugcauucugucaguaaugaauugucugcucucauuauuaagaaaacuuacgccccaacugcauaugguauucaagaaguuuaauucauaaaugcauuucuucauauauaaagcauagcuauuuugucauuaugugcaucuguuaaauacgugaaacaugaaggaauuuuuuugacaguucauauucauaugucuuaauuugacagauuuauuuacauuguguuuaagaagauauugugacauaauaauugacauuuaauaggcuuauuucucacauuuagaagcgaucacgagucuuugcucacuuggggaaaugugucagcccauuauaagaguuuuauuaaugcuuuucuagagguagauugauaaguagauuguuagcgcaaagauguuaaaguacuuuuaaagauacuauagcucuaaaguaucuuuuacaguguaaauaauaucugagguuugaucauaccaaaauaaaguccaaaggggcaagugucccagagacauuuuaguucucaguaacaaaccaacucaaucuagauuaaacacaaauggaaauauauuuuauacuaauauaaauguauauuaaugcaaauguguuuauuacuucugugagaaacccguaugguuaucucccagaaauauguguaagaauuguagcugagauucacaaaagaccagaacaaggaauuuagaaacuaucagguacuuuggcugccguucucuaugucucugccucccugcuucccucuuuccccucuucugugucuccgucgcucccugucuuucucucucuuucucuuucucugagguuucuuuucucugccaguguuuguucaucugguucauucuucuuucugcagacuggauuuuucuguauuauuucucuauggccuaaauguggucuuuuacaacccauacuuuauguguccuuggcuuagaaguauaccaccugcagcugauagggucugucccgucucugggaugaaaaagggagaauuauaaauaagagucgcuuguugaguacgagcauucauuggauuggcacccucuagucuauaaucacuuuugcucaguuuguuauuucuuaaggcacgugagcaagauuaguaccccuugaaaccaccaaagauaaucuguuguauuauaauauauauauauauauauauauauauauauuuucagggaauuugauuguuucuuuuaaauuuccacaggaaucuuuacagauagcacacucaaguucagcuagcaaauagaaauccaguuccguacucuguagugaguucacaacacauuaaaggauuaaaaaacauuucaaguaaaauauugauuacuaugucaguauuguauugaaaaauuguguucauuugucucuuucauuccucauaggaagugcuuuaacuaugcauaccaccaaggauaaugaugaauacuuguaaaacaccuguaaaaacauuagaaucaauuuaaauuauauuuugauuacagauaaagcaaauucauuuucaauauuaagcaauucuauaaacacuggcauuuacccuucucccucaauuuccagggaaagaggaaugcauuuugguuagauagcgaacauuuuaguaguuccuaauguuuguucaauauacagaacaguaugucaaaaguaguauuuuuuaucaccagaauuuauuaguuuguugcucuugugaggcauucacuuaccaaccauuuucaaauaucuguuuauacaaggcaugguacuuacugcugagaggauguauaaaguuugaauuugaucaagauccuucucuuaaggaacuuaaaaucuaauugucuaacacagucuacuugacuacuauaugaacuggaaaguaguauauauaauaagagaaguauagauugauuuauauucagaggaauaaacaguuauuucuguuggugguggcagccuggggaagagauuggagaaaucucaugaagaaaauagaauuucagcuaggaauguucaggaaucaaauauauagauauauacaggcaaaauacaaacaauacauuuucaguaaggacugaaaaucagggaaguaaagggguuuguuuguuaaacugucagaaguuauuaguuaguccaaaagguacagaaaauggaaacaaugaaaagcaagaucuuuguauugucaauuggagaguuuaaacuuuguucucauaauacuuggagaaccuaucauuuguucuucuaucauagauauauuaaugccuguuaauuuuuuuaauuguugacuuucaauuuguugugguuugagaaaaaaaaugcagugucacucuagcuaaagaguacagacuguuuucaacucucggcuuacuugaaaucagcuuuuagguugaggcaaacacauguucacaguuaaagguguuaaguacggaugucacagaacaguuugugauuaauuaccaaaugagugauguagacaaugauagcuuuaaguuuaggagaaguggccucaggauuagcugucugagacuaggcuguucacacugaguagaauauugaaggauuccccucagccauuucuuuguggucugcuugccgguuuccagaacuguuuuggcauuuuuugaaucauaauuucauguccuaaauauuucgggccaagugucauugugauuuuauauaguuuuacugaguuauucaucuucuguaaagucauuuuugcugcucaguuagaaaugaaaauacguacacuaagguugcaaucucuagauacaaggaaaagugggaauauguuuuaccucuaaaacugccagacaucuauuauucugacuccugaauggauaggucaagccagucuuaagcauuuaauuaccacaguugagggguaacauuaaauguaggagucucuuuauuugagacaguuucuguaaccuggugaaaauaaucacuuuagugcugaauguuaaguauuuuuuagugacaucaaaucauguucccaugcuucaauaaguuggauugggaguucccauuacuauaauagaauaaguuaguauguuucuuacccaguuuccagaaaaauguuaaugauuagaauguucacaauuuuagauuuuucuuuugugcugaagaaguaacaaagaaaucaaaauucaaguuaguuugguagcuuguguuauccauugauacaugcuaauggcugugcuuuuuuguugguauguaucagcagucauuuuucuucuggcaaaugugauagaguuaaauauguuacuauuucaugggaguuuugugaaagaccaucaagaauuuguaugaacccuuuccugaguaaguacaacagccuuacugguaaugauaaaagacuggcgacagggagacuaguugucuuuuauccuuucuuuucuuaaucuuguauuuaguggguguacacaaauauuuucaauaaucaaccagcauauaauugagaauuuacuguguaccuuuagcaggagcuuucuagaggacccagaaagucuguguguaacaugcacucauauucucaauaaccuuaguuuaacucaauaaacaaaaauuaccccaguauuauauuuuauaagacaguaaagugcuaaauugacauagauguucagaaaaggaguaaucaaagucuucaagaaaucaaggaagacuucuuggagaugaggagacuuaucuacacuggaucucaggagccauaaaggcagaaagaaggguuucucugaaaagagcagcaagcacaaugaacguggacuugggucugacuggaguagagggugcugauugggaucugcuggaagauaagaugagucagguuugaccagauuaagaacaugaugccaguguuucacauugucuuaagcagucucacaacuagcuaaaugauucuucuuccuguguauaauaacucuucaaagcuuuaaaaaggaauguuugaauccucaaaucuuuuuuuugcuuaaauaugcuuguaauucaauuaagauauuauaauuagcuauauuaccuaaauuagaaaagaaauauaaucaacuacuuugacagucuuugcuuacauaugcuguugucuuuauauucuggggaaaaguuugguaaaaauccauucauucagaagaauuuggugagcauccucauuguggcaagcaguaaauaccagaccagaguugcugccuccauagaccagucuagucgucgaagggaguagcagaaaugggaaauggucaggaaaauggucauuccgggaagaaaggguauguuguaauuuucaguaaggugaucagagaaggguaacuaaaaagaagauaguucuucagaaucagugagcaaaaguuuauaaucaauaucuaugagacuuuuuaaaagcuuugaaaguugauuuuuuuuucauaagaauguauuuucuaagguauaaaaggaaacuaaacaagaugcucaauuccaugugcccacgcaaugauuuuucagaugaaugcacuggacacccuuggucagacugcuuugcauagagccgcccuagcaggucaccugcagaccugccgccuccugcugaguuacggcucugaccccuccaucaucuccuuacaaggcuucacagcagcacagaugggcaaugaagcagugcagcagauucugaguggugaguuaaaauagaccaacagggcauuuuauguuuucucuuccaucccugcugaaauacacagacaaacuuugcaguguuuacuuugccugaaguuuuucucaugucuuuucuugcaauuuagccuguggacuuccccaucucccuuuuuugguaggguaagguaggugucaugggaaggaagcagauacagcuuuuaguuuuuuuagguuuaaauugaaaaccugacucaugaguguucugaucaaaggugacuuaaaacucauauaaacaguguggaauuaugguagcuauaaaaucuaucaaauagagaaaauuauaaaucauucauaugguaaugacauuuaauuaauuguuccuaccuguguaaaauucugacauacuuuuaaaauucuuaacuucauugcauuauuauaaaauuaucuugucuuuuucuggcuuaaauauaauuauaggccgggcacaguggcucacuccuguaaucccaauacuuugggaugccgaggcaggcagaucacgaggacaggagaucgagaccaucuuggccaacauggugaaacccugucucuauuaaaaauacaaaaauuagcugggcggaguggcgcaugccuuguagccccagcuacuugggaggcugaggcaaggagaauugcuugaacgcgggaggcggagguugcagugagccgagaucacgccacugcacuccagccuggagacagagugaaacucugucucaaaaauaaauaaauaaauuauauauauauauaaaauuauaaaauuuugcugaauguuucauugucugccugguauaguguuagauauuuuaaauauaaauugauaagaaaauagauacuggcuuccuaagucccaaaacuagaggaaguaaugcagucuaccuacugacaaaaugaacuagaaucaaaaguuuaguauaauuaaccucuuuccuaaccuuuuaauuuugucuguggauuauaucugcuauggaaugaaaugacaaaccagaagaguaaaauguagaaggcuauagacuaggagucagaaguccugguuacuuuuuucuaccuacagucugguaguucuuaacucuaucagguacagugcccgcuuuuuauaaagaaugucuuaugacauauccuuaugacauuucagaagugaaauucauagauaauaugaccuaacuguauagguaccuuuccaaaaaucuauauaaaacgcccuaacuagaucgggcaugguggcugacgccuguaaucccagcacuuugggaggccgaggugggcggaucacgaggucaggaguuccagaccaccuuggccaacauggugaaacccccaucucuacuaaauguuaaaaaauuagccgggugugguggugcgugccuguaauuccagcuacucgggagccugaggcaggagaaucacuggaaccuaggagacggagguugcagugagccaagaucgcgccacugcacuccauccagccugggugacagagcgagacuccaucucaacaaaaaaaaaagaaaagaaaagaaaaaaaugcccuaacuauaauauaaagggaaaauagcaguaaguuacaauaaaauaauuuauaguucuuauguaaauagauuggacacaacuauauuagaagacaaaacaugaccccacagauuucuaaagggaccccaagaaauacagccaaguugagaaucacugcuauaugaugcaacagggacccuucuagggcuuguagagauuaugauauguguauauuguuauaggaagaucagagcuaaauagcauaauaaaacuaauugugcaacauugugaaaacuauugaugaggauuuauuuuccucaugcuaggucauucguagauagugaucauucuacuucagccuuaauggugaucuugagacgggaagauuuagaaggaaaucuaucuagcaugucuucacuaucaacaugaguaagauccagcugaacaaaugaaauuuucuauauaaauuucaagcuugaacucaaaaaaaaaaaaaaaaaaaagacuuugacuuccuguuuuuauggagugauagaacauuugcuuaaaggagauauuacuccuugccuaggaaauauuucuucccucucaguaaauucuaaugauuucuaaaaguugugauuuuuguuaaaauuucuaaauuuucucauuuuacugagaaucauuuaguaccgaauuuuaaguuaguuucuguauguuuuaaccauaagucaggcaaacacauagcuuugccucaaauuaugugcauagcuuuuagagauaauuaacaaaauggagaagaaaguauugaauaaaucaagcauaucagauccauauaauacuuuuaaaaugucuucuuacugaaugcaguuagaauauaugaguucuggcaaaagauaaaacuaaauacugaauacaaaugaaauauuuuucuucgauuauuuugauaaaucuccuuuaaaauugauuuuugaaauaagacauuauauagguaauuaaaugcuuaauuuagaacaugcagaacuuuuuaguuuaauucuuuauugaucuggaaagcuaauacaaauaaaaaauauauauaggaaaauuuugcccuccaaaagguuuuuuuuuuuuguaaugggaauuguuucuuauuugaaauaggauaugaguuuuuaaacuacuauuuuuaccaggaauuuguaugucucuguagacuauggaccaugcauuagcugaacuuuuuaguuauuuauuaacccaauaucagguuauaucuauaaugacuuuugaaagaauauauuaauaucagucaaauaagauguauaguaauuuguuuuguucuggauaacauuuuauaagauucauuuaaauacacuuguuaauacggguuugagaucuacuuuagaaaccugcacuuucaacucucaagucuguaguugccagaaguuuacauuaauaaaguuuucauuauaaacugcuggcaauauuugugucaaaacuaacaucaauguaaagaaaacaagagaagcagcuuuuuaugaauuagcacuuuaaaacauuauuuccaaagauuugauuucuuucucuagacuugcucuuuccaauaugguagccacuagcuacaucuggcuacauuuaaacuaauuaaaauuaaauaaaauggaaaaucuuuccauuaguuacacuagccacauuucagguauuccguagucacacguggcuaauggcuagcauaauagcacaaauaacacuauuucuagcaccacagacaguucuuuuggccauuucuuuuaaguucgaucuugaccugaauucuugcgauuguauaacccagugugggauaagcauuacuuucaucuacacagguaaagauuaggcuuaugauaccuaaauuaaacauugaaaccccauuuacaguggcacauugaaauaagccauuaagaccuguugccaguccaguagucuaauauugaucaaacuacuaagucuauaaaagauguuuuuaaaaauaggcugcuuccuagcguuucuaacuuuuuaaaaacucuaaugagccagaaaaagauuggagacaaaauaagaagcccaucuuuaaucuuugauucuaggugacuauaauuucauguucuacaggcugagugugguugcucacgccuauaaucccugcacuuugggaggcaacggugggaggauugcuugagcucaggaguucaagcccagcuugggcaacauggcgaaaccccgucucuacuuaaaaauuuuuaaaaauuagccggguaugguggugcaugccuauggucccaacuacucaggaggcuaagacaagaggaucacuugagcccaggauuucaagaccagccagggcaacauagugagaccccaucucuaaaaagaaagaacuaaacaaauaaauaaauuucauguuauacaaaccuagcauacuuacaaagaauuuuacuaauauaguacuuugcauacaagcuacucuuucacucauguuccuuuuuuaauuucauuuuuuauaucucuuuuaauugugcaucacuuuauacaaaguuccugggcuguauguaagucauuucagcuaauacauuuuucgcauuauuucuaaaaacaagucuauccuaggccuuauucaagauauguaauaggugcaggucucuacaaucuggauaguaauuaaccaauauuuuaaacaucuuuacuuucuccucuuuaaccaggacuaauaauucuuuucucauaguuccagaagcauucuuauauuugcuuaagacuuuuugcuugauuggaaaauuauacucuuuaguagacaguccgcaucaagauauguguuccaauuucaaauaguucuuagauuucaaaaauuuugccauauuaaauguauccuuaaagugcugucaucgaaaaauacucaguuauaacucuauauacauaaacaauugucucuuuauuuuguugaaaugaaaaacuaaaaauauuaccuguagauauugaaaggauauaucagugaauuuugucaaauccagaaucacugucauagagacauaauauacacacagcaucuuaccuauaaaugcgguaguguaugugcacacuuauaauggagacuaaugagacaaugaaagaacagaauaagagcagccaaaaaaagagcuaagauuugauagacucauugaccccaauacauaguggaaauccauccaggaaaugcuuuuggaaugcucucugugugaaaaggaauauaaagaugagcaagaucugguuccuuuccucaacauuuccacaaauuaaaauguaauauaacucuuaagaauaauaauucaaagauuuacuuuguuauaugaaacacucucuuuuuuccucccuuaaucucagcauuuuaccugcuauuaugaucaaauaaguaguuuaucuuuuacugaagaauugucauaacuuauucuguaaaagccacucucuccugaaaucuacaaccucuucauagcaucacuugauccucccacuuggacauugggcucaaaaaagaugucucugaucauaagauaauacaaucuuagaucugaaagauuuucagcacucacuuuauaagggcaaaaacuaaacuguuacaugaguuguccaaaguuguagauuauagagcccagucuaaaauguaggccuccuggagauccauccuuuuguguuaacauaaugugugcucauucuaaaagccacacuucauguacauaaacauacuuuugguugacauauuauaaauuguuuucuuuaaaaacuuauuuuauuugggucaaugugaaaugaauuuucaguuuauuuacauuggauuaaucaaaauaauaacucauuuguuagccucuagaccuaacagcccaauuuaauuauauucuguuucgcauugcuaucauaccuccaauuauacaaacauugaaaguugcauuuuccuaaagccauucaauaaaugugaauuaaacaaaugucuguauuuaguagcccuuuucuguucacugauuauacuucacaagaugauucugauuuuaaaaguaguacauugagacuaaaagaaaaaucaaggcugggcgcaguggcucacaucuguaaucccagcacuuugggaggcugaagcaggaggaucacuugagcccaggaguuugugaccagccugggcaacauggugaaaacccaucuccacaaaauauacaaaaacuagcugggcguggugguguacacguguggucucagcuacuuggggcugagguggggaggauugcuugauccuggaagguugaggcuacagugaacugugaucacgccacugcacugcagccuuggugacagagcaacugucucaaaaaauaaauacauacauauguacauacauaaaaaaaguaaacauuaaguacugaaaguuguguggcuucccuagguuuguauaacaaaucuauggcaaaguuuugcuacaacauuuaguaaaaccaaacuaaauaauuuuuccuccugaacuacuuugcaaucccucaagaaccauuuuuguuuccaaaaucaaugcaguuggaauauaugaguuuggauauauauaugaguucuuuccuuccuuuuaugcagagaguacaccuauacguacuucugauguugauuaucgacucuuagaggcaucuaaagcuggagacuuggaaacugugaagguaagucagugcccuuaauaucuggaauagcacuguugaacuuugcuaaccaauucauuuuuaagcuucuaaguauaucuacucaaauacaaacaguaaaaaggaugaacagagucaugggcaggaaaaaucuguacuacuauuaaggaauucccaguaugugccuuguauuuaugaaaccauuuguauauauauguguguguauguauauagguagauagacagauggauauauacauacacacacacacauauacaugguuuuuaguaauuuuucuucagguuacaugaaagcucuuuuaauuucacuuauauuaauuacaguguuacuauuuuuggcugcauucacaaaauguauaaacuagaucgagcccagacauuagcaggaugacauuugaaagaauauuucuugaucuuuucucagagguucacacauuuauucuaggaaagcauuccugugaucccucaacaguggaauuauucauaugcagaagauagauuuuuucccuguguagcucuacuugcuucaaaaauuuuaucagucuguauuugugguauagaaacaaugguuguaguuuuauuuuuuuucaaauauagucauauucuaauacuaaguaugcuuuuuuaaaacacacauuucccaucuauaaucauucacuuagggaugaaguuagcaaaaguuuuuuguuuggagauuggucuuuugggguuuguuuuuuguuguuuuuuacgagacaaggucuugcuguauugcccaggcaggccucaaacuccuggggcucaagcaauccucuugccuuacccugccuacuauccaaguagcugagacuacaggugugcaccacugcacccagcuuugccuuuauuauuuuuaucgaaaaguuaauagcaaauuugcuauugacacucaguacuuuuuacgacauacugucaacuuugucaccucuucuuaagcaaacuuuuugcgauuuuuagcaaacuaauuuuagcauucuugauaacauauacugguugaaagugacgguaaacacguuuuaagcucuguugccuagaaauuuuauuuuuguuuuaauaugugggcacuuccaggaucacauccaacuuacgauagcaucuaaguuauuuaaagaauaauaguaaauuuuaguugugauagccacuagggagaaauuuuuauguugucuuaaaucuaaaacuguacauuuuuucuuaaaaaugcuucaucacuugaaauguauucuaauaaaagaaaauucuuaaauauaagacgauuaggcuuccuuucagagcaugaucaucucagugcuugaauugcuauaugugcuuauuauaauuaauacauacuuuauuuuuaaagcauacaguuuuaaauuccauguguuuuguauaugauaagcagauguauacuacagcuuuuagguuucuuaaacaauccauucacagugaaggccuaauuuauuuugaucuguggaauggaaguagcaaaagaaaacaaagcagcacaaauugagugagaauuaggccugguaaauuucuuccccaagagacuuuagaaaguaguagaacugagguuuuagaagaaaaggcugccugcugaauaaagcauuugaaauugugaaaaguaaguaggaaggaugugaaauugcuuugccauucgaaagaaaacugaaacagaauaaagaauuucuaaaucuuaaaaaucaaauauuuaauaagcaggaugggcuucuauuucuguagccucacaaaaugaguuguguuucauucccuaccuauuccuauuuugucaguauucugacaaauagaauaauaauagaguuaauuuagaauguaagaaccagugggggaaagcagcauuaggaagaagcuucaaucaugucagacuccuuagaggguguuuauuaucaauuuuugcaucuuuucuuuuugauuuauguauuuauucauuuuuuauuuaauuugauuugucaauuaugcuguuuauauauuaauauagccacagacucauuugucaugaaaagauauuugaccuggucacauuacaauggcucuucagauuuuagaggcuggugcauuuccguauagaguugaugaaacugugaacucgccuuuacugcccagacuccuuccugucaugugaaaauuacaccacuuaaaaagcgcuuguuuuuauccuaccugugugaaagcuucuugucuuagucuauuugugcugcuauaaaaaaauaccauagacugggcaauuucuaagcaauagaaauuuauuucucucaguucuggaggcuaggaaguccaagauccagguacucguaggcuuagugucugguggggaccccgucucucugccuucaagguggugucuuguugcugccucuucuggaggggacaaaugcuguauccucacuuggcagaaggcggaagggcaaaacggccaaaugcugugugaagccucuuuuagaaaggccuuaagcccacauucaggagggaagaguccgcaugacccagucaccuccuuaacacuauugcauuggagauuaaguuucaacaugaauuccagaaggacacaaacauucaacccguagcacuccuacuuccucuaucaguagaaauuuuucagguucuuaauuuuuauguaauaauagcuuauuacugugacggaaguggcagcaaaauuagugaauaccugaaaauccccagggacccugcaaucguccuuuauagccuagagcaugcuauugucugcucugcuucauuugcuuuuucuguuuuucauugccuuucuucugaucacuucccucaaguuggauaauuaggaaaguaagcgaugaugcaugauguagcagaaagacuaagagguuaaaaaucaguaaagcaggguuugagucuuuauucuaccccuuaccaacuguuugacaaggauaacucacuuaaccuucaucccugauuuauuuaucuguaaaguuaauuuauaaauuaaucuccaucccugguuuguuaucuaucaacuucuuagacauauaauaauuuccucacugaaagaauaugauauucuuuuuuuuuuuuuuuuuuuuugagauggggucucacucugucaccagacuaaagugcaguagcgugauuucggcucacugcaaccucugccuccuggguucaagcaauucuccugccucagccucccagcgaguagcugggacuacaggcacgcgccaccaugcccagcuaauuuuuguauuuuuaguagagaugagguuucacuauguuggccaggauggucucgaucucuugaccucgugaucugccugccuuggccucccaaagugcugggauugcaggcgugagccaacgcaccuggccaauauucuuuauaaacuguaaauuauuauucagauauuaucauuacucacuuauuaccaccagugauacagucuuucauuccuuccauggcauccugcugcuuuguaaacaaacggagcuuacaauuuagauugugcugaaauugaagcauucagggagagauaaggagacauagaagagauuuggaggacaucucugaaagagauggaaguaaagccuaaaaacuaggguaugauuaaaaaccaguuuaacuuguaaagguaagcaaacguugccccaaaaggcaaguaaagcacuguugacgacauagcuuugcuacagucaaucaaaagacccagggaguggcccaggcagaaaaauaauucuccagacccuuuuugcuugcuugacucacauuagagacggcaagagcucucuaguuacacagucaacugagguugguguuggcacaagcagauacgcuaugacaaacaguagagcauaucucagggaggaaagacuuacaaagauaaaacagcaaggcauuauuugcuuuggaaaugcuugcuuuauuguggguuuuucuauuugauuccgauuuugguugggaaauguugaaaaacauuaauuugcucuguacauaauaaaaaauauuugucgucacugaaaggcauagugcugauuucuaaacauuuguauugucuaaucuuuggaaauaaauauucauuagacaauuauaauuuacuuauccaagauguugaacuauuuuggggcaaaaccugugaauaaagaguaauguucguuuuguguuugucuuugugugugcaccacgaaagcaacuuugcagcucucaaaaugugaauuguagagacuuagagggccggcauuccacgcccuuacacuucgcagcaggcuacaaccgcgugucuguuguagaguaccugcuacaccacggugccgauguccaugccaaagacaagggguacguguuagaaguuagcuguuugggagucauucucuucaugcuuaaaaaauuuaaaauauuuuugaagucuuagauuuuuucuguauuaaaaaaguaaucguuauuuuuuguuuaaaacauaaauuaaaacauagaaaugugccaggcaugguggcucacgccuguaaucccagcacuuugggaggcgaaggcgggcagaucaccugagaucaggaguuugagaccagccugaccaacaugggugaaacucugucucuauuaaaaauacaaaauuagccaggcgugguggcacaugccuguaaucccagcuacuugggaggcugaggcaggagaaucacuugaacccgggagguggagguugcagugagcuaagaucucagcauugcacuccagcuugggcaacaagagcgaaauuccaucucaaaaaaaaaaaaaaaaaaaaaaaacauagaaauguacaguauagaaauugaaaauuuccugucagcccaccuccugcucagagauacagcauucaaauguugaccuuauuccuccagauauuguaaaugcauagacuugugugugugcuguggcgaugguggugguggugauuuuuaacacaaaugguggugccuuccuauauggucugcuuugcaguuuacuuuuuuccacucaguaguguaucuugaauagucuucccauaucaguacuuaauagucucauucuuuuaaugcuuguauauaguauuuuauuacauuauaugaauuuuguuuuguuuuguuuuugagacagagucucgcucugucgcccaggcuggagugcaguggcacaaucucggcucacugcaagcucugccucccagguucacgccauucuccugccucagccucccgaauagcugggacuacaggcgcccgucaccacgcccggcuaauuuuuuguauuuuuaggagagacgggguuucacuguguuagccaggauggucucaaucuccugaccucauggauccacccgccucggccucccaaagugcugggauuacaggcgugagccacugcacccagcccuauaugaauguuuuuauauagucuguaaguuauuguuuauucuucuuuuuugcuauuaaaaauguacagucucuucuaaaaagaagucauccaucccaaagacaucaguauuccuagaagcauaguuuuauuuuuacuaauucagauacuguauguuuuauauuaguuugcuaaauuauuuugucuaggcaaagcuuaaggcagcuacuuagaaaugugagaaagguauuuuaacugauauuaauucccguguucugaguuaauuucacaucaucucaaaauaagccaguagcuuucuguguaauuacauacaagugcacaguagaauuaaacugcacgauuuaggccucaucgaaccauuauguauuuauuuaucuuuuaaaagggacacaucagacaugaauauuucaaacuguuucagugcauuggagagcaaucagcauuugcuucuauugcucauuuuaacaguuagcauauuucaucccaaaacuaaaaaaaaaaaaaaaaaaugcacuugauacuuugcuucugccauguguuaacuucaacauuuuauucuuuugauguacucuuuugugggagcaucuuuuuguccuuuuagaaugucagcugcuuacaaaucagagcuuagacuccucucagaauaguuugcccauuucucaucugaguagaacuuauaguugacaucgucauuuuucuuacugaauacuucucugaauuaccuggauuaugaauuuucaauauuuggcaccucaauauuuacaccugugcauggaaaucaccacugaaucaccacuaugauuaaaccacuaugauuuaaucaccacuaugauuuacacaacuuuuuaccaagguagaacuugccuaaauaagcuaauuguauuauauuuuuuauaaguaagcauacaauuuucauuagcgaaacucauaaagauaaggauugcugugaguauauauccauccccaagaaacuuaggaaaaaaucuuuacauugaaagaacauuuuugaaauuauuacuccuuauuuagaaauggauaacuauaucuuaaagaacagagguggguguauuucuuuuugcgcaguguucaguauagucaguaccauagaagaaugguaggauuuuuauuauaagaaucauuguaacucaaagguuuguuuuaugacuuuaaaauaacuuucuuuuguuuaguggcuuggugccccuucauaaugccuguucauauggacacuaugagguggcugagcuuuuaguaaggcauggggcuucugucaauguggcggacuuauggaaauuuaccccucuccaugaagcagcagcuaaaggaaaguaugaaaucugcaagcuccuuuuaaaaguauguaguuuaaaaaguuaugaaauauaacuaauuuuauuuauauuuugguuauuacuugaaaguaaguugggguauguuauucuauuaagaacaauacugcuguagagacugcucucauuuucuauuucccagaagaccguuuaugugauaugacacauagcuuugcguagugccuaaagugaauaucugaaaugguuuaaguccaugucauaaaaauucaucaaaguagguuuuagaaagagcugaaauaguuugcauugcuugucuaguacuuauaguauuaauaucagaaaaaacuguacaggagaaacaagcuuuucaaucaaguuggguuuuuuuucuuuguuggcuauuuuauuauuguuaacuaacucauucacuaguaaacaucaaauauugugucuuuaagaacuuauuguaguaucagauuuuuauuaaaacauaagaugaucucuaaaguuguucauauagauuuuagauacauguaaaagagugaaaacuaguaguuauaugaaacuaacuauaauuuaugcucacuuaaaguauauuuuuaaaaaacgaccagauguguauuuaugagauuuucuuuugcuuuuuuuuaacuacggaaaaaaaauugaaguguuuaaauaaaauucuucucccuucacuuuuaugauaucaaauacauucuuaugaaucuugagaaaaacacaauaucugauacucauuuuuauuaucacugguugguaagaaauaacuuccaagucauugugaauccauuguccaccuugacuuacaacuaauuuccgcagugagcccaugacagucuguggccgacccauaauaaaaauuauugacuucuauuuacuuuauuuaauagcuauugguaauuaaacuuuuaaaaucuauaauuuuuaauacauuuauaucuaauuucaugauagauguuaagacuuaggauaaaaaucuuaaaaauauuaccaaacuuuauucuuacugauggccuuuagaauuaaguccuuuuuuaccagugugucuuacucuacucucuucuuuuucauaccuacugaguaucuuuauguaauugaaucuggucaaaauuaacauccaugcuauucuucaaaguaaaauagguuuccaaagacaacuuggagucugagaaaaaguguauuauauagguugucucaaagauacuuaacacucucccuacuuuaucaucaccauugauccugaagcuuugacuguauaguauuaauaguuagaaagcugauccauuauauuacuaaguaggaauuuugcaaaguguuuuucaaaaugcauauagaguagauaucuuccccagaggaacaaagguagaguaaauuaauuaccuaccuaccuaccuaccuacuuacuacagaaaauacaaaccccauuugguuuuucuucuuuguagcauggagcagauccaacuaaaaagaacagagauggaaauacaccuuuggauuugguaaaggaaggagacacagauauucaggacuuacugagaggggaugcugcuuuguuggaugcugccaagaagggcugccuggcaagagugcagaagcucuguaccccagagaauaucaacugcagagacacccagggcagaaauucaaccccucugcaccuggcagguaagcgcccccagugccuccaagccuccuuuuccuuucucggacaccuaauacaguuuacuaaaagacgaaagccaugcugaacacaaaugggacuacuuaguaaaaugcucuugauugacauaguuuuguauaauuucuuauugugaagucccuccauuaugugauaacaguauuagcuuuugaagcaaaaaguauuaaaaccuuaacauuuucugguccuuauuacauauguauguauuuuuuuuccuuuaagcugacacguuuccuguauuuuuuuuacucuaaauagcaggcuauaauaaccuggaaguagcugaauaucuucuagagcauggagcugauguuaaugcccaggacaagggugguuuaauuccucuucauaaugcggcaucuuaugggguaagcauacuaacauuaaaaucuagaaaacugaccgcacgcgguggcucacgccuguaaucccagcacuuuaggaggccgaggaagguagaucacgaggucaggaggucgagacaauccuggcuaacacggugaaaccccgucucuacuaaaaauacaaaaaauuagacgggcauaguggcgggcaccuguagucccagcuacucgggaggcugaggcaggagaauggcaugaacccgggaggcggagcuugcagugagcccagaucgcgccacugcacuccagccugggugacagagcgagacucugacucaaaauaaauaaauaaauaaauaaaauaaaaucuagaaaacuucccuggcauuuacgacuuuauuaaaugcauacuaugcauuaaguaaguagauaucuaacuaauagcaugauuuagcauaauuuuaaucuuuuguucagaguuuugguguaucuucccggcuaagcuuaacuaccuuuuggccaacagucaugcuuuuuauugcuuuuuggucucagcacguuaucaagcacaauaauaggcauguaaugggugcucaguuuauauuuaucaauauuguaauauaauauauauaauguaaaauaauauaauaaauaccaauuucuuaauucuaccucaaguauauuuuaaaaacuagaaaagcugugcagcuguuauacaggcauggaaaguauguuggcuuacauuuaucaucagcaccuuaaaaauauucgaguagcaggcacaguggcaugcgccuguaaucccagccauucgggaggcugaggugggaagaucgcuugagcccaggaguucaaggccacccugaucaacauagugagaccucaucuaaaaaaaaaaaaaaaaaaaaaaaauuaaaugguugagcaguugauauauaugguuucagagaguaggaauuacuagcuaaaaccuccaggugaaaguccagaguuuuggacaugaaguccuugcccacgccuauguccugaaugguaaugccuagguuuucuucuaggguuuuuaugguuuuagguuuaacguuuaaaucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagauaguuguagauaugcggcauuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggcaaugcaggcucuuuuuugguuccauaugaacuuuaaaguaguuuuuuccaauucugugaagaaagucauugguagcuugauggggauggcauugaaucuguaaauuaccuugggcaguauggccauuuucacgauauugauccuuccuacccaugagcauggaauguucuuccauuuguuuguguccucuuuuauuuccuugagcagugguuuguaguucuccuugaagagguccuucacaucccuuguaaguuggauuccuagguauuuuauucucuuugaagcaauugugaaugggaguucacccaugauuuggcucucuguuugucuguuguugguguauaagaaugcuugugauuuuuguacauugauuuuguauccugagacuuugcugaaguugcuuaucagcuuaaggagauuuugggcugagacgaugggguuuucuagauaaacaaucaugucgucugcaaacagggacaauuugacuuccucuuuuccuaauugaauacccuuuauuuccuucuccugccugauugcccuggccagaacuuccaacacuauguugaauaggagcggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuacauuuauugauuugcguauauugaaccagccuugcaucccagggaugaagcccacuugaucaugguggauaagcuuuuugaugugcugcuggauucgguuugccaguauuuuauugaggauuuuugcaucaauguucaucaaggauauuggucuagaauucucuuuuuugguugugucucugcccggcuuugguaucagaaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuuugguggguaaacuauugauuauugccacaauuucagagccuguuauuggucuauucagagauucaacuucuuccugguuuagucuugggagaguguaugugucgaggaauguauccauuucuucuagauuuucuaguuuauuugcguagagguguuuguaguauucucugaugguaguuuguauuucugugggaucgguggugauauccccuuuaucauuuuuuauugugucuauuugauucuucuuuuuuucuuuauuagucuugcuagcggucuaucaauuuuguugauccuuucaaaaaaccagcuccuggauucauugauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuuguaggcauuuagugcuauaaauuucccucuacacacugcuuugaaugcgucccagagauucugguauguggagucuuuguucucauugguuucaaagaacaucuuuauuucugccuucauuucguuauguacccaguagucauucaggagcagguuguucaguuuccauguaguugagcggcuuugagugagauucuuaauccugaguucuaguuugauugcacuguggucugagagauaguuuguuauaauuucuguucuuuuacauuugcugaggagagcuuuacuuccaacuauguggucaauuuuggaauaggugugguguggugcugaaaaaaauguauauucuguugauuugggguggagaguucuguagaugucuauuaggucugcuuggugcagagcugaguucaauuccuggguauccuuguugacuuucugucucguugaucugucuaauauugacaguggggacuucauguccaaaacaccaaaagcaauggcaacaaaagacaaaauugacaaaugggaucuaauuaaacuaaagagcuucugcacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaagaaaugcucaucaucacuggccaucagagaaaugcaaaucaaaaccacuaugagauaucaucucacaccaguuagaauggcaaucauuaaaaagucaggaaacaacaggugcuugagaggaggcggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaugaguauaaaucaugcugcuauaaagacacaugcacacguauguuuauugcggcacuauucacaauagcaaagacuuggaaccaacccaaauguccaacaaugauagacuggauuaagaaaauguggcacauauacaccauggaauacuaugcagccauaaaaaaugaugaguucauauccuuuguagggacauggaugaaauuggaaaccaucauucucaguaaacuaucacaagaacaaaaaaccaaacaccgcauauucucacucauaggugggaauugaacaaugagaucacauggacacaggaaggggaauaucacacucuggggacuguggugaggucgggggaggggggagggauagcauugggagauauaccuaaugcuagaugacacauuagugggugcagcgcaccagcauggcacauguauacauauguaacuaaccugcacaaugugcacauguacccuaaaacuuagaguauaauaaaaaaaaaaaaaaaaaaaaaaaaagaaaguccagaguuauccuuucaaacacugucaucaguuguaagaggaagagagauggauugcagugccuugaugccguaugucagaacugacugacuggaaguaacuaaggcccacucaagccuggcucacggcagaaauaggaugaaugcucaugugcuugacaguucauccacuuaaucccuucuugacuguaaaaacccacagaugccaguucauacguaccagguguucucacaguuggaaucacucuugauagaaggugguuucuagauuugcaaaagccugacaaacuauaaauaaaaaccaaaccaacccaaccaccuugauuaccauauucuuccuccuaccgccuucucccuggcccuuuguaaugagacugucgucucucagacccauuuuacaaagaccuguauuucagagagaggacaaaucugagugaggauacuuuuaaggaaagcaacaauccgguuuuuugaaagaaaacuaugcuuccaaguaugauauaaauuaauugaaaguaucauauuuaaugaguguuaguacugaaauccucuugaaacuacaguauuuaaaguuaccuuucuaaagaugaguagucuuuuauuaaaauucguagaaauuuuaaccuuccuucacauaagguucucaauuucucugagcaacaaauacuucuaccaaagacuuagcaugcuaaauauuugcugcuaacauacuacauauacauuuauauguaauucuuguuguuuuuuuuuuuuuuuuuuuugagaacaggucggacugcaguggcgcuaucucagcucacugcaagcuccgccucccggguucacgccauucuccugccucagccucccgaguagcuggaacuacaggcgccugccaccacgcccagcuaauuuuuuuuguauuuuuaguagagacgggguuucaccgugucagccgagaugaucucuaucuccugaccucgugauccgccugccucggccucccgaagugcugggauuacaggcgugagccaccacgcccggccuacauguaauucuugacccuuaaguuauaacuuacacauguauaucauuuggagacaaauuuucagcacuucuuagcauaauuguucucuucauaugguuuucuacuaauccuuuugcuaagcuucaguuaaggguuuauaaagccaaugggaucgguagaacugaaauuagaucuuuuaucgucucuguaaacuuacuaugaguagggacagaugguggccauagaauuauaauaaugaacugaucuaguaaggcuuauguuacacugucaacuguguagacuacaguagaucccauacauuguggauguaaggaaguucuacuccauuagccuucaccuuucacagucuuuauagcagucacggaggauaaggaaaagaaaaauuaauuuauaaaguauuuuaccuuuugauccucauucuucucaugggauagcguuaagauguguucuacugcauuagucuucaccuugcacagucuuuauagcugucacagaggauaaaggaaaguuaauuuauaaacuaaguauuuuaccuuuugauccccaucaguuaagauguuacuuacucuacgugugugucacucgaugaccacugugaagacaguaaaauguacagugguucucuuguggcucaagcguaauguagaguacuggucgaccuugucuaacuucacguucccuugaggcugacuugcugucaccugaagagagguguaaugcaaucggucuccugaccggaaguccacucuuucauuuucauaaacuuuauucaccaucacccauaacuccccuucuccuuuucuaacuccaaguaagaaaaaauaaugaacacuuuuuuucacuaucucuuuuuaugguauccucuuuuuauguuuguuaaaucccuacuacuuagcucuuuguaaaugaagguaacuuacugaggugagaaugaucaaaaaauucuccaggccuuguaaagggcauuugauagagguuuugaucaaccugguucaucucauccuuguauggaagaaugcaaaugggcuacauaauguguuuauagcagguauuuuuaccucauugugaggguggauugagucacucaaaaauuuuuuucauguauuaaacuuguaaauuuaaaaaucaggcauccgugaguugaugacuguuacuuuuuuuuggcaaacuuugacucuggugauuucuagaccuuuuuuuaauuaccuuuuuuuuuuuuuggucagauacaugagugugauaauaccuuuuuuuuguuuuuuaacaugggcaacccacuucccucagcaaucucgcaugacauacagugacucucaguugguauuuucccuguucacgaucucugcuccgcaaaauaauuuuauuuuaugccacuuguaaaaccuauaaucuauuauuaguaaccaaucaguaaccauauuaaguaguauuucucuuaaucucaauuaauagacuuaaaguaaggcuaggcaugguggcucacuucugcaaucucagcacguugggaggcugagacagcaacaugguuuaaggccaggaguuugagaccagccugggcgacauagugagacccuaucucuauauaauuauuuauaaauaaauauuuaauaaauauuuauuuaaaauauaaugaauuaaauuaagaaguauuuauuaguacuccuuaaauauauauacuuauauauuuaaggauauacauguauauccuuauauuuaaggaguaauaaauacauacauuuauauauuuaaggaguacuaauauuaacacaauauaaaaaguuuaaaaagcuacuuugucuccccuuaagaguagauacaacuguguucuauuauuuguagauugauaaaucuguguaucuuucaaaaguuccuuuuuauucauucuauccugccuuggcuggauauuuuaaugaaaucauaggacuccagucuacauuucuauuaggauagaaaaacacugauuauguuguauucgucccaugaauuugaugaugcuugaacuagccuggccacauaucauuuuguggaguagauuuucuguggcauaucaucuggaauacagcuucuauucugaaaaucaagcaauuuauagagcaacuguagguauaguguuacccagugaucucuacuuaaaucauuucuucuuccuaauauuaucucuuucccauuuucagcuuggaaggaaaauggcucuuguguuuuagucuagcaaacucugcaggcaccugugguuuaauggaaaaaccugaacuuagggucugaauaucugggaucuagucuuuccucuucuguuuuauaacccaguagucuucagcaagugucuaacuuuuucucaucuuugguuuucucaguaguaaaaguuggauuccaagaccuccuuuccagcuuguuguaaugauuaaaugagaccaugcauguggaaauugcauuaacuaauguaaggcauuauaaaaaugcaagguaauacuguuauuauaaaauaacuugcuucauggccgggugcaauggcucaugccuauaaucccagcacuuugggaggcugaggcgggaggaucuuucaagcccaagaguucaagaccggccuaggcaacauagcgagaccccauuucuaccaaaaaauacauauccauaucuauagauguauagauauuaaaaauuaguaaauuccuugcuucccacaguuccuguacuaagccagucagaauaagggcugcaugucacuccuacauuucacagccuuaggaauaaucuauauauuugacuggcucagugcuguguuaaauaaacacagauuaauugacuaggcugaggaugaaauaauaaucugagguagcugugaaauuacauaguuauuuacuuauguaguuauuuauugaucauuauuccuucauacuuauuuacuuuuuuccccuagagagcucaaucugcucugugugugucuuugagccuuuuuuguauaaaaagaaccucaguuuuuccaaauggagaaaaaaauacauauuuauuuaagaagcaucaauaaaaauuacaaguugcaugagaguugauauuagugguagugugccuuacugugucgguguucuuuauauaauaaugccuuguguuauauuugaauacauguuuauacaagacaguuaacuuuucugcuaagucaguaaauggcauugauacuuauuaccacaaagcauguaaauuuauaucuuauaagaguaaaucaauugacugauucauuuucucucaacuguuuuuauuuuccagugcuuucucuaaaauggauaacauuuggggaauuucaugacauaauuguaauaaagccucuguacaauuaaauggcuuuaacugaagccaagcauguuucucuuuccccuacuucccaccuuuuuaaaauuaaaagcuucccagucuuuuuagguuguauuugucauuuaaagcauuuuguauugcagcuggauucugaaacuagguuaaauugucuguuucuccuggaaacauuccaacagagaucaguuucuuuucuggaccuucuaguucaauacuuugcucuuauauacuguguugaauagaacugaacugcuauuuauuggauuugucagccuuaaauuccaguuacuauuuuugccucaaugguguagcuauuuaaaagaauuaaacagcuuaagaacuguauuuuuagucuauuuggguaguaauauacuccuuccuguucauuguucuuucagacauuugucagaaaauuucacaagcauguaguugguuuguccaagcauaaacuauaacuucaauauaaagaaagcuuaauaauacauaccagauauacaauucauuuuauacacacauacagaaacagguaauuuuccuuggacuuuuuguaauuuuggaagccuguguaaauuagucuaccagauuauauuauucggccuguaaacaugggaguucaauaaaauuaaucaucagaaacacaguuuaaguagcuuguaaccucacuggggagaagcuugaaauuauuccgugcuuuuggguuaacuuaacaaaaauugcugccuuuuuucaacauauagccuuugaauaagggagauaaauuacuagguuugguuuuguuuuaggugauuuugauaauaccacgagugguaccucuguuuucaucuuuuguguuagaaaauuuaaaaauaauuaagcuauagaauuaauuuuauagugauauuauaaucccagaagaaucacaaaacauccuguucugagaagacuuagucugauuaugcugcuuauuuauuuuauuuuuuguuuaugggguuuuuuguuuuguuuuguuuugagauggaaucucacucuucacccaggcuggaaagcaguggugcaaucuugacucacugcaaucuccgucucccagauucaagcgauucuccugccucagccucccaaguagcugggauuacagguguguggcgccacacccagcuaauuuuuguguauuuagcagagaugggguuucgccauguuggccaggauggucucaaacuccugaccucaaaugaucugcuggccucggccucccaaaguggugggauuacaggccugaaccaccacaccuggccuauuuuuuguuuuugggggcguuuuuugcuuuguauuauuagagcaaauguggaagcuuuccuuaguaguuggcugaucuguacuuuuguuuuuagauaaauguucuucacuuuguuuucagaaacuacuauuucuaaaauuaggaaauacagauauuuauauuacauaaaguuaaauacuaccucagaaaaagugccuguucuuuuugaagugagugucuucaagagugcagggaagacgauaucuuaaggaagauagaaagugacaugcauuaaguugcaucuugggaucuuucuuggccuucccugucuuuucccauucucauaaaugucuuccuuaaaagccucaaugugugguagucgagcagcagcaugaguuagaaauuuauuuucaauagaugaugugcuuuugaguuaauuauccaaacugaccaaguuaugcccagaaaugugucuguaagggacacaaaugugccaguugcaccaaauuauagcauacuggaguugaaauggaucucagaaauacuuaagugcuaaccagccuaacauccuaaauguauuuauaaaaauauacaaguuauuuuuaauauucuuaaaaagccuauuuguugaaucaguagugccuauugugugaucgauugucuuagcuuauuuuauaaggauuuuugggaagaagcugaagccuuuugcuauguggagcucuugcuugagugaaccuggucuccauggaacuugcuucuguauuggcuuuuauaguccugcuccuuuauaguucuucuccagcuuccauuuuuccuuuugucuccucugaggauuuuucuuccacucuccuuuuccaaaauauuguuguuuucaagguuuuauccaccuuguaauuaucuuucuguauuccuuuccuuaaugagcucauuuaucaaguagcuacaacuauuaauccccuauuccauuucguaaucucccuggagcccccagccccaguccucagcccuccauagguauugagcaaaugcugguugguaggugaguggugggagagugaguaagugaaugaugcccccucgacugugcuccaaccuuuucugacaaacgaucugcacaaugucuuuacuuugauguuuuaccucagaaggugccuaccucagugagccuuaucugagaguuucauaccuacuuaaacuuuuuuuuuuuuuuuuuuugagacggagccuugcucugguaaccaggcugcggugcgguggugcaaucucagcugacugcaaccuccgccuuuuggguucaagugauucucuugccucagccucccgaguagcuuggauuacaggcaugcaccaccaugcccagcuaauuuuuguauuuuugguagggacgggguuucacuauguuggccaggcuggucucgaacuccugaccucaggugauccgcccaccucagccucccaaagugcugggauuacaggcgugagccaccgcacccagccccuacuuaaacuuuuacaacucaauuucuuuuaauaguucuaccuuauuuucuaaucuuccagauuccccccuccuucccccccucaaaaaaauguagucaucuuugacuuuucucucucucucuucuguugugaauuuggcuuuuaaacacaauuuuuuuucuuucaaaauuucucagauuuagcccuucuuuuccauuuuucuguaacugucaaugguucagggucucaucaccucaugcccagguuauuagcaugucugcugcuaacauuuccuccacccggcaaucauuuagacauaacagaccaauuuucauaaaauguuauguugcuuuuucaaaggcuaaagagaaaacauugagaaucuuugagaugaguauuucaguaaaucugauugcaguagguagaaaagaaaugggaagauaagagaaucaaugugaauagaaugcauauuugaaaaguuuggcagauagauuagaccauuaacagaagauuugaauuagguacuaguuucacuuuacagaaugaaacaccuuacaaaguauuuguuuuuaaaauaaaguugaauauauuagagggaugcauuuuuugaaaaaaagcccaugaacaguuacaggguaauaguauaauuguguaauugagauuuugaaggaggcaagaaaagauggaguccaaaguguaaguagaagacugaaauacucuuuuuuuuagaagaaacuucuguuaaggaugaaaauggagauacagaggagugaauuguuaaauaaaaacagguauacacaauggugcuuuaccagaugaucucauucuuaacucuuuguauccuuuucuuuuuuuucagcauguugacauagcggcuuuauugauaaaauacaacacguguguaaaugcaacagauaagugggcguuuacuccccuccaugaagcagcccagaaaggaaggacgcagcugugcgcccuccuccuagcgcauggugcagaccccaccaugaagaaccaggaaggccagacgccucuggaucuggcaacaguaaguccucauuucagauacugauuauuguuccuucuacuuucacagaugacaucagauucucggguucaccagcuuacuuuuagucguguuuauuucacuuagaacagagaucuucugaaaauuuuugaaguucacacuuuuucuaugaaaauauaauuuaaaacucuuaagacaaacuaaacaguaaguuaauuuaauuuuuugccauucuuagccugcugggaaaacauggaucuuaagaaaacauguuuuuagaguguacccucaaagaauuauauuuaguaaaauaucuuguaccuucuauauuuggcauguuauuguagagcaacuaauguucaugauaauuuaccuaagucugugagauagucaaagaaaaauuaacucugggcaguauuauuuaacugcaaaguuaagcacugcaucaucuuccgugaacuuucugaaaaccagggaguuacuguauagucacaguaauuucuaauuuuuaagccagaaauguuuuuucaaguuauguucuguuucauuuauugauugcugcguaacaaacuguuucaaaacacccaguggcuuaaaauaauaaugacuuauuauuucuuaugauucuguauguuggcuaggagauucuucuggucuuaccuggggucacuugugcaacugcauauagcugguggcuggggcagaaacauaaagacggcuucauucauaugccuggggccuugacagauacaacuagaaggcaggggccucucuagucccauguggcaucucaucauuaaguggucuuguuagaauuucuucacagaauaauuguaucucaagagggagaaagcagaggcugucauuguucuuuaaggcuaagccuggaacugacaugcugucacuucugccacauucuguugugcaaagcaagucaugaagucagcucagguucaagggauaggaaaacagauuccaccuucuuugaaaggagaagcaaaaauuucguggccaucuuuaaucagccacagucuucccugugaauacaaauuaaaucuauuuuucccacauucaaauuacacucaccugccacgugcuccccccaccaacagggggcagauagucaucacuggguccuuagcaauucuaaaauucagccagacacauguuaucagggccaucuacucuggaguuagggaaugaucccugauuagggcccaguucugcucccagggagugguucacuguggcugucuuuuuuuuuccuuuuuuuucuuuucuuuuuuuuuuuuuucccccuuaagacacagucuggcuaugucacccaagccagagugcaguggcgugaucauggcucaccacaaccccaaccucuuagauucaagccauccucguaucucaaucuccugaguagcugggacuacaggcacaugccacuaugccuggcuauuuuuuuuguuuuuacuuuuuguagagacagggucuugcuauguugcccagguuagucuugaacuucugggcuccucccucagccuccuuccucagccucccaaagugcugggauuacaggugugaaccacuguacauagccucuguagcucuuggccaugcccucugaauuauccuucucuuuucauaagaaauggaucauauuuacagccaaguggcuuucucaaccuguucccugcuccuagaaauuuucgggacccugagccuuuuaucauuuugaucuaccugucccuuuuaguccaaacuaguacaacucuuccuuuguaaacuuuuggauuucccaucaaauuacacaccacuccaucagccaaaagcuccacccacaaaucuuuucaagacaggucccucucuaacauggaauccaaguaaaggugcagugggacaaugcccauaagauccuuugaagcucuuucaucuagccaagggaauucacaagguaccaccuuagagguuuuuuaaagauuuugagguaauauaucuguaccucuaguugauuuuuauucugaggccauguuuuccugucagcacgcuggauuugaccuuuggccugaggcugugccuuacuugaagaaacuuuugcugauggagaggcugggaauggugaauaauuuuguuuucuaagcuagcaaauguuaggugaauacauuuccuuaaagagaacuggacaguuccuuucucucuuccuguaccuuaucaugggcagauaaacacaccaguccaguugacaaggcagaauuuguucuggaaauuuccuuagccaaauuuacaaauuuauuuagguuuacguucuaccuuccguaagaccuccuguggcagcguugccaaacuuucugcuacacagcauuaguccccuuucucucgccuucaguagcacuugccuaucuaucuuccauucacagccucccucagcaauaaccaggccacccuucacgccuccaaccaaagccacauguccaccagcaccccacuuccagguacuggugugcauuucauuucucuauugcugcccacuaagccacccccaaacccacugaggguuuaacgugacaauuuauuauuucucacacgucugggaguugacugggcucagcugggugguucugguuuugcaguuaccugcaccugggaacucagcagaggcuggagcuuccaagauggccuuucaucccgcagggcucucccugcauaggaucucaccacucaguagucuagcccaaacuucuguacaacauggcagauggcuucuaagagaguaaaaguagacacugccaauccacuuaaagccuggcucaaaagccucagaaugucacuucuucuccauucuauuggucaagacaacucacagggcaaaccacauucggcggguagggggcagaaauucaaggggaggcauacaugacgggaggaaggaauugauggguggcugucuuuggagacuaucucccgcauacucgaaaagcaguugcaucuaauacuuaaaaacugaaaaguuuaugaauaaaugagcuaaauuaaagugucaucccuuugaaauuucaccagauguuaauuguacaugaaauuauuaagugugaaguaaauaaccagauuauagcuguuuaaacguaaacaaaauauaguaaacacagaaauuuuuucuaaagaagggugacaguuaacacugaaagugcuuuuuuuuaaaugaaagaagaaauaucuuuaaaaauuacauaguuucuccaauucugucuacugaaacuauugaaacucuuuggagcuguggauaggagaaggaaugaucaaaaaccaguaggugauaaugaggcauucauuaaggaaaaaauccacaaaguauuugguuaucagugaaaaacuuaccauuuuaauauauaguauuuucaugguuuuuguuuuuaaucauuuuuuuaggcugacgauaucagagcuuugcugauagaugccaugcccccagaggccuuaccuaccuguuuuaaaccucaggcuacuguagugagugccucucugaucucaccagcauccacccccuccugccucucggcugccagcagcauagacaaccucacuggcccuuuagcagaguuggccguaggaggagccuccaaugcaggggauggcgccgcgggaacagaaaggaaggaaggagaaggugaguagaccccaugaaugcuuauuuauuuauaccuuuuguuaguggagcagaaugacuuuuuucuauugauaacuauugaaugccucaauuagagacguccugucuguaaauuuucauacacacaacaucuuacaagaaauauuucuucauagaaggcugccacguuucuuggcauugucguuguucuuauuucuguauauucuagagcaucuguuuacaaccauagcaucuuauugaaccacuuauacugaaauugugucagaacacaacugagaggucauuucaggaaugaaaacuaaaaugauagcugauacauuuagauuuuuuaauucauuaaaagcuuuagauguuucuauauaaguagcauucuguaguauaagaauuauacuauaauguuaaaauuaguauaauauucucuauauuuuuauaaauuacaauaaguuauaauucuauauucuaaccauaauauuagaauacaaauacuaauuugauaaagauaaaacacucuguuuuuacuucccaaucaacuucagaaauaaagugucuaaauuaaaucuguguauucuguauuauuuuaugccauggaaaaucaucugacagccaagguugucagagucaugucuaaauggauacugaaauuuucuuuauauuuagagaauucuuucugagaaucuuuaauauguuucuguuuuaguugcuggucuugacaugaauaucagccaauuucuaaaaagccuuggccuugaacaccuucgggauaucuuugaaacagaacagguaaauacucuuguauauauuugagucauuuaaauuaaauacuaagauuaggcuggaugcagugguucacaccuuacucccaacacuuuggaaugcuucggcaggauugcuugagcccaggaguuugagaccagccugggcaacaaagcgagacccccaucucuacaaaaaaaaaaguuuuuaaguuagcugagcauggugacuuacugggccccuguagugcuagcugcugggaagcugaagcaggaagaucaugugagcccaggaguuugaaacugcagugagcugugauugugccacugcauucuagcuuuggcgacaaaacaaaacccuaucucgaaaaaaaaaaaaaaaagaaagacuuauuaauugccacccaccucuuccucuuuugcuucuuacgagcuauucuuaaacccacaacacauuucuauaagaagccagaggagcccaguauuuuauacuucuccccaaaauugucuaacaaaugagucuuuauuuuaucuuuauaagcagucuagcacuaugcauuuuauuacaugucaaaacuuagaccaugcaacuaccucaaaagaauguuuucaugauuguccuugguuguuuguuuccgaaaaaugucagucuuuauucaucucauuucauuauucaugugacuaggcuccugaagcaguugcccauuaauuuggaaagcacaguaguacuuagacaacugcacuuuuaaaaaauugccccuuuaugaaguuucuguuguccacuuggagucuuaaauaauauuaaaccaaaaguuggccauacauuccaauagacccacccuauuuugggauccaucuuaaaugucugugaaggucuaaggauggagucaucauuagggcauuuaugaauuaggauucuucuguuuguuuuacuguuuucauacaggauaaggaguuguaauauuguaugcuuucauuauuaugaucagcuuuaaauauugaaugaugguaacuccugaauuuaaauggacuauugauauacaugaaauuuaagaaugggaaagguguuuagagaaaaauuauucucccagguguagggaucacccuuguauaauaacacccauguuaguccuccagccaaggaagauaucuuguuacaauuugggacagguguaauagaaugcuuguaacuuaaagugugccaaaaucugcccguagguauaauuccuuuguuuucagcuuacgcuuacgcuuacccuguuuugcacagagaucuaaucuccagucuacauauguauucaguuucagaggacuauacucccuacagaggcuguaggggagaaucuauuccaugccucuuccugcuucugaugguuggcagcuuccuuggcuuguggccaugcuacuccagucucugcauccaucuucacauugccuuccuguccucucuaucucuucuaaggacauuugcauugaauuugaggccaccaguauaauccugggugaucuccucaucucuagacccuuaacauaauuucgucugcagacacuuuucuuccaaggaaggugacauucacagguucuggggauuagaacauagacguaucauuuugagggccaccauucagcccacuacaacauaauauggcccuagauaucuuuuuaagaccuagucaacuuaucagaggugucacccuuucaaucacccaccucuacacaucuuccccuauuuuagaauaaaucuguuuuuucaauuauucuuuauaugacauaauuuuccaguauuucacuggcaccuuuggcccauuaugguucccuucuaggcuuauagucaguuuggaguuaacuuaaaaaccaggucuuuuuucuuauuuauaucaauuauacuguuaagauuuuuuuucugcuuucucucuuuuuuuuagcuacauuuuuucauuauaguucaucuuuaaugcucuuaaugauaagaacagccgaguagggauagcacuggacuaaaagaagaccuuaauucuaauuauuuuuacccucuuacuagcuguguaaaauugggcugaaugacauuuauccuaucacuuccuuuaccuguaaaaccuaaugcuuauaaauguucagagaguuaaaauccucaguaauauugugcugcugugucagcuuuuaauacagugaugcaucacaggugccuuugcgucuaaugguuaggacuuuauagacugcugucuauaaaaucauuuucuuuuccaaccauuuauucauccucugguuuggagcuuucuuaggacaauauccuaaauaguaagacugcuucauccuuauucccuaacugaaggugugaaagcugauuuaaaaccauuauacucugcuguucccauauuacagcuauagcuguucuucccaaaucauuuccacaauaauuguaaaauuucaaacacaucuuugcuaaauaaaccaaagaccuuaacucaaacaaauaauuccaauuuacugaugaaaguuuucuaaagaauguucauuuuucuucuuuuagucaguuugcauuauaauuuuauguguucuuuuuaaauuuauaucguauauucgcauugucaguaacugacuuccuguggcguauuuaucacauuuuauugauuugaauaguuuaauaguuuagucuccuagucacuccuucugacagcuuguccugguuucaucaguuucauuguucuuuuuuuacugcaguuucauucugaguaaaugguuccauugguuuucuuuuagccagaauaauuucuauagccuuuuauugaucaauacauagacgauugcauuuaauguauauuaccaagcacaguucuuucccuccagacaggugauacuaccuuucuuuguauugaacugugucuggcccaaucaucaagcaaucaaauuuauuuuuauuuuaauugcaaauguuauuuaucuagccuuccauuauaaauaaauuugauaaccuuuuccauaacuuuaacccuuagcauuuucucccauuaacauucuauaucaguaauaugugaugauggucaauguauuuguauagucggggaggagugagggugcaugcauugaacgcauuuaauucauaucuguuuggcuuaagccaggggagccguuguuuucugaugcucuuugacaugcuucuaugucucauugccuguguuccuacucauggaugccagugggguguggaauguaguuauuuuauuucuggucccagaagaaaaccuucggcacaucauagccucaccuccuaucuucacaguuacucucuuggaagucucuaaacuaaauuguccuguuucccauagauacuuugccaaguucuauguugaauaauauaguauccuuucuaguuaaugaaauauaguacccaugugacuuuggcccuuccuuuauaacauagcuuuguaccuaugaacauagguaggaacacuuuuuauaugggaaagacagauuuuauuuacacugcaauuccuagaacauaaaugcuaucacuuggaagacugcuuguggacauuuuuaugguuaaccuauguauuuucauggaaagugaccagauaaauuuugauuucaaauucuugaagacaaaagcauggccucccauaauucauugugaacuugauuauaaaguuaguucuuauuacuccugcuguaccauacaaccuuuuaagcccaagcaagaggacgucuuuuucauuaaaacuaguuuucucuccccacccaaaguaaaaugacucucagaagcuagagguagcucuuuuugcagugaccuuugcuuuaugugcaagaugacuuuaacugacacguggauaaucuuuauucuuaguaauuuuauuuuaauguauacuagauagaaauaacuagcccaacaagcuugugauuuccucaguauaauaacuaagucaagguuuuaaaaaaggagcaaguuaauuuaaauaugauuuucagaaaaaaaaaugucuaacagcugauagggguauauauaaaauuccugagucuugaagcaacaugucuaaaauccaacuaaccugcuuuccauccagauauuucuauuucuuuuguugaugcaaaagucucauaguuacccagcuacagaauuuuggaauaaucuuacuuucauuccuuuuauuuuaaccauuucuauuuaccaggcccuguaaauacaguucuccaguugcuuucagauucaucccuuccaugccauuuuaucuucuucuuauucccaguugccuucccuuccaaaucugcccuucauaaugccaacagucucauccuccuaaaauacaacuuugaucauauuacucugcugaaaagacuucccagggccuuugguauacuuuuuuuguuuuuguuuguuuuuuuuuguuuguuuguuuuugagauggagucuagcucuguugcccaggcuggagugcaguggcgugaucucagcucacugcaaccuccgccucccagguucacacgauucucuugccucagccuccugaguagcugggauuacaggcauaggccaccauacccggcuaauuuuuguauuuuuaguagagaugggguuucaccauguuggucaggcuggucucaaacuccugaccccgugaucugcccgccuuggccucccaaagugcugagauuacaggcaugagccaccacaccuggccagccucugguauacuucuaagccucuuaguuugauagauaaggcccuuuaagauccucucugugccugcugcucugcugugcuccuuuuaauccuugauacauacucuccuguaaccauuuugaacuacaguacuuaaggucccucaaauacucuguauucuuuuaacugauuuucccuuugcacaugguauucccucugucuuaagcccacuucccuccuuccccugacugaugagcuccugcugcuuagcugaauuaugaccuucuucugagaaccuuuccucaucuccuuccugcuccuuccuucccagccccccuugcaaccgugaccaagcaggucaccuucacgagaguucucuuagggauuguccaagacauugacccacuuuuuguuucuugguuaccucaaguaaauagcaugaacuuugguuagcacucuguuucauggccccacucuuuuacuaucaguuauuuggaccaacuauguaacuuuccaacuauaagggguuguuuuagaauuaaaugaaauauuuaguuacuuuuuaaagaaauacauagcauaaagaagguacucauuaaacauuuuauaugugaaugagcuaacauaaaucugaauuucuuagcuuuucauugaagguuuuucaguggccacugccugauagauauguggacaaauuggacaccauguaacucacugcgacuaaauuuaacgcuuaaucauguccaccuucuagucauccuuuuaaagaauauaaacagggaaaagacagauacagcuauacaucucagcucuucuguguacuauuuuuaugacuucucuaaguaccagugaccucauaaauacauuaauaguacuucauuaucugucauuguaaggauuaaaugaggaaauguaaauaaagugcucggaacugugcuuguuauguagcgaguacacaacaaauauuguguggauggugguuggaugaugaaugguuggauggaauugcaagaauaauguauauuuauauucaguugcaaguauagaaaguugucccauucccuuuuuguuuuuuuuagauuccacagguugauagcuuuucaucucuucuauccuucaggauagccuaauaaacauuuucuuuuguuucuuuaguuacuuauuuucauaugcauuccuuuugugugacuguaaguaucuaauuggauaaaugccaagauagcguagguagaucacuuaucuacugcuguguaacaaauuacccaaaacuuaauggcuuaaaauaacaaacauguauuauuccacaguuucuguaugucaacaaucuaagcauggcuuaguugggugccucuggcucaaggucuguccugaagcugcaguaaacuguccaacaggucugcagucucaccuggggacucaccuggcaagggcugggacccgcuuucaagcucucucacaguguugguugacuggccuugauuccucaccugugggccucuccacagugaccuuauggaguauuacuuaccugcugcugcuugauaaauuaccgcaaacucagcagcucaaaacagcacacauuuugugagucaggagucuaugcacagcuuaguuguguccuuugcuucacgaucucucacaaggcuacagagcauuagccagggucaguaucucaucuaaagacucuacuggagaaggauccccuuccauacccucacgugcuuauuggcaggauucagucccuugcagucuguuggacugaagcccucaguuccuugccaugugagccuguauaacaugguuucuugcucuaucaaagccagcaagagaaagaugaucugcuagucacuucucaucaccauugcuguauuugcuugguuagaagcaagucacuaggccagccugcacuccaggggaggggagcacacaggaugugauguaaggaggugggaaucauugagucugucugccauagcguggcagccaguucuucuagggugagcaguccaaagcgugagcgcccaagauggaggccacagucucuuuauuaccuaauguaaaaaguaauuucccaucacuucugcuguauuauauuuguuagaagugaguucauaagucugucucacacggggaagggauuacagugaagacacaaaugccaggagguaggagagcacuuuccacguuaggugugagagcuccucucagccuugccuucuaaacuaagugacuugcuaucagucuuuucagguuguuuuguugguuugguuuggguuuuuuguauucauuuuaugauuagagcuauaaaaugaauaaauauauuaaauauucuccauuacuccucuagaacauuguagagaauauuguguuuugcuggccuggugucugcuuccuccagacgugcacuguauguaucaauccagaaaagucugacgagggccaggcgcgguggcucacgccuguaaucccagcacuuugggaggccaagacgggcagaucacgaggucaggagaucgagaccauccuggcuaacacggugaaaccccaucucuacuaaaaauacaaaaaaauuagccgggcgugguggcgggcgccuguagucccagcgacuugagaggcugaggcaagagaauggcgugaacccaggaggcggagguugcagugagccgcugagaucgcgccacugcacuccagccggggcgacagagcgagacucugucucaaaagaaaacaaaacaaaaaaaaaaaaaguaaagucugagaauucucuaaguugaaguuaccacauagauaugagacccuugguuuuaaacugaaguuaguuuagaauauuuagaagaaaaaaaugggacaucaauaacauaguuuccaaauuauauuaaaaucaugucuagcuaagaauguaaaggcuccuauuauuuugugaacuauuccaucucaaagauguguauuucagaacugggguuuguuguuuuguuuuguuuuguuuuuaaagcucugcugaaaccuuucuuuugggugguuggaugugaauugcccgcuuugugcaaugaagcaauuauugcuuaaauggccacuuagaagcaauauagaaaauuauuuccaaagaacgagugauauaugcucauuucacuggaaagaucaaacucauauuuuauucugacaaaaaaaucagcagagguccaggccuaauuugucaguuuuuuaaauguuacuugcaaguuaaaaaguggaaaaaagcgaucuuguuugaguuggaaacugcaugucuauaaaaggauuucuugguuuuccaaggcaggggaaaaucaaagacuaaucuuguagacuaguauauggauugucacaaagcuagcuucaucagggcuggaaaauugcauguucagccuucaagaaauguggcuacccgcguucauccuguguguucagaauguagccacugggugguaguagagucccagcuacuuuaguccauaaaggaauuagguuauuuugagccaacuaaucaucuccauuuuacaaggaugaauaaccaaaaguuaaaaacuaaccaaaaauuaaaaagcacuauguuguauaaaaacagaauguauuuuaaggagaagggauuaagucugagaauuuaugagagaguuuaaaaagaaucuaauuuucuuauccaaauuggaauuuuaaaauguagccucuuuaaaacaguuuguaaucuaaccaaauacuugagaugucaaucucacugcuuuuuaaggaagccugucccgggcuugaguauuucuuagcacugagaaguucuuccuuaucuucaucuaaaaauugcuuucuccuuuuccugcguuguuuacuugugcugaacgccucucccuuucccccaccguucauuucuacucccugcuggauacuaggaucugguguuuucccauuuucaagcuacugauuccuccucuaucuugaggcaagcaguagaugauagaacaaaauaaucuaaaggaaauauagugaugaucauuuuguauuucuauaguauuguuucucccuuuuuaauucucauggacaaaaagcaaaucaaagaguacuucaaguaagcagaaaagcugaugagacuaucaagacaacuuuaaaaaaauuguaagcucauguuuauaaagggaacaaaagaauuuucuuaauuugaaugguacucguagcauugaaggcaauuggaaaagcuuuuguccucuuaagaacuguuaaagauauccuagcuaauuuuguuucauuuuucagauuacacuagauguguuggcugauaugggucaugaagaguugaaagaaauaggcaucaaugcauaugggcaccgccacaaauuaaucaaaggaguagaaagacucuuagguggacaacaagguaagcuauucagaaaaaaaaaaaaauuucagaaaucagugguacaagguaaguauuggggcugauaauugaacucaggcaguccagucccagaaccauacacugaacuauuguaccuccugucccuuccccaucucaguuauuggccucaugcucccucuagcuggaaaaaucugagucagucuucccugucucccaacacuuuguauccucaauuuuucuggaaucucuguacuucuguccuuucccaugacugucacuugauccaagccaccauucucucucguggacugucccagccaccugguuuaucuccagccuuuacauuugcuuccugcuuccuuccaguaccuucucuacaaugugaacacaaucuuuucaaaaugauuauaugaucauaucacuccauugcuuaaaccccuguaauagaauccuguuucuuuuaggauagaaucaaacauugcuaacaugguuuuuuacaaucuaaccuuucuuaacuugaacuuuccucccucccacaugacugucagcuuugucuuuuuccauuguacuuugccguuacaagccucuuuccccucuguuuuuacccauuucucuauuuguuagaagcaccuucacuauaggaaagcaaggaaggagaaucuacagagcuaaucaaauuauaaaagagugaugugaaauucaaacuggaagauuuugugcuugagucuugcuuauuuaucuguauuuuaguucauccaugaaacuaacaaagauaauguguuuuaaagcaauuguaaguggcuauuucaagccaucuuacaagaguuuuuagaggauaauuuuuauauuuuagaucugacuauauugugaugucagugccuguuuuucuuuuuuuuugugucagacauagcuucauguauguucaugauagaguuuaauucaacaaauauuuguugaacucugcagucuguacaagaagcucuguaacaacagauaaaauugggcugggcgcaguggcucacgccuguaaucccagcacuuugggaggccgaggcaggcagaucaugaggucaggagauugagacuauccuggcuaacaugaugaaacccugucucuacuaaacaaaauacagaaaauuagcugggugugguggugggcgccuguaaucccagcuacuagggaggcugaggcaggagaauggugugaacccgggaggcggagcuugcaguaagccgagaucacgucacugcacuccagccugggcgacagagcgaggcuccgucucaaaaaaaaaaaaaaaagaacagauaaaaucaguccccaaacaucuucauuuuuuucuccugucugucuuugaguauauuuguuuaaaguaaccgaauuuaucagguucaaauugcagauaguuuagguuuguuccaaaaccucaauuacuuauuaugaauuuuuuuuuuuuuuuuuuuuuuauaaaauagagccugaguaguguagacuuuuguuuuauauguuaauuuuucucuccgacaggcaccaauccuuauuugacuuuucacuguguuaaucagggaacgauuuugcuggaucuugcuccagaagauaaagaauaucagucaguggaagaagagguaauauacaucagaaaucuuucauuugcuuuucuugaaaucuguggauaaaccucuuuuucuggaauuaaccucgucuuacauugccuugcggucacaugccuauuaaucagucugucuuagccacugugguagaauauugccaaaauuaaaauaugacggcgccccaugguuuucacaucauaagccuagguuuucuaaugcauggggcccaucugucuuuuuauucuggagauuuucuugaaucucaugcaaaauaaauaaggagccuauuacaacuauuuucuuauauuguuacagugccaccuaagaaugacauagaaugaaaaacucuugccucauagagagcaaauauguucucauccuuguuuuuaugcaguuauaaaugugacuauaaaauaauaugccuaaucgucacguaugcuucugggucugccucauuauucugcauaacauuuuuccagucacaguucuucugagccccuaugaaggcuguuuguguaacccuccugguggucagaugccagugagacuccugcuccacugacggcuuaugcauaaacaaacagccuaaugccauuguuauaaguaagcuacccaauuguguuaugcacauaccuaggcagaaaaagguaugccuaauucuuguuuguuuguuuaauuagugcucauuuuauuuucauucccaggcuaggaacuugcauagggaacucaggaccaugaccccagggcuguauuucagcucauacguagcgcaucaggaaggcaucaugggguccggugucuuacuaccuaauucuccuagcaguuaguacauuuugauaacaaugucaaaaauguagugacucuucacaaguggagcaguaaggaagagaauucauuuuuuuuauugaguuaauucucugagaaacuuagaucuuuaaaacauuuuucuuuuccauaauuauuuuuaauuuagagaguagucagaagacaguuauucccuuuaguaguacauuauagucaauguccccuggucuguguaaauauacuuagagaucccaagcugaagacuauugagauaauauggaauauuucaccuacagaacaaauauuuuuuaaaaauuguuuauuuuuagcauuuguccaacgggcauuuaaggaguuuuuguuugacuuaaucagaguguuaguucuucuucucaauaagauaagauaguaauuguagaugacuuaauguguuuuuuaauauguuuccccauuguguuuacagaaaacucuuucagaacuuuuauuuaaaaguaaauagaaagugcauaaauuuaauauuuauguuugaaauuauuuucucaccaaaaauacuuauccacuaaacuuguucaucaauuuauagugaacuccuauuuauuuauuaauacugaauuuuagacucaucauugucuagaauuacacacugggauguuuuuauaaaauuaguuauuuuguucuguagaugcaaaguacuauucgagaacacagagauggugguaaugcuggcggcaucuucaacagauacaaugucauucgaguaaguuuuuaaaguuucauggugaaaacuggauugcaaggcuugccuaaaaaccaaaucuagacaaugaaaaaaguuuauuaagucauauuuucaaacugugaaagauaauucgucaccugucugaagucagauagcacucuucucacuacaauaucucuaacuccccaagacaauacgucacuaaaaauagagacauucugaaagcgucaaagcuacaaacaggaggcuaaaucagcuucuacuagugauacuuacguggauauuggucucccugcucaugcacaaauacaggccauagcugacaauaauguuuuuuaucauuugagaguugcaucaaaguccuggaucuucaaucuaauugaaccaguaauuaccucagaauacauauauuucuuaaucucgguaucucaauuuauaauauggaacagaugacucaagcuuuuuacaaagggguaucauaaagaugaauaaaaccuguagagaacugguuuaacccuuugaguuaacagaccuguaaaaguuauacugguacacaucagaauaacccagggaacuuuuuuaaaaaaaauacagauuuacagauccccaucuccuaaaauguauuaagucuggggagaugccuaaacauaaccuuuuuaccuauuuuuuuuuuuaauccugaggugauuuagagguaacagccaggucugguauagaacaacaaaaacuguaacugaaaauuaugucacuaacagcuagaguauuuucugaauuacacugacaugguagcuuuaucacuuuuaaauuaugucuuaagcaaaauaaaaauugaaccuuccuaaaaggaaaacauacuuuucauuuuaaaucauaaaugcacguuucaccgauaauguuucuuucuucuucauccuuaaagauucaaaaaguugucaacaagaaguugagggagcgguucugccaccgacagaaggaagugucugaggagaaucacaaccaucacaaugagcgcauguuguuucaugguaagcagcguggcagggacgguggacgucucccugggccuuugcaggagucaguaaagggaaaaaccuacguuaaauugacuauaauacgguuguguuaaaaacggcuuguuuugauuauuuuguucaaauaauuacuucuugguaccagcuuucuaauguaucacacaucaguacagacuuuccagugcauauacagugaaaauacuugaucuaaaauuauuuuaguacuuaaauugcaaauugagccaccuagugaauuacuuuuguuguaauuuuguacuaguacauuauuauguauaauagaccuucuuagaaaauacuuuucauuuauacaccauucauuucuuaauauuaaccugcccgaugcaaauagugugcagguaauugagcuucuagaaaaguguucaaaaacgaaucuuucugucuucguauuucuagguucuccuuucauuaaugccauuauucauaaaggguuugaugagcgacaugcauacauaggaggaauguuuggggccgggauuuauuuugcugaaaacuccucaaaaagcaaccaauauguuuauggaauuggaggaggaacaggcugcccuacacacaaggacaggucaugcuauauaugucacagguaagcaucuugccauuaguguaacguuucccaccccuaggucacgaaccaaauugucuuuuuuuuuuuuuuuuuuuugagaugaagucuugcucuugucacccaggcuggagugcgguggcacgauccuggcucacgcaaccuccaccuccuggguucaagcaauucuccugccucagccuccucaguagcugggauuacaggcaccugccaccacgcccagcaaauuuuuguauuuuuaguagagaugggguuuugccauguuggccaagcuggucucgaacuccugaucucaugaucugcccaccucggccucccaaaaugcugggauuacaggcaugagccaccgugcccagccccaaauugguuuaucaggcucugcagaagucacagauuauccucagucuugcaucccgguaaaucccguugguucugggaaugggugggaacagcugaucagccucuucugacaggagcaauaacaacagagcagauaacuagggguaaaaaccagguacauggccuccagucacggguuaugauaaaacucccugcaucuuggcuuucucccugggcuucacuuuucuuccucuguaaucagaauauggcaaggcuaaggaugauuucuguggaacaaagaacugcuagcucuagucacauuugaaugaagacacacuucuauaaaaaacauagacucuuuaauuuacuucugauguugcuggugauguuguuguuuuaaggcaggauauauaauuagccuuggcaacuuaaaauaucaacuuuggaauuaauagcaaacaaaugaauauuggccuuguuaauagacuuuuaaaacucaaaaauuggagagaauaaugguauaaucucugugaugucaguggcgaaaaaaguacuuucccuuuccuuggcaaugaaaaaauacaaaagaauuauacuguacaaagauugggauuuauuacauuucuguguaaacuuacuuaccaaaugcauucuuuuuaacaagccagguuaauaagauacuuuguaauuugguuaagaccuuaaaaagacccaaauaauuucagaacaaggaucucugagggagaaaagccccaguaaccuugaaauugugauuauugaccuuaaaacuuaucucucaguuguguuuugaacaaaauuauugccaucagccauuuggagucggaugucauauacccggaaggaaacuuccuuccauuaagaccucugugguuaggaauacagagaaauuuucggcugggcaugguggcucacaccuguaaucccagcacuuugggaggccgaggcgggcagaucaugccgucaggagauugagaccauccuggcuaacacggugcaaccccgucucuacuaaaaauacaaaaaauuagccgggcgugguggcaggcgcuuguaguccaagcuacucgggaggcugaggcaggagaauggugaguacccaggaggcggagguugcagugagccgagaucgcgccacugcacuccagccugggcgacagagagagacuccgucucaaaaaaaaaaaaaaaaaagaauacagagaaauuuucaagaauguauagcauguaaaaguauuuuuggguuuuuuuguuuguuuuuuugcuucaaaccuaauuccucuggagacaaaaaugaaccuaaauaagcaauaaaagugaaccucaaugaaaauuaacagucgcucauuaaaauuagacacacaaguuuaagucuuagccaggauuucuggaaaacagagccucaagcaaaagcaugugacuaguauuuggccagugcagccccagggaagcaggaaugagggcccaaaaggaacugagguggagaagacagcagagcaaccgcagugaggugcauucaugagcuggccacagucucauagugagugcagucgauugcccaguccaugaggcaucuccggagaggcuguaucaacuacggcaucucacaacaguaguauaucagugagagaaagagacgaauuugucugcuggcuccugucuugcauuugucaaaauuugccaccagggcuaauugguaacccuaccauuuaggcugcugcgucugcagaaugcaccacaaugcaccagacaagccagugagcagacuugagccagcucucuacuugcccaucugcagcugcagcucaccgcuggcugagcaggucccacgucaucuccugccucggcagcaacaggcgagcccuggggcaggaagcagaagaccagggccugucaaguucaccuuugugugacguaagagacuagcagaaucuaacgacaacauagcacugccacaaauguagagagagauggagcucaaaaagccuccuucugauggagagcaaagcccuuuucucugggaccugcaggagaauauaguagaccaagccagcaucccagaggaucaucaauagcauccaacucaaaaagccaguccagauaagacccaguuguccuggauccagcacaaauuuuaguugacucaagauaaaaucucugguuacuuauaacacaaagcuuauacuccauuacuaaaaacaauuugacugaauuguaacuguuuacauuuaacagugugaucauuuguacuaauuuguaaaaauguuuauugcuuauauuagagauuagcagacauuuucuuuaagggauauauaauaauuauuuuagguuuugcaggucauacaaucccugucacaguaacucaauucugcccuuguagcgcaaaagcaaccacagacuauauguaaaugaaugcauggcugugugccaauaaaauuguauuuacaaaaccagauugcaggcuggauugagccaugggcuauagcuugcuaaccccugguguauauaauagacuuucuucccagucagucuuucuuacucugugauacuuaacaucugcucuaauucagguuucacccagacuauuaugauuuucagccauacauuuaagcuaaguacuuucguucaugauccacuuuuauuauuacuguuuaccucaucccaguuucuacuuuuuucccuguaaugaauaaacccaaucuuaauuucagguguuguuuccaucagcuuauuuucuucacuuuccaccuacccauccaugcaagggcucaguuuuuucucugguuuuuucccuuuuuccaccaggcaaaacuuacuggcaggcauuuucuuuuuuuuuuuuuuuuuuuuuuuuugagacggagucucgcucugucgcccagccuggagugcaguggcgcgaucucggcucacugcaagcuccaccucccguguucgugccauucuccugccucagccucccaaguagcugagacuacaggcgcccgccaccacacccggcuaacuuuuuguauuuuuaguagagacgagguuuuuaccguguuagccaggauggucuugaucucccuagcaggcauuuucuauggccgauuccuaagccauaccaaaacuacuuuaaacuuuaaguguaacuauugagucugguaacuguuuauagcaaaucauuauaucaaauuccaucccauuccuacucauaaaucugaaaaugacauuuaaauuagcuugccuuauguuaaauuuuuaaaaaauuaauagaucuagcaguuauauuauuguaagauuuaaagcuuccuucaaagcauuguuuuuuucuuuuuccuuagacaaaugcucuucuguagagugacccuugggaaauccuuucugcaguuuagcaccaugaaaauggcccacgcgccuccagggcaccacucagucauugguagaccgagcgucaaugggcuggcauaugcugaauaugucaucuacagaggagaacagguauguuacucaucaaacaagcauaaccaaguucacaaacaugucaauagagcacagagaccguguaagacuugagacacuuuucagugaaauauccaccacacagugugcuaguauuaauuacuucagauacaaaauaaagguaucaaaauaauucuuugacaucaacuuuuuaccuaaaacccauuaguagcugucagccacauaacacagugugaacaagagggcagcugagaaacaaaggcuugggcccucaugccguuuugaggccugcagcucugaacuaaugccuugugccacuucgugggcagcaugccagggcagcugcuguuagugggucuucauggauguacaugccacaggauuuguccaaaaacaaaaacaauuugucugaauguaagugaacuucaaaugaauaccauaacuacaauaaaagagaaaaauaaagaaggaaauaacuaaauauauauaaccuaugaaaacaguauuuuauacugugccuucagucaugggcaggguagggaaugcuguugggggaagacugacaaaggaauccugaacuccuuuuaguaaauguguugauggagauaccgugggcaaaacagugaaacucuuaagcauauuauaggauugagcacaugagcggauguguugauguauugauuugaggagccaaaauucucaugguagaagaagggacauacaaauauggaauggagaagguaagaaagacucuaaggguggacugaaauuggaaguauuacuaugaucucaugguuucuaacguguguguacacccauguaaauuuauggguaaguaguaauauaagcauguguguguauaugagagaaagagaaaccaaggaagggagggaaggagagagagagagacagacaggaaggaaaggagggagagaagagaggaaggaaggaagugagggaggaagagagagaggaagggagggagagagcgaggaaaggagggagggaggaaggaagugagggaggaagagagagcgaggaagggagggaggagagaggaaggaaggaagagagaagaaaggagggagagagaggaagggaagcagggagggagagagagaggaagggagggagggaaagagagaaagggagggaaagaaagggagacagauacuaaggaagggagggacagaggaaaggaaaagagagagaagaagggagggagagaagaaggaagggggaaagagauaaagggaaggaaagaacgggagagagaggaagggagggagaaagacugagagaggaagcaagggagaaagcgagagaggaaggaagagagaaagggagaggaaagaaagaagggaggaagagaggaaggaaagagggagggaaagagagagagggaugaauggaggggagaggcaggaagggagggagagagagagagagagagaggaagggagaaagcgagagaggaaggaacagggagugagaaaggaaggauuggaggaaggagagagaaaaaaaggaaggcaggagagagaggagaagggaagugggggaggaagggagaagggggaaugaagcggggagagaggggagggagggagagagagcuagagagcggaacggagggagaaagugagggagagcagaaggaagggauggggagagagggaggaagagggagggagggggagagggagggagugggagggagugagagggagaaagaggugggagggaagaagggauaggcagagggaugggggagggagaaagggagggagugagaggagacagagguagggagggauggagggggagagagggagagagaaggagggagggagaaacagggaaggacggguggagggagggaugacaugggacucaucauguacccauuauuagaccaggcaagaauuauuaauggaugcuaaauauggggauuguuucacuaaggagaagaauauuugcgugguuuucuuauuacagacuuacuuucaaagggggcuggggggaggaguaauuauauauuggagaaaggggacaaugccuugaccagauaaucaaaaucaacaucaccaaugagggacagauaggcuuauauuaucucucuagguggauacucuaaaggcacgacaucucugcagcauuccagccaaaaauacaugauguaagucuaaucaaaaugaggaauguuuuacuuuuuuuaauguugaaagauuguauucuucaaaaauguuaauauuauaaaagaaaggcugugcuaacuuuccagauuacaugaggcccaagagacaugaaaacgaaguuaaccuucugcccccaacugcauccaguauuggaagagaaaguacauuauuagaucaacugacagaauuggaauauggacauuaaauaaaaggauuguaucaauguaaaauuauaagguugauucuguacuuacguaaggcaauaugucuaugcuuagaaaauauauacuggcauauuuagggauaaaggaccaugaugauguauauaacuuguaaacguuuuggggagaauguguguguguguguuugugugugugugugugugugucuguguguguguguguguguguguguguguagugcguauguguggguguggguguaucuaguauacagggauagggaaggggcaaaugauaaagcaaaugagauaaauaaaaccuucccaaacguagaucugggugagguuauguagcuguuuuugguaccauuuuaauuuuugcaacuuacuuguaaguugguagcuguuuccaaauaaaaaguuuacaaaaaggaaggaauaaauuugucauauuuuucuguuuaaaucauaaaccuuuaacuucuagaaaagaagcuuuuuuuuaacuuuuauucaguaauuauacuucuucuagaaauuuguauuggaauaaucagugauagucacaaacacacacuauauacaugaauauaugaauagucaucacugucuuaucacaauaaaaaauuuaaacaaccuaaauauuaagcaaaagcagaauuguuaaauaaacauauucauaugucugauauuuuuuaacauuuacauaauauauaccaaacauagauucacccacagcauaagaauaugguuaucacugggugauaaugagugguuucaguucucuuuaccauguauuuuaaauauacuguaaguuaucucugauucacccacaacauaagaugguuaucacugggcauuaaugagugguuucaguucucuuuaccauauguuuuaaauauaaguuaucuguagugguaaauauuuauuucauaauuggguacaaagaaauaauaaggaauacuuagaagauaaguuuaaguuuacuuuucugaaauuuacuaauuaaccaucucccagguaaaauuugacuugauaauuuagucagagugucucaugaaauaauuuuagagagugauuaguacaaaacuuauuugaaagaaaaaaaaaaugccuaaauaaaaaaaugcacucagcauuuauuuuauuuccggggaggauaauugcucuuccauauucagguauacuuguacacauggaucguguuaacucuagcgucugcuaauugaguacuuucucaugagcaguuuuugcuaauuuuauagggaaguuuuccuuugcuaacuuuuauuucauucuccuuagucauacucuaaaucaucuuucacucuuaauguuuaacuuucaaaaacacacacguuuuauguguuuuugauugaggaugauuugaguaguaguauucguuauuggugggaauguuucuuucuugaagauugaaaagauauauugaagguuaacugaacuguacuuggaaagaaaaauggcucugauuauuacauaugauuggacuuaagaugucagugguauuuguuuauguuguacuuuaaacuucacauuagacaugaaggagagguguucucugcucauugguuucuccagagauuucagcuacuuuacugaacugaugugaacaaugcagaauuacuuaaccuggaaaagaaaagacuauagaauagaaugauuucuaaaaugguuuccaaacauacagaaucauucaagagagcaugacggucccuuccucaccucuaugagacauaaacugagagcauuugaauucaaauuuuaguguuagggauuuggauuaagaagaaaauucagaaaaugaguuagcagaagugguuguguauuuaaaaaauaaguaaauaaauacauacauacauccuacgcugguauaaccagcauggauuuaaagugaccugacggaaaaugacgguuuuugguccaucuuaggcccuucuaguucugcaguucaguaauucccuuacccuuaaucccucuggacuguaauugauuaauuaguaacuuaaagggcacacagaaacaauucaguagccuaaucauuaggaaccgggagcauuuagauaaggaccuuuaaggaacucaugccauuagaaucuuagaauccaccugacuaagauggacgugugucagggauccccuuaaaucaugagcuaccuaaaugcagacaccggcacuauugacuccuuugcuucaacagcuuuuccgcaaguaaaaugucauagaaaguauuauagauauuaaacuucacucggauaaaaggaaguaggggugggcauccacucauuuuugacacucagcauaugccagccugcguucuuuuuacauuucuccuguuuuugucuguccgcaugguaagcuccuucacagcaggguccacaucucacaccagaguguucuuaugugguagaugcucaauacacggaugcuagugauaaauaguuuucuugaccauuaagccaccugguugauuaauuaguauuuucaguuuuuaccaguaugugagcuuugcuagauuuuuuuauacccaacucuagaauuagcaguagguaucugaccuagauuguuuuaguaaaccauuucaaaaauuaaguguaugucuuaagauaaaacuacagauaguuucuuuugugagaaacuguaauauucucacaaaaauaaaaguacagacugguuacugagacuucagauuggaaagucaggagagauuuucaaucuucguuucuucccacuaaauguacuaaaauagaaacuguuguuguuuuuaacuaaaaucagagcagacuggaauuacggaaaagaauauuaugaaugguucuauauauauauauauauauauauauauauauauauauauauauauguagacagaacuuaacauuuauguuuuuuuguuauuuuuaaaguccuugcugagagcuuuuaggagggaguacucucuaaugaauaauacuaauaaaaauaauaacaauaauagauccuuacuaugccagaccuauucuaagacuuuugcauuuaguucucacaaaaaauccuaauauuacuauucaguuuuuacuuaucuuucuuuccuuuuauuaucuuauccuguaucuauaugcaaguaguuuguuggucagcauugaacaaacuauuuuugguccccaaaacacuuugcucacccaagagucuucuuuuagucacagaccacucugaacuacugaaucuaguuucaucgucauguuauaguuagggcugaagaauuccuauguagucuacucacuaagggguguccuaccucuccuuccaaauugcugccuucacugcaauuucugguuagguuuucagcagcuuccucugaucagccuccuuuuuccugcucccaccaagaagaacucuucccauuccagacacagccuuguguuuuacugacugcaagaaaaaagagaaagagaauaugaaggaggccagucuaaaucggagcccuuaucucuccuguaaaugaugccuuugaguagucaguuuuuaaauauuguucccaaacuguuguuucuggguuauuggugacucaguacaucucacccuuacuccuucuagcucaguggguuacaucaucuucuaugauuaauuuggacuggauucagcaaaauuuuucuuucauuuagcaaacuuuuauugaacacacgcugugugacagcaccaaugcucugugaggugaaaaagauauuagugcuaccucgggccuuaguuucccugcuuaugacacauggcucucuaauaagggaugaauggagcuuaauugacaguauucgaaguagaaauaacauucaguuuucuagauuguaggguuuauacacauuuauuuacaguuaaguaggugaaccucaaauuguucaggcaccuauuaagaaacugagucuauauagaauauuggucacgauuaacagccuuugaggcuuccacauucggcaaggcuuuaauauugugccuacuagaagggugauuuguuuuucuucuuguccuucccaggcauacccagaguaucuuaucacuuaccagaucaugaagccagaagccccuucccagaccgcaacagccgcagagcagaagaccuagugaaugccugcuggugaaggccagaucagauuucaaccugggacuggauuacagaggauuguuucuaauaacaacaucaauauucuagaagucccugacagccuagaaauaagcuguuugucuucuauaaagcauugcuauagugaugaauaguaugaguaacugauacauacucaacugcuacuguucccuuugaggaaauguuuacaggggcggccuuuuaacauaucucaggcucauuuucauugcaauuauccauuucuaaaacaagauugcuucgaucuagacuuggaaauggaaaauaagaaaaccaaugcuuuuucaaauguucacaauucacacacuacauuuguuuuguuaugcaugacgugucuauaacaaauauacacauacgacaggcaacaagcuuguuuuugauuugccagacaugcaucauuggcuauuguuuguuuguuuuuuguuuuuuuguguuuuuuggguuacuuugaaaaugagccagagccuucuugaggauauuuugcacaaagucacgcugacaaaaucauuagcagugcaacccaagcuucuggcugagcaagauucaguuuccacuuuuuaaaauuuuuuuauuuugcucuguagcugcacuucucguuaucauaaauugagaugaaaaggaaaaaacaucaaguuuuaguaccuuuuuaugaauuggccuaucuuacaagagaagggcacaaacaccaaccugacuuaggaacgccuaaauucagagaagucaaagccggugaaggccacuugcucuuuccaacacaagccugccacagaggucuucgggacaguacuggagaugcagguugacacgggcuugaguuccaaggugaaaaaacuggggaggcugugaaggaagagcugcauuaaggagggugaggagcgugugguucuguaucauggcagccccaauggauccaggggaugccuccaaaaaauacaugcuucccuucccuuaaucuguacuguugggauuguuaccccuccaaauuagcugccuuauuucaaaagucagugaaauuacugcacuugaugagggucacaaaaauaccacuugauuguuucuuuaguugagaaugcugggauucagacucgaauaguggauagauacacacaaaugcaaggacuuuuuuguuuacuccagauuugggguuuauuuugaguggcaugcuucaaauaguucauaaagauccuugcauuaaauuucugaaccauuucuucaaacuucuuaguguguuuagacaaggagaacaaaaauugaaaccaaagcccuuucuguuauuuuuucaaugaaggugagaaagaaauaccauacaauuuucuuugugaaauuacuguuuauuuucaucaacauuuaccaagugccauugacauuuauaaaaaaaaaugauccuuuauaguucuuacacuugcccuuuucaccuuaacugaauaugaauugagugcacuaacuuauuuacuugauauacugugcaucuacucugcuuugaagcgaaagaaauauaaacacgaggaggaauaggaaagacagugugacacaaacuugccauugcaauucaaagcccugaaaacgauggguuuaaugcaaggugauuaagcugugaccuccuuuaaucuccugaagcaaaauaaaaugguuacaugcaaaacuucuagaaauagacucuuaaaauauauacauuuugcuuugauuuuggcuucaacccagugcuggaacuaggcauccagacuaguuugaauguuuguagcugaauuuuuauggguccucaaaauuaaaucgagaauuagccucaguuguugcuucuuuugaaguuucagugacccaagcuggguguuugugucuuggcuacuuguuuaauagcacuagaauuccaggugaagcuuugagaguugauauucauuaagagggcuuuuuuuccccuucuuuccuucucuuuugcuguaacaaaggguugaagaaauugccaucuguguaguuuucaguagcugucaagugugucuuacuuaccuucccccagacguaguuuaaaaugguaaacacagcugugauuuuuaguuaaguaaaagaguuaauaugauauagauauggaaagcuuuauggcuucauuaaaaagauaaaccacuaccuaacugugguuguauguuguuuccaucauacuaacuagaugaauggaugcgccaguuuucaucuugguccuuacacuugagaaguuaaacugugguucaguauuuaaacugccaguguuauacgucucaugcucugugugccaggugaagguacuguguaaggaagacauuugcggugcuucuuguccuauaaugauucaaguauauaguaguucuugaaagagugugcauauauuacucaucugcuuaagagaguggguuaauggauauaucagaggagccaaauacauuuuuuucagaacuugaaaaccaaaggucaucaugagugcacucaaaaguuaggacaaguuuauuacauuugggauuuucaucuguagccguaugaagaacccuuuccaauauaaaagcauggcauuaaauuaggcugaagucuuuuauuuuuuguauauguacuauauagaaauacuagcaaguuaggaucauccaauauggccuaccccgaaauggccccucuguuucccuaaccacauggaagaaagaaucugaacgucuccaccggcucuacccgaguuccaaaacuaaagggcuucuccagaccugaugguuccaguuuaccugcuguuggccugcuggauacuugacucaggcauaaauuaagugcccuggucccgaacuuucucccuguauuugaccuccuucccucuuuccuaaauuacuagucuggaauuaaaauuagcuccagcaaugaccuuugacuccauucauuuucuccucaucuugggucuuaaaaaaggagaccagauaccuccuagcuuuuguaucacaaccaggaauggguauuaggccucaugcgcuuugcucagaacacugccgcuuuguuaacaaaugacagcauggaacccagaguuuugauucgaugcaaaauaacagcagugcaaccaggauucuuguuuuccuuuuccuucuuggaguuuggaauuucuagcuuuucaagcagcauaaguagaaucaacauuaggauguuuucaugaaauagcauccuuauacuucuuugagcuugauguuaguggcuagacugauuucccuuugcucucaaaauacaaagugcauugaaguauacagagaaaugccugaauauggcaagcaaauaauguagauuaacauucuauuauuguauccguuuuacaaaaaauaaaauuuugauauaugccggagaacggcauuagaaugcaauaaguugucuagguuuuucuguuucagugucucucccaauggcacgaaggguuauugggcauuguccccacccccgccuuuuuaacaugugcacuaucuggauuccuguaaauggccuugcaaacagaagugguguguauuuucaagcaccuuucccccauuguauccgaaucccucuugugugauaucugugacaaauagccuucuucuuguguuuucuguuggacuaauugucucacguaaagcuauagaccuuacuaauuuggcagguauucaaaacugccauuaagauaggauuucaugucagauacguauuuaaagaguaaagucaaauuuguuuaaugucagaucagugacagaagugaaaagaaaguaauugugaaagugauguuugagcuauuguacacaucuagcauauggaaagcaaaugcacucgaaaacuacuauucuagaacaugaggcuucuucagcaacuugugcacucugccauuaauaaauuaaauuuuuccccucuagaaagccuuaacuauggcggaaacuuuuuaaccuuuuauauuuuaauaaauaaaacauuguagucccauuucuuaguguuugaaaggugugucagugagucggccaugucuccauguguuucagaccuguucaucuuauuuuaugaugguauauuucauaaguaauauucccuuacaugcaauggagcugauuaaaauuaauccauuucaauuucuccauauuggaacuuccucagcuaccagauuucugguuuggagaagugcuggaaagauuucaaagccuauucaguuguguauguggggauacgacagcaacugugauaccuuguagaauaugagugauaugcaagcuguguuuuuuaauuguuuuaaaauguaaauuaugguuaugcuaaagugaaaaccuagaggaagcuaaugauuuuauauacuuugcacgaccaaauauggucguaguaugacgaguuuuauacauugccagagaguucugccuccucugaaauaacauucgcacuguagauugcauuucggcuuuuccuccuuucacauucuuuuuugcuuuacacuucacgucuucgcaccugcccuaccucccauccuuucaaagagguuucuuucacguuccagaauucagauuguucugugauuucuuuuacaucagucuacccauuucugcaggcagcccugaaagcccuuguguugauucagaguguuugcagagaaaugcaguugaacccugguaguggggugucccucacacacccgcgcaccccucccaaaguucaggaugaaaggcuagaaaacccauucaaaguuaggaaagaacacagaucuuugaggccgauagccuagaccuagaagaugaccuugaguauguaaacauugucuccgugacacaaaacacugaaacucuucaugugcauauaacaccugcuucugcucccauuguuucaagcucaucuuaucuuuguaguaguaauguuugucuuugauaccuacaaacuaaaaagguacuuuuaucaagguuucucaaaacauuuacaaaaccagcuuugagaaaauguuauguugccuggcaacagcacucggaguaguaauuguguuuucucauugugauguuggucugugugagcaaccaguguagugacucuuugguucauuauucguguuguuuuuauuuuuagucucugugugacccaacaguggcagggguuacaacccccucuccuuucuuuuuuguauuuaucuauuuguaggauugucagaucaaguacaagaugcccaguuaaguuugaauuucagagaaacaauuucacguuaagaauguuucaugcaauauuuggcauauauuuacaguaaaagcauucauuauuugucugaaauucaaauuuaacugagcaugcugguuuuucucauuguuugguuuuucuaaaucuggcaauccuacagcuguggucaugggaaaucaccuacagcauguuaaaguccucuagucaucaucucgucaccugaaauggaaguccuuuuucccucacccuccacuucuuuccaaaggagggcaucaaggaacuuaaccugccugccugguggguuucuauuuaagacaucuuugugauuauauuuaaccugcaauugugcuuuggcuuaaugucuagcucacuguacuuguaaaugauuaauauucaauaaaaccauuuuuaaaguacac

SEQ ID NO: 15590 - RNA, 15365 nt, Homo sapiens
cagggggccugggauggaccccggggucccgagagcuggcaggaaaguuaaagggggcagcgcggccgcggggagcucgagucccgggugacugcuggagggaggaggugaccgcgcagcucucgugcacggacggacuucgccgcccgcggggggcgcgaacccgagcccgggcccagcuccugccgucacggcagcugucccuguucccccagggcguaugcugccgcgggcuggcgcgucugcccucgggacuuaugagcugaacccgguacguagcuccccaagucucgaguccgagggaagggcuggggacaacaaggcgagggcgugcagcggggaccucuuuggguuccugucaccuacauuuucaccgugcgacuugcacuggcacaccggggcuggaacacucuagguagcuggccccagggagcuguugcuucagcguggagagggcgauccagggaccgcagcugggaagcgccucccgggcccacgugcuccaccgcgcugcugggcccggcugcgaccgugacccgggagcugcggcugcggcggcugaucccuuuaccaccuguuguucuggcuucgaaacuagcacaaguucccagccccgggucccgagaggucuggagacuucuccaaaguuggguagugggguuuggagcuuaaggacaagccgcuucgucucucuccgggccuuauuuucccuauaaaacgcgaggaaauacacuugguaggcucucaggccaccgagggcgacgggaccuagcacgauccccgucccgggcuggcggaggccaggcggccgcgcgggggugcuggugucgcgcugcuugcuccggccgggguugccccuuugccggccccgcccgggugcgauaacgggcuccuccuccucgucgucuuccucccaccgccgacaucuccgggaacccagcccaggcccugccucccggacacaccgacgcucacguagucgcgcuugccacaacccugcgggcucuccgaugcggcgagcgagcuggggagggggcuucuccgcggcccaaaaggugggugcggcgcgaggccaaggaggcuuguagggagguugggggcggagugcagcccuggucaaacuggacggaggggacagagucggagaguaacuugugggauccuccagccuggagagcacuggccugcuccugcgucucuuuggaauccagaaaaagggguguggaaggcacaguagcugcaaaagagggagugggggccgguaaugacuuacuggaagauuuggggccugucagagcacuguuuucugaaaaagaggagaaaacagaggaaagacuggacuugggaacuuggagacuuggaagguguuggaaccuguggucugaguggcgggggccugccugggagacccagggugcagcagaagagacaauuagagcuuuggucugggaggaagaggaggagaggaggaaauguuuccuugggcagaguuguccaggagccaaaacuaaagugaagacagcuggaggacuuacacaaaaguacaguugagguauuuaggaaaaaaaguuagugggaagagaagcggcaccaggggugggucgcaacauacaaugucagggccagcagggaccuuggaggggaccucaagcccagagcagcugagugacucgcucaaguagcaaagcaaggugcgggcauucuuagccuaguacucuguuuucccucguacguuuuuagacggcaggggcugugucauuugaacuugccucuuuccuagaauaugcaacuguauucacaaaugucagucuccaagaugcuuuggaugauggggacaggaucaagggguacaaggagccuuuaaggcugugaauaggcccccauggucugaguacaaaggggaaagacaugcacucucuucaugcuggaucagugaaaccuuuuggaagggaacacagaauuguuggagggagguagauggccaugucuuuaaaaaugaaaauuauaaccugguugugaauguuuacugaaugcaguucggcagcuuucaguguuccugguggguugcuugugcaucugauuuuuuuguuuguuugguuuuguuuguuuguuuugagacggagugucgcucugucgcccaggcuggagugcaguggcgccaucucuggcucauuguaagcuccgccucccggguucacgccauucuccugccucggccuccugaguagcugggacuacaggcgcccgccaccacgcccagcuaauuuuuauuuguauuuuuaguagagacgggguuucaccguguuagccaggauggugucgaucuccugaccucgugaucugcccgccucggccucccaaagugcugggauuacaggcgugagccaccacgcccggccuuuuuuugccuuuuuuuuuuuuuuuugagacguaguuucgcucugucgcccaggcuggacugcaguggcgccaucucggcucacugcaagcuccgccucccggguucgcgccauucuccugccucggccuccugaguagcugggacuacaggcgcccgccgccacgcccggcuaauuuuuuuuuuuuguauuuuuaguagagacgggguuucaccguguucgccaggauggucucgaucuccugaucucgugauccgcccgccucggccucccaaagugcugggauuacaggcgugagccaccacgcccggccuuuuugucuuuucuuaccagaagaaagagagagagagaauaagagaauggaggggauaaugucguggcccugauacaaaaaagauuuccucccuaugaaagguacagccagaaagucaguaguucagcugccugaaaccgugaaggucauaggguuauuuucugugcaggucuauaguuaucaccauggccgucuaaccuuggccagcugucuugagaagguguguuaugaguggaacagauaaagcauuuaugcaaaacuaucuccaugaucuguuaggguuugcccugucuuagccaugaacacuguaaucuacccucaagcauggcccagucucucaccagagaaacugaucccugagcucugaggcaucucuauggaagcaaguguuugagaauucauaccuaccugggagcagcacucauacacucauuccuauccugcaacugguaucagauccugaguccugcucucaugguucaaauguauguccauaacuucugguucuuuuuuuuucccccuuggccaacuuuggugacucauauucccuggccugggaaaaggacagagcuggagcagccagagagucugucaggagaggaggcugggcugcagccuggugcuuccuguguuggaaccgaucauuuucaugucauuuguaaaagaagcaccuguccaggugccuucuuuucaggaacuuaauauuaccuugcacaucucaguugcuaggaguacuucugcauggcggcagccaucccugucacaguccgcuggggaguuccugagcaguucaggaaagccuacaccaaaccagcacuuuggugugcugauucuuggagaaugaccugguaaauaaaaucuggaagcuaucugugggacaggcaaggugacugacagucgagucauaccccagauugaggccacacagguuaauguccucaccugcaguuauggugacacacaaagugaagggauucuagacugggguugcuugugcaaugucccugggguaguaguccugcggguaacucuugagccaucauaaccuuacuuuugccuuucauggaagaaucuuguaauagcaguuuggcuccuucaagugccagcagcauuguuuaauuagcucuggcucugacuagagccuggccucuccaagccggacuucugcuuguucuuacagcuuggugauaaaaagggaucucagggacaaauuuaugccacuggggugaaacagugaaacucuaccaaggucuucagcuaagucucuucagccugcgggauuagaacuugggacauuggcucuagugggcuguguguagauucuuugauugauccuuuugcuuuggcuguuuccacaauaucuugagaguuuccaaggcuuuuccuaacaugcagaaaaagcacguaggaggcugguuugcaggcuucuuggaagugcaaagagaacuugcagauaaccugugcugacucaguugaggaggaagcugugaagaggaacccuuccucccucaguucacacccagauuuuucaggauggguagaguggggggcacugggaugccagauauagccucuuguuugguuuucguacuuguuuaaaaacaaggcugggcacgguggcucaugccuauaaucccagcacugugggaggcugaggggagcagaucaugaggucaggaguucgagaccagccugacauggugaaaccccgucucuacuaaaaauacaaaaauuagcugggggugguggugcacgccuguaaucccaggggugguggcacgaguagucccagcuacuugggaggcugaggcaggagaaucgcuugaacccggauggcagagguugcagugagcugagauugcgccacggcacuccagccugggcaacagagcaagacuccaucucgaaaaaaaaaaaauuaaaaauaagacaaaacaaaaacacuaccuguguuacaguuagagcugaggguauaauuccagcacaguuuugcaaaggacaagaguaacuaaaauuuagauauuuuguaaguauaggauuuuuuuuuuacauugaaccuguuagucaauccguggaaccucugcaaaccuaccuugccuaauucagucagaacuuuccuuuccagaacaguuacguggcuauaagaacagaucauugaaagcaaauuugcccuuaaaauuuucacuagauugauuuucuuaaaggggaaacagugagacagauauccuuuaaaaugaauguuuaagcaccugcauucuggccauaaguuauuguuuuauuuguuuccgaauauguguauuucucugacuggccaucuguaaggguuucuugcaucccagggaaguucuguacuuuuggaaaaauggggucaaaucugauauguguucguccguucaccuuuuuucuuuacauguuugguuaaucacaaucagaaggugaaaaugagagguuauuuauagaacugaaccaguggucccagcucuuuacagaagacacuuggcauguugccugucacuucucagggguggccauggcugcuugagagugagcuccccaacacgucaucacacaccuacaccugugccauaaggagggguaagauagguugaggggagauagguuuggggacucauccagauccuguguucugugauucucagacuugagauuuuaauccuaguuucggcacucauuuccuuaauuuaguccauugaaacugucaaaucaaaauauaaauuugccaugguaauuagaaugauaaaaagugcucagauuuugggaggcugaagcgggaggauugcuugagcucaggaguuugagaccaaccugggcaacauggugaaacccugccucuauaaaaauugaaaaauuagcugggcauggaggugcacaccuguaguuccagcuacuuuggaggcugaggcgggaggauugcuugggcccaggaguuugagguuccagugagcuaugauugcaccacugcacuccagccugggcaacacagcaagauccugucuuauaaaaaaaaagugcucagcuuuagugaggcaguagugaugggauggguuuuuggcauaucauaaaauauuugaggauuuuuuuuagguucauuuuguucugaugauagaagcaauauuauuuuagaagauauaauacaaaccaggauaccagaaauuccugaaaucuugucaccuagguauucugauuuuaaauauauaucucuagucuuuuuucucugcauuuacauaauacaguugauccuuggacaacauggagucuaggggagccuagcccccacacagucaaaaauccacauauaacuuuugacuccccaaaaccuucacuucuaacagcuuacuguugaccagagucuuaccaauaacaucaacagucgauuaacacauauuuuguauuuuauuuguaacauauaccguauucuuauaguaaaguaaacuaaaggaaagaaaauguuaagaaaaucauaggaaagagaaaauauauuuacuauucauuaaguggaugcgggucaucauaaaggucuucauucucauccucuucacguugaguaggcugaggaggaggaagaggaggagaagggguuggucuugcugucucagggcggcagaggcagaagagaaucugagcauacguggaccuacaaaguucaaacucaugucguugaagugacaacagcauuuuuccccacaagucuaguuucuauguacaauuuuaucuucucucucucuauauauauauacauauguagacauaaauauaaauauauaauauuuuuuuuucauuucauuugaaucuuuuuuaaaauaauggcuuuaaugaugauauaaaauuacaucacaugggcuggccaugauggcuccccgccugcaaucccagcacuuugggaggccgaggcggguggaucaccugaggucaggaguuugagaccagcuuggccaacauggugaaacccugucucuacuaaaaauacaaaaauuagcugggcgugguggcagacuccuguaaucccagcuacucgaaaggcuaaggcaggagaaucacuugaaccugggagguggagguugcagugaaccgagauugugccauugcacuccagccugggugacacgagugaaacucugucucaaaaaaggaaaaaauaacaacaguaaaaauaaaaguacaucacauggaugugguacauuuaauuuaaccagguaccuguuaauggucaccuagguuauuuugucaucuuuuucccccuauaauguggcauugaacauuuuaguaccuuaaucucuguguguuuuuaauucuuuaccuaggauaaaugucucuaugugauauuaggauaaaaaaugauuaaaaaauuagaaaguuuguaccaauuuuaacuaaugaaaauguuugcauuggcugggcacaguggcucauaccuauaaaucccagcauuuugggaggcugaggugggaggauugcuugaguccaggaauucaagacuggucugagcaacauagugagaccucgucucuacaaaaaaauauuuuuuaaaaauuagccggacaugguggcucaugccugugguccuagcuacucgggaggcugaggugggaggaccgcuugagcccaggagguggaggcugccauaagccauguucauaccacuucacuccagccuaggugacagaguaagacccagucucaaacaaaaaaaaaaaaaaaagaaaaacuuguauuaucuuuucaauuuuuuuccuaauucaauaaauaaaaaacagacauuguuuuucaucuaaauuucuuaaauuaauaauaagguugaacauuuugcauauuuauaggccacuuuaaaauuuuuuuucaugaauuuucuauucauguucuuugcuuauuuuucuauguggaauauuugacuuuauuauugcuuuguaagaacacuuuacauauuaagguauuagcucugcugcuaugcuuauuguaaaauauuuucacaguuugucuguagucuuuuuuuguuuuacuuaucguuuuuacuuaaagaaaauauaguuuuuguuaacucagauuuauccucuuucagcaugauucucuuugcuuuuuauucuuauagagccaauuuuuuacuuguggaaaaaacaaauauucaccuauguuaaaggcuuaagaauacgaaauugcugguuguuuuuauuuuauuuauuuuuauuuuuuuugagacagagucuugcucuguggcccaggcuggagugugugaucucugcacacugcaaccuccgccucccagguucaagcaauucugcugucucagccuacagagcagcugggacuacaggugcaugccaccaugcccagcuaauuuuuguaauuuuaguagagaugggguuucaccauauuggucaggcuggucucaaacuccugaccucagaugaaccaccugcccagccucccaaaguguugggauuacaggcgugagccaccgcccaggccugcugguucuuuuuaaaagaaugguauccugacauuuaaaaaccuaccauaaacuuaaugaaagcagguuugugucuaucuucacuauugaaucccaguaucuugcuugaugccugccauauaggaaacacccaaucccuauuugugggaugaauccauuucuuuuuaucagauuauagcaaauauaaagccacaaugagaugucacgucacacccguuaggauggcuauuuucaagaagaccaaagaaaauaaguauuggcaaagacguggagaaaagggaacccuugucuccugcuggugggaauguaaauuaguacagccauuauggaaaauaguagggaggcuccucaaaaaaccacaacuagaacuacuauaugacccggcaaucccacugcaggacauauauccaaaggaauugaagucaguguaucggagaguuaucuguacucuuauguucauugcagcguuauucacuaagccaagauacggaaucaaccuaagugcccaucauuggaugagugaauaaagaaaacaugguauauaaacacaguggaauaccauucuaccugaagaaagaaggaaauccugucauuugugccaacggggaugaaccuggaggauguuaagugaauaagucaggcacagagugacaaauauagcaugaucucacuuauauguggaaucugaaaaagucaaacucauagaaacagagaguacagggguggcuaccagaaagugaggguagagggacuggagagguauccuuuggccaaaggauacaaaauuucagguagacgggaggaauaaauucaagagaucugauguacaauauggugccuauacuugguaaugauauguuauauauuugaaaauugcugagaguggauuuuaaguguucucacugcaaaaaaagugugauauaaugcauguuaaauagcucgauuuagccauuccacaauguauacauauauggaaaccuguuguacaccauaagaauauacaauuuuuacuucucaauuaauaaagagaggcagagaggcucacaccuguaauccuagcaccuugggaggucaaggcaggaggauggauugagccaggagugugagaccagccugggcaacauagcgaguccugucucuacaaaaauuuuuuaaaauuagccaagcauggugacuugcgccuguggucccacuuucuugggaggcugaggugggaggaucauuugagccugggaggucgaggcugcagugagcugugcucacgccacugcgcuccagccugggcacagagcaacacccuaucucuaaaaauacguaaauaaauagugucccucaggacagcuaucuguggaagacacccuuuuagucaaauagauuugggaaauuuuaaaacaguauauaugcccuuuugauuauccucuguggcacauuugccaacggaaggccccaagaaaugcugaccaaaaaaccugugcauuuaguuuuaaaacuaguggguuucauacucuuuuguuuguuuuaaccuugaagcaccccccaccccccaccgcaucucguccccccacaacauaaucuucucucaaacgcauguugugcuggaccacaccagaguuaauccugaccuguagccaggugggcauagauaaaaggaaauauuguuugccagucccugcuggaaugaugccuuuacacaucugucugaucugauugcuccacuguuuucuuucuucucuucccuuuccacgguucuagccuguucaucuagccccaugauggcuguggacaucgaguacagauacaacugcauggcuccuuccuugcgccaagagagguuugccuuuaagaucucaccaaagcccagcaaaccacugaggccuuguauucagcugagcagcaagaaugaagccaguggaaugguggccccggcuguccaggagaagaaggugaaaaagcggguguccuucgcagacaaccaggggcuggcccugacaauggucaaaguguucucggaauucgaugacccgcuagauaugccauucaacaucaccgagcuccuagacaacauugugagcuugacgacagcagagagcgagagcuuuguucuggauuuuucccagcccucugcagauuacuuagacuuuagaaaucgacuucaggccgaccacgucugccuugagaacugugugcucaaggacaaggccauugcaggcacugugaagguucagaaccucgcauuugagaagaccgugaaaauaaggaugacguucgacaccuggaagagcuacacagacuuuccuugucaguacgugaaggacacuuaugccgguucagacagggacacguucuccuucgacaucagcuugcccgagaagauucagucuuaugaaagaauggaguuugcuguguacuacgagugcaauggacagacguacugggacagcaacagaggcaagaacuauaggaucauccgggcugaguuaaaaucuacccagggaaugaccaagccccacaguggaccggauuugggaauauccuuugaccaguucggaagcccucgguguuccuauggucuguuuccagaguggccaaguuacuuaggauaugaaaagcuagggcccuacuacuagugacugcaggugacagggcguggcggagcugccacagacaagccuagcucugcucacugugcaguggagauggaaggccagggaggagcaacguggaacuuccaugaggccccguuugggaaaauaaaaggauccucuucacuucuuucuuaaacagcaaauccagccagguucagauuacacaaccagugucucacucaaaggagcagugguggcuggcgcgcuuucgcacuguggcagccacgagagucugugcacgucugugcuggaaaggguauggaugggaaucaagccuaugccagugcugaugaagcuggaggagucucuccucugcucuccacucagaugugggacaucagucgccaaaagccacucagccccagccaccucgcgugagacccucacuguucauuguguucaucuuugggugcucucugccagccaggccuuuccugcaagcugcugugcuuccccguccacguguaucucugcugugacacacugagcugacgcacauuuccagugcagcugcagaagagaaaugggauuggcucuuguuuucugcaaguucauguuuugcauuuuauguucuuccacaauugaucugauguucaggaaaagauaauaaaggcaaauuaguuagugguugagacaggcauuuccuccucccgcuucuugaccccacagauguauuccagcagagagcaacacaccagucaucaaaacccacuggcuccugugcggugucacagauugcaggguucugacaaggcaggacagucaagaguggggacacuuucagcuucuacuuuugccuucuagggggagcuuucuaaguccccacauuuaccccgagucaccggaaaaaucugauuuuucccccgaaagcucaaugacuuuaacgugcuuggcugguuugucucauucuuuaugaaagaauuuuggggccgggcgcgguggcuuaugccuguaaucccagcacuuugggaggccgaggcagguggaucacgaggucaggagaucgagaccauccuggcuaacacggugaaacccugucucuacuaaaaauacaaaaaaauuagccaggcgugguggcgggcgccuguagucccagcuacuugggaggcugaggcaggagaauggcgggaaccugggaggcggagcuuacagugaaccgagaucacaccacugcauucccgccugggcagcagagcgagacuccgucucaaacagaaaaaaaaagagaauuuugaaucuccuuucccaaagagucaucuuuucugcuguguuuaggacauuugauuugcauauccaauaucuccucgaaaccuucagaaaaugguuuuaucgugacugugauucacacuaucuagaacacuuuaccagcacccagggacauggacuuggguguucuuauuuaugguguguauguaaagagauaggggagaaaaaccucacccaaguucuuauacguuauuuuaaacguuugccaacucugaaauuucagagauucauuguucuuaaccauauuggacuaaagucuguugguuagugcuguuguaaaagagaccucuggggccgagugugguggcuuaugccuguaaucccugcacuuugggaagccaaggcgggcagcucaccugaggucaggcguucaagaccagccuggccaacauggugaaaccucgucuguacuaaaaauacaaaauuuagcugagugugguggcaggcgccuguaauccagcuacucgggaggcugaggcaggagaaucacuugaacccaggagguggagguugcagugagccgagaucacgucacugcauuucagccugagcgacagagugaaacugucucaaaaaagagagacuuccgggacagucauuaucagauaggccccaaaccugugauuuuucuugggcaagauugguguuuacuuaggggugcuuuaaaaauauauuuuuacaaguauacuuguaggaaguugguuuuuuauuuucuauuuuuguuuguuuuuggaguuugguuaaacgacucuuuuauuuucuguuuugccuuaucuuacuaaagugaaguuuuccuaaggcaagcaagaagaggaguggaagcacaguugccuggauuuggaggcagaguugucaggcuuuucaagcuaagagucuugugcuuggauuuuccagauuaauuugaaaagaccucccauuuguggcuuuguacauaaccaacaggcagauacugagugccuuggcuccuagaguuuugugguuggguuagguuguuuuuguuguuguuuuguuuugguuuuguuuucauuucugaaguuuaagaugccuugacuuuuuaaaugcucuuaaggcuauucgauguaauucuuacuccuaaaacuggcuguucuuagccugaaaucuaaugcuuuguuuuuuguaccucucccagguggguaacacucuaggaugacaugauguuauaauuuuaggggaaaucacauuuuuaccuuaugcuguuacugggcagaaccacguuuuauguaaacauaccagacaucggguaacagacaguacuuuaaauguuauaaauuuggugaucagaacuauuaauagcauaaaucgaacucaaauggaagcaaaacugauuucaugcagguccugaauuuuacuuugccuuaagaagugcccuccccacaaugcaggagaggcacagagugcacugucauugacauguuacccgacuaaggaucacucuguucauaagaaaaaggccugaagugacucuguuuaauaaagucaguuuaauuuuaucuaauaaugaucuuaagacauucccaugucaaaauuugaaauaugguaauucagugauaacuaucucuucuaaagcagccguaaacccuccccacuacccgucuuucucccagcucacccuggcuuuuuuugcugggggugcuggaugcaagcccccagccagcacaccugggaugcucacccugccgcacaguucagaaggcaaguccucaccugcucgcaaagacccuucuucuccaauaaaagacucuacuugccugaguuuccucaucagggcugucauucagugauguaugggggucugaagaauacugccuucuaucugucuucuguuuaccacuugcuccucugcuacccuccugccgcaaacagucuucuuccuuuuggcccaguucugucccgugaaauucucagaaggccucgggagcugcgcugauguauucucuccuuguuugauagcucaucaucaguagauaagccuacacacuucagagggugacagguuucuuacuuggagacuucacugcaccuugacuuguagauuugccuucagacagcucuugguuaugguuacaaguggcccccgagucccagaaucuuucccagguugccccagaaagaccagccaccugucacaggugcaguuguccggcaauagggaagcaacuucauuuuuguuuuauauuuauucccucaagugcccugaggagcauuugcaaacuggguacaauaaauaagcuggauuauacaaagauauuuaauaaauaagcuuucaguaucuauuggaagacaugaagcauuugaguggguuucuuuauuuaaaaaauuauucuacuggagcuggugagaaauaaugaagcuguacaguucuccagaaauuaaaacaaugucagagucaaugggagaauuuaauuuaccuuuaagauuucauuuuaaugguggcaaaauuauacauucuuagaagauguaaauuuggaacuguuaggagauugcucugugguuuugaucuuuucaaaccauuuucuuuuugaaaaaaggcauuaguuguagucauggacauuaaaugggccauauaugcuuaucaaucaaaaaaguguuccuuuuuuggaacugcccauuuucuggaucuucccucucaauggauaggggaugaaaaccuugguugccuuuuauuuguuuccucuucuaaaauuucucaccugaauguaguccugggagagucccgaucacgucucuccugacauguucacugaaaucggagacaagaaguuacauggaugaugggaucuuauagggucacacaaagacaauuuggcagcuuaucuuaauuuccugcagugagacaacacauguggaacugggaaggacagcuguuguuacgagcaguuuuuccuggucaugguuguaaagcucuguaacccacauuguaaagccgugaauguuuuuagucuuguugacgaguuuuuagagacugcuggaccucugagggcuuugagagugcagcugugaugauguuucacuauuacuucagugugaauguagaaccaaggacucaucuucauuuuauaccuaaaagugccuugucaagaaauuuuugcauguuuuaaaagauaaauauuuuuguacacagaguucaaggggaaaugcacuuuaaaaaucccaagaauggauguucuuugugugguaugagagguugguuuguaucucaaaagcaaaaauguaauaaaggaagacaaaacaaaacu

SEQ ID NO: 15591 - RNA, 1992 nt, Homo sapiens
acccgcccgcgggcugguuucgauuagggccaguaggagggcggagcggccgggacgccaggagggaacuagccuaaguggggacgguccccgugcaggagacaaagagcgucccuggagcgaucagggcucaggagcccgacccggagcccggggcguccgcgcugacuucggguccccggagccuggggcacggcagggagaagacgacggcggagaaggcgacagcggagaaggaaggcaggcugcaggggcgccgucggcgcggcgggccgggaugcggacgccgguggugaugacgcugggcaugguguuggcgcccugcgggcuccugcucaaccugaccggcacccuggcgcccggcuggcggcuggugaagggcuuccugaaccagccaguggacguggaguuguaccagggccugugggacaugugucgcgagcagagcagccgcgagcgcgagugcggccagacggaccaguggggcuacuucgaggcccagcccgugcugguggcgcgggcacucauggucaccucgcuggccgccacgguccuggggcuucugcuggcgucgcugggcgugcgcugcuggcaggacgagcccaacuucgugcuggcagggcucucgggcgucgugcucuucgucgcuggccuccucggccucaucccgguguccugguacaaccacuucuugggggaccgcgacgugcugcccgccccggccagcccggucacggugcaggucagcuacagccugguccugggcuaccugggcagcugccuccugcugcugggcggcuucucgcuggcgcucagcuucgcgcccuggugcgacgagcguugucgccgccgccgcaagggacccuccgccgggccucgccgcagcagcgucagcaccauccaaguggaguggcccgagcccgaccuggcgcccgccaucaaguacuacagcgacggccagcaccgaccgccgccugcccagcaccgcaagcccaagcccaagcccaaggucggcuuccccaugccgcggccgcggcccaaggccuacaccaacucgguggacguccucgacggggaggggugggagucccaggacgcucccucgugcagcacccaccccugcgacagcucgcugcccugcgacuccgaccucuagacgcuuguagagccuggggggcgccggguggcaaaggacucacccccgcacaggcccgccuggcuucgaguuggaacccggacacuugccccucacugguguggauggaaaucugccuuucgugggaccaaacaggacuccuuggacgauuaguucagguuggguuugguuuucuucuuaaagaguuuaguuuuccucuccagagggaucaggguccucuuagggagugacgggcuuuucauauauuuuugcugaagaauauauggaaaggguggcauuugcgucacguggaccagggacagugcugaaaucagcagugcucagaaacaauuuaacauguugaaacgacaauauucuaaaauacugaugaaucuugcaucaauauaauuauuggguuuuuuuucuuuuuccugcuguauaacuccuugccaugcaaacucucaagaggccaauauauuccuggccauguuugaaugagccucuuaaaauaaacuuagagccaugcaaaugccagcagcuuaauggauuucauggaaugaaauaccgugauuaacucauagcuacauaucauugcauaaaugggauuuaucuuuuuucucacuuauuuuugcggugaaagucgagggcaugcaagaguuucucuuccagaagccaagaggagaacaaagguccuaaugcuguacuauuccacccuuuggacgccucauccaggacgcagaggacucuagguuuaacauuuuguacaaaauggaaccuguuaaucauauuaaagcacauauguauauaucuuuuauuuauaaauaaaauuuuaaaacaauaguuucaguauagccaca

SEQ ID NO: 15592 - RNA, 1518 nt, Homo sapiens
ucacaaggcugaaaaaggaaaguaaaauccuuguguaacccuucugcccagaaguacacuggcacagauucuuuagagacgaauuuaauccagaguguggagccuuuauuaaggaaauaauccggugcaacguucugggacacgcuccuggacugggugggcuucugcacacucacccagcgcaccuccaauccccgggagcgcucggcaccgcccacuucucugcgaguggcugcaaguugcagagcaaaccagggggcgaucuggaacccucugggaguaaagggcuaagcuauaagcgcagggucgacgggcagggaccggaaacaaauucuaggaaccgagauccgcugagcagcagggaagcugcgcagccaccgcgucccgccagcgccgccucuuucccuccccgcccaccgcccgccuggcccggcggggcggcgcgaggacccaggggcggggcgaccuuugcuccggccgugagcaguccaggccaggcguggcccagccgcccggcugcaaggugggguguccccgccgcucggauccccaucucaccugccgcgggcgagguggccccgccgcuuccugcgcucaccucgggucccucccucccgggccagguuuggccgcggcagccgccccugggcgcccgcgcccggacccgcgguuucggucagacccgcccgcgggcugguuucgauuagggccaguaggagggcggagcggccgggacgccaggagggaacuagccuaaguggggacgguccccgugcaggagacaaagagcgucccuggagcgaucagggcucaggagcccgacccggagcccggggcguccgcgcugacuucggguccccggagccuggggcacggcagggagaagacgacggcggagaaggcgacagcggagaaggaaggcaggcugcaggggcgccgucggcgcggcgggccgggaugcggacgccgguggugaugacgcugggcaugguguuggcgcccugcgggcuccugcucaaccugaccggcacccuggcgcccggcuggcggcuggugaagggcuuccugaaccagccaguggacguggaguuguaccagggccugugggacaugugucgcgagcagagcagccgcgagcgcgagugcggccagacggaccaguggggcuacuucgaggcccagcccgugcugguggcgcgggcacucauggucaccucgcuggccgccacgguccuggggcuucugcuggcgucgcugggcgugcgcugcuggcaggacgagcccaacuucgugcuggcagggcucucgggcgucgugcucuucgucgcuggccuccucggccucaucccgguguccugguacaaccacuucuugggggaccgcgacgugcugcccgccccggccagcccggucacggugcaggucagcuacagccugguccugggcuaccugggcagcugccuccugcugcugggcggcuucucgcuggcgcucagcuucgcgcccuggugcgacgag

SEQ ID NO: 15593 - RNA, 516 nt, Homo sapiens
uuucccuccugccgccgagucgcgcggaggcggaggcuugggugcguucaagauucagguucacccguaacccacugccauggccgaggaaggcauugcugcuggagguguaauggagguuaauacugcuuuacaagaggugcugaagaccgcccucauccacgauggccuagcacguggaauucgcgaagcugccaaagucuuagacaagcgccaagcccaucuuugugugcuugcauccaacugugaugagccuauguaugucaaguugguggaggcccuuugugcugaacaccaaaucaaccuaauuaagguugaugacaacaagaaacuaggagaauggguaggccucuguaaaauugacagagaggggaaaccccauaaagugguugguuacaguuguguaguaguuaaggacuauggcaaggagucucaggccaaggaugucaucgaagaguauuucaaaugcaagaaaugaagaaauaaaucuuuggcucacaaaaaaaaaaaaaaaaa

SEQ ID NO: 15594 - RNA, 1209 nt, Homo sapiens
uuuggcugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccaug

SEQ ID NO: 15595 - RNA, 1616 nt, Homo sapiens
ggagacgcagguaauuaguccugcuccagcuccugcgggugcacaacuguucauuauguuuuuauuguuucuuaugauuacugguuuuauggaaugauauggaauuucuuauucuuaguaaucuauuuucuagagauaauauaucagaaugaguauaaaguuauagucuauccuuuuuuuucugaaggcuacaguuggauuacugacauuguucccuaaaugauaauauaagcagaccaaggaaguggcuauaguccagagauuuaugaauacauaaaauuuaguaucacagaaugacauuucuucacuaauuuauagaccaagucucucuuagacaaaugauucauggaaccauuauaauggaaauagaaagacuuauagucaauggaaacuggagcacuaguaaaugagggaagacagguuguaacauuguuugaagguugugacacuguauuuugcuuuuuuuuguuuguuuucaaauuuuuuaaauagagaugcgaucucacuacguuggccagguuggccuugaacuccuggccucaagucauccucccaccucagccucccaaaguccugggauuacaggcaugagccaccauuccuggccaauauuugacucugaauacacaccaagaugaaauaacagagcugauauuaaggaauauuuuuuaauauuuacagaguauaauaucagaucuauaaauguaaauugaaauuuucauaugccuauuaccuauaugugagaaaguaacuauguuauuuuaggaauucuaaguuaguauacccagagccauauuuuagauuccuuuucuaauccaaauuaacaauuuuuaaaaaaucugguagguauuaaaugcaagugaggaguguaagaauuaaaucaguaauuuucuuuuauuugccuggacuccuuucugaaaggacuggcuuuuaaaagaugauaguuuacugauguauagaagauguucucugaacucaacuuccacuguggguugaaaggcaggaaguauaaauugccaaguacgcaaaucaagcuuaacagggggacauguguggguugguaugggguguauaguguauguacucacccagcacacaguggcaggaaaaacggggggaggcaauggcccagaacaauacgcaguguaccccaaaaguagucuuaugcuucaaaagacuugggaacaugaagggaccccaaauguaacuugugcaaaugcacccugcauuuuaggauuaggaaagaggagacacagggaauggaauugggucuuagcaaacauauauaucacaagaaagugcuaccuggcagcaaaucaaugccaaaaacgagcauaauugaagaaaacuuaguuucuaaauaggagaacaaaaggacagccacuuugguguuacugccaaugcaguugucuuuccuuaucuccaguagagcuaugaauugaaaauccaauagaaugcuggucccccuuuccccaaagcccuucuaaauguuaacagguuaaaacuucucucuaaaggaaagacaaguaacuccaccaaaauaagcaugcaaguuaaucaaaagaaauuggagauauucucuggaaugaagaaacaguaagauauuuuacacgguc

SEQ ID NO: 15596 - RNA, 20395 nt, Homo sapiens
guugcccaaauaaaaaugaacaauaucccccaaauaaguauuuccaaaagaaaaucaccagucaucaacauuuauaagaaaacauuuugaagccuuuauuuacaaaagcuuuaaaaacaaauaauacccucuguuuugcaaauaauguuuuguuuaaaaaggaccacccaguuacagcacuguaauaucaugaauaaagaauguacaagggagacaaaccaaugugacuaacauuuggagauuugcuaauauuacugauugaaguguagguaacacacauuauaacuuguaguccaucauuucgggguagaguuaaugauuaccguaaagucuuccuacacaugcucuggucuggucacauauucugcauggcuaaguauuucacagucucuuuugucaauauauauaaaauagauugcaaagauauacacaaaaaaauaagcauuacacuccucagguaauuuuaucagcuauauauauauauaugagaauauauauauauuuuguuguuuuguaccaaaucucuccauuauuuaccuuuguagcaacuaugaaagcacaauuuuugucuucuaauuuaauuugguacaaaauauaccuaaagacuuaucuuuggauuuuuaauaaaauugauuuguguaaccaacaaaucaagagcaucauaagaauggcuacaaaauuuaaaaaaaaaaaaaggguaaauggugauggaauaaaaauaagcagaucaagggaagugugcuaucauaaaauaacuguagcuucaacaucuugaguaccaguuuccuggcagauaguaaacauccaaucacaagggauuuuuccugaaggguguaaagcugguuugaaaauucuucagucacagagcagccuacacaugccaauuagaaacugacagacacuagaugugcuuggaagauuaaacacuacguacagaaacagcaguuacuaagcuccucaguaguuucuugucuuuuuuaaguuucgcugaaucgacaguuugcacaacgugcuauauucugugggucaaaaccaaguaaauacuguguaaaguuggcagauuuuuccagcuaagaucaagaaaaaacaaauuuucugauaaaacagguuuagagucagaaacacucucuaaagugcaaaacugaugguccacgaucucaaauagcuaaaacuccugcagaauggaagggagagacgugaaacagggaaauaaauuacagucagugcuaguuaauuuaggaaaagggaaaaauaaaccaaacucaagucgguaaaguuuaucaaaauauucaaugauguagcuuuccccacucucugucacacacgcuugcuaacaaguauauuaaauuaaggccaaauuuaaccugaaugcguuuuuuuuuuucuuuuuauuaagaucugagauaggaacggucauacuuaguacugaaaggcagacaauaaaaugggccaugaaaggggggggaaagguacugucuauuguucgagggauucaaccagagauaaaaccuauauacaagcauguguguagcucgaaauaaaaauaaaaggacuauuucaugucaugacugcuuguuggcuuccucuucauaugcauucccugugccauucuguacauaggaugaaccagaaccaaggccauacaaaugaccacaauauuuggcaucaucaauaugaucuucaaagaacaucuaaaaaggaauuuugaagaaaaaaaaaagauaauuuuaaccaaaaggaaccacuuguaauuuauauuucagcaauguaaguacugacuguucacugacaauaaugauggcucuuuucuaugguguuccuuugaggcuacgcauuucaguucaaugaguaagacuaauguccucaaaaguacagagcucagaaaccaaagaaagagacuacaaaaaaaguguauaaaugcaugucuuuuccauuuagaccauuuuuauaagaauuuuucaucauggaaaaauaacuauuccauuaauuuaacaauacucaagaaugaagaaagccaaugauggugggggaaaaaaaguuuagguucauaaacugucuuaaaucuguaugcaaggcugagcuggcuauaaaugaucaaaccauaaagucauggacaguaaaauccaaacauucacacucuauuacuguccuugaagaagccaagaaaaauaaagauaaauuagugccagaaauccaccuuuaguuaaauaaaccauuaagacauuuuuaaaaugcaaagcuaaaaaauccaaaagguuguuucaauuaucuaaugaaacaauuggaaggaguccaaaacaaaauauuuacgugucaugaauggauaguccaaaucacuucugaaucaacaacacuacuuagcaaaacagcuuuaaugcuuucuauuaucaauacauugcuacaaaaaguuuuaaauucucagucucaauuuaaugucuaagagaaaauauacucaaauccacagcgaauuuuuccaaaagggaaaacuuauagucaagaaaaaccucacuuguuuuuugcacaaccaauuuuccuguuuaccuauagcuagguguaucugugcacaucacuuaauuacuuaggaguagauaauggguucauuuaguuucauucuuccaucccuaacacuuuauacucaaggaacugaucucugccuuuugccguuuaaggaggguuuuccuaauaugguuucugaugcaacuacuacguuggauuuauuugaucccuucggaauucaaccccccuuuuaagacucaaugcaguaaaagagccugaguucuucucuauaaaaucuucaaagcacugaagaaugacaugagcaaauaauauauuuaucaccaguuuaaaccuuaaaaggggucaugcuagaauaaaccuaauauaaagauuccuugccuuguaggaggagcaccaaugggagucagaaaagaacucuggaguucucccacuaguaauguguuuaaucauggaaguuauuagccuguuuucucaccugagaaauaauaugguuggaccuacaugacuucucagguaguuuauguuuuaaaauuguugguucuaugaugaacauguucucccaguuccuucugaacuacauuucaagaugacuuauuuuugaauacuuuuaagugugguggaugugacucauaugguaucucuaauuauaucuuuacuuaguagguacuuguugcccaaaaucuuuggccacaagauuuuuaauguucucaaccuaacaaccaacugagaaaaaggcagugaugucuucauacuucucucauuuugaaaaaggccauuccugugagcaaugaaucagauccugccugauguugugguccuauccguuccagcucuaacuguucugccaccuccuguaauccacccuagaaaaaauaaaaaauugcuugucaagaagaaaaaucuuacaaggccuaaauucacaaauuauaaacuuagacgcugaccaaaauaaaaauaaacuuuaguauguaaaggugaaucuuauaaagauuggggggaagaaacagagaaugugaauuacuaauguauuuguugaaugcggaaaaaguaucauuuaauagaaaacaagauccuaauugggaaaauguauuuucaucauguuuuagggcauaugacagguaaauacucuccuagauaugggaaggaagcagaccacauauaggguaauauuuaucaaguacacucauagucuaucaauccaguaauaauuauaaaacugaaaagcuaguauaacaccauuuuuuucauauuuucuuaaacuucccaccauccauuuguaguuuucacuuaauuuuuacaaaacaaagccauuaugaauaaucauuaagaguaugcuaaaugcuucacuaugguuuucuuaguuaagacgaguauaugcacacaacuccuuagaguggucugcuauaauccaccuauguuaauacuccuaagauuaaaaaagaaagaugagaguggaaagaguggaaagaaagaaagagaaagacaguaacagaaggaaagaaagugggaggacaggcaaggagaguaaagggaggggagaauaaguagagcgugaaggaaagaaacaccaacaacaaaacaaaaauucuucucuaacuuguuaaggccuccaccggcaaaauggcccuucugugcaucacagcuugaaacaaggcuuugcacagcaguugcuucugcgcuaaaaauagcacgaggauuagguaucguuagcagcugcuuaggagaacagaacuagaacugaauagaacagcauggcugacuauaggucaaaaagcaccuuugucguuaaccugaauuuuaacacagcagcuuacucaggacacauucagaauaucuguacuuagaaacuucccaguaacaaccacaugaugagcaauaauuugguucccuguuccugaaaacuaucauuauacagacaugucaauuaaaaaaaaagucagaugaaaacauguaggccucagcaugcagugcuuucacagggugggcugaauuucucaagcaagggauacccuacugcaaguucacuuccuggaaguccccucaaauuacacagaagucuacugcuacaaacauaaaauaaucuuucuugaaaauuucucuagucauaugcugaccauaucauguauuaaagguaaacacuggccaaaagaaagcuucucaucuucaguuaucuguuaagaccagcgugaccaacacgguaaaaccccgacucuacuaaaaauacgaaauuuagcuggguguggugauggacaccuguuaauuccagcuacacaggaggcugaggcaggagaaucacuugaacccgggaggcggagguugcagugagccgagaccacgccacugcacuccagccugggcgacaagagcaaggcuccgucucaaaaacaaaaaaagaauuaauguuuagaauuuaaaaauacauguuaugcagcgucaaaauguuacuacuaucuaggcaggaccuacacauuucccauaguacuuaacuguaacaagcugacaucuuuuggccacagaaaaaucuuuuagcuauauaguuuaauccuaggagcauuauccuaucacuagaacugacaaaauaauuucuagccaagauaagccaaaaggaaagaaaaacuuuugccacacuacuaaauacaucugcauaucgcuggccaccuuagauuccaccuuguaagaacagauucuaugcgucuugggagaaaguaacaacucacaauggcgugcauaugagagccucaauguccucagauuuguguuuugguuugugauuuucaaucuggcaagcagugacaagaaccggaccuaagccugaaauguguugaaaauucugccuucugccaagacauacugaagcucugaaaaaaggauucccuacaaauuauguaugcaagaaaaaaaaucacaugaccagauaauauaauugcauucacuguaauacuuuaaaauaugguuuaaaacaacaucccagccuaggcucgcaugacagucacuuggucugaacagugugcugcuguagauaaugccauccgaagccuuacuuugagauuuuugcagcucuucaugagguacuucacaucauaaaugacaggaaaaaacaaucgaaggaucucaaagaagucaaguucuucuucaggcaaguuagaguugguuaggauuuugauuaaguagccaaagucguaaccgcuauaaaaggguuaaaagaauagagaagagggacauauaaauacuauaaagauuaaaaaaaaaaguuuuucugauucaaauuuaagcaagucacacuagagcccucccaaaaacauuaaagagaagugcacacaagaacagagaaaacaaacauauugagaacuaugagaaaaugucgucaucuuacaguauuaagaacuuuaucacuuuauuauucagagauaucaacacagaccuacacuaccaaaccagccuauggucaauaaaauacuauuuuguugauaucugaauagagaacaccaagaagaguaucaagcugcccacagaugucucaaaauauuuuuuaaaguaacuauggaaauggagaaauaaagaugaauggaaacuuggccagaagaguuagcaaagguagcaagagaacuggcauucgguagacaaaaguaaugcaagucaucccacuuuuacauaagguggucauauacuuuauccaaagaauaagacuguaacaagguauuuucacuucucuuaaaugacuguguuaaguagucucucccuuuucuuccuucacaauucucuuccuuucaguguggcucccuaagagucauuauuaauggaaaugcugcacauggaagaagugaaggguaguaaaaaaauaacuacucucuugaucauaaaaugcaaacuccuacacucucaaauccagaacucuucucccuuuguccggccuuucgcacagcuuucugucucccuacacucccaggccacuuagacacguccgucccuugucuaccuuuccuuccaaggaccucuaacaggaagccuauaugacauuugcucacuaacauuaaaagauuauauuagcgcuuaggauuuauaaacuucuuaaacuauucuucauuacuugaaauuagaauaugaggaaaacaacuaaugauauuuaauggaauaaaaucuucuaucuugauaaauauucaaauauaucagucuaacuuagauucuaaacuccaagaagacaugaaugaacccuguuuguuuuuguucaucuuaauacccagugccuagugcacuguauuuugucagaguauuuuuuaaaugaaaggguaugucauauacaguaaaagggaagggcaauacuuuccaguucuuuugcaccuucauaucuagggaagaaaaaugacuaaaaaaaagguauuuguaucaagagucuuaaguuauguuuccuaagguacaaguucaagugcagaagagacaaaaaagaugauagguaagaaugaguguguucaguaccuacaacucaaccauuucugguuaguacacaucaaaguugcccacaugaacaguccuucacuauaaacaucccacagaucagagacagaaacuaaacaugcaggagacucagauuuaagauacaugugugaaguggaccaaguaugagaguauuaacaucuauguaacacaaugcuuuuucaaaaccuaacaaaagccaauaucauucugaagguuacuuuuagucccuggaacgucaguuuaguuuacuuagaugggaaaacucuuuuucauaccuggaagucuauuucacaaaaucggaauaguuuccuuaccagaaacacucuuaaauaaucuaguuucauaacaauaaagaauuuagaaccaccacuuauugagaauuuacuguuuauaaaguauuuuggugaccauuaaaacaagucuucaagcuauuucuucuaagggaugccuuaucacuuuaaaaaaaaauuaaaauccaucuccacacccaucccuagcauuuucuuugcuguuuugagauaguacuuaucacuaucuaacaaaucacaacgugaacuccauuuuuaaaaacugucugcccacccccaugagaauauaaacuccaugaggaaaauaauuuucaucuguuuuauucacaccuuaguuccuagaaucucaucucagugccugccauaugguaaauacucaauaacguuguguaaauguaagugaaugguuucccccguagaacauuaaaaacuaagguguagaaauaguaaaagaaaacccuggguaacaccaauuccaaauggcgccgcuggauuuaaaccagggucuuucacuuuuuagagaaccuguacuguuuccacuaugcaacaugcuucucacaggcaaaaauggaucccauauuuuaaauuaaccuuuaagcagaccaacauuagccuccuaagaguuaggagacaacucuauauggcagucaacucuuuccagaauuaaaccugaaauugcuaacauagugacccaaguaaguguggagcaaguaugagauggaaaaacaaaugccauuuucaauguagucguuuuaccuaugaaaugacaaccauuugaccccuucacagaggaccacuccagaagucauaagaaguucugcaaaguacuggguuucaauuccuuccuccucauguuuuuuaaacuggauaccagauguuguuaguagcucuauagaguccugggcauacauguccucccuggcagaagaaagagaaagacaacauucaaacaugccauuacuucaaacaagcuguucuucugcuuacaucuauaacuacagugccagaaaagagacagaggaauggcuugaguccaccuguuucaaugcuuuauauauaugcaagaaaaaugcaauuuaaauacaaaggucauuauuucagaaaaguguuucgaauaaaaaaucauucagagaguccaaaggugcaauuuuaaucuuuuuucuauuaacucuauuagccuuucauacuuaaauacauuuaacuggguuuggaaaagggucuccuauucaccaggggcuaccgucgcaaagugacagacaaguuuuuucagagacucucagucucagcagccacuguaaugcucccagauggagcugcagccauagcuguggggcauaugcccaucucccgugcucucagcagcaccaguaaggagacccaguggaaaaugucucaugcggaugaguuaaacuacacuucaucuuaaagaaggagaugccuccuuucacaaaugagccuugcaaaugccuccaauaagcaacacuguauaaaggacuguacuguaauagcaauaauuucuucugccaacaauccuauuccuaaaagacugccuuauaaaaucaagccaggaaaucuaaauauaaaccaauucuucaagauuucacuuaagccaaaaagaaagccaucuccaaccucaaauauauuuccaaccacaaauauguguaucugaaauauuaaaaguuuccaaaauauaucuguaucugaaauauuaaaacaaaaaaguuaccaaaauacagauacauuuuugagaauacgugaaaaaguguuuuuuuauuuacuuuuuaaauuguaagaauacugguuucuaccucuuggcaaaaggaauuccuauuaaacacuugacaaaucuaaaccaugggguucacuucacuugggccaaaaaguaucguuaugguuaguccuuuagaaaucaauuuauuucuaaaugucugaaaaauuacaaaacaauggaaauauuuuaaaagagaaggaaaccacaacaaucacguaaaagucagucuccccuggaaaauccuuuaggaaggguaacagaauaaacccaaugaaguaguuucuuuuuuuuuuuuuuuuuccagugaaaccacagcuuuccuaugcuaaaaauauguaccucaaaaaauuagaaucucauucaucaggucccagugcucacacugaggcaugccuuagcaacuauaagcaaugaaagggauaaaaaacagauucuucuccaggugcacaucauucuuggccauuugccaagguauagguauacaaguaguuuagaccuuuuucucuuaaguuuccaauaacacccuucaccugucuacuugcagcauauggcuucaccccauaccugcuuuacaaagaaacaucagauuaauauuccugucuuucuuuacaucuacguaugugaagaucuuucuuacuuagacuacaaagacagcuugccucaucgccaaagcuaauugcuaccaaugccuuagacgcuauuccaugccauuccucaaaggacuugucaagugccuaucuuuauccuaacauacaacuccuuaacuaacucaugaacacacaaauaugucuguguauuaucuguaaaacaaaauaaaaaccacuauucuguugauucugcuuucccuucuugagacagggucuggcugucauccaggaagcaguggcuugaacacggcucacuguagccuugaccucccggacucaagcaauccuccuuuuguagccucccaaguagcugggacuacagauaugagccaccaugccuggcuaauuuuucuauuuuuguagacaggguuuugccauguugcccgaacuggucuuaaacugagcucaaacaaucugcccacccuggcuuccaacuggccucccgaagugcugggauuacaggaaugggcuacugcauccagccuuccuucuuauggcacucucuaucuccuucuuuacacugccacuuuccuuaaaugaagcaucagcauccuuucuguuaccaccaaacccaaggugcccuguaauuucuacuauccuauugaauuacugcaaucaccaaaagugauuuuucuuuuuugagacggagucucacucugucgcccagacuggagucaguggcaucucggcucacugcaagcuccaccuccuggguucacgccauucucccgccucagccucccgaguagcugggacuacaggugcucaccaccacacccagcuaauuuuuuuuguauuuuuaguagauacaggguuucaccguguuagccaggauguucucgaucuccugaccuugugauccgcccgccucggccucccaaagugcugggauuacaggcgugagccaccacgcccagccuaaaagugagaauuuguuaaaaauuuguuuuaauccucuuuaucagugacauuauuuccacagaaugcuucucuucuucacagcucaucaguacuccacuucaauuuucauggauguaucaacuccaaauucaguuuggagagaauucccauacguuacaauuguaauucuuagacuuaggcaauagagagaaaacagaagaguuacaaaacacugaguuauaaagaccacgaccaacuuuccucaguacuaaaucccuagugucuagcacuguaacugacacucauucuagccaccccauuaaaaagucaauuuugaucuuucuuccaaauuuccaagauucucuucacggugcucucucuauauuaggcauuacucguuuaucuuccaaaugacuucuucuaccuaauguuuuucacuguauccuucuccuuaaacaucuccuaacaucaguguaaaucaagcuuguccaaccugcagccagugggccacauguggcccggcauggcugugaauguagcccaauacaaauuugucaacuuucuuaaaacauuuugagauuuuuuuuuuuuuuagcucaacagcuauuguuagcauuaguguauuuuauguguggcccaagacaauucuuccucuaguguggcccagggaaaccaaaagauuagacaccccuaguguaaaugguagcaaaacuugguaguaaacuuuagcagucauuuuugaguaagaaagaaaaaaugucacuuacaggcuguacuaagaaagcaguuguuacucgaacaaagguguuucuagaaaaggaaacugucaauuuuauccaaacugagaagcugauggguuaccuccuucucacguacugagaucacaauaguaucuaauuuaaaaacaauguucuaauucacuugaacaaaaaguuaacauggaacaaaugaaaugguaaagcacuaauuuuaauaaagguuuaucauuugagaaaaaggauaggaggcaauuuucaguguuucacagauguaguucuuauaaaagguuuucaguuugaguggaguacuuugcacccuuuauaaaugagguguucaaucuuuuggcuuccuugggccauacucaaagaacugucuugggccacacauuaaauaaacuaacuuaaacaacaacaaaaaaaucucauaauguuuuaagaaaguuuacgaauuucuguugggcugcauucaaagccauccugggccaaggguuggacaaguuuacuuuacaagguucuguagacugugcguguguguauagauacagguauuuuuagagacaaaguaucacucuguugcccaggcuggagugcaguggugcaaucuagaucacuauagccuugaacaccucaguuaaagcaauccacuugguucagccucccuguaccuguagugcuagcuaccuguaccuguaccuguagugcuaggacuacagguacacagccaccaugccuggcuuaguuucauuuuuuuuuuuuuuuuuuguagagacagagucuauguugaccaggcuggucuagaacuccuggccucaagcaauccuccugccuuggucuccaaauggagaguauauuauuaaacccaaaagagugaaauggagagucaggcuaaacacaguguaauuacaagccacacuacuauaccacaggcaucauuacucugcuuuuccuaagcccuacuuucguaaaauuguguauacuaaauaucuuuguuuaucugacaaagaacaggaagaaagaauucauacauuggcacuaccauuaauugccuacaguuucuuucacuauuuuaccuaccagauauuaggauguaugacacaaauguaggaugucaaacagaagaacaaugcaauauugcaacauacaguuaaguacucacucaacguuaucaauaaguucuuggaaauugcaacuuuaagccaaaagauggauaacgaaaccaauuuuuaccacaggcuaauugauaaaaacaagaguuaaguuccuacggcauauuucuggucacaaaaaaaucaucaaacuucuagauaaagaccaaaauacuucuaauauuaaacaaugaaauaaaugugagcuauauguaaauuuaagaacaauuaauaaaaacaagauaauuauuugcuccauuauucaguugaggggugaagaaagccagagccuauucuggcagcucagggcacaaugugggaaccaacccuggucagcaugucguuccguggcacagugcacucacacagauacaccuacucacucacacugggacaacuuagccacaccauuucaccuaacgugcacagccuugggaugugggaggaaaucagaggacccgggagaaaauccacauauacacgagaacgugcacacuccacucagguaguggcccgggucaggaaucaauuuuauuuuuuaugaagguuaccaugaaacaauguugaagaaaaugucauuugagguccugcuguaauaagaauguauuauuuuauuuacccaacuuaguuugcaaauaaucugccccucucuaaaaacaucuaaaacuucccuuagcuaucaagacuacuucuauuaauaauacagaaauauuauaacuaaggaaacugggugaagacccagggcuugaguuagaaugaagauucugacauaugauaaacaccagguucaaggauacuacuacuucuccuauauguaaauuaagagagcuuuugugggcugaaguggcaaccuaaugauaauacugacuugaaaggaaaacguacccaagguuccagaaaacgucuuacugcauuugacauguaaucuacucauaaacuggaauaugaaugcaacaaaaaucuucacaagaaggauaaauauuauaaaaggcuauauuucaaauugcacacaaaauuuuugaaaguaaaacuaauguaggauuauuuuuucuaucagaaguacuuucaauacccagucuuccaaauacaaaaaaagcugcagucauauuuuaaauauaacaucuuuaacaucaaaguauuuuuuuuggucccauaguaaaaaagaaaaccacgcuuuugaaauguuacguuuuauauauuuccaggauaacuacaccaaauucaccuagcaugucaccauacuugaggaaaaucaauuccuaagauuaaagaaaaaaaaaaaaaagucuggguuauacaguuauuucccacuuacgucaaauuaaauuuaaaauuaaacugccaaguugaaguuccuggaggguauucuccuugcucauucauaaaugucaguccuagcugaauuaucuuuaacaagucuacauuacaccgcaauaguugguauugauagucagcauugcuccugaauucuccaaugggucuugcaaccacaccuggaaacucgguguccuguaaaauaguuuuaagauucauuauguacuaaacagucaaaacuacaauccacacauuuuuaauuuuugaugcaaaucaaagaauccuacagaugauauucuacacauuuauauucaauuacaaaguauauuuuaacuagaaagaacaucacuuuuuagaaccauaaaacucuauaaacuuaauaaccuuuccuuaaauauauccaaaaaguuacuauacgagauacaugugauaaauuuaaccaaauacuuacucuauaaccaagaaaggggggaaaaucauaaauuccugucucccaaaggauacaugaaaugaugcucacaguauuccaaugcuaaaaccaaguuucuugaagaacugguucaaaagaggggaaaacgcccuguacuuuccaauugcuucucugacacaagguuuuucucaacaccaaaacccuaagaaaaacaucauuagcuuccuaauuucucuggcuuaaacaauauucucucuauaguccacagaaagcaugcugucaagaauugcaugccaccuacucacucuuguaggauguuaucacuucucuauguugccacucuuuaucaucugagaaaucaaugaucacuaugaauuuccauugguuaagaaaacaauuuuaguucuaaucauggguaaguacaccuuuaucaaauaguaugucaucuacaaagaaacagucauauuuuaaccaaucaacuugcuccuccccaaaguaaugcauuuguuuauuuuuauuaaaaauacugagacaaagauacaucgguuuaguauuagaauucaaacuagggcuagcuaagaauaaaaacuaccuaucaagucacuaugaaauaguaaagaaaucaauauuucucuaaauucagugcaauucaacagccacuuuauugaauacuauauguguuaugcuagguguugggagagaaaggauuaaaacacuugguuuauggagcuaauaauaauccaguggauguagaaaacaguaggguagcuaacagauauagacaguauaaugguaaagaagaaaaaucauuaacuggauagacaaucuaggcagaccaaacagcacgugcaaaagcagaguugcuuaguaacacaguauauucacagaacuccaguguuaauuaugaaaacaaauugcagaccaacaacguuucacuggcacaucugauuuuuuuguuugagaaagagcacccuagcuucugggagcucaugugguacuaccagcuaggcuuugguguugcuaggagcagaccuggcacucauagccacgcccuaauguucuccuguugaacacaauuucacaaaaguucaaccucaaauaaggccacucuguaaucaugucugaacaaggacaaaaaaauaaaaaugucaaaccacaaaaugaccaaguaucuccauccuggcuaaaugaaugacuguuccuucucugcagcuuuaaccucauucuagucucucauuuaagacuuaguaagauacccaaucacagaauuaccccagcuucccgaacacauccaauccacaguaaagcucugcuucccuuaccuuccccuaagaccaccugacacgagcccaaauccuuccuaacucuuauucaaacggcccaugguucccaugaauuccagugcguuuucccucacugcaaugagggauaaacccaaccugucaaaucacagguguauuccugauggauuuuggcuggagggcagugacaaauuuuacuuuucauggugaaauuaaucccuaaaaauaucaaccaaaaggguugaauucaagacuuuaaaauuuccuuuuccuccuuuauaugaagcguuuuaaagaucugcuugugggcauaccauagcaacguaauuauauuuucggauaacuugacgaauuuucuucaucucuucauccaaguugcaagcccaaacuucacaaauucuuuggcuaugaucuacaguugccgcuggcauagugagggcacaagggagucuagaugccaagcaucaaaauguuauacuugauugaagauuuguuucauaaaauauuuuauccuuuauuuauguaccugucaaaauaaaaaaacaauaugaagaccagauauaucaaaucugaaucacagaauaauugauccagcaggaaccuaagaaguuauuuauucaaaguucuugacucauaaaaaaaaaaaaucaaaguuuagaaaguaacuuaaggucacacagcuagucuauaggaaaaaaaggacuacaguacagauuuccugguccuaauuucaguuauuuuaaaauagcuuuuuuacacauacauacuaaucauauuuuauaacuuuccacuaauuauuuaucugaguucaacuacucugcauaaaacuuuauaaagccauccauuuccagacaaaaaaugaaaaauuacuuauuuacaugugacaagaucagauguuaccauggcaaagaugguguuuauuuuuauuccucauuaauaaaacaaccaaaauccgacuugauaacaagaucuacuuuaccggcguuuauucuaacuagacuagaggggucaaaaauguuuguaaaugcucugagaaaaaaguaacggccaugaaaauuaucugaauguucgcaguugcagaacggaaaaagaacacaauagaacgucuaaaacuuagagcauauugcaugguuaccaaagauagaugucacauuucuggucuauaaacagaguuccuguugauucuugggcagggaaauuucaaauccuucugcauuuuucauacaaauuggaaaaaaaaaaaacaagaguaaaaagagggucuuaugacugucuucuaaacucugaagagucacaaauguaacuuccaauucuccaaguagagaaacuaaaggagauccaggacaccccuccuuuauaacucucccaccccgauaggcacacacacacacauaagcacaaaaacacaaagacuuggaaagacccuguagucuaacauuguuuuccuccaccucucucucuacugcagucccagaagccccgaagagacaccaaaggccuucucauuacuggagaaagcaucuccguacugcaguuucccagagaaacgagaggacggcaccgagguauucaagccauagauaacucucuucccuggcaaagcgccagugcgaaggugcugauaacacugacuggagcuacacugacucccaagcacugccgcgugaaacaauacgaagaggugaggaucuaggccaccgcccuccacucccaauuuccgucccacugcgaagccccagguacaaagccuuugcgucaucacuacgcgccaaccccuugacaaacccccagccccaguuacccagcccccaacccgccgccaggcuccuuccuccgccagccgcacuccagcuggcgccaucgcgcacccucucagguucaucguccccgcccccuuucuacuucccuaacccgccccuccccccguaaggcugcagcggaugcaagaucuacuugugucgcugagcucgcgcuccuccuccuccuccucgccauagagacagcacucggcggcgguggcgguggcgguggcgguagcggcggcggcagcgggugccccauagacaccucucgcccagcgaagggaaaggcgagcaggagcugcgccgcaccgugcugcgccgucgcuuuucgcacguccugacgggggcgcuagaugaugacgcgacacgcagagggggcggagagcgcccccgggggcggggcacgcaagugacggcggcgcgggugguggagcgcugggcggccaggcucccuggcuggccgguuugggcgucugggccgugaaggugggaccuccuguuccgggccgcaaguuucccucuccagccgcccgccguucguagcaugucccccagaacucggggagcgcaggcaggacaggcuuagagaagacgcgguccccagcgcuugggccacggacgucccaccccgcuccucugucgcuggagaaccgccgggccgagccacugggagaagcaggccagagccuuccagggccuccggcccguggacccgaggaggaugagcuggcuuuuuccccugaccaagagcgccuccuccuccgcggcugggucccccgguggccucaccagccuccagcagcagaagcagcgccugaucgagucccuccggaacucacacuccaggugacuggucgcugccucuccaccggaggaaaaaguagggugggagggcgggcuuguccuaaccacccucacagcgccucagucugcuccccaccagcuccucaugugguuuaccucccuugguugugggucacacgcuugcucugccacuccugcccccuuuuacuguuuuccuccggacccucccugccuccugccgcaccacugcucagcgcuucuaacucggauuuccucaucccuccugacacauagcugcugacuguaaucucucaaucucucucauagucuauuuccaguaucccuugcugcccaggcuucgccacugaucuuucccuuugcccaccugauugccgcgucagcagaauuguuaaaauacaauugugaagaguaaucuccagguuucacaaagaauggaaaauagaacuguugcaacaucaaaggaaagggaagccagaguuuucaucagugaaugcuucucgucugagagucacuuaucacguagucagucuucuugagucucuaagauuuacccuguuggagcagucucuccccaucucacagcgaccagugcauguacauuucucacuucuuucauagucuuguccccacgcucaagaauuacuuuauguucaucuugauuguucuguugucuuccugugaguuuuucauuuuaucauggucaguuuagaaauauuuuuacaauucauauuauuucaacuuuuacuguaaauugguuugcugcagccuuuuacauugcaaaugucuauggucucuaaugguuuucaaaaauuagaacugcuucuuuauauuuuaugcauuuugcaaguauauuuacuuaacaguuucacacuauuuuaaauaaagaugacaacauuguuaagucccuaaccccuuuuuuuuuuuuuuuuuuugccggggguacggcucuccuguugcccaggcuggagcgcaguggcgcgaucucgguucacugcaaccuccgucucccggauucaagcaaucauccucccucagcuccccacaccccuccgaguagcugggauuacaggugcgcgccaccaugcgcggcuaauauuuuguauuuuuaguagagacgggguuucaccacauuggucaggcuggucucgaacuccugaccuuagauuauccacccgcuucggccucccaaagugcugggauuacaggaauaagccaccucgccgggcuccuagcccuuuuaaaaauauuauuuucauacaguuaaaaaauauguauccucagauaauaucgaauaauucuuauuuaaaauggaauaauuuuuaauuaaauagucuaguuaauagaaaaauuuacugcaaaaucaguuuggcuaaaauaaggccugaugcugacugaacuuuagguguuucuugguucguugucucaauuguucuguuuguucagaacuuucaaaaggugaaauuuuaugcuguuuaacagaaaagaauggcaggcuguuauugguggcuuucauucuggaaaauuaaguucgcaaaguucuuacaagucacucuuacuccaaaucauguucuguacugaccuuuaagagcuacucucacaagguaugcuuauaaaauaaggggacucguuuuuaacauguuuguucccuuagaaguuguuaccuugguagacuauauaccaaaccaguccugcuauugcagaaacacuuuuuuagaaccacacuuuuggaauuaauugcuuuuaaaccuuaguauguaguauuauguuaaauauuuucaaugcugacuaauuuuuuucuucgagguuggaguuuaauuuuuuaaauacuacaaagucucuugcugcuaaggcugguaaguaagggaaguaauugaugugaaauuuauaauuuuggccucccaaauaaagugagauucuauagcagcaauuguuaauguaaagaguucuggaauuggcuuaagaggaucaguaaauacgcggaguuggauacagaaaggauucauuuuauguauuauuuuuugaaccagaaauuaugaacguaugauuggacaugauuacauuagauaauguaauuuauuuuguaguguuaugaacaaauaacuaaguauuuuauuguuuuaaguucuuuuauaaaaacacuugaaguuuuauugagauguuucgcauuuacaaauuauacucgaauaauuccggagacacuuaag

SEQ ID NO: 15597 - RNA, 167297 nt, Homo sapiens
cgggucccgccugguagccgccgcaggcgugggguggugccgcgccgcgcgcccccaggugcagacgccgcccccgagaccuccggggcggguucucggcgaccccgccaguggugcaaagggcgccagcccuccccgccucugcgucuuugcucccggagcgcuugaaggagcugcggguaagugcgcgcuggaaucuguucccgcugcccggcggccgggguggggaggggacaggcgagcgcgccgcccagggugacgggaccgguccucggggaggggagggggcguuccaggggccugggggccgaagcugagggcuaaagggggcggcagcgccggcggagcggaggcgggucucacgugggccagcgcagagccugcggaagggacggaugcggaucucgucgcugucaccuugaaagugaccgaggggcuugacuguggacuccuuacgccgcccacccgggcccggcggucccagccuucucgcagggccccuucucagcagaagcaagcggggccgagaaagcggguggaauaggguugcugcaggucccaaagaccccucguggcgccucgcuacuuucugcagcuuguuugcacuuuuucacgcucuagaaaaaucucaucuuaauuaaggugaccuuauugacuacucuauagugcuuaguggacuuagguguucacugaggaacguuuuuguucuuuuuugaagacguacuccuuucuaccaaguuguuuguugauuuuugacuuggaguaauuugggacuaggaaggaagagguuaauucauuuagccugcguaguuacacauacucuguuaaauacuguuuguuugaaguagucaguguucuaagaaaggaaauccaguguguuuuguuuguuucaaugaaaccaaagucuuaggcaaaacggugcguggaagcuuucaaguuuugccaggugcaggugaucgaaagucaaucaucacuaaaucacagcgcuggggcuggagggugggaguagggguguuaccagugaauuucaggaggaagggaggcaaugcaggagggaggggauuaaaaaagagagucauugcuuccugggaaccagugaccucuuuaaggaggguauauacaagauaacagugcauggacaacuuuaaaaggaauugcauaaacggaauugcaauucuguagacaguuugcuuuuucagggaugguuagggcaggaaaugauacacaacuuaaaauggugauguccuguuaguacagugcuuuacaguguagaaagugcuguuacagauuuuuuuuuuuucauaggcaauauauuccauuaggaaagcuauacaaagaaaagauuagaacuacaugcuuauccuuaaaaccaaagcuaaaaaaccuuagaaguggaauuuaguuuaaaauaauauguaguuauuuauguaacuugcaccacguuuuuucaccuguucuuuuuaaaaucagguuuaugaagagaaaauaauucuugguaaaucugcuugguagaaaaucaugcuuggaacaagaccuuuuaauuaugucaauaagucaagguuacauuuuggaguauaauaggauuauaagauucuagauaauaucuuauauuuuuuggaaacuaaccugcaguuauuacacucaagcauuuaaaaagccuguuacuuaauagcccuguucuguuaacccuguuuguuuugauuucaaaaguaauccgugcuugcuguauaaaaauagguagauugagaaaagugaguuaagcaauuucagcaaagauaaucacaguuaauauuuaagaaaauacuuguuaauauauagaaaaauuuuuuauaguuauauaguuuaucuaaauauacuauugcguggagguuuuuuccugauuaauguaucaugaaaaauuuuccaugucaugaaaucuucagaaaucuuaguggcuacuuaauauuacauuacauagauguaucaaacugguuuucauuuauuuccacuuacuaaauauacuuuugcaacaaauacguuuuuaaaacuuuaugugcaggguuaauauccuuagugcccuugaaauacaguugaugguuggaagaucuccucauacauauugaccauuugcuuuccaaaaaauguuuaaccaaauuauguucccaccagcucucugugagaauacugguguuaccguauucuugucaacauguagaaucauccuuaaagggaaaaaaaaaaaauucuucccagguuuauaggugaacagugcuuucucuauauuuaaacuucaauuucuuugauuacagaugauuugaacaccaaagaaaucuaguuguuuuccauuuugaaauuugauguagugccagauuuuucuccugggauauuaguauuuuuccauuaauucauaagagccuuuuauggauugauaguaaaucuuugccauucauauugcagauacuuuucccauuuuaucuuugcuuuauauauuuacaguaguuuugacauacacaaauuucuuuaauguugauaaaucuguugacuuucucaaaacagaauuuuuaacacuucuaaaucguagcuucagaacuauaugugacugugguagaagauuuaaaaaaaauuuuccagccgggugcgguggcucacgccucuaaucccagcacuuugggaagccaaggcgggcggaucaggaggucagggguucgagaccagccugggcaacauggugaaaccccgucucuacuaaagauacaaaaaauuagucaauuguguuggcauggaucuguaaucucagcuacuugggacgcugaggcaggagaagcgcuugaacccgggagguggagguugcagugagccgagaucacuccagugcacuccagccugggcaacagggcaaaacuccaucuuaaaaaaaaaaaauuccccaaauucuaaauuagaaucuuuucaaauucauugcaagaacuuccauaucuuggguuagagacuguugcaaaacuaauugcauuuguugaugagaagccacugggccugguauauacuauuaggaacaacauccuuugaaaucagagcagaaaguuuuaaaucccuaagacugaauguuuuucagaucuguuauucugugauuauacaaaguaggcucacacuccauuuauugucaguaaucuauuuguaguaucauuuugccagauucuucuuuuuauagucauuauugugguuucauacggacuuguugauguccagacaaauguacugcauacguaguuaaaaaauuuccuggauuaauuuccaauacugcuacucagcaaaguauuuauuugggggggcgggggaacacgucuuccugauaucucaaaguuggguucuuucucuguguugugaaagcuugaauauacccugaaaguccucacuaaaggaaguguguucuccaugagagccugagucccuuuuauuccccaagcuuagagcguaagaguaagcgauaggaccauauuugagccauaaggaugaaauuggaguucaggaucugcgugcuuaggggcacuuaaaaauggccucagacuuucucuggaagaaggcaggccccggagggaggugaccacuuagcagcggauacaguggugacuguggccuccugagaaggaggaugagcgaucccacccacaggaaaugaaggacuagaugggaugguaugaacucagcuagcuugaaaucuggccccgaaaagccuacuuugaccagggagacuuuauaccugguuuuggaugguccaguauaaccaggaguugaauuugacuuguaauuucuucuaacuuuuuauuuuauuuuauuuuauuuuauuuuuugagacgggauauugcugugucacccaggcuggaauacaguagcaugaucauagcuuacugcagccuucacgucccaggcucaagcuauccucccgccucagccuccugaguaucugggacuacagucaugugccgccaugccuggcuaauuuuuguauuuuuuguagagacaagguuuugccauguugcccaggcuggauuugaacugcugggcucaagcaaauccucccacuucagccucccagagugcuaggauuagaggcaugagccaccgcccucagccuaaaaauuuauuuugagauggagucucacucuguggcccagguuggagugcaguggugcgugcgaucucagcucacugcaacccccaccucucagguucaagugauucuccugccucagccuccugaguagcugggauuacaggugugcgccaccaugccuggcuaauuuuuguauuuuuaguggagacaggguuucaccauguuggccaacuuggucucgaauuccugaccucaagugauugccuacgucagccucccaaaugcugggauuacaagcgugagccgcugugucuggccuaaaaguccggccuaaaaauuuauuucuaaaccaaguuuuguagaugauugcccugaugaugguuauuuauuuauuuucuuagagaaaaaucccucaguaaucuuugaauuuacucuuggauauggggcaauuuuccaugaugacauuaaucaugacuuuuucuugcucacuuggccuuagaaaugguaaaagagacuuccauuuuggaggugacagauuugggggcucuuugccauguggauacauaagauaaaacuuccuuuucauacccuagaagcagauuggcaacuugugauugcucugauauauaaauguuacacaaucaaggaagaaaggguggguuuucucaacaaguuuagagugugaacaaggucgaacuuggaagugcuucacuuaaguaaauagcuuucagguacuuuagaaguacguauuugcauauaaaucuugauuacaaaauaacuuuguucauuaaaguuuagacuucaagcuguauauuguaaaguaauaaaaauguauuuauucaaagauaaacugcauuuaaaucuugcuagcaggcccauaucuaaaguaagaauguucuuggggcugggcgugguggcucauuguaaucccagcacuuugggaggccaagccaagcggaucacuucaggucaggaguucuagacuacccuggccaacauagugaaaccccaucucuacuaaaaauacaaaaaauuagcugggugugguggugggcgccuguaaucccagcuacucaggaggcugaggcaggagaauuccuugaauccaggaggcggagguugcagugagcugagaucgcuccacugcccuccagccuggccaacagagugagacuuugucuccaaaagaaaaacagaaaaaaagaauguucuugggccuggcucaguggcucacaccuguaaucccagcaauuugggaggccaaggcagguggaucaccugaggucaggaguuugagaccagcuuggcuaacauggugaaacccgacucuacuaaaaauacaaaaguagcuggugugguggugggugcuuauauccccgcuacgugggaggcugaggcaggagaaucacuugaacccgggaggcggagguugcagugagccgagaucgcaucacugcccucuagccugggugacagaguaagacucugucuaaaaaggaauaaaaggaauauucuuguauacacauuagcuacauaaauaaaaguaagaaaaacacacauuuuacccucauucuaaccuagaagcuuuauugcuaggacacagugugaacucaucuaaagggaagaacagacuaggaauggaucagucuuucagguaagauguauuggaagagguuuuuaaaccauuaaaugaccuuauucuuuuaaaugcauaaauguguaccuuauaaguaaauugugucuuaagcaugaugcagaagaaaagaaaauuaguauuuaaauuugaggacuaaucaaauauaauuauucugaucuucuacuguuaacuaaaacauuuaaggacauuuuguguccuaaaaugacauugaaaagggaaucuugggaaagacucauacuuaucaggagacuaggaagaagaggcguaacauacauucuuguguaaauaauguuugugacaguguucauuaagucuugacuguuggguaguuagcuuaucuuuuaugcuuuuuguacauuggaaacaugguaauauuuaacucagguguuauuuacacauauaccaaucuggaugaaaagaaucaauauuucuucaccuuauuucagauaagcaguucauaggagguauucagcaguguucagugacaaauaagaaauuuauuuuccuuaauguuuauuuuguagauuuuugcaugauuguuagcuaugaaugauacgaaguugaaacugcauguccucguaaaacauagcucccuuggcuagcuuuacggaaugaaaauagaagccagcauagauaugagcaguuucugagaugacauugaaacauagaccuacccccuuccccugaccucugugucaaggugguugagucauauuucccagaauucugauuaagucaccuugcacuguuaaaaucuuauuuuuuauuauacuguaaacugcuauacuguuaaucauuucguuguuaaucaaauuacagaauugaaccauauuugcuuauuacugugacccuaagccaacaggcuuuaauugaagugaggauugcagaaguccuccuugcuggugggucaggauaggguagaaggauauuggagaaugagaaauggauuuaaaagggcugagccaugccaagaccuagcuaccaagaaaaauucacguguuguauuagauccccaaucuaggccccacauacagaaccaagucauuuauacguaguguauaguuaggcuuauauuucauguaaaaugauaaauaaaaagcaugaguaaaaauccuugcuguuagaauauuauguuugauuuuuuuuucuuuuaucuuuuuuuuugagacagaguuuugcucuuguugcccaggcuggagugcaguggcgugaucuuggcucacugcaguguccgccuccuggguucaagcgauucuccugccucagcuuucugaguagcugggauuacaggcaugcaccaccacgcccgucuucauuuuuuauuuuuaguagagacaggguuucaccauguugaucaggcuggucucgaacuccugaccucaggugauccaccggccuuggccucccaaagugcugggacuacagacgugagccacugugcccggccuguguuugguuuuccucagccucagccauuuuugagcacuuucuaugggccaaacacugagguagaagagaaaaaaaagaauuugaccucuuuucuuggaggagucagagaaaccccaaucauugugaaaagugcaguuuuggagauguuaguaaguguuuguguuguucgaaauauucucccagguuguuaacguugggcuuugcauuaaaaauuccaccugcugacuugaccaaaguuuggucacguagguuguauugacauucuugguuauauaaagcauccuugucauuaaucaugcuuacccuuuuccuucucaccaaaaggauuaagaaggaaaauacuuagcacuguacucuuuggcgucucuuaauuucucucaaugagaaucuuuaguuaccuuuuccaguauauuuuugcuacaucuuguaagcuccuuaaggauagggucuaaauguucggaugcuggguacauuuuuacuuuuauaauuauuucucccagauguggucuggaauaaaucaucuagagcucugauggcaugggaauuugaaauucuuuugucagauagucacagcuacuggaaggucuuuuaaaccacagguauuaauuuccuuauugcuuuucugugccuugcuccuugcccucuccucuugcccucacccccucauccauuguuucauacucagcaagcagagggaagguaguuuacccucagucuuguguccgacugaacggccauggcuuugggagcagagcaucagagcuggaaggugccaaguuuccugaugcuucugaguuacuguuuuauuaugaagagucaguuugagaacaucuggcauacccaugugcaaauacauguacguaauugauuccacucaugauuuaugacauucccuauucgugcagacaaucgcaaguugacaauuucuuuugacuagggacuugggcuguuuucuguuuagagaaaaauguauguacaacuuaggaauucagauaacuuugcagucuaggauucuuuuuucucauuacaucuaauaagauuuguguuucagaguaguuuugcauuuauguaaaacuuuucaauaguucucuagacuugcugguuauugaacuugauuuaaugcugugaagaaguauuuucuguuuaaggguuaaaaaauuguuuugcuuucagauuuuuuuugagacagagucuugcugugucacaggcuggaggacaguggugugaucucggcucacugcaaccuccgccucccagguuuaagugauucucaugccauagccuucugaguaccuggcacuacagguaugcgccaccgcgccuggauaauuuuuguauuuuugguagagacagaauuuccccauguuggccaggcugguggcaaucuccuggccucaggcgaucuguccaccuuguccuuccaaagugcugggauuacaggcguaagccaccaugcccagccuucugauguugcuuuauaguguuuuugauggcaccucugcaaagggauuuacuuacucuuaauuugaauuuaaaagaguagggucaguuaaugaaaagggagguaagaaaaauccuacauuucuguuucuaugagaaaaccuaaaccauuuuauauugcagauaagacuauuuuguuggaaaguucugguuacagcuuauuaggcugaacauuuaaaaauguauaaccuuguagauauauaaucaaaugaaaacuauuuucuccuuauauggugugaguuguuuugaucuugaaugauuagcccuccauccuucagugcuagggacugcuuuucuucucuccuuccuccuguuuuuauugaauuucaaauaauaaauagagguauuucaccauuuagcuagauuuugcccaccaugacauccauuaugaaacccuggggacauacuuuauuauagaauuggaaaaauguaauggguauccaggacauuuggugcaguaaugucauagagagugcacagacuuaacaggcaaaauuggguucaugucugagauuuuccuauuagccaugugaccuugagugaaauuucauuaccuuugcuccccaguuggcucaucaggacgcuggaagguggggguaguaccuugucuccugggguuauucugacacaggugccagguauauagaaaaugaucaaugggugcuaauaaccuuccuuagucucuaguuuuaaauuaaaucuucugauucauagauagguguuucauuuaauuucugcugcuuagccuuggagguguugcuuggaucugcuggugcugucgguugggaguuaaauucuaggcucaggaggcugauaacuuucccucuuccuuaggaggaauugauuuguagcaaacauuggagauuguuuauucucagacuccagcuuugucaccucuuguuuuucuugaaaguuuaagucuagugagcugcugauacuccauuugaacuguguuuucaaaaaaucaauguagauacuuuuaucuuugguaaagucuguaaauuauguugccucuuugcuaucagucagcacauucgaaagacaauugagucaucacuuugaacuaaucuuggacuuguggauauuacaguacuaagguucccuguucugauuuuucaccuguaacauaguccagaauauuuguauuuuagaguuucaauuguaaaauguuacuauuaauauacaguauuuaaauauaaaagcaauuuuguauuuucaucuuuuaagcauagugaaauauuaauucccuauguuuguggcaagcacauuguaaauaugauauuaagaacugaucacaucagcccugcgguugggcagagcaggucaugagugcuuucuuuuauacugaaggagacuggggaccagaacuauuuggauaaauguuuugucuuauggcgaguaaguuauggaacugggacuggacuuguaccgguccauuucccacacccaguaugaugcuguuauuugacuaguuuuaaugcgaguggaaguaauaaguuucuguugccaggauuuucuauacauuggugcugaaaugggauaaaacuucuccccgcccccaccgauaguuugcuuugucacccagguuggagugcagugguacgauccggcugacugcaaccuccaccucccggauucaagcgauucuccugccucagcuuccuggguagcugggauuacaggugccugccaucaugcccggcuaauuuuuguauuuuugauagagauggaguuucaccauguaggccacgcuggucucgaacucuugaccucaagugauccaccugccuuggccucccgaagugcugggauuauaggaguaagccacugugccaggccaagucaugcaguaguuaugauauguaaaauuucaaaugacauagcugagaauuacgguuuauuuucacauuuucuaaucacagaacguaaagccgaauguuaaauguuguaagccauucagauuaguagcacaagugaaaaauugacaguuagagaucauuacaaucaugaauuccacuuacauaggacuuuauagcuuucagacugcuuuuugcaauaaguccuaauagaacuguauagaaacaaucauuugaauaauuagauuuuuuguaucucacuucauagauuagcagucuguggucuuauaugcuggauagcaacuacuauuuuuuuuccugaaacuuuuuuuuuuuuuuugaaagggaaucuugcucugucacccaggcuggagugcaauggcuucaucucggcucauggcaaccucugccucccggguucaagcaguucuccuaccucagccucccgaguagcugggacuacaggugugugccaucaugucuggcuaauuuuuuguauuuuuauuagagguggggcuucaccauguuagccaggauggucuugauuuccugaucuugugauccaccugccucaaccucccaaagugcugggauuacaggugugagccaccgugcccaguugaaacuuuuuuuaaaaguagaaaucuugaauucuguuuccuuauuguaagcuacugagcggcagguaauuaguggaggaaauggagguaaucccagauggaaacugaaguaggaggugaggccagugucagaacugggaagagacgaaugcccucacaaaaccacaguuucagcugaauaucagucaugauuuuuagcccuaaaagucaucaguucucuauuuccaaauugucuucuaaggaauauauaggguuaggacuguauaaauaggcccugguuggagguuggcuaucguugggcugcugcugugaguuaaauguguauauacagucaccuucuguuaaagaacucuugcuagcagaaagccuaacauagguaaucauuuucaagaaaagggugcaggaagucgauguuuaauaaagguugggagguauaaggugaggugccaacuugcguaacuacacacacauaaagacauuuuccauuugguguuggcgugauucaaauggaaaauuauuuccuuuucaccaaguggacuuuggagagagaggacaacucugaaguuucuaaacaaggaaauguucauggucauuuaacacuuugggguaaagauuuuauauuucagcuguaaacucugcccugcccacgcgaucuacccccacgucccucaaacagucugagcuaccuuuuagguaguuuuuaaaaacuaacugcauauaauuuaaaaacuaaaaguggccgggggcaguggcugacaccuguaaucccagcacuuugggaggccaaggcgggcagaucaccugagauugggaguuggagaccagccugaccaaauggagaaacccuguaucuacuaaaauuacaaaaguagccaggugagguggcucauuccuguaauccuagcuacuggucaggcugaggcaggagaaucgcuugaaccugggaggcggagguuguggugagcugagaucgugccauugcauuccagccugggcaauaagagugaaacuccgucucaaaaaaaaaaaaagacaacuaaaagcaugcacagucuguacaucaaaucauuucuuuagcauaacuguacagucuuugagagugccuuugauaagcccuggggguagauggugcuuuuaauuauuuacuucuauacaaacagcucauuguauaaaaguaaauacuuuggacccaguacuauccugaaacuuacuguuuugccucuuguucuuuuuuacugauuuucaugacaaagguuacuuucugauggaauuuugaaaaucaucuacaauaugaugugauaucuaagagagcaagggcuuuauuuuguuccuuccucugggaggaguauuuagaauugugcuuuuuauuuuuguucaauaaacuguugaaggaauguugacuuagauugagaaauauaguugagauucucagaagucggcugaguuaggacugcaggcagcuggcacaugauccuuccuagccugcuuuucaagguggugguuuagucuguggcugucguacccuacuggguuguggacagagaccuacuucaguggaagguucuagaugaauauguucaggauguaacaguaaaacaugaaauucugaguaaagagacagaaacgguaacuaguagcuaucgucaacauuuaaggguuucuguuggguaggaaggauuaguuggcaagcagauuacagaaaaagaaugcggaaaaaaucuguagauuccaauaagaauucaugaauaugucucagaauacacacugcuguucacuaccacaugaucuuugaaacaauuuuugagauaacauuaagugugaugaaaugcagugcaccuggcuuaagugugcaauuauaugaguuuugacaaauacauauugguguaacgaucacaccaaucaagauacagaauguguccaucaccuuagaaugucuuuuuuuuuuugagauggaguuuugcucuuguugcccaggcuggagugcaagggcacgaucucggcucacugcaaccucugccuccuggguuccagccauucuccuacuucagccuccggaguagcugggauuacaggcacccaccaccacgcccagcuaauuuuuuguauuuuuagugcaggugggguuucaccauguuggccaggcuggucuugaacuccuuacucaggugauccgccugccucggccucccgaagugcugggauuacagugugagccacugugcccagccagaaagucuucgugacuggaugaauaaacuauugagcuuuggucaucagaaaagugaggaugauaauaaggcuuguuuuacaagguuguuggcauaacaguagcaauguacaauuguguauuagaaaguuuccaaaaauuuuauuuaacucuaaaacgacccuaugagauggauuguugaaucaguuuuuguccaugaggaaaaugaggcgaagaauauuuuuggcuuguaacagguaacccaguuccugagucaguuuaggagcuccuugauaaacguaugcuucucauaucagguggcuauaagguccauagcugugcagaccuaccagguguuuaggugauuucguuauugugagaaggaagguggaaauagaucaagauuacacauuggaguagaguuuaauguccauugcugcuauuuauuaacucuguguuuugagcaagguacucaacuucuggaaacaucagguuuagcaucucagaggaggagggaugggggaaugugacugucaugugaccugucugucacaugggacugucuacugggaggaugacugugggaacacuguggacuuugaagagcugugcacugaugucguuaucuuuacccaugcuggaggcuguggccuguuccucauccuggccucacaaacugugcuggccuggcguggagcaguggaauugacagggugucagggagcgguggccccuccuuggcaguccuuggauuugccaaacacuguguuuacacagcgcuuucucucaccagcccuuaugauguccugaagcuuccgaucgcuuuucagcaaugaggucagccucacuccacaaugcuugucaaguguacuaggaaagagucuuuuuuaaaaauucaacuuuuauuuucuuucugaaauguauagcugugauacaaaacaguauaugcugguuugagguggaagaguucauaagggauccgaagaacugauguacuguggccugagcgaaagucucuugugauaaagcgcuaccccugcaguguuaaauguugguuguuaacguagcaccuuaacucuuaauaucacauaugaaacccagcuccuucauaccgcucggguggauccauuucuuccagccccagccagucucucaacuacggaagcaggugggacacuuacacauucacauugugaccccaaauggaacuuuauuucuuuauaacccaacugccucacacauccucauuucaccucacuuguagagaacauauaauguggcaaccucaagauaacucaguguuuuuugguuucaaagagucgcuugcagauaaauaucuccuugaggauuuuaaguguggucaguucacgcuuccuaucugaggcucuucucuccucugaaggauggauuuccuccuuccucagcggcucacccacuucugagauggugccuggguccuugaagagcuuuuaucugagauggugccuggguccuggaggagguuuuagcaucauggcagcgggugaggacugucugcugccaggcacugccuuccagaccucucuggucucuacggaaguaacucaucgggcuuggucuuugggugccucuguccuaggcucgugcguguguuggugauguggcuuccauugcaagaagggucagaauacacugaccuuccuugacguguucuaagcugcuuuuuuuuguuuguuuuuuccagagauggggucucgcucugucacccaggcuggagugcuuuggcacagucuuggcucacggcagccucuaacuucugggcugaagugauccucuggugucagccuccugaguagcugggacuaugggcaugugccaccauggcuggcuaauuuuuaaauuuuuuagggacagagucucacugugucgcccgggcuggucuugaacuggguucaauagauucucuuguuuuggccucccaaagugccgugauuacaggcaugacccaugguaccuggccuuaggccuuugcugauccaucggcccucucaguacuucccuugguguauuucuuucucuccuggucuguugcuuugaucuuugcagaggugagaaacugcccuccagaucugccuuugucaucuagaucagagguuccaaaugugcaucugugacccugggguaccuggugacagaauguugacuugaacacggugagauggaauaaaaauacaguguaccaagauuuucauaaggcuaaauguauauuacguaaacuaaaggaauguucuuuaugcugcaguuuuguaccccuuucacuuuuuguauuaaaauaauguccuuuuaugauguguuggcagucguacaaauuuugucugaagugccccucuuggcaaaauuaaagcugacauccccaugcugucucugcagaguuuuggaguguggaugucacagguccauaaaaucugaaaggcugagaagcacucaccugccuaugccuuagucucagcucaagcuuuaucuucuucuggaagugacauuucacuguuuucuccauaucuguaacaguggagccuauucucugggucccuuuagccuccagucgcuucuaccuuugcaguuuuuguaauuauuuacuuguacauuuuugucuuccuggcugaacuggaggcucuuuggaggcucuuugaaggcugggaccaucuuguucagcauuguguccccaucaccuagcaaagaagcugcaugugauagaggaccuaggaauguuuguugcaugaauaaaaguucuuguuauagguggggcgcaguggaucacaccuguaaucccagcacuuugggaggccgaggcagguggaucacuugaggccaggaguucaagaccagccuggccaacauggugaaaccccguuucuacaaaaaauacaaaaauuagccggacaugguggugcacacuuauaaucccagcuacucaggcagcugaggcccgagaaucacuugaagccgggaggcggagguugcagugagccaagauugcaccacuguacuccagccugggugauagagcaagccucugugucaaaaaaaaaaaaaguucuucuuguuauaaaaaggucacucuguaacagggauaaggaagcugacagaguggugugagaaaugcccccauucuguagccacggaacuucucggagacuguucugcaugcuauuguauacauuccucucuuuguagccaguuggaacucaaucguaaaaauuacacagggaucauuucauucuugaaagucucuuaauaugguggcucaugccuguaaucccaauacuuugggaggccgaggcaggcagaucaccugagauuaggaguucaaaaccagccuggccaauauggugauacuucaucuccacuaaaaauacagaauuagccgggcaugguggugcgcaccuguaaucccagcuaccugagaggcugaggcuggagaaucacuucaaugugggagguggagguugcagugagccgagauggcgacauugcacucuagccugggcaacaagagugaaauuccaucucaaaaaaaaaaaaaaaaacaguuguaagaaaauuagcaggguuuagauugccaacuaaaacaucuuacacugauguaacagcagggaguaggaguauucucaacuguaaauguggauucaguuaaaccacacugccauuuugccuauaacggcuaagcuauaggaaguuaguaucaaaaggagagauguuauuuuauuuaacuuaugauuacuuuaugaagaguugaaaucauuuggagaaaggcaugaauggauacugaauuauuugcuuuuaaaacguuugggggcuguugaauuccacaaaucucaauugggugaguguggguagaacauuucucugccaucuuucaguggaaaucuucauugcauucaucucugccuuuaagcucugagugaccuucaugucaucggggcccauaggucuuugggaauuggaguggugguccgggccacugucagugguauuuguugaccacagcagagccucagauugccguuaaggauggagucugcauguuacugaauuguuuuuugagaaauuacugcuggggguacuuaguuggugucugucuugcuugagcuucagauaccagugauuguaaaggcugucaccaauaggcugucaggcccuuggaagucagacucaaggaccgucuucauggagccucaggcugaguugaacacaguagccacagggauacaaagcuaaacaaugcccaacuugugaauuuccacauucuucucauagcacaacagcaugcgcauugcauaucuuuuuauuuaaaaaaaaaauuacaucaucuccuccuccaugucuagugaggacagauucuaaggccugguaugcucccucuuccuacacucccaucuaagaaaggcaaauagcggccaguccuggagugcugagacuuuguucugcuuaugagggcaagagagggaacuuggcugguccauguuguguuccuuuguuuuccuggcacacccccaccuuuagcaguguuuggaaaauuccaacuccagaauggauggaauggagagaacaccucacucaccuucacagccagagacuucacugggcaggugcuuauugucagagcuaggaccagugagcaaaucgucuuuauuucuuggagcuguagcucagagucaagccagguugccuucucaaauacaagggccaacauguuauccucauugcguucuuaagggcguguguguguuuguuuguuuguuuugagacagaauuucacucucuucgcccagguuggagugcaauggcacgaucuuggcucacugcaaacuccgccucccagguuuaagcgauucuccugccucagccuccugaguagcugggauuacaggcgcccacuaccacacccggcuaauuuuuguauuuuuaguaaaggugggguuucaccauguuggccaggcuggucccgaacuccugacuucaggugauccacccaccucugucucccaaagugcugggauuauaggugugagcuaccaugcccggccagguuucauaaggucuucauuuaauguugccaguagaaaccugggaaugaaacauuuuuuacacuguagacuugugguuucagaaaagauguuacaauucuuuacaaaauccaaguuagggauaaagaaaagggaucaguuuugaugucaugauggccuuggaggaaaggugugauaugaaauacauaaauguauuuucucuguauuuuuggauguacucucccauaaaacuucacuguuaaaacauuuaaaccuaauuugagggucuuaugcuucauuuuaauagugagauggaaaaaccaaucaaauauuuaucuugaauuuguaguucuuaaaauucaaguuauuauagucuuguuuccuagaggcguagcagaagauaauguauaguuuuaggaucagguguauaguaucucugguagaccuuuuccaauuagaaaugauacaguauaugguuaugucuauaaauagcacaagggaauauuuaacuuacuacaucaucuugguaugcugugcuuuuuuugaaaagugacuaacauuuucuuugaauauuuuuaucaauaccuuuucccaaagcuguuacacacaucugaaaucucacuguuaugaauggacaugacauuuaaggggggaaaaaaaucccaucauugaguuguuugaaauuuccuggcuaaaauccauguaugaguaguauaucugugucagcuuugauuuguuagccccauaaaaccacggacuugcccauuugaaaugggagcccagccuugggucuggccaaccgagggccaucagguuagagggcgcuguccuuggagggccuuuauagcacuuaggaccugagacuugcuguguuagcaguggaguguugcuaaucccacagggaccugccuggcuucugaaggguuucucucuaaaggcggccucaugauuaucuagggccaagucaggaaucagaggggcugccagcccaaaaauagccacagccuacaaagagggaccucauggcacagagccaccacugccuuccugaugccagagguugaucacaugaugggggcaggaggccgucgagcaggaaaggggugcugucuaaagacagguguggccagugcaggggagagccagcauuucuucuuggcguguguagggggagguuaaagucuuagugguugauuuaaaaaauuuuagaaaugaaaguaaauauugaaguuagucauuuuaugaggcuaggcuuacugggauauguuucuggauaauucuaauuuguaagaaacucuuguguuuaauauuaaucacugucauucagaggaaucgaaacaguaacaugucuuguuuccuuauacugccuuugaacacaaagugaagccuuguuucaaaacuugcagacaacaggccauuuaaacaaagacuacacauuuuaaguugaaauuuaggggaggauuauuuaacauucuuacuaauaacucuuugguuacaaugugguacaaauuguauguugaagucauaugggcuggaagaaacuuugauuggaaauucagacaaaaucuuuucagaaugguaguuguuugcugauuggcuaugagauauuugaaacguaguauuucuuuuagagacuccuuuguuccauuuuagguggaaacagaucacuugagaaguugugcaaguaaauaauccguggucaaaaacaggcacacucuuauuccuugaagccuucaggguacuuauggagaucugauuagauaagaggauaauucuguuugcacaccuguugauuuaggggugaaaugucauugaguuuccuagauucuuccacagccccucaggauugacuaugaaguguaagcugugucaucugauuugucauggcagugagcacucccuuaccuucgaugaugccucacgucaccuuuugcauaaagguuagucuguugcuaauuauugucuuaggucacugggucccuuuuuuguauuagaugugauaggaggccauuagaaggcuuggacugaggaauggcaggaacugaguacaauucagaaggaugacucugguugcuguuuugagaauauauuguaaggaggcagaggcucaugauuugaccaguuaguagucccagagagagacagugguggcuuggaccugggauaauagugaaggugaggaaugcuugcuuuugaaauguauuuugaaggcagugccugucggaguugcuacuggggagagagggaaagaggcagauuauugcugacuccuagguuuuuggcuugagguauauucauggugucuuuuguugaaaaccaggaacacuaggacaagaaggaaaugggcaggggucuggaagcccagaguucccuuuuagacuugaagcuugagauuguaucagacuguucuugcauugcuagauugaaauacccgaggcuggguaauguauaaagaaaagagguuuaauuggcucaugguugugcaggaagcauguugcuggcaugugcuucugaugaggccgcaggcagcuuccaaucauggcagaaggcagcaggaaucugucaugucacauggugagagcaagagcaaggggacgggggagguaccacacuuuuuuuuuuggcugucccuuguggagcagggcaaagccauaggaagugugcccagaguccgcugccacacaguuucaacaaccagauguugcaagaacugacucccucuuguggacagccccaagccauucaugagggauccacccccauaacccagucaucucccaccaggccccaccucaaccacuggggaucacauuucaacaugagauuuggaggggacacacauccaacccaugucagagauuccuguuaaacauguaaguggagaugucacauugacaguugagaauucaaaccuggagcuuuggggaaagaucagugcuagagaugaguaugugggaauuguuaucggaguguauuugaaacaagagugagugaaggaagagaaggaauaaggggcugcccccgcccccccuccaacacuuggauguugaucaaagaagaaucucuuagaggcauuugccaaagagaagucugugaguuuaggaggaaaaccaagauagaguagggccucugaagccaagugaagggggccuucuuuaagguugauucccguauugugaagagguuucgauuugucaaacugggaccauuuuuuccaauuuuuggugagagagagagugagugagugucauuaucauuuagaaacguugauaagcuucaggaaaccuuguuaaauaaauaauggcaaauucagccagaaguaagaacaaauacaacaaaucuuuuaaacaccagaacauggguuuuaguuuacccauaggcaaccucauuucagggaaauacauacauguguugaucauuuuugaaauauugacaaggauuggaggaacguacuccuugauggucccugaaauccaaaacacaucauuacgucuccuggucacugucuuuaggcuguuuuaaaaccuucauuuacuagggcuucuuauguaggaggccauaauccuuaucacagcaaaauaguaaacuguaaccacccgucacauguugaaacaguugaguugcuguuaacuacugcuguaaugacacauuuagaaaccuuuccagucucugccuccuuaccuacuacuuauuccuggggucuaagcuugugugacuuguucagagaggccuuccuugaccccuaaucccguaauagcaaucagagcauccaugcuuuccuaugugaccuguaguuuguuuguauaguugugucuauuuuuuugucuauuuuguucacucuguacuagcucauagcagagcauuuggcauuagaugggcacucaguacauuugaugaaugaugaaugucauccaauauuauaaaacagacaccuuacaggugccucaguagcuuugguuuggugucugagcucagugucuucuuuauuuuuauuuuuauauauuuuuggagauagagucuuacucggccacccaggcuggaaugcaguggugcuaucucagcucacugcaaccucccccuccagggcccaaacgauccucccacuucagccucccaaguagcugggacuacaggcacccaccaccacaccuggcuaauuuuuggauuuuuugguagagacaggguuucaccgugcagcucuagaacuccugggcucaagggauccgccugccuccucccuccaaagugcugggauuacaggcgugagccaccacaccugcccuccucuuuaagucugguuuauugagguauaauuuacauauagcagaauuugcacuuuucggguguauaguacaaugaauuuugacaaacaccuguagcugugcaaccaccaaccacacucagcaaaauagauuuucauuauuucaaaguuuccuugugccccuuucagucuuugcccauucuuagacaaacaccaauccuguucccuuagauuugccuuuccagaauauuauauaaauggaguuauagaguauggagacuuuugugugugacgucuuuugcuuagcguauguguuugagauacaucugugugguuuguguaucaaugguuuaccuuucuguuguggagugguauuucaucagaugaauguaccacaauuaaaaaaaaauaaucuacccgugauggacauuuggguuauuucaaguuuuuggcaauuagauuuuucuuccuaguuuaauaacacaggcaagauaauaaaauggcaucagugacccacagcuccauacccccacccacaucuguuuuuguuuuccuguguugcuuuuucuacauauuuuacauagcaggaaucauaaaacacaaaaauauuuuuccuaguuuuguaaacugcauaauuuauaaauaguugcauuuuauugaaucacuguacugugguuuucuaauuccuucuugucaacauuuucaucauuucuaagucuucacagauguggaaaauauacugaaaaucugcugaaauauuuccuauaauaaauuucugacgauaguuuucuugagacucuuaauggaaagucauaaaaauucaagcaaauagggacaaaaacuggaugggugugauaaggauauggaguccuucuaagaacuuagugucuggcagguucucaggaaccaagucagugaggcaaucuaaccuucacuguuuuucauuucugcuccccuugguauguuggucccauccacgucucuguagagauuugcuuucucugcuuuuggguguguggagaagguggcugaugcacagcgccuggauuuauguuauuuaguuccagggacacacugugccugacaucuuuuuuuuuuuuuuucuuuuucuuuuuuugagacagugucucccucugucacccaagcuggaguacaguggugugaucucaacucacugcagccucugccuccuggguucaagcgauucucuugccucagccuccaaguagcugggauuaccggugugcgccaccaugucuggcuaauuuuuuuuguacuuuuaguagagauggaguuuugccacguuggccaggcuggucucgaacucaugaccucaggugauccaaccaccuugaccucccaaagugcugggguuacaagcaugagccacagugcccggccauagccaccuguuucaaauccaaaugcugggggugggaaaauugcauacuguuagacuuaagugucugcacgagggcuaauucacuaguucauuuaguggaacccaccucagugaguaggaggggcuguguucagagaaaggggguuguuguggacuaagcccacacccagguuuuccauuuuaaguaagauaucaugaaaucaagucuuacagcuguugaaauugcucuccgaaagcgcaauuacaauuaggucuuaaaagaggagagagcccagggaguauuacgcauauauuuccuuaaauuuguauuuagauaggaaaacaguuguuaauagugauuaaauaucacucaucgucaccuaugaguaauguuuaauagcaaggaaaaucuaauuuacagucaacauuuauugaaugcuuucuuuauguaagccuuguaucugagauuuuuuuuuuuuuuuuuuuuuuuuuuuuugagacagagucucacucagucacccaggcuggagugccguggugcagucucaccucacuacaaccuccaccucccgaguucaagugauucugcugccucagccucccaaguagcugggacuacagacaugugccacaaugcccagcucauuuuuguauuuuugguagagacgggguuucaccacguuggccaggcuggugaacuccugagcucaggugauccgcccaccuuggcaucccaaaaugcugggauuacaggccugacugcacugggccucguaugugagacuucuguguauugucuguaggucucugcagggauuguuaccaggaucacccccgcccccaccgucaauaccaaaaucugagaaugccuaaguucguuauauaaaauauuguagucuuugcauauaaaaacacauccuuccauagacuguaaaccaucucuagguuacuuuuaauaccuaauguaagugcuauguaaauacauuuauacuaguuauguuauaguguauuuuguauuguuguuuuuuuuucucccgacuauguucaaucugcaguuggcugacuguaaauacaagcaaguuugaaagaccacucagcaccaugcugcauucuaacugagguuuguuuaacccugcagaaggaccucguuauuaagugggcuuugacugggaauauuccaugaagagguaguugugucauucuuugccugcagaugggaccggcgcugaugcugaauggcuuggcggcccaguaggaaccuaagcaccuugacuucacucugaaaugccugcguagucaugcgacucaguaucgggcugugugucuugucacuuuuauuuuuaggcccccacugggguaacccagguuggccaggcugccucaccaggagacuguaccugagcucuguuugcccagugccugguggccauggguccagauguuuguccuaguaauuuauucuaaacagcuacaucgaaaacaucuuugucagcauacuugcugugguuacuaugauaauuuuacucuucuaugauauaaugucucuuuuaugauaguuaaguuaauagagugagaauuucauugaagauuuuaacaaagaacuugcaaacuuaggaaacuuguucauauguacacauggcugcuuucugugcgaccaucuagcuuagaaaagcuuccaccuggcagguguguagggcgugaugcaugcugucguguagacccuuuacauuugaggauuuagcauuugaggucucagauacucaugaugcagccugaaguuucaggaucccggaggugguacgguauuuuucuccuauucuguagauugggaagguugagguauccaaaggugaagccauuagcucugacucuucuaauuugugguguugcuuuaaaaaaaaaauuaugguaaaauauauauaacaugaaauuuacguuuucaaccauuuuugaguguacgguucaguggcauaaaguacauucacaaaguuguguaacuaucaccaguauuuucagaacuuguucaucaucccacacagaaacuguacccauuuaacaauagcuccccauguuccccugccccagccccugguaaccucgaauugacuuucugucucuauucauuugacuacuccaggugcuuuauguaaguggaaucauccaauauuuguccuuuucugguuuuuuuuuuuuuuuuuuuuuuacuuauaauauuuucaggguucagccauguugcagcauguaacagaauuucauucuuuuuuauggcugaauaauauuccacuguauguauagaucacauuuuguuuauccacucaucugucagugguggccacugacaccuuugaugguguccacuuuuugguuauuguaaauacugcugcugugaacauggauguacagauuucuuggagucucuauuuucugcuuuuggggguauaagaguggaaugcuugaucauauggcaauucuauguuuaucucuuggaggaaccacagaauuguuuuccauagcugcugcaccacuugacauuuccaccagcaacgcaaggggguuccaauuucuccauauccucaccagcauuuugaucauagguguccuaacgaguaugaagugguaucugauugugguuuugauuugcaucucgcuaaagacuaaugauguugagcaucuucucaugagauucaccccaaugccugguggcaucaccuccgcuuccuuuucuucacauuuuagaaagggguaaacuuacuuucauuuucuuccccaguccuuauccucuucugauuugagacugaggugguacuagccagaaucaaguaggaaaagcaacaccuuuguuucuuuuagacacauggaaacaaaguccuaacugguguucagcuguuuggcguuuaugcagaugugaagggcuaguguuuucccaaacuaguaguagcugcauugugguuuaaauggguuucagauuggaggccagccugggagcuucuuaacagaaugcuauuaagagagaaaugcuguuaguagcguuuaucuaggaaaacgagcuuuaaguuaaauaaaucuccaggcaaacuuuggaagauuauaugcuuguggguuggggacugccuuuaccagcaggauuguuaaggucauauaaugaggugagggagcuaaaggagagaauguagaugugagggcugcacaguggggaagaacauggacguuggaaugguuaggugugccuccuagucuuauuuuuauauagugugcugugggcccuggcuuccaccucagaaaugcuagucauugauccaugcauguguagaucuguguccaagcugguugacauagacaggagugaugagggacaugucaagaguucuuccuggaaagacccugugggauuuuggugcuccauugcuaugauuugaaugugacucccaaauuuuauauguuuggagguggagucuuugggagguaauuagauuuagauaauuucaucagguguggaccccaugaugggacugguggcuuccuaagaagagagaccugagcuggcaggcucuuacugucucacuaugugaugcccuucuccauguuaugacacagcaagaugguccuuaccagacaccaguuuuguguucuuggacucuaagccugcagaacccugagcuaaaugaacuuugauggcuuauaaguuacccagucuaugguguagcaacagaaaacauaguaacauauacaucaaagugagguaucuuacccuagauuugccuuuauguaggaaagccauugauauagacacugggcuuuuuggcuuguuucagguaaccccagagcaucucuaggccaccucuaaugacaguguggcuagcaugacucuugaagacucuuccccugcuccugcacuacguauggugaucugagacguugcaaaauauuuaaaaaauucgguucagagacauugauuugcagugauguuuaauacagucuuuuauuuuccuuggggcucugauuccuaaucuuuuuauuuuacuguauaucuuuuuuccucuuggauccucucuggcauaacaggaguaaagagaaauaauaguccuucagccuaaauuaacaucucaucccaacuaggugaaagugggggaaaguugugcauguguguauauugcaugaacaauauggaaaggaaggauaauuuaguucauaguaguuuuucuucugaacguaucuuugggaguuuaaucuccuuuugauucucuaauauggauuagucuuguuauauaaucuucaagucuuuuccaugccaguacuuuucaagggcaccuuauguucauaugguuuuuccuuaccuuuuauuccuuuguguguuuuuuuggugcugaauuacaggugauuguuucagaaauuagaagaacuacucuggcuguuuacaaagugaugaucugaaaugcuuuuacuuagugccuagauuuucucuaacauugaaugauaguggguuauaagaagaaguugaacauacuuugucugguuuugggccuaguuucucuuuguaggaaaacuuaaucugcuuugcaacaaccuacuagaguacugaauguacugguuucuuauguuaauugacaucagugauuguagccauaagugcuuccuugguaugacaucaguagagaguacacuggccucuucuacugggaagcaggaccagauaauuauguuuuagcagauauaauaugacagucauaauuaugaaucucuuuaaauccucugugguacagucaguagggauauugaaaacaauagggauucaaguuuggauaaugcgagugaaauauuuauucuuguuuucaccuguagcuuugggacacaaaguauuuaauauaguauaaugguguaggacaucuuuaaauguuucaguuauuuuguuuuguacaugugugucuaguuucuauaggcauuccuuuuaauacauacgauguucugaagguaggauuagucugcaguauucaugccauuucaaggauaaaaauuagaguuuuauccuaaaugcacuuguauuuugcuuucuuucauacauuuaugaggcaagaugaugguaaacuaaaggagaggaaggagauaauucugauccugauucugcuucuaaaucauugugucaucuuaaaagucauccaggccacuacccugcacaauucugggccaccauggccaucaucuuuaauguaaauggaccagugaaguuucuguccauagaauguggugugaauggugacucauagaguuaugcaguagacacuaguagaaaucguaacuucuuuucucuagaucucaguuuucucacauacagaacuaguagauuggguuaaaugaacucagccacuguaaacacuggacgaugaauuauccauguuagucgaucucuuuuccaugaguggacccuguuuaucggaaaauaguaaaauugucuuuguuguaagaguuguauuuaauuucaagagaaucuaucauaggguuuguuuucaugcguagacugccugcuugcaagacuucuuggcaugcauuucaggugucugauucagacaaucuguuguuggaauuugaaagacauuuauuuagggacuacacugacuauuuuguaaaguaacagcuuugaugacacuaguuauucacauugcugagagcagauacgcuggcccaagauucugaauaaaagauuugcagaucuuuuaauugcaaugucugugaaagaaacguugauuugaaaacuucauugcaugaagcauguauuugauuccauuggagcauaaauuuauuuuguuuugauauucaaaauuccaaaaguaauuacaaauauuuaaauaauuauauaaauguauaaaguaaacuuacagugcagcccccugccuccccuuccucaucauugaccugagauggugaaccacugcuaaugagaagguauguaucuuucaggaacuuuuccuuacacagauuauuuuauuuauuauuaacuugauaauuuuugagcagucugaaguuccuaaguuuaaaggauauaacacuccuaagaacuuauugguauagguaauuagucaagggagugagaaguacaauuguagccagauuaauguagguuauuccuuacaucuaaauuccaauuauauuauagaugcauacuuaacaucuuaccuuuaaaacuuuuuuucuuuuucauuauccaaaucacuggaauauuccaguuucuuuaauccagaagcagucacccagccacagugaaugcugauuuaaucugacaggcaaaagugccuucuguuuucagagaugaucugaaaauugcuuaaagaacuugucauguuuuuguuuguuuacaguuuuauugcaagugauguguacaguauaaccaagaaacaucugcguacaaguuuucugccuguaaagccucagaaaagucugugauguuucauuggcagagaguccaaggaaaauucuuuaguuuggaagaauaaaaaagucguuacacucagcccuauuacugcugcaaggcugaacugucuuugaauaaucauaguccccagagaggcuucauuguacggucugguguuuguauuuccuguagucugguugcaguuucugcauugcuccaugaaaaagacagucucugaggugcaaccaaaggcauuaaaaaauuuuguuuggacagauaacucgaauaagacaucucuugcuuaaguugauagcaguugguuuugauauucugaggaauauagguaaguuagcuugguaugguugauuuggggcauuuaaauuaaaaccacucaaguuucaaaagggauuuuuuuuugaagcugcucuuuaaaucuuagaugcuuuccaccugcuuauauuuuguuugugguauuuaucauacuuuauuagauuaccccuacuucaggcuaaauucuagaacguuugaaaaugcuaagaugauuaugcagaaaagugaguauccccuuauguacuuuuuguaaaggauaauaaucaaaugcagggcucugcuuuggguuaaaauaucaaguacaaaaacucucauuaagcaacauguaaaaauguuguauauuauuacaaaugacugugguuauuuuaugguuacaccaacaauuguauggagugcggcaggaaauuauuauguauuauauacuuuauaugucaucugaagugucuagaaccuugcuuauuucucacuuuugcauugugauucugacuguagugcuucccccccaaccccccccguguguguguguguguguguguguguguguguguguguguguguguaagcaaagaguguggcagugggucagagagagaagaaaacugaaacugcuugagugcuuaugauuuaaaaugaucugagcauuuuaauuuggcuuucaugucgucuucacagcaagagaugaggauugagggaaacacaacuuuguuauuucugcugcuuuuaugauauguuuaaagaauauaggaugcccugaaaauguuaaaccauuuuccuuauuaagauuacugacuaagggccgggcgcggguggcucacgccuguaaucccagcacuuugggaggccgaggcggguggaucacgaggucaggagaucgagaccauccuggcuaacgcggugaaaucccgucucuacuaaaaauacaaaaaauuaucugggcgugguggcgggcgccuguagucccagcuacuggggaggcugaggcaggagaauggcgugaacccgggaggcggagcuugcagugagccgagaucgcgccacugcacuccagccugggcgacagagcgagacucugucucaaaaaaaaaaaaaaaaaaauuacugacuaagccuucagaaaugcaguuuuaagaguuugugaauguguaaggucuuccacaugcugguuuggagguuuuaggaaguuguugagccaaaaaaaaaaaaaaaaaaggaauaaaagcauuuuuuggaaugaacuugaggaaucagaauucuugaaccuuagcaggucagugaauugauuuugucuggaaucuuuauacuucccgcaggcuuugcugggagcuucuccuucggggugcugucuuugcuaucaccagcuaggggcuugcuccuccacccccaagcagaggcuuuuuaauugcauagugugaguuaucuaagacaaacugacuauacugugcuauugacugaguaagucaguuuuccacuccaaugcccauuuaaauuguaaccauauuaaaaaaacaaaaacaaaaaucccccgaaaacuccagaaguguaaacaaaauaccauuaauuguuuaaucuuuauugguguaaacaugauuuuuugggagauucuuugacuuuucugguguguugauaucaguuuuagaggacuuuggaaugcugucugcccaccaggacucucucuucucugcugguggucuuguaaugguuuuuuguuuuuguuuuuuguuuuggagguaggagacuucuaucuucuuauaagucacuugauaauuuuugacuguuuguauaaaaauguucuaauugcugcaaaaaggcucuuaaagauauuuuaaauacaaaccucauguggcuuugaggguggguagggaaagggggugauauauuuuuguugaggucauuuuaauuuuuuuuuuuuaccauggcauaaacagaguuucucucauagcuuucuuuguuguauaugauuuucuuuuaaaaagucuuaaauguguguguuuuagaaagaagcaaauuaguuuuccuuggauaauuaaacuaguaucugucucuaugcuuaauaaauuauucauuuuaacccagaucucuuauucauguuuugaaccucucuuuuauuuauuuuggauugaguaaaagaccuucaagacccuggaaaauccugaauuaauauccugagcucacauauuaguuuauuugaagaaagagaagagagaacauuauaaaacucuccuaguuuauacucaaagcguaaauccuucguguaucucucuagaaugugauacauuauuuauacagcucucugauacuaucugcuguggcuuccuucuuuaaauauuaauguaagugaaguagucuuuuaaaauaauguuuaauucaacagaccuguauugggcacauauugugugccagccucucugcugcucagggcagaggacacagcaguggccuuuuaagcgugucuggcuuguccucuccuuugccucgugcugccacugccaggaguucccaucugcccuagcaguuucgugcgucuagucucuccucacuaggacaucuuccaccuuuagccaauucgaagcaucagucuccaucauaacuccuuuggcagacucccauugcucucagaguagaagccaaacucuugagcugaccaaaccguuggcucuuuaucuucauguuccccaacccccaaacuuggagcaucuugcugcacuucagucucuuucacaccguuuuuuuuuuuuuuuuuuaagagacagggucuugcucuaucacccaggcuggagugcaguagcgugaucauggcucacuguaaccucgaaauccugggcucaggcaguccuccugcccucagccuucagaguagcugggaccauaggugugcacccccaugccugguugauuuuuuuuuuuuuuuaaagagaugggguuuugcuguguugcccaggcuagucucaaacuccaggccucaagcaauccuccugccuuggacuccuaauguuuugggauuacagcuaugagccacuguacccagccccuuuuaccuccucucacucuuuuuuuuuaaacugcuaauggaagcuuuaaucaccacauggaaaaacaauacauucauauaucaaaauuggccccaaauuccuuaucaucaucaucaacagucuagaaaugaaaugacacauaauauaaaacuuuccuguuuauaacuaaaagauuuaugaaacuguuuuuuauaaaugccuuuuuuuuuuuuuuuuuuuuuuuuacccugaggaugauaucaccaaagugaaaaaagaaaagucggucauuaucagcuggaauguauucagcauagaguuuuaaaaaccauuugucauuauucuggagugauuuccauucauucuccccacccacacuaugugaugauaacaggaaaagauggcaaaugguugugccagucuuauuauauacuggucauauaauucucaaauauacugaucauaugauugucaauucagucuaccuacuaaaagaagaaaauaaaauuuuaacauccauuaacucugcacuaucauacuuuaaaauaugauuaaaagaaagaucauauuuuaaaauauacuggucauacaauucucagauauacugauuauaugauucucaauucaaucuaccuaccaaaacaagaaaauaaaauuuuaacauccauuaacucugcacuaucauauuuuaaaauauguaucaaaaucaauucucuguuauaaaagagggguuggcuguacauucucagaccccacaacaacaacaaaccaccagaaaaccaggacaauacuuucuuacacaggcuccugccaugcguucuacaaauuucauauaagccaacuagguaaguucagaguucgcauagauugccucacaaauacuuaacucugggcucuuagucaccuucagauaagaucugcaaaugucuaaaagaaaaauaacucccaaauggugcaacaguuauuccagucaagugcugagagagguuugccuauuaaacuugaaaaaagauagccauguugaguaguaggaggagaucucauggaggaaggagacuuguauguggccuuuggcaugagugggaauuaaacauuuucucauucucauuaaggaugaugauuacuuguguacuggguguacucacaugugauggucugcagacauuuaauuacccauuaguugccaaguuucuguucuuuuuaaaauugcauggauacugauaagacuuguuuuugcuaauaccguaugcuuucaguuuuaugaucuuugacagcuguagcaaacuugaacuuggugacaaaaauucacuaaaucggcacccagugucaaccagucuuaaaaugccucuaaagugacaauuaagcuuuuuuauuuaaacaaagguaaacuaaugcuagcauaaaggucucuuaauuuguaguguauaauuuauaguauguaaaguauauaauuucauauaguaaaugauaucuuaaaugauaauuaguggagaggauuugugaaaaguaagaaccaauuuuuggugcuauuucuguuuguuguuagguaauuuagaagcccuaugguaccugauuuugugagugguuauuuuuaugaagagauguaguaauggacuuuacgagaaaauugagaguauacuguccuugaauugaguugaccugucucugaaagagccaagaaauaaaaauaaaaccaaaaaaauugugugugcauuuguguguguguguguguguguguguguguguguguguguggugucuguauuuuaaugauggugaaguauagaugacagcuagucuuuuuuuuuuuuuuuugagacagagucuugcucuguuuccuaggcuggagugcaguggcauaaucucagcucacugcaacuugugccucuggguucaagugauucuucugccucagccucccuaguagcugagauuacaggugcacaccaccacgccuggcuaauuuuuguauauuuuguagagaaagaguuuugcaaggcuggucuugaacuccugaccucagguuaucugccugccucggccucccaaagugcugggauuacaggcaugagccaccaugcccagccaaugacagcuaguuuugauucaucacggcaagguuccccaauuccugggcuguggccuguuaggaacagggcugcacagcaggagguaggcuucaggcgagggggcaaagcuucgucuguguucacagccacuccccaucgcuugcauuagugccugagcuccaccuccugucauguuagcgacagcaucagauucuccugggagugugaacccuauugugaacugugcaugcgagguaucuagguugcgagcuacuuaugagaaucuaaugccuaaugaucugucacugucucccaucacuuccagaugggacugucuacuuacaggaaaacaaacugagggcucccacugauucuacguuaugaugaguuauauaauuauuugauuauguauuacaauguaauacuaauagaaauaaaguguacaguaaucauaauaugcuugaauccucccccuccuccugguccgcagaaaaguugucucccaugaaaccagucccuggugccaaaaagguuggggaccacgggauuagggcauagacuaguucaggggucagcaagcuacaguccacggccaagucuggcccacugccucuuuuuuguaaaucauuuuacugggaugcaguugcgcuuguucauuuccauaucgucuguggcgucuuugauucuacaacagcagacuugaauaaaugcagcacagaccgcacauccuguaaagccuaagauauuuuauauuggccuuuuucagaaauggcuugccagcccuuggacuagauuaacgugugaagacgucuuaaaagaagcagaccuggggaagauauaaagaugaaacaggaacagggaaauuguucaguguguaggggaugcauuauuauaaacuauuguuuaauggguuuucuuucauaaaauugcagguacauagaaauuaccuuuuuuuuuuuuuugcaguuuucuuucauaaaaaugcaagugcauagaaauuaccauuuuucccugcuauuuuagaaccucuuagcuuggauuucugaacaauaucagugaguaagaggauaggucagaugucaccagcuacccugauucucuguauccccaaggauuuguagaucauagaguuuuuucauauuaaacaagcacaggccuguaacaucuuuguuuugacaaaacaaaagaugacuaaaaugacauaguucuuaacuguuguucucuucuuucaaaguaguuacaguauuuaagaauaucuaucaucacuguucuuuccccaccaaaaaacccuuuaaaacauucagguauaauuuauuucuugcucgcugagaucuggguggcuguuuacaauuugugggcacuaauccuccaaggagggauucagggauccaggcuuguuccaucuugugguuccgucaucuuuaacacguuuccacacuuggcuugcuuuguucaucuguguggucacauaagaacaugaaggauuaugugugaguucuaugguccaggcccagaggugguacauaugauguccacucacauucugcugucuggaacacacagcauuaccugcaaaacacauagaaacauaauaucugugugcuagaaagaagaggagaugaguuagauaaccagccagccacaguuacuuguguuucccuuugccuggggcuccaggcuggguaggguacuguuaauccuguugccuuagugccuccagcgaguaucucccucagugcaccgucguccuggcucuggugggcagcucauucccaagagaaaaaaagaggucgggccauucuggguuugugcagcuaauucucacuaaauuuacaaaaauccacuaagucacuucacuucuccuggauggagugagucaaaagccaggaguguuauacaaauuaaacucccuccacguggaaggaauaagccgaagugguauggaaacaacauucucugcauuuccaguuauuuucuagaugcaaaauaugagcugucuugagagcagcauucaaaagcauaaauuaagaguccaaauguagagaaagucuguaucuacuuuaagaaaugguaccggccaggcgugguggcucacgccuguaaucccagcacuuuggaaggccgagguguguagaucacaaggacaggaguucaagaccagccuggccaagauggugaaaccuugccucuacuaaaaacacaaaaaauuagcugggcgugguggugggcaccuguaaucccagcuacucaggaggcugaggcagagaauuguuugaacacgggagggggagguugcagugagccaagauugcgccauuacacuccagccugggggauagagcaagacuucgucucaaaaaaaaaaaagguaccauuggaugugaaagcagucagcccugacagccacuguuguuuuugaucuggucaacuggacagguguuucucaaagcucuuugccgcaucuuugcuaauccaagguggcccauggaccaaaaggauugguaucaccagggagaaggauagaaaugcagaaucucaggccccauccuugccuucugaaucagucaguugaccaaccaaaggcccaguugauuugugggcacauuaaagucagagaaauacuguuucagaauaaaaggauguaauuucaaauuuauacuuguuuucuaaauuauuuaagguauaacuuguauuacuucauagccguccaccauuuugaaaugcauuaaaucaacucuaguuuccugcuguugauuuaagcaacuucauaggaaaucguuaugcuuuuaggaaauugaccaccaaguacuccucuacucgguuccuaggugguagacaugcuccguuaaacguagugcuugagguggcuauuaaguuugaugaaagguaggcugcaagagcaaauuuaagaauguaagcuugcauuaugaaaaauaguaggaaguugaggcuuagaguagaacuguuagcuaccuugaaugguuuuaacaggagguggagucuuaugaauauauuuuuuauaauacaugcugcugaugacauuuuguucagcugcuuaauuuuuguuuuuguuuuguuuuguuuuugagacaaagucuugcucugucaccugggcuggagugugguggugugaucucggcucacugcgaccuccgccuccugaguuccagugauucuccugccucagccuccugaguaggugggauuacaggcaccugccaccauaccuggcaauuuuuguauuuuuaguagagacgggguuucaccauguuggcuaggcuggucucaaacuccuggccucaagugauccgcccaccucggcuucccaaagucuugguauuauaggccugagccacugcaccaggccucaacugcuucguuuuuaguaagauaaaaugauagcuuagauguugugccaaugucaucuuuuuugauucaagggagguugaagaucagguaauauuuuggguuuuaaagcuuacagagcuaaacuacuauugugauuugugaguucuuaaaaacuuuuaagaagacugauaauggcuuuaugauuuggaagcuauaaauuauaacuguauuuguauucacaucuuaaaggacuggcgugccauauauuaacauaaauaaguaguaaaauuacauucugugugguuauaaaguaaugaagccaguucuuauguuuuacuuuuggaaacauucuugauuuuauaguuauaauaugguguuacaagguuaacuauauuagguccaaauuauuaagcuagacacuguggguaauagggagauauagaagacaucuacucuuauauaagccucuauugaguuucuaguucaguuggugaaauaaggcacacagcuauuguauaaucugcuauugacaacugauuuggucacgucaugcaguugauuucucagagguuucucauuuguaaaaugaaguuugaauuggaucuuuaaaauuucuucuagcauuaauaugguaaugaugaugaauucuauuauaugauaauaauuguaauuaauauaaugauucaguucuuuaggugugucucuucacaugaagaaauaauggaauuuuuuaucuuuggggaauaaacaaucacuuuucuuaagcuaagauuuagaaaguuuuuuuuccaaaggcauuggaauuauaccucaaagcuuguacuaguaguucuuugaccauuucuuucagcacauauuuacuaauuuuuaauccuuauaaauccuuagggaaauauauauuuugguaaccguuuaagaggagcugcucuguuacauucccagcucuuuaauaaguggggaauuuguucucucugguccaaaauguucucugaaaaagaucuccuuguuuucccaaaugauucucuuagaaaggaaacuugaucauucugcuuuguucuggaguguuacacaaguguuauaccuuuguucugguguuauaccuuguucugguguuauaccuuuguucugguagguaguacuaccaaaagagaacuugagaaauuaucccuuugggugaggaugguuuguuucaaguuuuuuuuuuuuuuuucccuccagcacacucucugucuuuuuauuuuuuaacuuucugcaucuuguuuaaucaaaauauuucuaagauggcaacuuugaaggcuuuacaaauagcaacuacagcaauaugaagacuuugcuuaugagucaggugagaugaaggcaaagaauauauaugucgagcaaguggugcaagcuuaggacccauucuuaaagucggggagaaauaaaauaggcaguaaaacaaaauggccaacuuuuaacucuuuugacaaacuccugagcgaaggccggucaccccuuuucuguccuuggcuuugucuucauggugguggugguggugacuuaaagccauuguuuucuuuucaugaauggugagguugaucuuccaucuugcuggaacugaucagcuuaacugcagaaccuuuuugauauccaaaucccuguaccacuauuuuuuuacucuugucuacaaaguagaagagaugucaguaaauuuauuuuauauaaaaacaauccuuaaguauuuaugaacacauguuuguggguuuuuuagucucuuugcucaccaauuugaaauuuguuuuauuuuguuuuguuuucuuuuaauagugauagggucccugucacccaggcugaagugugguggcaugaucauagcuuacugcagcugugaacuacugggcccaggugauccuuucucccuagccuucugagcagcugggacuacaggcaugcaccaccgugcuaaaaaaaaaaaaaaaaagaaaagaaaucguagagguaggguccugcuauguugcccaggcuagucuugaacuccugggcucaaaugaugcuccugccucagccucccaaagugcugagauuacaggcaugagcgaccacacccaaucucuuuuugugaauuaaaaaaaaaucauaaacccaaguguacuaaaauguuaagugaaaguuaaaugguugauggcuucuuuauuuuucuguuacucuuguaaaccacuagcuuguaaaucuaaaacauuuaaccuuaacuuuaguggcguuucacaaccguuaaaaauguuuuuauaguauaaugacaugggaaaaugcuucagagacaaugcugaccacaguauaugagucuuaaaagcaaaacucaguauauaauauauauauuuuauauuacguauuuuuauauauaaauauauaaaaagaaagagaacuuuuauauauauauauaaaauauacauauauaguaacaugcacauuauaaagaauccugcccccuuuuuaaauauagcaauuuggcaaaugaucagaugucaaagauugugaagauuucaguuuaguauuauuuauaaaugagaaaagcuggaccccuuuucuacaaaaaguuuuuuaaaaaaauuagcugggcaugcuggcacauaccuguagucacagcuacucgggaggcugaggugggaagaucgcuugagccuaggagguugaggcugcaguaagcuguaaucacaucacugcacugcagcuugggugacaaagugagaccuugucucaaaaaaaagaaaaauaaaaaaagacaacugguaaaaacaaacauaggacuagugauaaaauuauuuauccucuuacauacuuauuuaaaaaauaaccuuggggccgggcaugguggcucaugccuguaaucccagcacuuugggaggccgaggcgggcggaucacgaggucaggagaucaagaccaugcuggcuaacacaguggaacaccaucucuacuaaaaauacagaaaaugagccgggcaugguggcgggcgccuguaaucccagcuacucgggaggcugaggcaggguaaucgcuugaacccgggaggcggacguugcagugagccgagaucgcgccacugcacuccagcccgggcgacagugccagacuccgucucaaaauaaauaaauaaaaaauaacuuugacauaugagcccuuaauucaauuuauaugagguuuaaaaaucaucuuuuaugcacuucagaagaggaaacuugaguaauaaaaaugccauuaauugaagcuaacaauuauuuacaaagacaguucccacgaucuaugcuaagugcguguuugcagugcacuuugcauauauuugcuuaugccacagucuguuaacugaguauuagcuguuagggaagcagaaagcuguagcauauuuagugcuuuuggaaauuauauccccugcauguaagccuaaaaaugaauaaauauauuucuugauuuaaacauuuagcuuggauguauuuuauacuggaggauuaaaaauguuaauuuauguuucauaaaagcuuuuauuaaggcucuugccaauaaacuauucagugauuucacuaaggaguuauaugguaaaaaggguucacaaauuuacacuuuccaucaguauauaaaucacgcagccuucauuuuuggauucaaaaucgcuuuuuggauguguaugugugcacaugcuguugaaaucaacauugcagccuuucuuuauuccauuaaaggcugguaucaggaugcuuggccagaaagacacagagcacuguuagcgaagaaaacugaucguuucaguuuuaacauaguuccuauucugguuuuauucaggccacugaaguuugaaugcagagaaaacgcugcaagauagaaaaaugagaccuacucuucauucggcaaguugaauuaacacacgaaauggcauuuuuucccucccucauggauauuuuuuuuucuuuacaacaguacugugacaucggauugacauugaauacuaggauuagaaaauuaguucaagugugugcguaucuguuugcaguaguaaaaagaguuaacaaauuuacacuuuccaucagaauauaaaucacacagcccucauuuuaggauucacaaugaccuguuugcaguccuagcuugaacauuuggaccuuucuuuggcacugcaguuugaccaaaagcauaauaaaauuuaaguuauuucccaaaaguggccgggcgugguggcucaugccuguaaucccagugcuuugggaggccgaggugggcagauuaccugaggucaggaguucgagaccagccuggccaguguggugaaacccugucucuacuaaaaauacaaaaaucagccacgcaugaagguguacaccuguagucccugcuacucaggaggcugaggcaggaagauugccugaaaccgggagguggagguugcagugagccgagauugcaucacugcacuccagccuggguggcagagcaagacuccaucucaaaaaagcaauaauaauuuauuugcaaaaaguuuuagauuuaaaugcuuucguggguguuuuaaugguuucauuuuuaaguguacaauucaguaguuuucaguauauaacauugugcagccaucaucaguacauaguuuuagaacauacucgcaaaagaaacgucaucccaauuagcagccacuuuagguuuucuuauucuggacauuucauguaaauagugucauauaguauguagacuuucaugacuggcuucuuucauuugauauaauauuucaaguguaauauuauauccguguuguaccaugugucaauauugcauuccuuucuauugcugaggaauauuuugucaaaugcauaagaguacauuuugcuuucugcucuucaguugaugggcauguggguuucuacuuuaugacuauuaugaauagugcuucuauuuagaaucauguacauuugugugcaaguucccauguugacauauguuuucauuuucuucaguagauucuuaggaguagaauugcuggggcaugugguacuuaagucuucuucggccaccauaacaaauuaucauacacuggauggcuuaaacaacaaaaacuuacuuucucacaguuuuggaggcuggaaaguugaagauuaagguucuuuucaggguuugguuuuuggugagagcucuccuacucuucucaguguacccuaauuugguagagagaggggaugaaccaagagugggagagcauucuggugucacuuucccuucuucuaagggcaccagcucuguuggaucagcacuccacgcuuaugacugcuuuuaaccuuaaucaccuccuuaaaggcucugucuccaacauaguuacauaagggguggggguuugggcuugacauaugaauuggagagggguggggaacaguuuaguguauaacauaagguaacucacauuucaagggacuuccaacaggguaccacuggagccuuuaagaaucgacaauuuuuuuuuccccuucaauuuggaaauagcauauguuuaagauaggaauaaaaacaaaggagaaacgugaguucuugauugaucuucagcugauuugcugggcuuucauggccugucuaauaaucacucugcauggaaauaauaggggggcccuucugagaaugaaagggacauguuuacuaaucauccugggacaacagacauacuuugggacugucauaagcaaauuugggugaauugucacucugucagccaacaagaagaaaauacuauugccagauuuaccuccuccucucuuugacaagucccugggagugggggagaggcauaucaguuauaaagucagggacaggguuaacgagcaaugaccccaucuuccauuuugccccauuugcuauucccucaaauuaaaaaaguaucuugaaaagcggugauagauugccugauuauaucucaguuacccacaucaguaguuguggggucuaaaugugaacauaaagugauugaaacuaaucacuuagugauugaaaccaagggguggccuguuaauuuuucuuauaguuacuugaguuaaacauuuuauuucuuccagggaacaacaaaucauuuaaucuucagagcaucuuagacugaaaaccuuucaacugugcugaaaaaccuagaagacagaccauuuugcccacccucucauuuaaaaggaauugaagaagaaauaaaauggcagagguuuaagguuacuauucaggaugacugaugauaauucagaugauaaaauagaagaugaauugcaaaccuucuuuaccagugauaaagauggaaauacacaugcauacaacccgaaaucaccaccuacacaaaacucuucagccagcagugugaacuggaauucugccaacccagaugacauggugguugauuaugaaacugacccugcuguaguuacuggugaaaauauuucuuuaagccuucaggguguugaaguauuuggucaugaaaagucuucuagugauuucauuaguaagcagguguuagauaugcauaaagauucuauuugucaguguccugcacuuguagguacugagaagcccaaauaucugcaacacaguugucauucccuagaagcaguugagggccagaguguugagccaucuuugccuuuuguguggaagccuaaugacaauuugaacugugcaggcuacugugaugccuuggagcuaaaccaaacauuugacaugacaguggauaaaguuaacugcaccuuuauaucacaucaugccaucggaaagagucaguccuuccauacugcuggaagccugccaccaacugguaggagaaguggaaguacaucuucuuuauccuauuccacuuggacaucuucccauucugauaagacgcaugcaagagaaacuacuuaugauagagaaagcuuugaaaacccucaagucacaccaucagaagcccaagacaugacuuacacagcauuuucugauguggugaugcaaagugagguuuuuguuucagauauuggaaaucagugugcauguucuucaggaaaggucaccagugaguacacagauggaucacaacaaagacuaguuggagaaaaggagacacaagcacuaacaccaguuucugauggcauggaaguccccaaugauucugcauuacaagaguucuuuuguuuaucccaugaugaauccaauagcgaaccacauucacagagcucauacaggcacaaggaaaugggccaaaaucugagagagacaguguccuauugucuuauugaugaugaaugcccuuuaauggugccagcuuuugauaagagcgaagcucaagugcugaacccagagcauaaagucacugagacugaagacacacaaauggucuccaaaggaaaggauuugggaacccaaaaucauaccucagaauugauucuaaguagcccgccaggacaaaaggugggcucgucauuuggacugacuugggaugcaaaugauauggucauuagcacagacaaaacgaugugcaugucaacaccaguccuagaacccacaaaaguaaccuuuucuguuucaccgauugaagcgacggagaaauguaagaaaguggagaaggguaaucgagggcuuaaaaacauaccagacucgaaggaggcaccugugaaccuguguaaacccaguuuaggaaaaucaacaaucaaaacgaauaccccaauaggcugcaaaguuagaaaaacugaaauuauaaguuacccaagaccaaacuucaagaaugucaaagcaaaaguuaugucuagagcaguguugcagcccaaagaugcugcuuuaucaaaggucacgcccagaccucagcagaccagugccucaucacccucaucagugaauucaagacaacaaacagucuugagcagaacaccgagaucugacuugaaugcagacaaaaaagcagaaauucuaauuaacaagacacauaagcagcaguuuaauaaacucauuacuagccaggcugugcauguuacaacucauucuaaaaaugcuucacacaggguuccaagaacaacaucugccgugaaaucgaaucaggaagauguugacaaagccaguucuucuaacucagcaugcgagaccggguccguuucugcguuguuucagaagaucaaaggcauacucccuguuaaaauggaaagugcagaauguuuggaaaugaccuauguucccaacauugauaggauuagcccugaaaagaagggugaaaaagaaaaugggacaucuauggaaaaacaagagcugaaacaagagauuaugaaugagacuuuugaauaugguucucuguuuuugguaaguaauauauauauauuuuuugcaugcuucagagaacuguggagaaaacugagauguguuagcauuuaguuaucuauuagucaauaauauugcagaaccaggugggcagauuuacauuuaguuguuaauucauugucuugucaguacugggguguuaauagguuucaauacaacaaaacugcauauggaaaaaaaaauccucaauuucaguauuuuguaucaaguaucaccguuccuuuuaauagugugcugaaaaaugaaguuacuuuaauauuuuaguauaauuaguaguuuaagugccugauacaaucagguuauauuuuauuuuucugaaaaaguuggguugucaacuuuaaaauguauuggacagcauuuaagaaagggcuugggagugcugguaaacaugucaacauaaaaauaacuccuggacucuugcggaggaggcagcucugggaaguagagcccucuuguaugagcaagaguguucuugauuuuuccucugaccggccaauaaugauuuuuggcaaguaauuuuucgagacccaaagaugaaaggauuggaccuaguggaugugugaagccucuugcagccuuaauauauuaauuccugguauauaaaauaaaaucuuuuacuuauguauagugaaaaaccaguauguuuuccauagcgccugucuaaaauauuugggggggaccuagagagugcuguuuaaagaauaaagaauucacaugcaguguaaaggugauuuuccuuuaaacaugcauguguuuuugagaauaguguguagaaauugguuuucuggguuuuaaaaacauuugacaggccacuguuggucguugggcauguguccucagcccuauuuuuggcaguggggacuuagguguauuuucagccccagacaggcuguccuugggugccuguccucugggccaggaagggagcuaagugccagcggagaaaggcaggugugacacagacagccugucccuuggagggcucguggcaagaggaaugaagcacauagaauagcaagugcagaagggcugacuuaggugugucuucagggugcauggggaccacaagggagggaauugucagguccguuuagaagacaagguuaggaaagaccgaagauauucuagauucucuaaaacaucaguuuagacauguuugggcuuuaacaaccagucuucucuauuuggaagaaggguacaccacagugauuucuaaacuaaugaguucauccguuguuucaaaacucagauuuaguuuuuaaguuaucuugaagucaaacuuagaaaaccgauaucauuuauaauuuuaauuuuuuugcaaaauuaaauuacaacauacucuuaauucuaaucaacauucuuaguuuggcauuuacagauauacauagaaacacgauguuuauucucuugauuuaugggagacuuuuuuuggugugucaguccccagcuaccaaaaacucuaucauaaaguuucuuuuucuuuaaugacauuugucuugaauuuaaauugguuguguaauuuugaaacuaaaaguuuuccugauuugugcauugagucuuaggguuauguugccccugugcagcuugaaaaccuguuuuucaggcucccgaugugguacugagguaaggauagaaucaucagguugaaauggauccuaguaugucuuggagaaacagcacuuuucgccucaggaaucuggcuguuaggauucauaauuagauaugaaauacuuuguaagucuugaaagauugucccauauucgcauaugcuuaucaacuggcauaagggacucuuuuuucuuuuuugcuuucuuuuuuuuuuuuuuuuuuuuuuuuaaggcagagucuuguucuugcucuuucgccaggcuggagugcaguggcaagaucucggcucacugcaaccuccgccucccagguucaagcaauucuccugccucagccucccagguagcugggacuacaggcgugcaccaccacauccagcuaauuuuuguauuuuuaguagagacgagguuucaccauauuguccaggauggucuugaucucuugaccucaugauccaccugccucggccucccaaagugcugggaauacaggcgugagccacugcccccggccuacucuuuuuucacgaucaugucugaagcacagugcucucuaauuuugcuaguuuaccucuugcacauuuccaugucucugggaaggaggacuggaaagugucugggcagacccucauaggccacuggcuuugcacuuacuguagagagcugaaugaauuugcugcguguuuuccugaaacaugaaugucgguuggucacuucagcagcacucaaaggcucuuacugcccuggauugacgaagagaccaugcuggagggauguuaauuuucuuuuucuuugagauggagucuccucucucacccaggauggagugcaguggcgcgaucucggcucacugcaaccucugccucccagguucacgcauuucucccaaguagcugggacuacaggugcacaugccuggcuaauuuuuuguauuuuuauuagagaugggguuucaccacguuggccaggcuggucucgaacuccugaccucaagugauccgcccacauuggccucccaaagugcugggauuacaggcgugagccaucgcgcccggucggauguuaauuuuuacuguugcuuuguuggccuuggccugccuuaggccuugaguuuacugaaucccuagacugccugcaaccucacagcucauugguggucaggguguaucugaaucuuuagaaaaguucuuauuuggaagaaggaacuugauuuuuauuugaaacggggcuagauguagcuccucacaacagagguuauguguucaugauagugugugagauaaagggaguggagacuuaaccuaaaaggaaaggaauugauauuuauucagugcuugcucugggucaggcacuuugcucaggugccuuaguuauauuaugccauuuaaugggcccuguaacgcucaggugcuuuccauacauuguuauuuacucuucccaauaacaacagggcaauuguugucgacauuuuaauacuucagcgaggucacuuaaaacucacacagcugguaaauaguaaaauugggauucacacucagagcccucacuugaauccuggccuuuucugcuccauacaccauacgguuucaaaauuuuuggaauguuggcucugaaaggcaaaacaagugauuugcugaagauucacuuuuguaaauugaugagcaguuugccuuacuuuuuaaaagaagguuuucucugggagguuaacuuuuggguugcuuuuuaaaagaagauuuuucucugggagaugaauuuagccagcuuuaauuuaaccuagccagagacagaagaucuuuguuaguuuguguacagucacuugcuuuucuuggccaauucuguauuguucuccagugccaaaacaugaccuccagcuguucucaugggugauuggccugcuaaguuauuguugaauucaccuaauguaugaauucgacugccaucggcauugggcuuuauguguaucuaucggaaauuaacacuugagauuuauuaaagaaagaagagugaugacagggaacaugcugcuuuacaagcacggauuuuagaguaguuucaaauuguagcuccaccauuuacugggcaaagugaccucuggcagguuacuaagucucuauugagcucaguuguucuuugugucaaaaaaagggucaaacucuguaauauauuugaagagauuuauucugagccaaacaugagugaccaguggcccaugacacagcccuuaggagauccugagaagaugggccuaaggugaucgagguacagcuugcuuuuacacauuuuagggagacauaagacgucaaucaguacauguaagguauacagugguucugucuagaaaggagagacaacuggaaguggaggcagcuuccaggucacaggcagauuuaaagauuuucuuucuuuuucuuucuuuuuuuuuuuuuuuuuuugagacagauucucuguugcccaggcugggggugcaguggugugaucucucggcucacugcagccucugccucccggguucaagugauucucuugccucagccuuuugaguagcugggauuacaggugaggaccaccacacccagcuaauuuuuuuguauuuuuaguagagacuggcuuuccucauguuggccaggccggucucgaacuccuggccucaugugaucugcccaccucggcuucucaaagugcugggauuacagguuugagccaccacccccagccuaaagauuuucuaauuggcaguugguucaaagaguuaaagaccuggaaucaacaaaaaggaaugucuggguuaagauaaggagcuguggaaaccaagguuuuaucauacagaugaaaccuucagguagccggcuucagggggaguugauuguaaauguugcuuaucagacuuaaaagagucuguucuaucagucuuaaggucuuuguugauguuaaugcuggucagcugugccugaauuccaacccuucggagaguauaauuaugucugacucccccuuccuuucauauccugaacuaguuuuucagguuaaccuuggaaugcccuuggccgagagaaguggucccuucagaugguuggggggcuuagaauuuuauuuuugcuuuacauuaauguaaagggagaauugcaaauuguaguuugguguuggaauucacacugugaguaaggcucagacucccauuuccucuauguagaauagaaacauuuauugggugcauacuauguauuauacauauggugaugauuguuaggauguagggaaaaaagagacccugucugagugccuagugcaguggguaauacuguugcaggaguuuuucucaacccauuuguaaaacuugcgaugggggugccccauucagcccgccaugcucaaccucuugcgggcaggagugugugggcaagugaguacaggauccagccagccacuuugagcaccggcaggagcaugcugugugcaggccccacaguggugcccaggugguggugucugugacccuaaagccccagagggcaugcuacagugcucucuuggcuccaccauccauggacaccggugugucaucagcucagugggcccuuugccucacuguguggggcagcugcccuccaguagcgagggcaaagggucagugugauaaccuuuuuuggguacccaaaguuggugggucccaagcucuuguccacuguccaagaagaauugggucacauggacaccugaaggaugguggaggcagauaauuuuauuuagcaaugaaaguggcucucagcagagaggguagcugaagacgggacaggacgggcagauaaucuucccuaaagucuggccaucuacacuuggcucuucuccaaagcuaagccaucucuccuccaaaguccagcugucugucugccauccaaguacuaaccaggccugacccugcuuagcuucaaagaucaggcgagauuggguguguucagggugauaugacaguagacucagcuguccucugaagucuccaguugauaugauuuggcuguguccccacccaaaucuuguauugaguucccacauguugugggaaggacccagugggagggaauugaauaaugggggggcaggucuuugccaugcuguucucauaauagugauuaagucucacaagaucugaugguuauuauaagggagaguuuucuugcaugagcucucuuugccugcugccauccauguaagacaugucuugcuccuccuugcccucugccaugauugugaggcuuccccagccacguggaacucuuaaguccaauuaaaccucuuucuuuuguaaguugcccagucucauguacgucuuuauaagcagcguaaaaauggacuaauacaucagucaagccgcuugucuccccuaccaagugagucuggggucuuuacaugaaugggauguggggggcaaggcaggccauagguaguuuuggaaaaggcaacuuucaauugguaaaaagacauuauucagaaagaacuaauuaggagagagugggcaaacagguuuagaaguucucacuuuaggcuguggguuucaggguuuuugccuugaaggugggguuuugcuggggaccugcccccgucugccuagaauuucucugccuccugccucuaucaauacaguaaacaggcaaggguauguugauugcuaaguugggagugugaguagacugcugugcugcaggagggggaacaagaugugguggugggcagaguugucaaggaaggcuuauaggggacaucacauguugucacuagcuggaauuugaagggcagguauucuggguagaguacaaagcugaagaaauaugagaagauuuucuaauuuaggggacucuagguagguguggugggagcugggagaauggaacccugagcaguagggaauaaggugaagaggauggcaggggcuuccauaugcaaaaggauugcugggccuugugaagaagauguuaucuggaagacagacagaaggugucuaacccuauucgaguuugagagagauugcccuagcaggcagauaaaagaugaauugaaagcuggagagaccagaaagauccuguggacaucguuucaguaaucuugcugagaaaugacagcagauggaaaagagaaacagcuuucauuguugaaguugggugccuggguauguuguggugaauacaggaagagauaaguuuugagauagauaggaaaguaagauuaauuuuagaaaaugcuucauguucuuguucuuuaaaaugggguacaauaaaccuaccaacuucacaggauuauuaugaggguuaagugaauugauacauauacuuagaauuuagaauaguauucuauacgggcuauauguuaguaaguuaaguagagucauaugguuuggcuguguccccacccaaaucucaucuugaauuguagcuccuguaauucccacauauugugggagggaccuggugggagauaauugcaucaugggggugguuucccccauacuguucuugugguagugaguaagucucaugagaucugaugguuuuauaaggggaaacugcuuucccuuggcuuuuauucucucuugucugcugccuuguaagaugaaccuuucaccuucugccaugauugugaagccucccuagccacguggaacucugagcccauuaaacugcuuuuucuuuauaaauuacccagucucaggugugacuuuaucagcguugugaaaauggacuaauacguagaggugcuugaaggaugcugaguugggauguauagaaagaaguuagguauaugggaaacucaggagagaguacugguugaacauguggauuuggauguaccaguguacacguggcaauugaaacagcagccaagaucauguaggaagaguacauggugaggaaagagaacagggccaaggcuaggucuucaugaagacuagcuguaucagucuguucucacauugcuauauaaagaacuaccugagacuggguaauuuauaaagaaaagagguuuaauugacucacaguuccacaggcuguacaggaagcaaggcugcaaugucuuguaugacuggaggaggaggaagagagugagggggcaggugacacacccuuuuaaacaaccagaucuuguaagaacucacugucauaagaacagcaagggggaagucugcuucuaugauccaguuaccucccaccaggucccuccuccagcacuggggauuacaauucgaugugagauuuggguggggacacagauccaaauuauaucacuagcuuccaaagguacagaagaauaggacccagaaaaggaauaaccggacagguagaaggaaaaccaggaaagagcuuugucaggaaaccagagaauggaguuauuaacguucgauguguagagagagcccccaggggaaggauugaaaacuagcuugaauuuaacuugugacacuggugaucuugaguacacucucacuaauggguacaaaggcagaauauggugaauuaaagaguaagcugugaagaguuuuaauuguuucauaguaaaaaugaaaauugaauacagucagcccucuguaucuaugggcuccacaucuguggauugagccaaacuuggacugaaaauauucagaaaaaaaaucugcaguguuucaaaaagcaaaacuugaacuuacuacaugcugaauacuauguugaauccaccugaaacaaguaauagguagauguuguaaguaaugaucguggagaugauuuacaguauaugggaggauguacauagguuauaugcaaacccuacaccauuucauauaagagauuugaguguccauggauuuugauaucugccaggguccuggaacuaaucauuuuugauaccgagggacaacuguacacguucacuuagaaauuguuccuuucacguagcuaauaccacaaggaagugguauggggaagguaugaucuggauuaaaauuuuguuaaugaaaaaagccaaacucuaaaucauuugaagagacuuauucugacccaaauaugaggaccauggcugaugacacauccucaagagguccucagaacaugugccuagguguuuggguuacagcuugauuucauccauuuuagggagacagaggacaucagucaauacauuugagauacacguuaguuuggucugggaagaugagacaucuugaaguagggacuuacagaucauagguggauucaaagauuuacugcuuggcaguucguugaaagaauuaaguuauuggcucacgccuguaaucccagcccuuugggaggccgaggcggcagaucacgaaguguggaguuugagaccagccugaccaacauggcgaaaccucaucucuacuaaaaauacaaaaaaucaaaaaaaaaaaaaaaaaaaagaaaacauggugaaaccccaucuccacuaaaaauaaaaugccaaaaaaaaaauacaaaacuuagcuacaaaaauauaaaaauuagccaucucuacuaaaaguaaaaagauugaugguggugugcacccguaaucccagcuacucaggaggcugaggcaggagaaucacuugaacccgggaggcagagguugcacugagcugggaucaugccacuacacuccagccugggcgauagaggagacuccgugucaaaaaacuaaagaaguuauuaucuaaagaccugaaaucaauagaaaggagugucucgguuaagauaagauaaggggcuguggagaccaagguucuuauuauguagaugaaaucucauacguggccgccuuuagagguaauagauggcaaauauuaccuauuuagacuuuuaaaaggugcuagacucucagcuaauuucuuugggaccaaagaucugggaagggaagaagauucucuacagaauguaaauuugccccuacaagagacagcuuugcagggccauuucaaaauguguuaaagaaaaauauuuugggguaaaauacuucaauuuccuucagggcuugcugucugucaugugaugcuaaacuagagucagguuggaauuuagugucuuuuugcuauaaagagucuguuuugucugacuuaagguuucuguuuuaauguuaauucuggucaguugugccugaauucuaaagggaggagaguauaaugaggcaugucugaccucuuugccaucauggccugaacuuguuuuuuagguuucuuuggaauugccuuggccuagaggaggggcccauucagucaguuggggggcuuagaauuuuaguuuugguuuacagucuuaacuguuauuuucacagggcucugcuucaaaaacaacgaccaccucagguaggaauauauccaagccugacuccugcgguuugaggcaaauagcugcuccaaaagccaaaguggggcccccuguuuccuguuugaggcggaacagugacaauagaaaucccagugcugaucgagccguaucuccucagaggaucaggcguguguccaguucugguaagaauaaaauaguucaauaguuuaugaguuaauugaauguaaaauuggacagucaugauuauaggucuaaugccuucugucacuaaagcaguuagccuuuuguggaucagcauccugagcacaggagguagaaaaagaagaugacaacauauaucccuuaucuuugagcaaggcaaaggcuaguugaggagagagguauagguguauaaaccaucuuauaagcuauucagaaggauguguacauaaauauacaauuggguggcugauguaaauuugaaucauuucauuaaguuuuuucaaaugguuaagugcuuaacaaugcugaaguguuguacgguaggucccuagugugcccucaauacaugugaagagauuaauuuuuuuuuuaauuuuacugaaagauguaugauagauuuaggagggauaugagggugacuaaaaaguuaaauuuuucuaaugugaacuuuuauuuauguuggcuuguaucuuacaauuuguaauuuuaaagucauguuaggccaaugaaaugugagcgccucaagaauagcuauuaaguaucauacuaaauuuggcggacguacagaucuguguuacaaagaaauggaaaagucaucccugugucacggggaugaaaagccugcuagccauuccaauugacugagaacaucuugcaaagaacccaccuuacuucugccgguacagccuugggcaaauuaaagucaugucaaaucaauuuaguaguaaguucccuuauacaaauaguuauguguccacacacgugagaauguuuuauggaaacuaaugaaagcgagcaaaucccagaagaucucuguaccucucuacaauuuaguauuuguagguuucauuuuucaacccuaccaugaagccucaagugugaaagccuguaaugcuuagaaauguuuuacgggcuguuuauuuagauucaggccuagugucaaggucaaggagacaugaccacagaggcgugaguggaggaagagggguuugcagcacauggcuccauccccagaggaucuggguggaaacaggaauucauuagcuuggaguguucaucaucugggagaaaaacagaggccaaaagccauugggagaaagagugauucuuauuugggauauugccacaccuggggagucaaggcaugagugagaugaaagcucuaguccuggcuggguguggugguuuaugccugaaaucccagugcuuuaggaagccaaagugggccaggaguucaggaccagccugggcaacauagcaagacacuaucucuaaaaaaaaaaaaaaaaaaaacaacaacaacaaaaaaaaaaaacagcugggcaugagagcaugauggugugcccuuguaggggcuccucagcuauucaggaggcugaggcaggaagaucacuugagcccagaaguucaaagcugcagugagcuaugaucaugccacuguacuccaaccugggcagcagagcaaaacccugucccuugguggugaagaaaaagcucugguccuuacuguaguuguccaauaaggcucauggugcuugcagagaaugggaagcucccuuccuccucugugaggaacaccuguagcuugguggcacuggaguguggccccuggccugcaguuaggagcccuguguuuuaguuccacucuggccccaauacgcugccugagcaagucuuuuacucucccugggcuucaucuucacaucuugaaaguguaagugucugagaaucuaagacccugucagcuuuuacagcccuuaccuuucuagggacaauuuggagcucaccuaauuuucugaguaacugcuguuacugguaugauucucugaauuucguggggcuugaaucccagaaaaucuaagcgcacauacuuuuaagaaaugaggccaguacccaggauacauugaaaaagauagaauccuuuuauguaggcgaucagucccacccagcggggaaguaguuguuaaguccuuuuacucuguguugcauaaugugucuuagagaaaaguggaucuguuuagucuuagugaaaagacagggcaugcuuuugagcuuuuaucauccugugucgaugagcuugauaacugaguuaugcauccagauuuuucagucugaguuaaaaacuaauuacguuuuacugggugguuuucuguaucugaauggaaacaaaguuaauguaacuggaaacauucuggauuugaauuugaguuuuguauuugacugguuagaagacuuuuauggucugaauacuugggucccucuacauuaauauguugaagccccaaccugcaaugugauuguguuuggagacagggcuggugaggaggugaugaagguuaaacggggucauaagagugggauccuaauccaguagggguggugcccuuagaaaaagaugaagagaugggcuuggcaugguggcucacgcuuguaaucccagcacuuugggaggcugaggcagguggaucaccugaggucaggaguuugagaccagccuggccaaugugggaauguggggaaaccccuucucuacuaaaaauacaaaaaaaaaauuagccaagggugguggcaggugacuguaaucccagcuauuggggagggugaggcaggagaauuccuugaucccaggaggcggagguugcagugagccgagauagcaccauugcaccccagccuggguagcaagagcgaaacucucuuucaaaaaagaaaagaggaagagacacuggaacuguccucaguaugugagguagaaugagaauguggccaucuggaugccaggaagagggcccuugcugggaagcagaucagcuggcaccucuaucuuggacauuccagccuucagaacugugagaaaacaaauuucuguuguuuaagccaccccaucugguauuauuacuauuauggcagccugagccgacuaagaagacuaauuugauucuacuguauuauguuuuacagaaaaauuaauagcaacuaauuuuuuuggaugcucucaguaaauugagagguguuucuuaaucgccacagaguuaaaaguagaacagaaaaaucaaggagcagaaacaaugugcuuuuagauccccgugauccuguugccauugauuguacaaugaagugucuguguguauuagcaaauugaaaccaaauggauauccaccauacugacucacaguuacucugcugaaagguaagcggcagaaauguuccagccaauuuggcguuuucaauaaauccuuucagaacacuuaaguagaaaaccagacccaguauugaaacagccauuuucuugaagcuuuaaaaugaaugugagaaggaauuguaauuaaacccaacacagcuguucuuuuuccuuuuucuuuuccuuuuuuuuuuuugagacggagucucgcucuguugaucaggcuggagugcaauggugcaaucucggaucacugcaaccuccgccuccuggguucaagcgauucugcugccucagccuccugaguagcugggauuuacaggcacccaccaccacgcccaacuaauuuuuuguauuuuuaguagagacaggguuucaccauguuggccaggccggucucgaacuucugaccucaggugauccacccaccuuggccucccaaagagcuguuccauuuuacuugucaaaauguggaaauauauuauaugagaccagauuauaagagauuauaacaaaccaaaucuaaacuaccuuugcuucuuuggaaauauacugaaauaagaugagauagugaugaaaauuauuuguaguaguaauuauuauaaugucaaugauagcagcucacacuguuaaguauaugucggguuccaggcucaguuuuaguaauuucaucuauaaauucauuuaauccucacaguaacuuugaggcuuaucccuauuuuauagacaaggaaucuuccacagaaaaguuaaauaauuuguccaauguuaaacagcuggaaaguggcagaggugggauucagaccagccagugaugcuguuaaccaacacauuauuaaucucaauacuauuaguauggccaugaguuuuguuuguuugauuuauuaauuuauuuauuuauuuauuuaugagauggaguuucacucuuguugcccaggcuggagugcaauugacgcaaucguggcucaccacaaccuccccuucccugguucaagcaauucuccugccucagccucccgaguagcugggauuacaggcaugaaccaccacaccuggcuaauuuugcauuuuuaauagagauaggguuucuccauguuggucaggcuggucuccaacucccgaccucaggugauccacccgccucggccucccaaagugcugggauuacaggagugagccaccgcgccuggccugaguuuuauuuuuaauaauaaagucuaauuuguuuuuuuguuuguuuguuuucuguuuguuuguuuuuuugagacauuuucacucugucguccaggccggagugcacugacuccaccauagaucacugcagccuugaauuccuggacucaagaaauccuccugucucagcgucccauguaccugguaucacagaugugugucagcaugcccagcugauuuuuauauauuuuuguagagaugggggggucucacuuuguugcccaggcuggucuugaacuccugggcuuaagugauccucccaccuaggccucccacaguaccgagaugacaggcaugaaccaccacaccaggcuaacguuuaauuuuuuuaaaaauuaaaauucuuguugcccagcugaaugguuuagaaacuguggcacuuuucuuuucaggccuugguuuaaagcuugauguuaacucugaugugaaugauuuuauguggcuauugaaaauuaaugcugcuucaggaaaaauagcuaaugcaugccgggcuuaauaccuaggugaugguuugguaggugaagucaaccaccauggcccauguuuaccuauguaacaaaccugcacagccugcacauguaccccggaacuuaaaacaauaaaaaauacaguaauaauaaaauuaaugcugcugaauaaauaacugcugaguaaauccuucaugaucaauucagacaucuuuagagagacccgccuucacucucuuuuggaggcaauaccagcuuuucccagguuuuagaugauaaauaucuguguucuucucuacacacaugaguugccauuucagaggccagccugagccagguaggauuacagaaguagcgcagaaugcucucccugccccgugacuccugugagcugaggagggagagugcguguuuaugcagcaaacacaaagcggcacaaagaauggugauggguggggaaaaggccccaugagaagaauguccaggggugggucggugaagaaaggccuccugaaagagaugguuuuugguuuucuucuagagaaagagaaaccacauuucaaaagggcaacucuuuauuucaguugaguuuauuguggguuaauaaaguaaauuccuuucaagacaguaguccguccgaaacuugcagugacuugccugucaucgcagguuucucuucuuucuugcuaaguuauuuccuucgugguuuauguaaacugauuauuuuuucauucauuucguguuaagguaauuucaaaucuucuucaaauuacuuuuauauccuuuuaaacuuuucuaggugagaauuugagggagacaguaagcaaaauuaugagagauuuuucacauacuugaauaaaguaauuacuaaaaaucagagguuauuacccaauaaguuauucuaaaagccaaguugaggccggacaugguggcucacaucugugaucccaggaauuagggaggaugaagugggaggauuacuugagcccaagagauugagacccaccugggcaacagagugagacccugucuuuacaaaacauuaaaaaauuagcugggcaaguggcacacacuugugguccuugcuacucaggaggcugaggugggaggaucacugaacccaagugguugaggguucagugagcuauaauuguaccacugcacuucaggcuaggugacagggcaagacccugucucugaaaugugaauaaaauuuaauuuuaaugugucgcuaauagauguuucuauauuuuuauguaauuaaauuaguuuccuuaaaguguguaucaggaucucuuuucauaaaaauaguauuagucacuaacauguuuugagugccugugugcgccaagcacagugcuaagcccucuuuuaaaugcauaaucucauuuaauucccacaacuccuaguagggauacugugauaaucgccauucuacagaugaggaauuugagggucugaaagcuucaguaacguguccaaaguuacacagugggguaauugguggagacgggaaaugggccggguguucuggccccacagucugugcucuuaacccugguccuuuacgugcaugcagaagucuugacacacuccugucuucuuucauggacauaugugaauucuucauuaaaccacauaugugugaaggagaauguggggaaggcugguuugugcuaagaacucuucuaagugcuggaaugaagugcacagaagagacccguuccuuccauuagggagcuuaaauucuaauaaggggauuaagaaaauaaauacauuuuuggauucaugaugaugaauccaaaaauaaaagagaaagagccaaacaugguggcucacgccuauaaucccagcacuuuggguggccaaggcagauggaucacuugaggucagaaguucgagaccagccuggccaagauggugaaaccccaucucuacuaaacauacaaaaauuagcuggguuugguggccggugccuguggucucagcuacuugggaggcugaggcaggagaaucucuugaaccugggagguggagguugcagcuagcugaggucgcaccacugcacuccagccugggugagagagcaagaccccaucucaaaaaaaacaagcaaaaaauaaaauaaaauaaaaauaaagcagugaaggagauuagauuuuuaaacgguuggucaagaaaggccucacugagagggcgacauuugggcaaacaccugaaaggaagggaggagggaggcauuugggugucaggcgggaggacuuuccaggcacagggaccagccgugcagagaccccgaggugaggcaggguguagggugcgugaggaacagugaaccacgcacuguguguggugggggcuggaggacauggaugggcggaggaggucaggaccaaccaagcagggccaugcaggugccugcgaggcacauguccucuuuucauccucacggacaucaucacuuguaaaugcuugaucuuuuccaggcguuucacacaauucuuacuuggcaguaauuauggagaagauugcuuuguggaaugacucaugaguaggcuuaauaugucacagugcaggcuugcccauucauucaagaagugcuuagagucgcugcucuguguugggcaguguacuagauucugagacuacaaacaggauuaagcaaauaugcccucuuaaggagcuuacugguuggagggugaggggauaagggggugucuaagcaaaucguuccaaugaaaacucuuggcucuucagauuccaccucagcuguccuggccucucugcugcuuugcauuuauagugcuguaugcucauuauuuccuuacaugucugucuccuucuagacggugaaauccauaaggauagaguucagcucuuaguuauuuucauauuuuccagugcccagcacaguguacugguugcacaacagguguuuaaaaacauuccuuggcuugauuugaauggagaccugugcgaagcacuguguauccacaguaaaggagcaacacuaacuuguugugagggagaacuggaggagaggcggugacauuugaacuguuuggaaugcgccugcaggagcuugccagcagaggaggcugcugggguugcugagggugcagauguggccuugucaaaggauaccaugugcuuggggaacgucaaggccagagucagcaugccuggagcagacgugucccggggucaaugacagaugagccucugccucgagggagguagaggcugauuaguucuaauaauguagacacaaacuugcacgagugcuacauauuuuuugggaacggauaguagaaugcauguuuaaaauaauuaggagacagagugucuggccacuucuguuggugugaacaguccuaagugucuccccaaccgccgccuucagaggcuggauagguggugggccaugaagugaaauguggaauagaguagcaagaaguuuuccggaggagaauagugaguuuaauucggggcaugugaaauuggaggaggcuacagacugggaagcaccucagagggguaugugcaugccugagguuuaagaguaaaaauauguagagacuaaggaaaccaucagaaaagagcugacauaaagauauaagagacaggcccaguggcucccgccuguggucucagcuacuagcuacucgggagccugagacaggaggaucucuugagcccaaauuugagucuacagugagcuaugauugcaccacugugcuccugccagggugacagagcgagacccucugaaaagaaaagaaaaaaaaaaaaguuggugugaaguuuugaggucucaaugaucucaccaccucauugcucaguggagcucugcucauaaaccuugacuccuaaugagccaggaggcucacugugcaccuucuuuuguucuuaucaggcauuauuagcauaggugucagaugguaaauaaauuugcuggugaacaugugaagacccuuguuuaucuccuuuguaugguagcugggaaaaugaagcaacaccuuuaagucuuugguuuauuccccucugaauuuaaauguuccuguaguugugggacacauguuccaggccugugacuaaggcaguuauuuuuguuuaauccccaccugaagccacagacaucuugugaacauacuugcagaggcagguacugacagcaucaccgagaaugcugcgcuucuguggaguucgagucaucgugagaacuucccuuugugggacuuuuugcuccuuugucaaauuacugcagucuuaagacuugccguguuuuuguuaugacucaccuguguugcucugccuuugucuggggagcuuacccuugaauuuaagcaaaugaggauaguuauacagaguccuauugccuugaugaacucaagaagguggaauaguaaaaucacuauuugcaacauauaaaucuagaguguuacugaaauauucuguguucugcaacguauuuacuuaacagauagagcguguaugcuagguaagucauguaccagacacugagggauugugggaugaguaagauguaguuuuugccuucuugguauuaacugccaaauagaagaggugacaaguucuuguuucaucacauuuguucuuauaauacuaaaauuuaauaaaaagaacuguaggauuuuggaagaggguguaauuacaaauaccaaaguucgcuuaaugguuuucuuucuguaauauaggagauuauauaauguaauagaguuacacucuuaaauagguaggggccaggcuugguuuaauguugaugcuuugugcuguuuaacuuuugcccccugagaucugagaaguaaggaggaugcacauguauugagcuauuuuucaggacuugacugagauacuagaagguagaaugagaagaggaguuauggcucagaauauagaauguagagauugaggucaaagucaguaaugauggugugaaaauacagaggagggccaacaggugauuaggacacaacagauuggcuuucuggcagucaacaaagaagaggcugaccuagagccucuugucaaugucaagaaagggaugcggggcccuguuuuauucuuuaccucuugugucuugaauuuaaccaggcaaauuggauaguuuaucaaguuuacacuacucucuucccaguaggcuauuuuaaagguauagcauuuuaaauuaaaagugagaaaauaaacaccugucaucuuaccaccaccaaauagcuuuuaacuuaaaaauuuaugacuauuugguaccuuuucuuuuugcauauucucaugcacauauguuuauguauauaauggagacagugucugcuguuuuuuuuuuuuuaauuuuuuugaggcacagucuugcugugucgcccaggcuggagugcaauggcaugaucuuggcucacugcaaccuccaccucccugguuuaagcgauucuccugccucagccuaccgaguagcugagauuguaggugccugccaccacgcccagcuaguuuuuguauucuuaguagagacaggguuucaccauguuguucaggcuggucuugugcuccugaccucaggugauccacccaccucggccuuccaaagugcugggauuacgggcgugaggcaccgugcccagcguggaucauguauagucuugaaaaucauaguuaggacuuggaguuugaacuggagugacuuaaauguuaaugggaucacucugagaguuguguugggaguagauuggauaugggugaaguaggaacagggagaucagcuugcgggggucgcugugauggcagcaggagguuauguuuucucggaccagguuguggcagugaggcccgcucagauucuagguaugugcuugaagguaaagccagugagguuugcuuagauuggauugggggugagagcaaagggaggagucacggaugaacaugaccauguuggugugagcaauggaagaauggugcagccuuuaccugagaugggaauggaugguggaaacacagauguugggaaggggagaucugaaacucaguuacauagaaaugauugauaagaggccauguggaguagaaaacuggauaugcaaguuugaagugcgugggagaaaucuggucuacagauauaaauuuaggauucagcaccauauagaggauauuuaaagccaccagacuggaugagagccccacggcaguaaguguagagagcacaggucaaggauagcucuggggugcucccuggacucuccagagucaagaaggaacagccaggaacguaggggcaucccugaagccaaguaaggaaagccuuucaagaagaaaggaggaaccaauugcauccaauacuguuggcaggagaauggcgcaguuaagaacacaauuuacagcaggcgacagaaaacccaaccaguggacauaaaccagaggcuguguguguuuauuccucgggagggcuagaggcaggcuguuccagguuugacgauucauaaauguccucuuucugccucuccacucaucucacaucagcauguggcuuugucauuggcuuuucaguuaaaauauggcugcuaggaguuccgugugcaucccaccacuuccugugacugcauucaaaggcuggaagcaaaggacggcaucucagggcagggaccuccuccucucuuuguuuuucauggggacacccaugcagcagcucccccuucgcccucuuguccuuaugucugauggguacagaccagaucuggcucuugccccuacuggcaugaaagguuggaagcaaguauuugacuuuuuaaacucuucuaugggguuaagcaauggugauggggauuaggaaugacaguuggcucaccaggaaagguguuagacacagugagguuaaauaaaagaauaauaauaaaaguuaucaacucuuuguauucauuguuucaucaagagcuuucgcucacuuauauuugggggcauaggauuuuuuuuugaucugcugcuguucauuuccuuugccuguuguuuuuaugucuuuuuauuuugcauauggugauuucuuaauuuuuuuucacuuuuauguugucaaauacauuguuuccuuuaacuuuuccuguguuuuuaugcauaauaagacggucccuacucaagaagacugaccuauguuuaauuauuuuuuuuaugguuucaucuuaagcccuuugcguuguaauccaauuuaauuuauuuugguggauggcgagcgcugacagcuaauauuuguaugguacuuugugccagaugcuguucuaagcauuuuaaaauuauaaauucauuuaauucucacaagaaccuaugagguaaggaguacuccuaucacccccauucucacauaugagaaaacagaagugcagaacggugaggaaccugcucacuaggcagugugagguggcgccggguuugaaccuagacgaucuaccucgagauugucaacuauuaacuacuguaccguucugcuucucaaauuuuaauuuggcaauucaaauaucuuaauaccacaaauaaguauguuuuugcugauuuaagauaccucccuuauccuauccuauccugaauuuuuauaucucugagauguauauaccaccguauuaaucugucaguaugguuuuauuccaguaggacuuuuauuauuuuauaauaucuuacuccaacuaguugcacaaguuccuuguuuuuaacuuaaauuguggcaaaauauauauugcacagaaugugccauuuuaacaauuuuuuaaauguacagcucuguggcauuaaguacauucacauuuuuugcagccauccuccauauccaucuccagaacuuuguuuuccccccugaaauccuguauccauuuuacuaacccccaguucuccgucucuuucagccccuggcacucaccacucuauguucugucuauaugcauuugacuauucuaguaaucaugaaagagaaucauacauuauuuauaacuggcuuauuucacuuagcaccguguccucaagguucauccauguuguagcaugugucaacuuccuuuuuaaggcagaauaguauuccgugguauaucuguaccaccuuuuguuuauucguucaucugccugugaacaguaggguugcuuccacauuuuggcuauugugaauaaugcugcugugaagaugguuguacagauaccugcucaagucuuucacuuuuuuuuuuuuuuuuuuuuuaaagacagagucuugcucucuugcccaggccagaguauaguggcaugaucucagcucacuguaaccuccaccuuccaggcucaagugauucuccuaccucacccucccaaguagcuggaauuacaggugcccgccaccaugcccagauaauguuuuuuguauuuuuaguagagaugggguuucaccauauucgccagacuggucucaaacuccuggccuggccuccggugauccccugccuuggccucccaaagugcugggauuacaggcacgagccaccacccccggccugcuuucacaucuuuuggaucuguaccuagacaugcaguuguuggauuauaugguaacuucagguuuaauuuuuggaggaaccaccauaccauuuccacaguggcuacaccauguuacauucccgcuagccuugcacaaggguuccaguuucuccguguccuugccaacacuuguuaauuuuuuguuuuugcuuuuuuuuuuuuuuuuuuugaugauagcaucccauuagguacaaagugguaucucgcgcgauugugauuugcauuucccuagugacuagugauguugagcaucuuugcaugugccucugggcuauuuguugucuucuuaggagaaaugucuauucgaguccuuuguccaguuuuuaaauuggguuuuuugguauuuucguuguugaauuguagucuuaauguuuuucuguucuaaauuuuuuuuuggcuauucuuaauuauucuagauuacuuuaacauguuuuaaaaauucaauuccugcguuuaaaagcaaucacauguagguucagauugcaauagcauuuaauaagauaucaauucauggaagaauucacauguguacacuuguucagaacuuuuauuuuucucauuuuuauaauuuucacaauagaauagcacuuuuuugauaaauuuauucacagaaacagugcauaugugugugucuaugugugcaauuccuuuuuguuaccaaaguaagggauuucuuuuucuguuuuuuccuggcacauaggaaauauauggauuuuguauaauacuuauuugguaagaagcccaucagguuuauuuaauauuuauacagugauacucuaccauugaagcuaaguucuuaaacauguauauuuaguguuggugagagaauuuggucccuuaagcuuaauuggaaguggaccugcagccacgguuuugaguauguauaauuuauuucucuuauaacuuguuaacuuguuugucacuuuuaaguuuccccugauuuuauaauaauuccuaguuacuguagguaauuacucuaaagguaacugucucuaaguaguugaguuguauuuaaggaacccaaguuauauaauuauagcuacagacauauucucugaauuaacuggaaaaaaaauacauauucucaugucucguauuuuaacugugucuguuaguuuggcauuuucucuuucuuacuuaguaguuaguggccuugccacuugugugccauacugauauauuucaaauggaccucaauaaucuuuucauuuuuuaguuaaaauucucacuucucuaacccuggcaggugcugguacacuagcuuccuaucuuuuucccugauuucagucuucagucaguucugcacacugcuaccacacaaucaaguucugauguaaaugcuaaaaaagccucacccuccccgacccccccaacccacaucuucccaccauauccaucccuaacauuuaaggucuaaaauuaugagucuggcauucaaugccaugucucacccaacuguaaacuaccugccucuccagccuuauuuucuucuucccaccuguguuccuacuaagcuguauaaacuacagaacaacauaccuuauggugagacaugauguuuucuuuaguuuacaguuuuuacugagaacgucuaauucuguggcaggaugucaggugguucuggcucuguauauguuugaacuuugugauuacuugcacuugccuuacuagguaagcacauaaauacuuguguaagacacaccuucaugugaaucuauuguccagauuuuuauuaagaugaucuguuuuggccaggcacgguggcucacaccuguaaucccagcacuuugggaggccacggcaaguggcucacuuaaggucaggaguuugagaccagccugaugaaaccccaucucuacuaaaaauacaaaaaaauuagccgggugugguguuguguggguguaaucccagcuuccuacaacacaaguugugcagcacaucuguaggacguauucaucuugcauaacuggaacuuucuacccauugaacaacuccccauuucccuuccccaccagccccuggcaagcgccauucuaccauuuuguuuuacagaauaggauaauauuaauauuaacacuauccuguuguucacuuaaucuuuccauugaaauuuuaguuuugcuaggcgucuuuuacugauuuuuauuguuguuaaauauaguauacuuacucagguuuucugaggugaguauuuuaguaaauugguugauuagugaagguuugcuucaaauccaauagacuguguuacuaucuaaggcaaaguggagguguuauuccuuccagauuuucccuacauaaaagaugguuauaauuacagaauaaaaaccaaucuguugucuauacguaagucuaugcuaagugcacgagcuuaaaauaaaccacugaggucaauaauauccugcaaguagaucuuaaaucuuuaucuuucucaucugggauaaguuacacaauacgauaugaccugguaaaugucaccuuuucggaacuguaacucagagaaguccuguauugauuucacuguuuaagaauuuagcgccuguguuacuugcagucucucaauuaaccuaauauugcuauguuuuaguauugccaacuuuaccguuaagcuaaacgucgggacuguuggugaaauaguuauaugucuuuguugcauccguacgguuuucaccauuccgcuguaggagcuccuguccaguaagagcuccauucugaacucugucugccuccaagccucauacuuuucuuuaacugagauguuucuauucuguggcauggccgagggaacacugggcaggugguuagacacuuggauucuaggccuuacugucacuggccggguaugugacccaaguaagccauuuaaccaccuaaguagucuucucaucuauuaacugggauaguaauagucacacacuguuaggauuauucuaucaaagaaacuaaucuuuuggugaaaucggcauucauuauccucauugcucauuagucaagagccaugguggaauugggaagacuuuggugaggacuggcugccauuagguguaggggaugggccuggaugggggugacaaugagauaggggaggucagggaaaugauauuugguugccgggguaagcuuuccucuagugcagcugugugaagguacaggucuucuguaguaauucccaggcacacucagaaaugucugcaaaccuaaguuguguuuagaaacaaagcuaugaggcaugcauuucugaagaauaagcugauuuccaaaauguaggaagccuuggcugcacuguggcuguggcccagucauuuugaucuguuacgugcccaaccuugcuuauuaguuuugaugaugacucaucaguguuucugcugaaggggcggcaauuuggcaaauuuauauucuaaaaaucuguuuuccuguucuuccuaaagcaaguaaaacugguggcuaaccauaaauuuuuaaaguguguauuugcuaucuaacaguugcuaauuauuguaaaggauguaaagaaaaaagucucuaauagacugaagauucaaauaagcuuguaaaaauggguuaagcacugaaugcuucaguauagaugaugggagaacacauuaucaaaauacaucauuuacuguuggcauuuaaaaaaaugaauuuguugaggaaacauuuauuaagucucacuccaugcuagaccuuugccaguuccugaggaccagaauugaaucaggugcucuuccugaucucaggaaccuuagagaugguccaagaagaauguggaggcaaaugcugugauagaaacaaguacauggugugaggagaaagcaaggcuuaguccacggcauucagagaaggguguccuggcaggauaagcucacagagagguccugauucucaacagugcuucagaaacuccaggugcauuuuaaucaccuggggaucuugugaaacugcagguggugauucaguaggccuaggguggagcugcaaaugaguagcaaggguucagaagagaagcuugagcugacuuuggauucacuggacagaaauaggggaggggauagaaaggaggccguucagucggaaggaugggcguaagcagaagaauagagcgaaaugacuggagagaaaccacgaagggguguguguguaugaagggguagaggcauggccugagggggaagaaguggguagggaucaaccccacauugccuuuuaagccugugaaauuaaauauuaaauaaaaggauugaaacuacgaucaccauccuauagauuggggugugcaaucuuuuggcuucccugggccacauuggaagaagaagaauugucuugggccacacauaaaauaugcugaugauagcugaugagcuaauaaaagaaauugcaaaaaaaucucauaauguucuaagaaaauuuaugaauuuguauuggguuagcguucaaagcugugcugggccgcaugcuguagaugguggagaaucccaaauuuuagauugggucaugaccuuaauuuucacauuuaggagauuaacaugauggaguuggaagggauggaaggacaggauuuuaggaguccaauacaguuuagacaaugauauaaaggguuaaauaaggauucaaaggguggaagaagagcucuuugaaaagaaaugaugugccuguuggaauauuaauagaauagcacaugaugugcccuggugucagagagaaagcgagguuaaucggagcagagcacacauggauguaggagagccauacaagagugaggcuggagccgaaggaggggagcuuaaugugguaauuucaaaugccaggccugaggagcuucagcaucuuuuucuccauuaggaugagguuuuuaugagcaaaaucgcuagaacaaagcaaugggcauuacuuuccagcagcauuauuugacucacuuaugggauccuuagugauacgcaacaaugucauuuucaucaaaggucuuuuucaacucuggguagucuucaguuaggugguacugguagcauugggagacagugcuagaauauauggggaucuggggaagaaaagaugauuccaaugguuugaagcuggaaaaaaauaaaaaauagggcuauauggcuggguggggugguuuacaccuguaauuccagcaguuugggagacugaggcgggaggacugcuuaaggccagaaguuugagaccagccugggcaacaaagcaagauuuuuaaaaaaauaaaacaguggagcuauaauuagcauaaacaggagcaugucggucuaagaugaaaaccuagaguacucaauaaguacuuuaaaacaugaguagccuugagauucagaaggaagauagggcugcaggugagaacaugggauucauccgcauaggacaaugguuagaggaaaguagagaaaauagacucuccaagagaaugggcaugaggaggguuaagagcgaaagacugggcuugggaaaugcccauauuuagguagcagguucgugagcaucaggagaauguaguuucagagaugccagaggauacgcagccuguauauuuauuucacugauaaguggaaacauuuuuacugcaagaaagaguugcaaguuggagugaagaucauuuaaguuuggcaaauaaacuguguggggaguaaagaagaaaaggugagauuaaaaaaaaaaaucuuaauaguauagcaccaccugguguuagaacauuaggcauuuuucaaaugaaauuuuugcuuaucaaauugcauuuuucuuccuguuugggugauuuuaaaauuuuccacucaggagaauuuuguuaaaguuuucaguuaacgugaguucuguuuucuguguauaaaugagugaauuuccugagaucucucuuucauuccaaagauguauuuggacuugguucuuauuuauuucuuauaugauagccuauuguccuaauggauuauuuuuuuuuuagucaccaguauggggggucguaucaauuuguuuauuuuuuuauuucaguuuugccaaaagcugcuuucucaugauuauucugauugaucaucuccuucagagaacaugugugaguuaauuacuuuaggagacaggguuacuccuacacuucucauauccuaauugccucaucauuucugcucucuugccucuaaaugaucaaaaauaaacaugucugcgugaagcuuucaucuuucaucugaaguuacaugauugugaacauucauuuuguguuuugacuuuguuguuagugcagaaguuugaguuuacaggcuuaaaaagugccagcuuucgggaugaauagcacuggaaacuuuuuguuuuuuuuaaaccccaaggaaagccuacauccuugaaaacugcacagucgucaugggugaauuugccuagaccacuuccuaaauccaaagcaucuuugaaaaguccugcgcugcggaggacaggaagcacccccucaauagccagcacccacagugagcugagcacuuacagcaacaauuguaagucgacuuuauaucacacuucggggguuguggaaacagucauuacaagaaaaacuaaugcucugcaaauaauuagaauuuuuguuucugggguuucaggaaaaauaggcauacugcuuccuuggaguugcucugaaaguuuggcagaaaaaaaauucuuugaaaaacacucuugaaauaauuauguguuaaaguauauuuuugcaugaaggauucgaaagugcaucgucugaagugaugguguuuuggagguuuaagaguagcaacccaggggauuuggacucuaacuggaaucagaaaaaaagauuauuucaguuucauuuacuuugcaaaagacuaucuccuguggaaucuuuggaugcuagauuuuguguaauaggacuaauauaacuugaauccuaauucuaaaaaauugaaacucaggagaauuuuguuaaaguuuucaguuaacgugaguucuauuuucuguguauaaaugagugaauuuacugagauaccucuuucauuccaaagauguauuuggacuugguucuuauuuucucauuuccuuuuuuauacuuccccacgaaauaauucauaaauuuaaaccaucuuggagugcccgcugugcacagacaccaugauaggcgcagugaggagcacaggauauaaaagaaauggcccuuauucuaaaaaauaguugaggagaaaaagaagguauuuucauggaugaugagaauaccaauaaaaccagacacaaggguguggagaggaguggcgaacugaucucuucaguuugacagaucaguuucuucuuuugggugaggaguuggggacaaaguguaauaaugcucaugaggcuccucuggguguggagcaguacuuuaggauguccauauuugcuuuuauuuuuuucucucagguaacuucugcuguuacccugauauuuauauagaaggugauugaggcucagagauguugucacuggucuaaaaucacacagcagcuaugugagggaauugagaaugcauuuuuuguagagaaggcauugaauuaaugaccgaauuaaugagcacauuuccgacgggucaccuagcagcaguagcuggacucauaugagaguaaguagcugcauacccuggcacuucaggaauacugggauaugugacuugcaauuaaacaggauuguuaccagcuuuacuguuggaauuuugaagguguggcacaaaaucaggcuugcauguaagagggaacucugaauuugaaaagguaauucacacguguauuauuuuaagcucucuuugucuugcaaagcaauuuuaaagacaaacugccaaaacagaaucaccaacaugcucuagaaaaacuguuguggcaacagaauuuguggcacuugaagcagacacagucuguagugccacagccccguguuuuccaucgacauccauguugacuuggccaccguuucaguacugugucugaugcuccuaaggaggcuguaaagugcuuuuguccauuccuuuuugucuuuuaacaaagggguuuaccauacacccacagagccugucuaguggcgauguguuccuguugcggauuaagcauucaaaucagugagucucuuucuuaguuugauuugcuagcugguuuaaucuguuuuguguagugccuuggagcuuacgcauuuuuuuuuuuuucccuccauucgaauucacuaagagcaagcaugagggauaugagagugaacauggcugcaguuuuuccugcuuaagcuugcuuugauccuuuuaaaugacuguaccaggaggauuucgcaguuguacagaaacugauauuucuucaaaaaucuuuaucaauucuacacucaccccaccggcugguucagagaggcacuaugaugcuaccuuauugacacugcuggucgugggaucguacagccuuuguauaauuccuuuguuagccacguuuacugggaaaaaaaguaggucgacgauuucugguuucuuuucuuuguaagcaugcuuaaauuuuuauucaauaaauugauuuaggaucucuugacuucuguuuuuguaacuuguaauuuaugguaaugguaguauuugggggcauuuuguauguauauuuaagaugugaaugcuucuguguaggaccaauuuuguugucucuuuuauguguuuugcacucuuaauauaauucagcagcaucguuaauguucuggcacaugaaauuauccuauuaucaaagacuuuuugaugguuuaauuucuuaugaaauaacuaguuuuuguguguauguagcugguaguugugcaaguguagaaaaauacuuuucuaaaauuaaaauggaaacaucacaucuuuauuuuccuaaguuguaacugaaaguauuaaacauguauacuuuuaaaggcuaccucaaaacaugaaaaaaucaucucgcgcugaaaauuuccuguuucugauaauggguggucauguuaagaauuaacuuccucuuuugaucaguguucugauuuauacuggcuuaaguauuugaaucccuuuaacaaauauugguuucucgcuuugucugcuuguuucuuugugaugugauaucuuuaguggcaucauuuaagaacuucugauauaacacagugcuguuguaaaauuagcacuggguucucggaacuuugggauccuauagaaauaauguuacuaaauuuuuuaaaugaccaaaucaaaauacguaaggcaauaaauuguucuuauuugggaauuuuagcagguucuuuguguguguucuuuuaaguguagaaaauuucaaaguuacgaucuugauccuuuuggauauuaguguaaaacauuucacaaugguuucuauaccaaaugugcucauuuauagagguuaaagauuauaaggucuuucacacucagauaccuaauauccaguuuuuaagaucauuaaaguaacuggguaaaaauaaaugauauauuguaugucaugaacagaguugaagauuuggggacuauugugcaauuuagaagggggucuugggagaguguauaacuuugcgauguuagcaggaaaguaagguccaaagacauuacuuccucuuccacuuuggccacaaaaccauguuuauauuugagagccagaugguaggggaaauguaagaggugcagaccaaagcuauuugcauucuccuggaaauggaaggaacagaaggagacugaauaaaagaaauggaguguucuuucccuucaccuucacugacagcccuggcugagugggguguaacaugcagaaaagggcacuaaccuuggacccaccuuaguuuguuuuuuguuuuuuguuuuuuuuuuuuuuagauggaguuucgcucuugucgcccaggcuggagugcaguggcaugaucucagcucacugcaaccucugccucccggguucaagcaauucuccugucugaaccucccaaguagcugggauuauaggcaugccccaucaugcccggcuaauuuuuguauuuuuaguagagaugggguuucaccauguuggccaggauggucucgaacuccuaaccacaagugauaugccugcgucugccucccagagugcugggauuacaggcaugagccaccacgcccggucccaccguaguuuuccuacuaacucauguuaaguuggacuaucuuugucuuuucuuagccuccagccuccauacucuccucugaucaaugacaagggaggacugggucaucuucaaaguccuugcagcaacaaacauuucugacccuuuucacugcaauaagacagggccucauuguuuggcaggaugguguuuugaguuguucaagugauuaagcugauaaagaauaggguggaucuuauuuacccuuaguuuuuuguuuuuuguuuuuuuucuucucucacaacaggaaugggaagugaauauugucucaccugccaacacugguuaguggccaacacugguuaguggauaagaauucgccuguaggauggugucagugguuucucagggugccuccagguucagagggaaaguuuuguguucaagucgugaugucugucaugggugaggcuaagaugaggaacaggcgguagauucauuaggcuccacaucacaaaacauguuaguacuuacgcacuucugaauggacuauuuaaaaaggaaauauuauccagaccacuguuaacuuuguucucguucuuucucuguucacguuuuucuaggguauaugugagacauucuuguuauuauauaguugagugauauugcuuuugaaauucaaaaguuuagauuucaguaguacuuugauuuuaagccaagugggcagaugaucuggcacaguggggaguguuaaacugauucacauaaaauucaagaaaugaacagaauguuggcucuguguguauauacauaauguaauaaaagcgaauuuucacuagguguuagaauguaguaugaauguuaguuugcagauaaaagucugaaacaaugagaagcccuuuucuuuuuuuuugagacagagucucacucuguugcccaggcuggagugcaguggcacgaucucggcucacugcaaccuccgccuccuggguucaagcaguucucccaccucagccuccugaguagcugggauuacaggugccuaccaccacguccagcuaauauuuguauuuucaguagagacaggguuuugccauauuggccaggcuggucucaaacuccuggccucaagugaucugcccaccuugucuucccaaaguucugugauuacaguugugagccacugugcccagcaugagaagcccuuuucuaauaggaaaaucaugucuucugcuugggcuuuccugagaauaucccuuaguuuuuccuuuuagacucaccagcuccuuuauuucacuugaaccacacuuuggccauggggaaaugaagauaaagauuccagagaaucuguuauucuggcauaauugagacaguugggaccaaagaugacaaaggggcaguuuuaaacuacauauuagaucagguugagaaguagguggccacaugaaaaauuuuauguauugucucuucaagccagcaguguuuaguguccauggcucucuagaacacugucuuuaggaugauucugaggaugcauccagccucagugggacugaauaccacagugaguugugaaggcaaaugcacugucuauucccauacccgauaugggcgaaugcacugucuauucccauacccgauauucagacccuuguuauucauagauaggugauucagcacagcuaggcaguggucaagucagcaccagaacuaggauauuuuacauccuguuccauugcuggaaacuauuaugcaucucuuauauuggaauuguugccgcugaggacuuuauuguuuggauauaaugacucuggcugagggaaaauuuagauagcaucaggauacucagucaguugccauguuaggaacagaaauagagggcaggggaaauauuugaagagcauuaugacucauggugguauacauccuucaaguugggguuuacuggaaagcagugggccagccuagaguacaguaaguagaaauugagagaaagauauuguuagucauaaaauuauguucagcucaguacagguugugccugccauuaguaaagcagaaagcagguacaaucguugaucauagaguauaugaauauguaucuuguauauauagcuuucauguaaauauguauaaaauauaaaugcauguguguuuguaccugagucaaacgcagacauuuuauccuugcaguaugaauucugacuucauguugcguguuaugaagcugaugauggguguggugccggguugaucuaguguuguauugagucugaaaaguggcagugagacagcugauuuccagcacaccaccuccuauuuugcaugugacagagaggcaagggacacaggaguaccaucccucaugaagaaccuguccuuuacuuuagugaaaaucuuuuuacugaucucuuugugaaccgugggccuuugugucucuaaauuuuagaaaagaaaagcaugaauuuagaaucauacaauugcauauuaggucuguaaauugaacucaguuuaauuuuuuaaaauaugaauaagugacuuauuuguugcugaauauaaucaaauacggcuucaagaaaaguaagacuaaaauccagauuguuauaauuccaugguuaagacugucuaauuuucuuuguuggauuugauucagcaaaagcuaaaaugcuaauugaaacccaauauccauuuucuaugaacaucuaaaaaggguucuguugaauguuguaauggcggugucuuuaauacugucacucccauuagcuuccugucaacuuuggaaaagccaagucucuagguucuagggaaggugagaauuggaaaaaaggacaggaaauugacagaauuuucucagcaggagggaaagcucuguguugauuugaccuaauauuaggaauguuauuugggcacgagaacaaugaacagauggcucauuguacagggccuggguguggauuaggggaaaauaauagcacgccuguacaaaguuugaaugugauguguauaagcacuauuguagcaguuggaauagguuagccuagugaaaaauuucuagcugucuucacauuuauaaugcauuuguaaacaagguagguaucuuaacccuuugcuaagugagugaagugagaaaagggaucauaguugguaauaaagaaauuuauaagcguugaauaguagaauagaauugggugccuagaauuggauauugaucauuauuuggaaacaaacaggcuaggugcgguggcucacgccuguaaucccagcacuuugggaggcugaggcgggcagaucacgaggucaggagaucgagaccauccugccuaacacagugaaaccccgucuccacuaaaaauagaaaaaaugagccggguguggccgcgggcgccuguagucccagcuacucaagaggcugaggcaggagaauggcgugaacccgggaggcggagcuugcagcgagccgagaucaugccacugcacuccagccuggacgacagagugagacuccgucucaaaacaaacaaacaaacaaacaaacaguagaaaauccagucuggauugguggaggggaaauuuuuacacauaauauaaaaagaugguuuuuguuauugagguaagauucccuuuuauguuuuugcuuuggagcuaaaacauaaaguuuacuuuggaacaaacuuccuuuguucagggcagaaguuagcauuuuaacuccuugcuguaggagcaaggauuugaaccagagcguguccuuauagcuaccaaggagucuguauguuacuguucuugugucauuaacuagcugacugugcgaauucuuccuuguccccauggagaugggugcucuuccuagcugcaccuggggcauucuuguuacauagcaugaaguggcuguauuauuucuuccccaacucuuaucugggaugaaagcugaacuggacaagaugcauaagcuuggacugugccaggcuaaccaggauguguggucacucugauuauagccuuuauuucgcaucccugagacacaagcuaccuguuauccauguuguauucccaauguucaguaaugacuggcaugucguaggugcuuauugagcauuuguugguucaaggacaaaggaauaaauguggaaggucgaaacuguguuuaucuauacaauaaaauguacuuuucuguuuuauuacagcugguaaugccgcugucaucaaauaugaggagaaaccuccaaaaccagcauuucagaaugguuccucaggauccuuuuauuugaagccuuugguauccagggcucauguucacuugaugaaaacuccuccaaaagguacaguccucauugugguuugaagagggagggcaagacgcuuaaaguccuuggcuuguagaaaguuaaauuuugacaauuagguuuaugguauagucaacaaugauuacaaauauguugagaaaggagauauaauacauuuuugcacugaggaaauuguuuuucugacaguugguagguucuauaguuaaaaaucauuacguguaagucagcaggcagaacaaagguauaagguagaaacagcaaaacuucaggaguuaaauuauucuaaaacagugcucuagaauagugagaaaggaguagaaaugcaugauuacuuuucaucaggguagauguuuuauguuuauuacuguacuugugucuucaugucuuuggucuaagacauuguucuuccucuaaauguucuuuaucucuguuccuucucauaucccucacuuuuuauuugcugugauuaugaaaaguaauuuucagguuuacaaaauaugugguauacacuuaaugugcaauguuuucaugcagcuuugucucaguggggccaaagcacaucagaagccuucuuugugccacaugcgguggcucacgccuguaaucccagcacuuugggaggccaagacagguggauugcuugaggucaggaguuugagaccagccuggccgacauggcaaaaccccaucucuacuaaaaauacaaaaauuagcugggcauggucguguguaccuguagucccagcuacucaugaggcugaggcaugagaauugcuugaacccaggaggcagagguugcagugagccgagaucgcgccacugcacucccgccugggugacagagugagacucugucucaaaaaaaaaaaaaaaaaaaaaaaaaaaaagcauuauuugugcuuagugaacugaagcuuaacuaaagccugagcgaauaauugugagugagaaacuugaccuauaaaaugagacccacauuuauguuagagaauuuggaaaacacagaaacaaagagucuuccuuaauucugucaaccagcaauugcugucacauuuccuugugacuuuuuuccucuguauguauauguuguuuuguuuuuauuccagcaaaacugagguaauaaugaauauacucuucuguaucuugcuuuuuauuaaguuaguaguguaucaggagagcuucuucacuuuaaauggcuauucuaugguuguccacuucaguuuauagugggcaacuucugacuuuuauugggguuuauuaauacugagaugaaccucuucaaaugugagucaagauucauuguuucagauucugguuacuuguggauaucccagaaggaggaauuacuggguuaaccugcaugaaacucuuuggauuguuaauaucuauuaguaacuuucucagagguguuacucugucacagcauccuccuuaacaugucucucucucucucuguguguguguuuaaaggauaauaugguaccuugaggcugguuaauguaugucaauaccuuuucuuuguacugaauugaagagaaaauaggcaugaauuuuaggaguggguugaauucuucagugugcagcagguugucauuugccuagggaguuaaucaaauuucggaggcaccaaaugaccucuugcugaguugacaucagguuggaaaacugugguuuuuuauugaugaugauaaagccccaugauccacacagcaauaaugaaguuaacgcuguugaacuuugauacuaaaauaacuugcagagaaugagauuccauggacagcuuuguagaacaggagacucagaauucuaaaaugccucacuauugaauggauagguuaugucgcaacaguuuuaccugugugggaaucagugcuuuccauugauaacagccacguauuuuaagagaucaucaucucuguaaaauuucagauagaacaugguagcuguucuaacugguaucugcagaugauuauguccuagaaacaacuauuucauguuaaguagaagcaucauagauuucuuuuagugacuuacagcuguguaccuauuaccccuccugauuuuauauuuuaucaguuuggaggaaaaacuucuauuuuucuucauagcugaauagaaacggguaguuucggaaagcacacgggagugacuguccuucgugaagucuggccucugcucucccggcagcagaauggcauaugugcacagucugugaauucaguacuguuaaaacuugaacuucagcuguucuugacugaaaaaauacugcggcuuuuccuuuuaaaacugguccuauuuaauuuguggugacuucauaucauacuuaaacauuuugauguuaugugaaauaucaccuuauauuuaaaaugcacuugacaaaaguugguugaaucucggugauauuucccaccgggaaccugaaauguagcgauugauuguuuuugaaaauaauucuuaucaacaugguuuguuuuuaugugauaugucaaauaaaacauauguauuuuacauguuucuuuuauaucuuagguccuucgagaaaaaauuuauuuacagcucuuaaugcaggugagugaccacuuuauggauggcgauaaaaagaaucuuuuuguaaaguuauguuacuacaaguauuuacagugauuuuuuacuggugugcuuauaaguagaauuuccaauuugagguguaaaccuaacuuuuuaugacgggucgcauagcauuaaaauacgguaagcaugacuggccaucuaaugcaugaaaggacauuguauuacuaauagauaguuauagucuuuuaaaaaaugauuuuguuaauguggucuaaaugaaauggaaaauguacuucccccaagaucaaugcuauuuugaaauuggauauuccuuaauuuuuaaguggucucaauauuugguuuuagcaccuuuucccaguucagcagccuauauuuuuauguuuuuuuuuucacacuuucacuggacuuaacauucccaagauagccugcagccuccacuauuugaaccacagcugagaauccaaaacuuuaugucucucaagaacccauaaaagauuucacaaaauaucuucacugcgauuccuauacuuuggauggauggauggauggacagacagacagaccgacagauaggcugggcccaguggcucacaccuguaaucccagcacuuugggaggccaagguggguggaucacuugaggucaggaguucaagaccagccuggccaacauggugaaaccccaucucuacuaaaaauacaaaaaaguuugccggacguggugguacgcuccuggagucccagccacucaggaggcugaggcaggauaauugcuugaaccugggaggcagagguggcauugagcguagauuacaccacugcacuccagccugggugacacagugagacccugucucaaaaaaaaaaagauagauggauugaucucucuagauagauaaggucuccuguacacugccuacauugucuuauuuuauauacagugauaaaacaguuaugugccuucuaaauccauggcagauuagaagagcaaaucagaagaaacgaagguacaagcaucgcucauuuucuggagccuugcaaauacugugcuuuuugcaacucuaccagcaucauuuuuccaacagcaguugcucacuucaugucuguguguuacauuuugguaauucucacacuauuucaagcuuuuucauuauuauuauaucuuuuacggugaucugcgaucagugaucuuccauguuacuguugugauuguuuugggacaccauggaccaugcucaucuaagacagugaacacagcugauacguuugcauuucaagugcuccacugacuggucccucuuccaucucucucccuuuucuuggucuuccuuauucccugagacacaauaauauugaaaguaaccaauuaauagcccuauaaugaccucugaauauucaagugaaagaaaaguugcaugucucucacuuuaaaucaaaagauagaaaugauugaguuuaaugaggagggcacauugaaagccaggauaauucagaagccaggucucuugugccaagcaguuagccaaguuguaaauggaaaggaaaaguucuugaagaaaauuaaaagugcuccucuagugaacacucaaauaagaaagcaaaacagacucccggcagagagaaagucugaguggucugaccagaagauuaagccagcugcaacuuucacuucggccaaagccuaauccagagugagacccuaacucucuuuaauuguaugaaggcugagagaggugagggagcugcagaaaaaaaaaagcuggaagcuagcagagguugguucaugagguuuaagguaacucuucauaacaugaaaguacagggcgaagcagcaagugcugauguagaagcuacagcgagucauccagaagaucuagcugggaucauuugauaaagguggcuacacaaaacaacagacauucaguguaggugaaacagccucauauugaaagaagaugcuguuuaggacuugcacagguaaacaggagaagucagugccuggcuucagaugacaagcugucuuauuagaagcuaauacuucugguaauuuuaaguugaagcugacguucacuuaccauucugaaaauucuagggcccuuaagaauuacguuaaaucuacucugccugugcucuauaaaugaaacaacaaagccuggaugacagcguauuuguuuacaguaugguuugcugaauauuaagcccauuguuaagaccuacaacucaagagaugucuuucaaaauacuacugccgacugacagugcaccuggucacccaagaacucugauggaguauaguauaguguauuacauaguaauauauaguacaagaguauaguacaggaagauggauguuuucacaccugcuaacauagcagccacuuugcagcccauggaucaaggaguaauuuugacuuucaggucuuacuauuuaagaaguacauuguguaagacuguagcugcccuagauacugauuccucugauggaacggggcaaagucaguugaaaaccuucugaaaaggguuugcucuucuagaugccauuaagaacauucgugauucaugggaggaggucagagcaccaacgugaauaggaguuuggaagaagcugaccuaaccgucauggaugacuuugagggguucagugcuucaguggaggaagucacugcagaugugguagaaauaggaugagaacuagaaugagaagugaagccuaaggugugacugcauugcuguugaucucugguaaaauuugagcagaugaggaguugcuucuuaugaauaagcaaauaaaguaucuucuugagauggaaucuacuccugguaaagaugaugugaacacuguugaaaugacaaaggaguccgaauauuccauaaacuuaaagcaguggcaggguuugagaggauugacuccaauuuugaaagacucucugcuguggguaaaaugcuaugaaacagcaucacgugcuacaaagaaaucuuucaugaaagagucaauugaugucgcaaacuucauugcugucuuacuuuaaauugccacagccacccaaaccuucagcaaccacuacccuaaucagucagucagcagccaccaacauugaggcaagauguuccaccagcaaaauaauuccugcucacugaaggcucagaugaucuuuagcauuuuuuagcaaugaaauauuuuuaaauuaagguguuuuuuuuuuuugagacagagucuugcucugucgcccaggcuggagugcaguggcaugaucucugcucgcugcaagcucugccucccggguucacgccauucuccugccucagccucccgaguagcugggacuacaggugcucgccaccaugcccggcuaauuuuuuguauuuuuaguagagacgggguuucaccguguuagccagauggucuccaucuccugacuucaugauccaccugccucggccucccaaacugaugggauuacaggugugagccaccacgccuggcaaauuaagguauauauuuuuuuagacauaaugcuguugcacacuagacuauaguguaguguuaauauaaguuuuauaugcacugagaaaccagacaauuuuugugauuugccuuauuaugucaugugucuuauggggugauauauaucucccagguaugcauguaauguuacagaauguugacuacaguuuguucacacauugugagugucagguguuaaggaugcaguccugagcgaagaaugagcaggggccuugucucuggagagcuaauaggauaguuaaaaaaauaaaauaaaaaaccugcucaaauagacaugaaucacaaaugcacugaguucuaggaaggaggguugucuuguccuagaagagagguccggauugaaggcugucaugugagggaaaccugggcaagagguauaaauuucugagccuguuguguaaagaaaacagggugggauaacauuacaucaugaauaacaugaauaacaaauauccuugaugccccaucagguguauucaguuuccucaguguaauaagcagggaaguguggggaaauuaucucagaauucuuuuucuuuuuuuuuuuuugaggcagagucuugcucugucgcccaggcuggagugcaguggcgcgaugucugcucacugcaagcucugccucccugguucacgccguucuccugccuuagccucccgcguagcugggacuacagacgccugccaccaugcccggcuaauuuuuuguauuuuuacuagagaugggguuucaccguguuagccaggauggucucgaucuucugaccucgugauccgcccgccucggccuccgaaagugcugggauuacaggcgugagucacugcgcccagcuaucucagaauucguaaccuuuuguaggcucuuaaagcuaggaagacagccaugcagaaugaucuaaguucuaaagauccccaggaugcugagugugaauauaugugguuacuaaagccuuuauaggguaaaaaugcagaagaaacucugcuguacacauuuaggcuuuuauuuccuuuuaaguuucugguacauccuaauaucuggggaaaaaagauagcuaauauucuauggaauggcuuuguuuaaaaauuaguuaaccauuaucagaaaacuggcucaauugguagcucuguguuuaacaguuuaagaaaccuccaggcuguuuuccaaaguggcuggaccacuuuauauccucaccaggaguguaugaagaauccuguuucuccacagccuugucaacacuuggcuuugucugucuuuuuuauuauagcuaucccuacuggguaugaagugauaccucauuguuguuucaauuugcauucugacagccagugacauugagugucauuucgugugcuuacuggccauuuguauaucuucuuuggagaagugucuauucaaaucauuugccaguuuuaaacugggucauuuuuauuguugaauuguaggaguucuuguauagucugauauuagacccuugucagaguuaucauuugcaaauauuuucucccaauucuuggguguguuuucacuuucuugauaauguccuuggaaacauaaacguuuuaaauuuugacaagguccacuuuaucaacuuuuuuucuuuuguugcuucugcuuuugguauuguaucucagaaacaguugccuaauccaagguugugaagauuuaagccuguguuuucauuuaaguuuuuuuugcuauucuagcuguuauaguuagguuucugauucauuuugaguuacauuuuuauaugguaugagauagaaggucuaauucuuuuuugcacauggacauccagguguugaagacauguauuucccccauuuaaaugccuuggcaccuuuguuaaaaauaauugguuaagaaugugaggguuuauuucugauuucuaaauuguguucuuugcauuuauauguuaccuuugccagugcuacacugucuugauuaguaaguuuugaaaucaggaugugagucauucaacgucuuucuuuuucaagauaguuauggcuauucugggucccuugauuuucuguaugaauuuuaggaucagcuugucaaucucuguaaugaagucaggugagguuuuaggaauguaaucuaauaauuccaauucuaauaauuucuguuacauugaaucuauagaugacucuguauauauagaauguauucuaaggggucaacauugcagcuuaaucuagauugugugguaggccucuguauuuucccgaaaccauaagcaugacuuucccagguucuucucgaugguuaguuauuaucaugacuuaagacuaaccugguauuaugaggagccuagugaggaaaaguuacuguguggacagaggaccacaacaaaguguguuugcuuuggaaagacgacuuugaugcugaaaaaugaugcugaaaagccagugacuuuggguggaucauugaaccucuuugauaauaguuuucuauguaacugaaaggguggauuucuagauuucucccuacugugauauucugugacugaaaaucaccuugacuuuuuucauauucugcuggaaaugagucauauuuuagcugauacagaagacauugccuccacacauaaacauguuccucugaguguaaauuuuuaaucguuguacuauggcuuugagauauuuuuauuuuaaagcuguaaguagugguggagauuacaguugaguugaccaacuucauauuccuuaguucuaguaaaauaaucacuuuuaauuauagcaguuugccaaacuucaaaaaguuuagcauguaguuuagaaaucacccuucagcuuuuuaaaauuugucguuuuaaaugaaauuuagauaaguguauauccugcuuugucauuuaacauauaguaaucacuuuuacauuuagcagauacaguaacauuuaacuacuuuugaauauuuagggugcuucuguaucacauucauaaaugauucuaugaugaacaucuauacaauuagcacuuucaacuuucaauuucuugugauagauuauuaaaaguaguaucaggaaaucacaauauguacccauuuacagucacuucacucaaauagccaaauuguuuuccaaaagcuucauaucauuuuauaccgugguugacauaaaagacaccuggcuucaucauaccuugggucaacauuggauauuauuuuuaaauuuuuuugacuaacauaauaguuuaaaauguuacaucauuguuuuagcuugaccuuuaucaauuaaagaaauuacauuaucucauaagacaauguagaaaagcaggaggagaacgaacuuuuaaggcacgggauguugguuuaaaccuucguccugcugcuuucuauuuguguccugaccuugggcuaguugcuaagccucuccaagucucaaauuucucguuuggagacaugggaauauuggggaaauaauucccagaaaggcaauaauaugacaucauagaauuguuuuauaaaagguucucaaauaauaguuaagucagcugcuaggaacgguaaugauggcgaucuuuuacauuguuuuuauaauucuaggggcuuauuuuuaggguucuuuuccaggaaguugaauuauuuuaaaucucuaaagcaagcaggaaagacugcuuaaagucaagaaccaaccucuuggggucuaacuguuguaauuuauuuaaacguuaugacgcugcaagauuguaguugauauugacucuaaaaaaaaucuuggcuuacugcugauaaggaagaugucacacauaccacagaauacuauuauuaccuugguucuaccauacacuaaagccacuggcauaccagaggcaucagagcuguauuuauccaguacccugauugguuuacacaagaucaucacucucaggugccagagugucugccuuggaagguagaaaaugcacugguccuuccgcaguuacuuaguaaagacaucacaggagaacagggcggcuuucuugccuucuuuugccaagugcugggaagugguugcaaguugcaaaccugcugaugaggugaugccgaggcugccaggguuucuucuggugagaguagagagaaggcuguuuuuucacuguuguuuuaugauuaacauaacuuucccccuauacuuaaaacacagaugcucuuuucauaugggauacauuuuuguuucaaauugguguuggggguugugaggaguggaucauuuaguaaaucuucuugagacagugacuaccuuuuuagcaggagcuagaucuuuuucacauauauacaaaguauuucagauaaauuaguuuuaaacacacaaaguaauuaaaacacuaagaauauagacuuaaguagaaaagaucuuuccaggaacacuaguauaauagaaacgauuaauaauuaggacaacaaaagcuuuaaaaaaccuuagaaacaggcugugcaugguggcucacgccuguaaucccaacacuuuggggggccaagacagguggauugcuugaggccaggaguucaagaccagcuugggcaacguacugagaccccaucucuaccaaaaauacaaaaaaauuagcugcacgugguugugcacacuuguagucccagcacucaugaggcugaggcagaagaaucguugaacccaggaggcagagguugcagugagcugagauugcaccaccgcacuccagccugggugacagagcaagacuccgucucaaaaaaaauaaaaagaauaaaaaucauuagaaacaguauuuauaagcaaagaacaaacugagguuauauuagcacauacucuguguagagcucugucaaaucagcaagauaaagacaacucuauaauagaagcuaaauggacauaccacccaaagagaucuacagauucagugcaaucccuaucaaaaucccagugucauuuuuuuaaagaaauagaaaaaacaaucccaaaagucauauagaaugacagaggacugcaaauagccaaaacaaucuugacaaagaacaaagcuggaggcaucacaguuccugauuuuaaaguauauuacaacacacaguaauuaaaagaguaugguacuggcacaaauauagaaacauagaccgauggaauaaaauagucuagaaauaaauccgugcauauacgguuagcuaaucuucagcaagugugccaagaauacacaauagggaaaggauagucuuuuuguagauaguacugggaaaacuggacauccacaagcaaaauaaugaaauuggacccuuaucucacacaguacacaaaaaucaacucgagauggauuaaagacuuaaauauaagaucugaaacuauaaaacaccucaaacaaaacauggggcaaaacuucaugucauuuuucuugguaugacaccaaaagcccagguaacaaaagcaaaaauagacagguuggaguacaucagauuaaaaaucugcagagcaaagcagucauuuaauagcaugaaaaggcagccuaugagauaggagaaaacauuugcaaaccauacgucugauaaggcguuauuuaccaaaauaauugaaaucaggauguugaagagauacuugcauucccauggucugucgcccccaauauuucaauguagguuauuuuuguuuccuguaaguguuggccggucugagaaauaaagagaaagaguacaaagagaggaauuuuacagcugggccuccaggggugacaucauauugguagguccgugauguccaccuaagccgcgaaaccagcaagauuuuauuagggauuugaaaaggggagaggguguaugaacagggaguacgucacaaagaucacaugccucaaagggaaaaaggcagagcaaagauuacaugcuucugaggaaacaggaccagagcaaaaucagaaacuccugauaagggucuauguucagcagugcacguauugucuugauaaauaucuuuacagaaaacaggauuugagagcagagaaccggucugaccucaaauuuaccaggguugguguuucccaauccuaguaagccugaggguacugcaggagacuaggagaccagggcguaucucucucaguccuuuuuuuuuuuuuuuugagacagagucuggcucugucacccaggcugcggugcaguggcgcgaucucggcucacugcaagcucugccucccagguucacgccauucuccugccugggacuacuaacugggacuacaggugcgcaccaccacgcuaggcaaaguuuuuacauuucuaguagagacgggguuucaccauguuaaccaggauggucucgaucuccugaccucgugaucugcccgccacagccucccaaagugcugcgaucacaggcgugagccaccgcacccggccaagcuaucuccaccgcauaggacagacacucccagagcggccguuuauagaccuacccccaggaaugcaauucuuuuccuagggucuuaauauuauauuccuugcuaggaaaagaauuuaacgauaucucuccuacucgcacguccauuuauaggcucucugcaagaagaaaaauauggcuguauucugcccgaccgcgcaggcagucagaccuuaugguugucuucccuuguucccuaaaaucacuguuauuguguucauuuucaaggugcacugauuucauauuguucaaauaaacauuuugcaaucagauuguucaguuaaugcaaucaucacaggguccugaggugacguacauccucagcuuacaaagauaacaggauuaagagauuaaaguaggacaggcguaagaaauuauaagaguauuuuuagagaagugauaaauguccaugaaaucgucacaauuuauguuuccucugccguggcuccagccggucccuccauucggggucccugacucccugcaacaauggucauugccacauuaugauagccaggaugugggaacaaccuaaauguguccauaggauaaagcaaauauggcauauaugugcacuggaguauuaugcagccuuuaaaaagaagaaaguccugccauaugcugugauacagauaaagcuggaggacacuaugcuaagugaaauaaaccagucauggggcaaauacuguaugauuccacuuauaggaggcaucuaacauagucaaagucagaaacagaguagaguggugguugccagggaaugggaacuugauguucaaugguacaagguuuguuaugcaagggcgaaaagguuuucgagauguuuguuacagcauugugccuacaguuaacaauauuauauuguucuuuuaaaauuuuguugagaagguagaucucauuaaguguucuugccacaauuaaaaaaacuaaacaaaaagaaagggaaaaauaaguggauggacagaaaagaaauauaugaaggacuaaggaauauaugaaaaauguuuaccaaauaugaguuaaaauaaugugcucucaguucuugcuuauuucuuaauguuagcaccugguacuggcgaagaauaagaaacagcacucauauguacagcuccuugguaaauuacagcagcuguagcagagagcaaacaccuuccacccgggaauucuguuuuucagaauugguccuaggaaaguaauuuauuuacuuauugacugcuuuucagaauuguuuacaaugggggaaaauuggaaacaaccuauauaccuuacaggaauuaaguucguugacauuuuaaagacauuuuugaagccauuaaaauaacaauauaaaugcuuauuuaaucccauggaaagauaagugugaaauuuuuaaguuuaauaaguuuauuaagcuuauguuaaguuuaaaaacaaauuggagagcagucugauguguaaguaauuuaaauugaaaagaaaauucuggccgggugcgguggcucacgcuuguaaucccagcacuuugggaggccaaagcagguggaucacaaggucaggagauugagaccauccuggcuaacacggugaaacccugucucuacuaaaaauacaaaaaaaauuagucaggcgugguggcgggcgccuguagucccagcuacucaggaggcugaggcaggagaaucacuugaacccgagagguggagcuugcagugagccgagaucacgccacugcacuccagccuuggcgacagaccgagguuccgucucaaaaaaaaaauucuacgaugaacauaugagguuuuguuuuuuaaaaacaaacauuguacaugaauuaaaagcauuacugcuuuuaauuuaaacucuuauuuugcuuauugcaaaauaaaaggcaaugucacuguucuuugagagcuuaucaucuuacagguggguggaaguugauuguuuuucuaauugcuuuguguuaauuuuuugauaauuacaauuuaucuucguacugaggaagaggauaguguggaaaaauugggccuuaaguugaaguuucuacaacuggaauagagaauugaacuuacuacauuaaagacugugaggaguaaaaugaagaaaauguugcaauuaaugcuguguuagggaaaguaaggagauaaauauaaagauuaauauuccauauuaggcuaaggaagauugguuggauagagaugcuugaaucuccacacaagucacuugguuuaaauuuuaaucuucuuccucauucuuuaugaucauuaacaacaacaaacaauaacagauaaauugaaggcauuuuguagcaucuaagcaccccauacagauuaugcuagauucuugucuagaaucaugacaucauuguuuucuaaaucacugauuuaaaaaaacacauuucuaugcagaccaguggaauuucuguuuguuugaauauacugugauauuacaacauacugacuuaugaaacauucuguaucauccucuuuuguuauuuaagccuuaguauagacuuuacacaucguuuauuuuucuuugugucauuaugaaaacucggcucauuuuguaggcuuucuauaaaauuauucuaacacuuaaacuuuuuaauuuuuuucuggcugcaugauuuuugaaaaaaaaaauuaggaaaauacaaaaacauauaauaaagaaaaaauagaaauccucccucuucuaccucccagagcauuggugacauucuggcauguuugcuccaauauacuuaaucguuuuuguuuaauguugagauccuacauugcauaaaauuuuaaaucauguuuuuguuuuccacugacauccuaacacaggcucugcuucauaaagacucaucuuuuuuuuuuuuuugaggaguuuugcucuuauugcccaggcuggagugcaauggcacaaucucugcugauugcaaccuccaucucccagauucaagcgguucuccugccucagcuuccugaguagcugggauuacaggccccugucaccaugcccagcuaauuuuuuguguuuuuaguagagacgggguuucaccauguuggccaggcuggucuugaacuucugaccucaggugaucccaccugccuuggccucccaaagugcugagauuacaggcauguaaucucaccaccgcgcccggcccauaaagacucauagcuaacuuuuacaacuacaaacuguuguacuuuaggcacuaaaauuuccuuauuuuuuccucuacuguccuuggugaugccuaucuuuuccucuuaaauuaagacuuuuaaaaauaacaaagaugcuuuuuuuagguacuucucacauucguucaauuucagaaaauauggaguuccuaacugguaacagaugaucaaauaaucaaagaauuuuuuggaaccaauuuuuuaucuuggcuccccccagaggcauauauaguauaaaaauaguugugaccugaaaguaauugcuuauccaguuauuuaaaugagcaaacguaaaguguguaagagagugcuuggagcaguagauuguaagcgauggccauuuguuuauggacugccaaggcagcucccuugcuuuggugcacuugugcugcacggccaccaggaggcagacuauguuugggaaagaacugaauuuaguuuauuccugcagcuucuugcucugcuguuaagagauaucauuaacaauguuuauuuucaauaugugugguuauagcuuaauguaauucaaguaaaaauguuaaugaaucugauuaaucgaugauuagaugguaauuucuucuuuuagggagucuaaagaacuucccuuuuaacaaggauaauuuaaggcugggcgugguggcucaccccuguaaucccagcacuugggaggccgagguguguggaucaccugaggucaggaguucgagacgagccuggccaacauggugaaaacucaucucuacuaaaaauacaaaaauuagccaggcaugguggcgggcaccuguaaucccaucuacggaggcugaggcaggagaaucacuugaacccgggaggcagagauugcagugagcagagacugcgccauuacacuccagccugggcaacaagagugaaacuccaucucaaaaaacaaacaaaaacaaacaaaaaaggauaauuuagaauuugcuguuacugaagaaacaacaaacacaaccaaaagaaagaaaaaccaccuccuacuauauggagugguggcaugucuguuuuuaaucauggcaaaauuugacucuguucuucuguuuguuuuuaaugcugauugguuucuugguuuuuacaagguuuugggagguagaggaaaagguucugguauauuuuuaguauguagaaucuggaaggaaaagguguucagguuuuuuaauaauaaacugggaugaaguaaaaggcaacaccuagaagcagcuggccuugauuuuaauuccuugaucauuuagcuucaguugcuguggugcaauguauguagcagguuuuucgucaguguaugaacuagguguaucuuucucacaggaacccuggacagguuauugggucugucucucuugcugacaaccucuaaaauggcaaguugggggcuugagugaagagggagggggcuugagggaagagaacuuauuuaaauuuucucuuccucccucucucuucccugcuucauacccuacucuauagaauuucuaaaagaacugcuuccugcuaguuuuaauagcacuuaauaguguuauuuaugguaacaauucugcauuuauuucugagucuuauuuucuaggaaaucuuggaaacaggcauaggacauuuuuaaaacauuguuuuguuuauaacauuuuuaaaaauguuaagagcucaggcuauucgugguuuaauggaauuagcuuaagugggcauauuguuguuguuaauucuuauaaccauaucuuuguuuuucaaguucuuuugguuuugcuaucauguuuuaacauacuuuuacaagccacucuacugaaauaaaaauuaguagauaacuggcaaaagauauucauaacugugcccuccucacacuccuagucuugaaagaccacuauaagagaccacaugauguucuauaaaugcaauuacucaugcaauaaauguagucuuuagaauaugccuaucugauggacuauucuucuggaacucugauauuacaucugauagagaaaccguauuaaucuuuuacuguugauuauuugugagguccucagcaugugggaauuaaaguugaacuuuaaccuuuugacaaucugucauuaauauauuagaauagaaauuuucuuaaauauuguaguugagaacauuuauugccugaagucuuuaaaaaaaaaacuuuuccaaaauaccagguuuaaauguaguuuacauguaaaauaucuagagaaaaaaugcucauguuaucauugugaauauaaggagugaaaaauguuaaaaucaggacacaguuuacuuucaggaaauccuaauuuuuuucuaauuaugaaagaaacauuaggcacuugaaguaguuaauuuccccuagcgaucuuucaagugguuacaggaucugugacauuauugguuguucuguaaagcuccugagaccacccacuuucuccuccccuuuaccaucucggaugaaaaccauaacaacuccacaagcaugcacagugugaugugguucagaggcagcuucuagaccugcaggagggagauuguauucagaggaagagcaucauuuuggcaacaucugaaagugaaaacggaagccagaaacacuuggccagcccugggggauuuuuuucuucuaugccucucugguggaaugacauuugcuguguaggcaucuuuccucugacuguauuucuuggccuugaagaguacugaguuuaaaaagacaguaugugacaguccauggaaauugccucuucugugaaaucucgccaccugcuccgaagacauguuguugucucccaaauucuccuuauccaccauucacauacgacugacggccaaaggauugcuucgaaaccuucgacuuccuucaggguuuaggagaagcacuguuguuuuccacacaggucugucucgcauagaucucuguuuaguguugcacgggggaugucuucauuaauuugcagauguuuaucagagguuuuuccaaggagacagauaauuggaggaaaaaagcucucucuaaugagagaugaggcuuaauuuaaaaauuguuuucuguugcuucagcacaagugcauaguacuuuuacuuuuggcagcagauuguguuguuuguguugauggaaggcagaauuguugccuugguguucccuagcucuuuucuccaucaccagccaaaugugugaaaaucagcaccuguuaaauuauauuuuaguuccaguguuugggaaauaggacacagguaaauuuagaagaauauuuccuguucgccuguguagaugagaagguucccaucguuuuucauuggauaguuucucagucagauuugacaguuaauuuuaauaugcuaaaagauuucuguauacuaaacacuucugacagaaaacauccuaaugguuauggggaaguaguaagugaaucacaaaucuaguuuuccaaucuucauaauaaaagugugugcagucucaaaauacuuccccugagguuuauguuuguaucugcuuauuauuuucggugccuaagaugaaaauaaauuuaguauauauuuuaggcacguggugaccugucugcucacuuuuagggcauuggguuggccuauguugcuacuuuuguccuagaugauuuuacagcuacaguaaauuaaaucaguuuuauucuguaaaauauguuagcugggguguuuuuauauuuguuuugggcugaauagcguuaggugucacaggaauguuugaugaggauguaaauagauuuuuguuucugcuucaugugcacgugaccccucguguuucuuauuuuccacguggcucaucucugucccuggugauuuguuuucagcugacuauuuuuaguuuucccagaggcaucucccuucucugugggagaauucucauuuuuuccagcaccucucucucguguuucauaacuccccuugaccugucauuugauuuugccagccucucccuuucagucugagcugacgguaaauggggggaggcagcgaggaggaggucagcaguggcccuccucucccagcucagggccgcugcagcccuuccaacugaacaaauuaauaggggggaaaaauaacaaagggugcccuauauuugcaauaauuugucugaucuaaaguagcuccaaauagcuuuuaauuuuaaagaguucuuuuaaaaauacuguaauccacgcuccaaguuaaaaaucaaacaguauggaagguugugcaguccuaggcaagccucucucuuacccagagucccugucugcucuccguggagacagccgcucucagcugcuugcauaguguucuugcacguuuccagucacauguaaaucuaugcaggucuuuuuuauucuuuuuuguuauacagaaauaaaagcguacuauauauucuauaccuuuuuaaaguuaauguguuuuagauuugcaugugaucacauguuuaucuaccucauuaaaaaaaauaguucuguaacauuccauuauuggguaagucaugauuuacuuaaccagugcucuaguaguagacauucuaaguugucuguaguguuguugugaagcagauagcuuuccaagacagcguaagcaaacgacacaaggcuucuauuaccaggguuuaguugauagugauguauuggacacauuuuauuuucuaaacuuacguaaaacuauuuucuguuuauuugcagucauaauuuuuugagcuagaguucacauagaggugaucuaaucugucuuauaccaggaagucugaggcccagagaagugaauucgcuugcccagaggcacacaguaagugccagagauaggacuaaaaccugggacuucuauuuagaauuuuuggcguacauauuuuccagcugcaaauuuugcuguaauuuuguuagauccaaggaauagcagggauggaggaagcguuuuguguguuggaggcuuuuuaaaaucauguaaggaauauaauucugcuuacucccaauaucagucuuugaugggcuuauccauguuaugucauuuuaacguccgagaaaucguccgucaaguggguaauucaugccgucauggugacucuuaucugaauggacugucagcaguaacuuggguugguauccuuagugaaggaagugguguugguugccucagugcagugguguugaccuggaucccaagaggccuggauuguagccuugauucugcuggugaccaagugaauagcccugugcaccuaaccucacacggcuacaaaauaagggaaccacaagagaugacuuccagguuccccuuagccuccaaaucugugaauuucuggcugaagauuugaaaacccucaguguauuacucugcuuggaaauucaucuuaucuaaaugauuugucuccuuauuuuuuuaccuccuaaauucaguuaauacucaugaauuaucuguuucuuuucaugacaccaugugucuggucaucaaaccccaccuuugguuuuuguuguuuuuuuguugcuuuguuuuagauggagucucgcucuguugccuaggcuggagugcacuggugcugucugggcccacugcaaccuccgccucccagguucaagcaauucugcugccucagccucccgaguagcugggauuacaggugcccaccaccauacccggcuaauuucuuuguauuuuuaauagagaugggguuucaccauguuggccauacuggucuggaacuccugaccucaggcaauucgccugccucagccucccaaagugcugggauuacagacaugagcuaccacgucuggccaaaccucaccuuugaaucauuacuuguccugauuuauccacaaucaauugguugaaaacucuaagacuccaucauuugaaaucuugauuuguuuuuaccaccugccauuacccuaguccaggcauuaucauguugaagcauugaaacugcucuuccuggcuggugccacuggcucacaccuauaaucccaguacuuugggaggccaagggaagagaaucacuuaaggcuaggaguuugagaccagcccuggagaguuaaugagacccugucucuauuuaaaaaaccacacacaaaaaauuaauagguaaaaaguggccaaauaugaacacuuuuguauaauaagucaaaaguagccaaauaggaacaguuuuguauaauccagccuaagauguugacugggcuuucugaagagcuuaguauuuggucugugccuccagccuuucccuugcuucuagacugucuuucacauuacagauuaauucauucguuucauaaagaaguacccguuagaugaguacuguguaccaggcauaaugguaggugcugaaaguaugacugggacuaagucccacauggacccugccuucacacagcccacuguuuaacagaaggagacagagcaccaguuaauaaugcaggguguggacuugugcccaagcagcucucagcagguggagguaccuuuaauccagguccuccaguagaagugccuuuuaaguuggguccucaggaaauggagaauuuacuaagaaacaaaguguuuccgacagagaaaacagcauguaaaaaccuugaggggcuugaggaagggcuccuucaaggaaacaaaggaguuguaguauuucugagcauagaauguggugggacgggggcuggucauuguagagauccggccagaauaagcuuucucauugaucccacgcagagggcacugggcacucugauauauuauuacugggugguauccaucacuggcaaagcguguuguuggaucgagguuaucuuuccucuuuaaacaggggagaggaggaaaagagugaauuugucaggaacugugcgugauguugcaggacauuaggcacagaugaaaaucuaagaaguccagugaugacgucacugacauggagaagggucagcaauagucuuuuuaccaaaguauuaaacucggucuauuucggaauucuaccucaacauauuaguucuauuuuuauaaugaguuaguggagggaaaagacuuugcuaagaaauauucccugccacuuagcauucaguuuuucuaugaagcuggaaauucuuguauuaauugcuaugaagagugccauuugaaccucacagguuaauuuccuucuugacuccagugaaggcaauucaguacgcuaaagacagaauucuuucugcugagcuagugacauuaaaagugauuacugcagcgcaagggaggaacauguguacguacguaucgagggauggcagagguaguaucagaacaaaauauuuccauuuacuuuugccauuuuauuuuauuuugaacuuuuagguucagggguacauguaaagguuuguuauauagguaaacucaugucacagaguuuauuguacagauucuuguacaauaaauaguuuauuguacagaugauuucaucacccaaguauuaagcccagcacccaaguuauuguuuucugcuccucucccuccuccuacccugcacccucaauuagacccccaucuguuguuucccuucuuuguguucgugaagagaaccguuuuaaagaaguguucaguaacaggcaggcagaaugugaaugcguuuguuuaauuaggaugaaauucaucaaauuauguucucgcauuugguauucacuuuugacucuuuuuagauggaauuaacagcuucacuaagaagcaacuugucucaccugaagaaaagcagcuuugagguuguucgguggcucugccgugucaggaauccucaucucugcugucuucuuagccguguccucaugauuguugccucaugaucucacaguagcugcuccaggaaggaagaaaaagaaaugaggaagggguggugccaggucgcuuaagcuuccgucucauuggccgggucuuagucacaugacucgaccuggaagggaggcugggaaauagagcgugugacuucucuagucucugucccacagacagguauaaaauguuauaagagcucuauuggaauaucugccacagagaaggcagaacagguauuucucaagcggauguuggccgauuauaaaugaggggaguguauuauuuaacaaguuggaucuugcaacaggccuugcuauuuuuucucuauucuaugcguuuuggaggggcauugauuaccuguguguaaugguuccauuaaacuuucaaguuauuuugucguuuggacguaagucuuaacauuugauuuuugaucucuugaaugaauuuucaguuauaaaauacauugggaagaauguguucaacuuuaaauguggcuuuuguaugcuuaauauguuauuagcgcauuuauggauguguuauggauuaggagggcauuuauucauguacuguuaaggugacaguaaguaaacuucaauuucucuuguguuuuucguacuacaaaauguagacgucaaugaagccauauuagaaagcuuccauuaaaaaaaaacacauauauuagcauuugcgugugaaaagguaaaauucagggauuuguagaauguagaagaaaucaaaaggaccaaggugaagaagaacgagagauguagucuuucacugccccuuaguuaucuuacugugaauccagauucuuccuuucagccuccuugaaagcagucaugaaagauuuugcuggccucuugccacauagacaagcauuugcuaagaacuggugugaugaauggcaugaugcugaaaacguuuugucguggauugauuccaagcuucgguagcuguggcgguuuuagagcuguagcuuugccgugacaugaauaucugcccuuuuguaguuacagcuuucaauugaagaagacaauaaaguguugaauggcaaguuuugcucacaauagguaagauuuugauaaguuuuuaaaagugagauguugaaagggacaguauguccuaauuugacaaguuucagauaacuagaguuuuacuacacuaaauuauguuuuaauguaguaucuacuuuuacacaaaaauggaaaguaaguaauaaauuacgguuuagaguugcauucagaaugggaaggauagcaguguuuuucaucaagagacacuggaggaauauggcaagcuguauauaaguaaauacuuguuuuguuagaacaauuuauucugguuaauuaauagauaauuacccuauaaauuaauguaaugaugcuuuuuaugagcuuuaaagccucuuucagagcuaagaauaauauuuuauuaauaguauaugcauauuauuuucuuagaaacacaacaggugugauuuuagagguaucuaauauugaauaucauauuucuguauuuaucuuaggcaauacuuugggucauuuuaguacacgaggguccuuuuuauaaacaucagcaauuauguggcucuguggaaaauuaagaguaauagagcuuucuuuuggggugagagauuugccuuuuuucucccuggugaccugaguccuaggcacguuucuuccaaauugcuugucgacaguuuaguauuuugagaaugauguucucuuuuuauuuauuguuuguauuguaaauauuucuaauguuuaauguuuuaauuggcuauuuuaauuuucauuucuguuauaagauagucuguguuuuucuuuuccuuugggaagauacccagcagugggauugcugggugaaugguaguucuauuuuuaguucuuugaggaaucuccauacuguuuuccauagagauuguacuaauucacagucccaccaacaguguauaagcauugccuucucuccacaucuuugccaacaucugugguuuuuugacuuuuugguaauagccguucuggcugauaggaaaugguaucucaucgugguuuucauuugcauuucucugaugauuagugauguugagcauuuuuucguauguucuacuuuuuccauauguuggcugcuucugugucuucuuuugagaaacaucuguucauguccuuugcccauuuuuuauugggguuguauuuuuucuugcuaguugcuagcguuccuuguaaauucugaauauuagaucuuugucaaaugcauaguuugcaaauauuuucucccauucuauagguugucuguuuccucuguugacuguuucuuuuacugugcagaaccuuuuuaguuuaagucccauuugucuauuuuuguuuuugcugcauuugcuuuugagaucuuagucaugaauuccuugcgucggccaauguugugaagaguuuuuucuaguucccuccccccacccaggaauuuuuauuuuuucaggucuuacguuuaagucuuaaaucugucuuaauuuuugcauaugauaagagauaggucuccaguuucucuguuccaauuuucccagcaccauuuauugaauaggguguccuuuccccauuguauguauuuuugcugacuuugucaaagaucaauuagcuguaagcauguggcuuuauuucuggguucucuguucucuuccacugaucuaugugucuauuuuuagaccagugccaugcuuuuuugguugcuauaggagagaggcaaugccuucuuaaaaguacuucugaauguggugaauuuauauuaacucuucuuugaguuaggaguccauuuuagguacauaagaguaugagaaauuugguuuuuuccugccagcuauauggaaaauaguuuagggcaaguuuggacuguugcuucaggaaaaauuuuauaagcguaauuaacccaaacaggaauuuuuuauaugaauaugcuuucuauucucgaauaugcuuucuauucucuaaucugcuuuuaaugugaagaaaagaaguagaacccuuuuugauauaauaugagcuauugcaacgaauucuaccaauauaguaaugaaaaguuuaaauggugaggcauccuaaauccuccucccucccccuacaaauaauugggcuuggcuugggguuuuuuguuuguuuguuuguuuguuuuugagaacggagucuugcucugucacccaggcuggagugcaguggcgugaucucggcucacuggaacuuccaccucccggauucaagugauucuccugccucagccucccgaguagcugggaguacaggcaggugccaccacacccagcuaacuuuuuguauuuuuagucgagaugggguuucacuguguuagccagaauggucucaaucacgugacuuugugaucugcccgccuuggccucccaaaauguugggauuacaggugugagccaccgcacccggccuggcuuggguaauucuaaaugucuaaacacugugcuuugcugagcuuaaaauuuuccauuuucaguaaaugccaugucuaccuagaaauagaaaaauauuauauguaaauagaaaaauauaugucuccuaaauuauuacuguuaacucuuuuagaguaaacagcuaaugaacacuagaaaacuuuauacaaacauaaacuaauaauugacaugaaugguaacuuuaaaaaacuguauguaagauugcauaggcaggauaagcaccugccaccagaugcuggggaaacugacugaaagaacuucugugucagugucccugugagggcuuuuagauguguacgauuagauuaaggcagaaaaaagggaauuuucugucuguccaugccgcuagcagagagagaccucucacuagcuucugaguucauaaccuauguuuugucaacccacaaacaucgguuuuuaaugcaauauguuguagaaaggacuuaccauccagucagugacugucaccuuuuuacagauagguugagauuuggaguugaagagcugagcacuagggaaacaugagucagcagagaucuuuggugucuuugugccucucugagcaauaccacccucuuaugugauacuucuccuguccccgcaaagcaccagggcaggugcacacccaccacagcagugcccucaugguagauuuuaauaaauauauuucaugagugagugaguaggucagugaguauacacaaaaguggacaacguucguuuccaaauucuguguuuaguuuguguuucacggaacccaaggcaaacucccucaguaggucuggucucuaacuugauuuuaauaauuggaaaagccagcagauugaggaaauguguggcuucuucagccuagaaugaauguguccucagcugcuaguaugugguuacgguuaguccaugucuuaaugguuagguuuuucucucaaaauuguuuuuggucuugggauuuggaggucuauuugccuaagugauuugagccugagaaaugggcaucuuccucauuaaccaacuacuuucuuuaagaagaugauacaugacuucauugcacuaguuuuaaaucuuauuaaauugagguuucugaauagaaagaacaaagauagccaacagggucauccagcugcuuuccaaaugagcaaaugucuuugguucuggccuucguuuuccugauggaggcugccauuucauuagaaugagucccaguaaggcuggaucacagcugauggugguaauuaucuuguugagauaaaucugaaucgauauagaaguugacguuuaauuuuaagguuucugauuaaauuggcccuuuaaaaucagaacauguucuguuaauagguacaguaaacaaaauaauuuauacuucuguauaaaaccuuuguuaucaaaacaguaacaugcuaauaagcaaggguaagggcaaaguuuggcugauaauaugcuaauuucacguuaguaaugaauccugcaggauuuaagggaaccccuggcuuuucaguacugugaaguacguauugaugagccuugggguuuugagcgucauuggagauuuuugcaucaucucugaucuucagcugagccaggagugcugagagugggaagcauguggaaacugggucaucggcugccaugcggucacacuucauccuuagggagcacaguauauggagcggaagauggugacugcacagcacgaguuuccagcgccacggagagggcagucuguuggcucauuugcucucauuuuaaaauuugaagacacguacucuuagacgaauacaucaauguguucuuuccuccuuaaucauaaagcuauccugaguaaucacuuacaaacccugcguaauguuuagauuccuguguaguuuccccaaggaaaaauucugcauagacuauuuccuucauagcuaaguauuauauaaaaaauguauguccucgaauuucacuuuaacugucuguuaaaagugauuuuauuuacuucuuauauuuaacuuuugaauagguaauauauuuaccccaugguuaaaaaguauaaaaaaugcuucaggauacuuuuuagcugucugauuccuauuaccuucccuucaaaaguaaacauuguuaguacaauuacauguauucugugauauuuuuguuacggauuuauaagcaaaaagcaagaaucuugaagaauauuuucuccaaaauauuaauauaaaagacucaccucucagauuuuguaaauaauuauaaaccaacaguuuuaaagcucugaaauuguguuaaaaauagcguugauuagcauagaaauucuagaaagagaggcaaauguuacucaggacucaggaaaugauaaaggaguuaucaauaaaugaauuuuuaaguaaguuucgguaggacauauacaaaugauaucaggagaaugaacugugucuauauuuguuacaguaaauucuagauagugaaagaauuugaacauuuuuguuuauaaaguuauauaacacauagauguuuauauguagguuuguuaaaaugaguuaucagauaaugggcuuauauguauuauagcaagauauuauuacauuuguugcauaaauauuuauuuuuauguaugucauauauuacaucaccaccuaauccgcuuuccaaaaugugugggaacagaagaggcuuagcaucagaggccuggguucugacuuugaaucuggauucccauagaaguugucuacauccagggaagacauucacaccugugagccuucucuucccuaucugggguuauugggaggaugaaaagaaagggaaagugagagcacacugugaugagcgaaacacuguggaauuguuauguguuaugugacaauuucuaaaaacauuuaggaaaugacaugaaagaaugcuaaucucauggucaaauauuuagauuauuuuucauuaguauguaacuaauaauuuguucuuccuucagggcuguaauauuacgauauuaacuuggcuauuuucuacaucuaugcaagugacaauuauucauaagcuacuacuaauaauugcuaauaauaaagaguaauggauaaauacuuccucucaucaaguauuacagagacacagugggacaauggauauuuuagugauuuuagaacugagaauuaucaaguauuaauacaaauaugacuuauuuaaccauguaaugcagccauagaaaauaagagccuuuuuuucccuguuuuuaacuuaguuuauucaauauauuuagccauuuguucuuagaaagugaguacugauguuucuuuaagcaaucacuguaguagcuugccuuuuccugaaaaauuagagacaguaauuacuaaauuucuuuaaaaguuguuucagauuugcuaccacagaacguggaugcuguaaugaaagacuguuagaauaaggaaacuuuuuuuuuuuuuuaguuucuugugucuuuuuuccagauuuacauuuguuuggauuacuuggcuuguuuauuucaagaaccuaagcaauugauguccuguuuuuccaauucuguuugauauucaaaaugacacauuuggaaugguuccaagacugaacaguuuuuuauuuaaaacagaguaauacccagggcaccauugcacaggaagggaauaaucacuuagcguggcauuuuggguggauuuggaguguuagcaugugcuuuaaaaaaaaacuguguaagccguuauuacuacuugggaaaaaagaccaacaaagcuuguguucgauagaaaauggaauaguauagucaacaguauaguacuccuaacagugaacuuaaagaggcaaaaucugaguauauuuucgauguauguuaugauuuauuagagauuaggaaaugacucaucugcgguauaaaucuguguaauggcuaggccaucaucagggaaaagguaaaagauuuguagaaaauguaugggaggagagaaaggcauuuaauuuaaaguccagugauuuguguguuccuuucagcauaugagaucagaaaagucaggcuucucuucagucaagguuucucuaccaauuuaacuggaaaaugagaaacgaggagaacaacauuuugcacccaguuuuuguguuucuggguugccaaauccauuugugucauguuccuaauucucuguuccccauaaaucuuuuaaagucauaaaugaagccacggucccuguucaugaauuccaaccgucuagaucuccgauucauuccaguucucauccauaugcauuccuuacagcaacauaacuuaaauggauuucuguggcuuaucugguuguuuuugaauccuugugguggugauuuuaaaaauuaaccucaccuaucuuuguaccuauguuaauucguuuugcaguugaaaagagcaggcaaaagaauccucgaagcuuauguauccagccacagacagcucccgaugcgcugcccccugagaaaacacuugaauugacgcaauauaaaacaaaaugugaaaaccaaaguggauuuauccugcagcucaagcagcuucuugccugugguaauaccaaguuugaggcauugacaguugugauucagcaccugcugucugagguaaggaggugcauccuagaaagagccuuucuacuugaggucgggggagcacggggaggacuugcucacacgcuggccuugggaauaucuagguaaaugaugggaaagaucaggugucauucaucccauuacauuuuugucacuucaccagauacuugagucggucucuagcaauuugggauggaaacauuuucucacuuccuuuuuuuccccuagagucuguugguuagaauggcaacagcaaaaaacauaauugccucuuacgccgguguaugccucuagaccuaaacuagcauuagcauuuuuuucacuuaauuuguguguuugucuguguguagcuuuucauaucacacuuaguuuaaugcuuugaaaaaugacguuaguuauauuuauggauuaaagagcacuuuugaguuaacucccugaaucauaucuggggauucuuucugaaaguucuguuuauuccuaaaacaaucucuguggugcaacaaaagcaaagcagauuugccguguuguuacuuuucccuaauauucuucagggauguuauuucaggaacuggcuaaaauucauugagaaaaccaaguuuauaucaacauguuacugacauagcaauaaaagcuguaauuaucucagggggcaacugauaagaauacaacuugagcucuucagacauuuuuuaaaucacaguuuuaaagauggcuauacaugauaaugcaaaggggaaaaaaaaagacuggcucaguacuguggcucaugccuggaaucccagcauuuugggaagacgaggagggaggaucgcuuguggucaggaguucaagaccagccugagcaacauagggaaaaaauaaaaauuaaaagcaaaaagaaaacuguucaguuugguuguucuguaguuuuguucagaucaacaaaccuguccugguuucauacagaggccccuguaauauggcugccuuuuuagggaguggggagagagagaaguggaugagacuuggucugugccuuggagaaacuaccagacuaguagacaguuucaaugaauucucuuuuuuuuugagacagacucucacucugucgcccaggcuggagugcaguggcgccaucucagcucacuacaagcucuaucucccggguucaugccauucuccugccucagccucccgaguagcugggacugcaggcacccgccaccacgcccggcuaguuuuuuguauuuuuaguagagacgggguuucacuguguuaggcaggauggucucgaucuccugacccugugaucugucugccucggccucccaaaguccugggauuacaggcaugcgccacugcgcccagccuuaaugauuucuugaugaguauuuuacagcuuucuccagauuuuuuuguuuuuguuuuuguuuuuguuuuuuuugaggggaaguuggagacuacuuaggguuuuaguaacgguaauaguauaugguauuuuuguuucucuuucauuuguaagaaaggaaucaagaguguguuuauauaaccaaguaagcuaacuagaaacuguauacuaucaaauguggggaacaauuaguuuuuauguuuagaaauaaaccaauuauuuuauuuuauuauaucuagccuaauagcccccauccucaacuguuuucucuccuuucauccuccucaugacgucagucaaguccugugaacucucauuucacagugcuuuuccccuuccuaugucuuugcuguccccauucaugccauccuugcucagacccuggauagcuuccacuagaucaugauagcaacuuuuuuuuuuuuuuuuuuuuuugggauggagucuugcucugucacucagacugguaugcaauggcgugaucugggcucacugcaaccuccaccucccggguucaagugauucuccuuccucagccucccgaauagcugggauuacaggcacccgccaccaugcccgacuaguuuuuguaauuuucuaguagagacaggguuucaccaugugggccaggcuggucuugaacuccugaccucaggugauccgcucaccucggccucccaaagugcugcaauuacaggcgugagccacugcgcccaaccugugauagcaccuuuuuaaccaaucauuaggcuuguacuguuucucaccuauaauccaucccaagcacugcugacagcguccucuuaccaaagcaucccacgcugcugauuaaaucuuccagugguucucccuuaucuacagcugauguguccagugugguagccacuagccauaugagacugagcauucgaaauguaaauccguugaauugagaugugugguaaguguacaauacacuuggauuccaaaaacuuagaaugaaaacaaaggauguaaaauaucucauuaacaacuuuuauauugaauauauugaaauauuauuuuauauauauauuuggguuaaauaaaauacguuauuaaaauuagcuucaucuuuuucaacuuuucucagcguggcuacuaggaaauuuauaauuacguaacucauguuauuuuguuuuggggagucugguuuucaacugguacuauaaggcucuuuaucauuuggcaacaacugccccuuuuaauguuauuaucaugcccagaugcuguagccguacauaaagagauggaggagaagcaagagggauuuauugaauacuagguuugagcaaaaguaauugcgguuuugccaucaugccaaaagcuacaguuacuuuugcaccagccuaauauuuacuaagugccagauauucuuacuuaccuuauuuaaauccucaccaaagacacgaguuggaauuuacaaauaugaaaauugaggcauagaguuagguaauuugccugcuaucagacagcuagcaagaggagaaccaggacguaaaccuaggucuaggaagcuaucaacuaaaaauguccuguaaacuuccuguacgucauccauuguucacguaucauuacuggguugcuguccuugcccacaauaccuacauguucaggucgguuuuacagcagcaucacaucaccacuugcauuuaauuuacauagauucaguacacaaacaacugaaggaagaaaaaugcaggccgggcgcuguggcucacaccuguaaucccagcacuuggggaggccaaggcggguggaucaccugaggucagaaguucgagaccagccugaccaauaugguaaaaccccaucuccccuaaaacuacaaaaauuagccaugugugguggcaugugccuguagucccagcuacucgggaggcuaagguagaagaaucacuuuacuuugagagguggagguggcagugagccaagaucgcaccacuacacuccauccugggcaacagagcgagauuccaacuuaaaaaaaaaagaaaaaaagcaaauuaaaugaagaacacaaguccaccuuguauuccccccagugaacgaaggcccgggagucaauuugagaugaaggucaggaguccacccuuccuucaugugucugcucaguccccgaacaccucuuguggcgugagcauucuauacucucugcuaucuuaguguuuaaagauacuuuucccucaugcaaccuggccucuaaacacaagccgaggccuuuaucaggugcucaguuauagagagaguugauccaacgcuagaggaaaaaaauucacuggguuggaucuacagagagaugcauuguccacaaacauggcaagcuccuagugaauuucccagacaauuguacugugugugaauuucaccuuauacuuaaauuuagguccugacagccaaggaauugugacugcacugaauacagcuccagaacccgcuuuuuuuuuuuuuuuuuuuuuuuuuuuuuuuugcgacaguggccuugcucugucacccagucuggagugcaguggcgcaaucucagcucacugcaaccuccgccaccuggguucaaccaguucuccugacucagccuccugaguagcugggauuacggaugcccaccaccauacccagauaauuuuuguauuuuuaguagagaugagguuucaccauguuggccaggcuggucuuaaaguccucaccucaagugauccaccugccucggccuuccaaagugcugggauuacaggcaugauccaccacucccaguccagaacccacucaggaaugauuuccuggccuucuagaucuacguucuguucccgucuggauuccaggagcauauaugcuucucuuucauugucuguguuauauuagagauaccgguuuaaugcuuguuuuugcuuuuuaagacaggaaauuuacugaaggcaggaucugcaucuaguucuuucuuaugaaaccaccccagcagcuuuaauagucaacacaguauauaugugagugaacauaugaacggagaggauggaauuccagauguaggaugagcauaaagucuuauguaaauguucuuugcucucuuuauuuuauaaucagcaaauauuuacugauuguguaauguauacugagcacuauuauaaaacaguuggaggcuaggcaugguggcucacaccuguaaucccagcacuuugggaggcugaggcggguggaucgcuugagguccagaguuugagaccagucuggccaacauggcgaaacccugucucuaccaaaaaauacaaaaauuagccaggcaugguggcaugugccuguagucccagcuacucaagagacugaggcauacgaaucgcuugaacccaauagguggagguugcagugagccaagaucgcaccaccgcacuccagccugggugacagugagacccugucucaaaaaauaaauaaauaaauaaauaaauaaauaaaauaaaaauaguuggagaaaaaaaaucauggguaaaguuaaacaauuuuaaaaacucccuuaaccuuuuaguucccauucccauuacagaaguauauauacuguguuuauacacacacacacacacacacacgcgcgcgcacacaugcauauguauauaaaauagauacagauacacauuguauacauauacauuauguauguuuuuuauauacaugauauaccuauacauuguaugucuauguauuuuuauauauguauaauauauagguauuuguguguguguguguauauauauuuuuuguuauugcuaaccuuuucuaaauggcuuuagagccuucgauuaugggugaaaaugguuaagagaaucuugcaacuaccaugcuuuuguugcaagucuacuuaguaacuauaaguuucccacuguaguggcagacauauuucauuacauaucagacauucuuauaucucaugaaucugagaacuaaugucacacucuguuucgcagaagacacacuaaaguuauuuuaguuuuuuucuaauucuugguuuauccuugcuuaguuagacgguauucugcacagacagccaaagugaacaacaguauugaugguaguaauuaagcuucuuccuaaaagggucuauuggguggcuuucuagguaaacuugaacagggcugaggucacccuccccaaaccucuaauucuucaaaaugccuccacaucuuuuuuuuuuuuuuuugcaaguggaauuuaaccuaaaguagcaccugaacaaaggugaauuuugaauggcacuagcaguaaaguugacuuggaacaaaaaaacauagaugcauugagcaaauucacugugugggugauggggaggaggucagaugcagcacacgucugagccaucugauguggcuauucucugcaagaugcucuaugcuguugaugcuacucaguggcuagcaaaaaugcaggcacaccgaugggaccacagccagagacuaagugccugugucccagggacuccuaauucaauuauggugaauccauuuuuuuuuucuugagcauuucauauauuuaaugccugagcauaaaggcaucuuuauauccagauuuccaccuuucucuuuuuucacauuguguguaauucugcauguuacaauacaaagagaauugaaucaaccuguuaucuagacgguuaagaguuuaucaucuaagagagaaacacugaucuaggagcagcugaguaaaaagaaacaguaaaucaguaucuaaaggacauaaugcauuuuaucaucuacaaguaaaggguaaguacauguaaaggccaagcuaccagggagagucaggcagaaacuaacccuuaguaugugucuuuuacaguaugggcacuggggucagcauuucaucuauggaugguauuuaaagcccuugguuuuuuucauuacugcuucccauccgaugaggucaucugccuugauagaugaccaaaagaauugagccuggauguucuaguucuagguaggccccaugcuucuugaaggcagggaccaugucuuaaauuucuuuuauauuuucacagcaucugcuaugaaaaaugcuuaguuaauuaguuugaaguaauaaguuaccaaccaauuuagaaggguaaauggucuaugcauuuggaggaggggaauggugucacauuacaagggaagaaccaacugacuuuugcacaacccauuuagacaaagagugaaagaugaccucaagguuuuccuguuacuguuacugugccugacagagguuggaagaugucaguaguuucugaggcauuaaggacaggaacguggagugcaguggaguugaaguuuggggaaaugucgacaugcuuggugaaacucccuuucccaaaaccucccuuaauaagcaaaaauaucaccugguguauuuuugcaguagaacauaaugauuucacacaauuuuucuuugcaguuauacuaacuguaauuuuuaauuucuuucauccucccauuaguuuccauaaauuugaaaaaugauugaauuuucuugccaucucuuccuucuguuaguaacuugguuacuacugaaaagugaauuuuaagcaaguucaccaaaugaguuucaggauuguuugugggcauuuaguaaagcugucuuguuuuuccuguuacuugagugguaaagcuuccugguguuuacuugaaguagauuacuaaacaaaauucaggcuuaaauuugauauuacgagaaguauuuaugauacauauuuuuauguuuuucuuccauuauuaugcgggcugauuuuccucaggcuuuaauuucuacauuagaaaaccaauuacuuauuauuuuaagaaacucugacucacuggugauuucagaacaacuuaaugccauauuuuuaaaaaccaagcauuuagaauaccauugaagccagaaagguacucagugaaaagugggucuuaaaucccagucccugcugaccacguuucagugcuggcguuuagacuugacuuccguagcucuuacugagaggugagaacaaaguaaaaguuaaaaauauaugggaucuccaacucucagaucagcacuucagacuuauuuugaaacaccucucauuucauaaugucauuuaaauuuguaaacgacagcaugccccuuuccuugcucuucaccuaguucauaaccucauuuaguauaugggcuucgaagaacaaguuucccuuuucuauuaguaagugugaucaaauaaugaccacaauuagagaggggaagaaaaaggcucacaagucuaaaaauaacuccauuauccaugcagagggggucaguuuuuucuuuccuccguugcagcugauauuuaacuaaauggcaaucgaucagucuaaugccugccucucguuuuucauaaaugaaaggcuguggcuuuaaguaaucacaggcugccugugccaaaggcagaagcugcaguaucagcuucugugagugaggaauccgaggcacacgguaaccugcaggacaugaaguaagacgcccgagggccaauggcgcgccuccugcuagagcuuugaauguagacagacccgacugguggguggcgcggccaccuguaugcuucuugcacagugcgagggguggggggacuuggagacagaagcuggaaaaugggcugccccagcagcaaacugugccucuauucuccaugugcagcaacaaggguaauuaguauuuguuuauagugcuuuucuggaagaaugucaggacuacugcagaggcugucuggaauucagggaaaaugcuuugaaugacaagcaacucuugccugcaaaggccgggucucaugaucucugcaacgcugugaucaggauguggugggagcuccgucuugggugauccucgugagggcauuuuucagcgagcuuugaaauucuucauuuuuuuuuuaguuacucccuggugcuagggaaucuaccuuuuaaggaacuguauguaauuacuguauuuguguaaguauguguguaugugugauugccgggaguugcugguaacuugaacauuauucuucagcucaagguugauacuugcuucucugauacuaaaaacagccauccgguuuucuuugguuuguuucucuaacaucgauuuagaauuaucacugauccaaaauaucauaauccuuagaaaaugguauguagcugaaaaaaauuaauuuaauuuugucuuuaaaggauuaucuuucugcuauagcuuucuaacaaacuuuuugucuuucuuuuagaaggauuggcauuguaacgaaacuuuuuuaugugcaaauauaggacaaagugcauauaugugcuuauguuuagaacauuaaauauuuaucuuaaacugauuagauguuuauugcccuuggaggaggagaacgcauuacaucuuaaguacaguaugcauuagccgaaagguucuauggaucagcagugaagcacuggcucaaaguaaauauuucuaaaugggccauucacugcgucaaaccaaaguuucacugggaccugcaaaaauacagauuuuugaauuacgaauuuccuuaacagcuaagggacaacuguguuucuuuuaacaacacaaauuguuagccuaaaugauucauaucuuggcuucccaauacugggucucauuuuccuagugauaacaaauguguaccuuacugaaagggacccucuugaaagcaugaguaacuugauguguguuuuccgcagcgggaggaagcacugaaacaacacaaaacccuaucucaagaacuuguuaaccuccggggagagcuagguaagagcuuuuuguuguuguuguuaaauuuuaugggacaaggggaacacuggaaaaugugguuguccugucugcguuguggcuggaguugcaugcugggagcuguuggcacucccugucuaguaucugggcaaacacuuacuaucgacauuucuuuugaaucuuggcagcuugaccuucaguucacagaauuccuggcacugaucugacuaagccuagcagaacuucugaugagcaaaauauuucucuugcugaagagagggacagaguuauuuuuguaauugugugaauuccuguuaaauaauguugucauuuuuuuuucugaagcacuuuucauaugagaauagugaaaguuuccccucuugauaaacaguaaauccguuguacuuccaaggguugguuugugaguagugaguaugaaguugaaaggaugcuguccaugaaggcaacuuggcugaaaaaggcacguucuaugcuaaucuuacuauuuggaggggggcugaugguucaccaccuccccgcuccacagggagccccacgucucaacaccuaccacccagcccugcaguuuacaugucucaacacccaccacccagcccugcaguuuccaggucucaacacccaccacccagcccuccaguuuccaggcuacgcuguuauuuuaguuccauucucuccuggaagcccuuaggguucauggaacagacacgacacugccuuugcuuuguuuugcuuuucucuuuucuguuucuuuuucuuuuuuuuuugagacggaaucuugcucugucaccagacuggagugcaguggugcgaucucgacucacugcaaccuccgccucccggguucaagcaauucuccugccucagccuuccgaguagcugggacaacaggagcacaccaccacacccagcuaauuuuuguauuuuuaguagagaugggguuucgccauguuggccaggagggucuccaucucuugaccuuggccucccaaaguacugggauuauaggugugagccaccgcacccagccgacacucccuuuucuacgucaacucguaucuuggagugaucugaccgcuuugggguucuucucucugcccugggcuccucaaccuagagaaucaacuuccugcuucagcuucagccagaucuggagcugaccauucuagggcuuauuuccuugcccuuugcaguuuucuguguguguuacagucuccaccaaaauaugcccagguauguuguaugaauaaugcaagguaacauccagagaagcaaauuguguucacccaacucuaggagaaacugcccuuuuuucuuuuggacaagaccacacugccaaccugauuugcuggauuugaacacucuuaauucucccaccuucaccacagcagaaaucaaacggcagugaacguggggucaagacuuugucugggcugggugugguagcucacaccuguaaucccagcgcuuugggaggcugaggugggaggaucacuugaggccagcaguuugagaccagcuugagcaauauagcaagacccugacucuacaaaaaauaauuuaaaaaucagccaagcaugguggugugugccuguugucccagcuacucuggagugugaggugggaagauugcuugagcccaggaguucgagacugcagugagcugucauugugcugcugcccuccagucuggccaacagagcaagacucuguaaaagacuucucugcauucaucuucccuuuuccccuuccagugggaggugaggccaaaucccugacuaaccguccagauucuuaauaccuagccaagacaucaguccucacuuuauuuuaggcuguggaaaugaaggccucuuuauggaaaaguaauuuuaagacagauggaaacuucagaaucccaaagacuugagaguucuggugaaacaguucaaggaaaucccagcugagagacagcccagcucucagacuuugcaggcuuucugccauguuacuuaacuugacagcagcccuuaugauuaccuaaaugaccaacccaacuugcuuuuguccaugccuuaaauaacauaauuaacagaguuagaagaucaggaaagaggccuuuuuguguguguuucagaguucauuauaacccaguggaaguggaggugagccuaccuagagguucacauuucagccucucuccgaagacaaggcagcaaugagaauggaacacugugcccauucgcucugcuucaaugaaggaugcucuuuuuacauuuuaguggacagcacaauuaagcaaccgcaguuggggcccagggauucagcaccuccagugagucagguagccugacaggaaauagcuguaacagucugugcccacugucaccuuccuauccuugauaaggaagcuguccuggugcacugcuucuccugccucccgaguguugguacaguggguggccuauccagauccccagucacccagugcuggcuucuuagggaaugugucauugcugcuguugcagcaggcauacaucugaugguaaccguucuccguuuggagaaggguuuugguucuguaaguggagggaagcgaaaccuguaaacacuugugaugaagcgguccaggaagaacacucucaaggcugccagugggauuguuaguuucagcaugaaacuaacuuugacauugacauagcaaaguugggaacccaguuuuaaauuuugaggcaguaaagugguuaggcugauguugucacacuguccggggccacauuugugguaacugagugacuuaggacaagucacuuuguaucucuucugucccaauuucauccucgguaaaaauggcgaugcuaauugucugccccaagggugggugugaggauuacaugagguaaugcauuguaaagcaucuagcaccaaguguuaacugcuauuaaauaauagguauuaggauguaugcagcuugacagcuguguaguaauuaaccacacuggcuguuuugugagggcaucaucuaugcuacagaaaggaauaaucauuagacuaaauauuccuagaaaucccaaacgacaggcucuucaaacucaaguggaaaugagaccucaucagaguauucuccugauccaguagagugugguguguggagucaaagccuagguuuuuguccauccacuccuaguuggauguuaccuaacuucuuugaguaugguuuuuucgcuggugauaugaaaucaguauguauuuugcugcguuauuguggagcuugaauaaaauaguaaugcauauaaagcagugguguagugccuggcccaucacagcaacucaagaaaagagagcugccacuaucgccgucaucaaagcacccacuucuucccuccaaaauaauggggguggggcgaugggaguuggugucacucucccauuggguaauuuuucuucaccuucucaaugaaaguugagacaagguacccaaacuacuaagaacugcaaagaaaaaggacaguucauaaacucaggagcacugaaacccagguagagucugugcuuuccaccuuccgcaucuaacagccuccagcugucccagcauccacugacuuucccguuguucccucagucucacuguggcaguguccaaagcagccuguguguuuccacugucugagccacacucccuucauggaagcacugguucuuugcuucugcagaaacucuuaaaagugucccuuugguccagugauuuuuugauacucuacguugaugucuuuacugucucguguuuucuuguuaccuucagguauaaaguccauaauuguagggauucuuuucuguuuccuauggaaaaauaauauaauaugcuuucuguuuucuuggguacucgauaaauauuuuuggguauuuuaaguuuuaaaguuuuuuuuuuuuuuagaacaauguaugaaaauuaagauuuuuaagugaaaagaaaacagccggcagcuccacugcccugacauaacuuuauuugcauauucccuuuucuuaguuuauaugaauauauacaacuucauacuacgauuuuuuaaauuaagguguaauuuucauacagcggaaugcuaauuauuccaucaguuugacagacauauacuccuaaaaccuacauccuuaucaagcauagacuauuucugucaauccaguaaauucccucaugccauuucacaguggaacaccccucccccuagaagcaaacacugauuuaaccuuuauuaucaaagguuuugucugaacuagauucucauuuaaauggaaagauauaguaugcuguuuuuugucucuggcuuguuucauaauacuuuugagauuuguguauguuaagugucugcuccaaucuuuuuuuuuuaaagacagggucuugcucuguugccaggcuggagugcacuggcacuaucucggcucacugugaccucugccuuccggguucaagcaguucuccugccucagccucccgaauagcugggauuauaggugcauaccaccaugcugggcuaauuuuuguauuuuuaguagagacagggauucaccauauuggucaggcuggucucuaacacuugccucaagugauccgcccgucucggccucccaaagugcugggauuacagaugugagccauggcaccuggucagaugucugcugugaucuuuuucacuggauaggucaagcacuuuuccacauugccucauaguguucauuaugaucaccuuuaaugggcugggggaaagucugucaaguggcugucccauacguucacuuaccccuuaaauagugucauaguauauagcaaggguuucauugccagcuguuuucucauccauucccaugguuuccgcuacuaccuauacaacagugacacagauuuauuuuucuaguucucuccuucccaagcugcagaugcuucccagugaggggcugcccccaggugagccaguccaguauaaucagaccuuccugaugguccagccccuuccuuccugagcgccaugcagcgucuccucauucaccccuguuccucagcuuuggcagggucgauaugauucacuuaccacccaagcuaacaacugaaaucauacuccuguucccccauccuccacgugcaugucagucuguguccuaaaugccacuuggauccaucccugcucagcauucuggcugcugcuguuuuaagucccacaauuucucaccuggaagauacugcaacagcuacccaaugggucaccuugccuccaggccugcgcccccaacuccacuugcggccaggaucuguacuuagagucaggcugacaugugucucuacuggacauuuuguuuuuuuuguuuuuuagaaggaguuuucuacccugucacccaugcuggagugcaguggcaugaucuugggucacugcaaccuccaccuccuggauucaugugacuguccugccucagcgucccgaguagcugggaauacaggugcgcaccaccacggccggcuaauuuuuguauuuuaguagagacgagguuucaccauguuggccaggcuggucucgaacuccugaccucaggugauccaccugcugcggccucccaaaguguugggauuauaggcuugagccaccacuccuggccuguacuggacauuuuuaacaaacacaaaagacucuauuuuggccuugggggaaaaaauccagacauacuaagcacaccauuuaugauuugacugauugaaaucuuccaguccaaauucacgucuaggcacucuuuccccuuuguucagaccuccuuuccccucccaggccccggccauggguucauuugcaccucuuguccacaucuuuugcacgguauccucucugccuggagugcacucuccucuuuccacuccccucccgucgcggaccccucaugcuccuucucuuuuacucaguuuuuaagucuuagcuaaaauaucuucaauugaauuucacccaaaucuuucaaguaaguuaacugugccuucuagugugcuuuucaaagcacccuguacacauuuaagauuuuguucuuacagagauuuguuuauagaccucuucuugccaucuagaauuaggaacucuucaagggcaaggccaauagcuccuuaauuuuuguaguucucccaccuugugcuuggcacuuagcaggugcuuagacuucaaucaaugaaugauuuuauuaccaacagugguagcuagggaaagguaguuuucuucuuaaaauaugcuaauacucaguguuuuuuaugcacaaauguuuuucuauaaaccguuuaacauuucuaugacaaacacauauggacacaaagaggggaacagcagacacuggggccugccugaggguggagggcgggaggagggagaggagcagaaaaaauaacuaucggguacugggcuuaguaccggggugaugaaauauucuguacaacaagccccugugauucaaguugacccaaauaacaaaccugcacaugugccccugaaccuaaaauaaaaguuuaaagcagagucagaauaauuaaaaaaugaaauccacaucuugaaaagaaaagauaauuguccuuuaggaaugcauagucauaaaggagagcuguaacucucuuggauacauuuuauauuauguccgacaaucccaguuaaucagaucauuuugaaagugucagccuuggaaauagauuacaguuaaauggucuacaucugcagcagacauuuugccucuaggauaagauucuuuccagagucauguugaauaacagcuggugcaauagagggccaugauuaugaucuuuagaguucuuuuugcuuuucauuaauguuaauccuuggaaucagacuuuucaucuaaaucagggguguccaaucuuuuggcuuccccgggccacguuggaagaagaauugucuagugccacacauaaaaugcacuaacacuagcaaauagcugaugacgaaaagaaaaaaauucacacaucucauaauguucuaagaaaguuuacaaauuuguguugggccgcauucaaagcuguccugggccacgugcaggcugugaguuggacaagcuugaucuaaauuaaugaagauuauuuuguauuucaaaauuauuuuugagccaucacaauuaacagcuaacucucaucuuuuuauacauuaguccugauuauuucuauuuugugaaacaagauuuuaauccuuaauucacuaaaaaugcuugcccuuccuauaauaguguaaaaagaccaguugauuuuugugcaugaaaauuaugagcuagguauaacaacaucguguguuuggugccuacucaucccuaacaaacaauguucagcucucagucuacuucucugcauuguauuuauaaaaaauaaauuguggcucagagguuaaguaacuucccaagggaagcuggaaagcaaagagcuugcauaagaacccaagauggcuagaccaccaaucuucugguagucaccacagggaaaguuugaugaaaugauuuaaaagauuggaaaacuauuugaaauaaacgcucguuugcauugauagcuacuuuuggaauauuuuucuucuaaucaagaguuuaagaaauauuguuaaaauguaucuuacugaggaaaguaacuugcaaaaaacaguacauugccaaaagcaguauacacauugccuaaucaacacuuaacccagugucuaugaacuucacauugccucacgccauauggaauguguugauucauucacuguuccguuuuuaucuacaauuuugguuuaacaaggcuauguauuuaaaauaauuuuuaaacucuuuacagguaagucacuuuugaguuguaaaauuccagaagugacuuuucuugaaguaggcuuuaaugaaaaaucuauuaauauacugaaaaccaacuguacaccaaaacagggcuguuuaucucccugacuuguuugaagacugaguugauagccaccucagacuuagcucauucucuuccuauccacaucugcccucaauuuggacuuugguuggcuguauuuauaaguaaaaggccauguucuuucaccugcagauaugcaguuuuaccagugguaccuguguuugaaacccacugacuguuccuccuuguccuguuccuuguccuaacuccagucucucaacuugggauuuuccuaauuuaauaccuuauuguguagaauaguggcucccaaacuuuauuguguacgaaaauagaccugguugaaaugcagauccucaguucucaugcccauugcuucugacuugguuggcuggggaugaaguccaggaaucugcacuuuguuuuuuuuaaaccccaacgucuccuauacccaucauccuacuaaccccucuuugggcuuuaaggaauaguaauaggugcuucccaauuacagaaggagaggcagcacuucuaaaaagauguuguguugauggggaaggugaucccucuuccugaccucuggcccuaguguccucagguuaacaggagaccaguuuuucuuccuuauuagcaauaucugaguacagcuuuggcuaccugcaaagaaaaauaaagcaaaaccuuucccuuaauggaaauugaggaggaaucugcacuuuuaaugaucauccaggugguucucauguaggugccccaggacuacccuuugacacugcucuagcugccuagaauguuguuucuuuuauguaaaaaaauacauacauaucucaagcauaguaagaauaauaugaaguaacuccgagugaauugaguccauucuuauaaauaagcuuuuaaauuuuacacaugccaaggacuuuuagcagccuuuuugacccucgugcucuaaaaaugauccgucagugaggagaagaggcagaaugaauagucccugacuuaaaaucauccuuuuuuuuuuuuuuacauugaaacucuugauugaaacaggauuccuuuaaagucagccucacuuuuucucaggccugaaucuuagaacauauugucagauauucagcugugcucucgccuccaacccacuuuuauuccuaaauguguucguuuauacacggaguguuugcuguugugauuuaaaaaaaaaaaaaaaaaaaaaaaagcaucuguucugcagcaugcuggccagugaaugagcugaaaaacagcaaauggccuuugcaggcuucucuucaagggugggaggaggaacacuggcagggagaggcuagaaccuuaggggaggcccggcugguaccuaggcaccaagauggagauggaagacaggcuggcuggguggaauugucuucccaccugugagucacacuuugucagcacuacccaguauagggggggaaaggucauuuuuuuaccugccuuaucuuggaaucuuuucagcagugcuuccacaagagaauuaagcccuacuacccugaggcauccaugguacgugugaauuaacuuugucuucuacaucucaggcugggaaaaauagccagucagaucccgcuggguguucugugguuaggcucucaaagaggcuggaguucuagggccgggcauaguggcucaagccaguaauuccagcacuuugggaggcugagguggacagaucgcuugaugcccggaguuugagaccagccuugccaacauggugaaaccccauaucuacucaaaacacaacaacaacaaagaggcuggaguuguagauccagcuccguuauuuccauucuucuuugguaaaaugagaugucugauaauaccuauuuuauucguucagagcauuguuacauuaaaugaaacaaaugugagagcaccuuguaaaguaugaacugaguuuuaaaggugaaguggcauuuaugggaggauugauuugauugugcaggccuuuuguaaaaagcaaguuccuaauaauuuaugauuuauggaagacuuugaaaugagcucuuagugauuuguugauuuaaugcccaggaguaaucagaaaggcauuuggagauaauuuggaaauguagaaaaagaaccuggucuaccacuugucugcaaaauuucuuggucauuugacaaaguaucuuuagagaggcaaacccuggcacuaugugaguaggggauuauuccacaggcugggaagacuuucuacaaagcauaagaguaacucuguuucacuuuacuaucaccaaucuauacuguuggcagaacaggugguauuuguuccuaccuuccauaucaggacacggaggcccaggaaacuggacaugccuauuugugggauagucugggucccaccuuuuuuuucuucuuuaggccacugccuguccacaaagcaucaauuugauguuuaaaaaugacuucuugguuacuuguucagugauguuacuaccuccaguuucaaaccagaucagaccuuggcuuaagggggucaccuacauagucgcuugccauggacgugugucaggaucggauuuccucggauuucccuuaguagaauguuaugacaucaucacacuccuacgguagaauguaguguccccuccugcuucuggggguggggcacaagagaagugacaguucuguuuaccccgagaaguguaauggguauguacuguugaagaaagaagugaaggagcccagaacugagaggaggaggccgguuucccaggcggccaagagagagugaggggcccacugcaggcagagcuggaggcaggcugcucuucuccauccuagauggugcagagagggggauuucgggguggggugggggagagucgccacccacagcaggcuggccagagcgucugggaaaggaguaugugugcaguuugggaauggaaucaucucuuuuuccuguucgucucuucuuucuaugguauucucuuauguggcgcuaugaaaauuugccuggcacuuuucuuuuuuauauuuuaguucugauuuacauaaaaucuccuccaaauuaggaaaauucuauugcguauaaugucaagaacaauaguagcggaagggaaagacuugaagugaguguacacuccaccauaauagcuacgucuguguguucauaugcaucaaauuugaauacgaggccagcaaugcugcuuuuuaacuguuauauuucuguuauggaacccuaagccugucuuccaggagucuucaaacacacuggaaucaauggacucuugcaagccguaacaguuauacaauuuaucugcaaaguuacuguggucaggcacuggggugagugcuucaccugugcuauuucaucuucuagagaagggacuaauaauaucuccacuuuaaaaaugaagaaauguaggcuuaggccaggugcgguggcucaugccuguaaucccagcacuuugggaggccgaggcaggcagaucauuugaggucaggaguucgagaccagccuggccaacguagugaaacccugucuccacuaaaaauacaaaaauuagccggguaugguggugcaugccuguaaucccagcuacucagggggcugaggcaggagaaucgcuuaaaccugggaggccgagguugcagugagcugagauugugccacuacacuccagccugggugauagaggaagccucugucucaaaaaaaacaaaacaaaacaaaacaaaaaguaggcuuagaaaguuuaaguaauuugcucaagugauguagcagcugaguggugugacugagauuugaacccaaguaauuuuggcucuauccuauuaggacauuuauuuauguucuugagcauuaaaauauuuuuggucgucucauaaugaaccaugcuacucagauauaaaaacuaggaaagcacuguaucauuucaaaagaauauuaacaaugucgggccauggcuguguaaugcuuuucucuguaaacaguacauuuaucaaucaacaaagggaaaugagucucugugagauggaaauaauaaaagucugaccuuccccucugagaaaaagccaugaggacuaauuaaguaauggcuccacuccaguucugcagggcuaaguaaugaaggaccugggaggacuccagcucuguuuuccagagauuauguuugacuguggcacugggcauuuuccacauaucaucuugauaauuacuugaaaagcaaaacuuaaagcauuucacugauuacgauuuuuuuuucuugcugagauauccaugauuuaaacugucagggagggucacuggccuagaauucuucuugggugauucauugcagagugaaaauacugacuucuaaucucaauguggccuuacauuuuagagauguuuuuguacaugaguuugccuuccuuuccuucuucuccuuccuccccuucccucccuuccuccuuucuuccuuuuucuuuuuuuuuuuuucucuuuuuccuuaaauccugagaacuguauuuccucuuuuaagcuagauugcuggagauagcuuucaugguuuacaaacauguauacaaaaguugcccagcaguucuccuacagaugguggucuguugguguuccuaaucauauaugugcuuuuuuaaaaaauagacuaauggaaugauuaaaacaacagaggccaggcacaguggcucacaccuguaauuccagcacuuugggaugcugaggugggcggaucaugaggccagaaguucgagaccagucuuacccacauagugaaaccccaucucuacuaaaaaacaaaaaauuagccaagugugguggugugcaccuguagucccagcuacucgggaggcuguggcaagagaaucgcaugaacccgggagguggagguugcagugagccgagaucgugccacugcauucuagcccaggugacagugcgagacucuaucucaaaaaaaaaaaaaaaaaaaaaaaauagggacaaaaagacuacuuugacuuuguguuugucuaauaccuucuuucaaacauucgcauguccaugcuugcuuguugcaaauucgaaacaauuuuauguuugguuuuggcuuuguggggugucugauuaauugaaagugaguggaauucuggagaaugagcaagaagagacuaggcugaggauaggagugagagcacacacagguggcaccauaaaucucuccuaagcuguagucagugcacaggaaaguccauggccuaaaaucgggguuaugcacgccccccaccgccacacacacacguuuaugucacagcugccgaggagcacucugagaaccuuuaauacagcguuuacaugugcauccuuuaaaaaauacuucaugagucuuuaugccaaauaaauguuuccuucgcagcccaggccacuuccuucaaacgaaagccauuagugugagcgauuacugcagcccagcuguuccccagcagcacaccgggccaguaaacagagcaaaggucugugcacagcugcaggcugaugucacugucuggggcugggccugcugcuuuggacuauuacaauaacagcagugaaccuccuguucccccaucugacccauuuucucccuuucucuuucccguuucuucccauguguccucucuucaccucacuuaucaaaacgucagagcugccuuuuuuuuuuuuggugaauagagggaaacagcccugucccauggcuaauaggaaaggacuucuguguauccuauuugguuuuaaaggcugaugugccacaauuacauauucaaagcgacaguauuuuuaucauaaacagauguguuaaaaucagccaggguagucugcuauuaacgucagcuucgaagcucuucuagcccagggcuuggaggcagucucuuguuuauugcugagucccugaguucacuuagauguuucugucccagauaugagcuuccagauggguucagaucuuguuccugcuuuuuuauuuuuuaacuuuggaaauaccggaaauuuuaagagaagcaagugaaaagccugcgugaaacuagaauuucucugacuagaagcuauuugauaccuucaccaacggcuugcaaaguauguuucuguuguagguuuucauagaaaguucuaauacgagauucacacgaggagccuucagagucggaaaguuacuuggcagaagcuaaugcaguguuuacucguuugacuaacauuggacuucuugagucauuuuuucuucugugguuacuaguguaauagaaggaaaagugaaugugcagagaauguucuccagcagucaagaccaucacuaucuuucacuaaauucuuuuaaaggagaaaagaaacuuuuaauauucagucccaaaggcuugaguugcgugcgauggccccuguaaucuggccuccgucugucuuuuuggguucuaucuucucugcuuugugaguuucuuaaucaccaaggcucaccguucugucgcccaucauugcucaugcugggauaggauuuucauccuugaugccucaauuuuauuucuaucauauggcuuaauuugaaaaucuacugaccaaaucauaaccacagugauguacucauuaggauggcuguuacauauauuugaaaaaaucaaauagguucuggugagcauguggagaaauuggaacccuuguguguaguacugcugaugggaauguagaaugguucaaccacuauggaaaagaguaccauaguccuucaaauaauuaauaauagaauugccauaugagucagcaauuccuucuggguauauacaccaaagaauugaaagcagggacucgggcauguauuugucccccgguguucauagcagcauuauucacaguagccaaagguggaggcaacccaaguguccguggaugguaaguggauacacaaaugucaucuguacgugcaauggaauauuaucauuauuauuauuugacacggagucuugcucugucacccaggcuggagugcaguggcguuaucuuggcucacugcaaccugcacugcuuggguucaagcgauucuccugccucagccucccgaguagcugggacuacagacgugcgccaucaugccccgcuaauuuuuguauuuuuacuagagaugggguuucaccauguuggccaggcuggucucgaacuccugaacucaagcgaucugcuugccuuggccucccaaaaugcugggauuacaggcgugagccacugcacccggccaacaauggaauaauauugagccuucaaaaggaaggaaauugugacacaucccacagcuuggaugagccuugaggacauacgcuaaaugaaauaaacagucacaacaggacaaguacuauuugaguccagguauaugagguacugaauggucagauucauagagaaagaaaguaaaauggucgcugccagggccuuggggaaggggaggggauggguuguuacuguuuaauugguacgaaguuucagguuggggggaaacguucuggagaauggaugaugacaaagcuuacacaacgauguaaguguauucaaugccacugaaucauacaccuaaaaauaauuaaaaugguuaauuugguaucugcuucaucacaguuuuuuuguuuuuguuuuugagaugaagucuuucccugucgccaggcuggagugcgguagugcgaucuuggcucacuguaaccucugccucccggguucaagcgauucuccugccucacucagccugcugaguagcugggacuacaggcacacaccaccacgcccagcuaauuuuguauuuuuaguagagaugggguuucaccauguuggccaggauggucuggauauuuugaccucaugaucugcacgcuucggccuuccaaagugcugggauuacaggcgugagccacugugcccagcccucaucacaguuuuuauuuauuuauuuuuuaauuguuuuaaaaaucugaccaaaccuuugguccacccugacuggacguaaacuauccugagugccacucccugggccccaaggucuggccugguccugccacuucuccucugucuguugucucuuccaguagaggccccaucaugcgccuugccagccccagcacaagaaacagcuugguagaaaagaaggggcacgggcuuugggugcaggcagaaucagaauucagacugcucaccgaaacccauccucucacgcuugccagcucugugccccugggcagaugauuuagccucucuguggcgguuuccuuaucuauauguuuaggaggguccucugugaggguuaaacaagauaaagagccccauucugugccaggcaacgagaaauaguuuuuguuuuggggauuuuuuuuuaauguuaaaucuuugcccuucaauaaacauuuguagauugauuuaauuuuuaaggguucucuuuggcagacacuauuccugccauuauuucaauguggccuccuuuuccucugaaagaauacugacugggggcaagugacuuggguauuucuaccaccacauggcagguuccugagauaacaaguugacaccauuguaggaaaucuuccuaagaaccugccauuuucacguuccuuaggccaaauaauuauugaucuaaauuguccuuuucugugcccuaaaauaaucuucuuccuucaacuccugauauguuauuccuuuccaaagagagguaaggguuaauuuaacagauuugccagcaacccugucguauuaauccacgaguacucuggggauguggacagcauguguaucccugacaguuacaguaguacccugucugccuguauuuacacaucggugacagaagacugggaauguccaaagucaggcuuccuaaggaauucaagauuuucuaggauuuauuguaguguguguacauauaucuuugguuguguucugccauguauuauauuguuagucauucuauuuuugguaguuguagggaagagcuaagauguucugauuuucaauuauguguaucagauuacuuugcccuuuuaaaauauauuaacugggaggccgaggcaggcgcaucacgaggucaggaguuagagaacagccugaccaacaugguaaaaccaugugucuacuaaaauacaaaaauuagcuggucgugguggcaugugccguaaucccagcuacugaggaggcugaggcaggagaaucgcuugaaccugggaguuggagguugcagugagccaagauugugucauugcacuucagccugggcaauacagcaagacucugugugugugugugugugugugugugugugugugugucuauauauauaguguauauauguguauauauguauuauauauguauauguauaugcauguauauaugcauacauauauguacauauauacacauguacacauagauauauacauauaugcaugcauacauauguaugcauauauacgugcacauauguaccuauguauacauauauaaauuuuuuuaaccuuucauuuuauauugcuuuuuuuuuuuuuuuuuuugagauagggucuugcucuguugcccaacaguugcagccucaaucuccugagcucaagugauccucccaccucagccuccucaguagcagggacuacaggcccacaccaucaugccuggauaauuuuuuuuuuuuuuuuuuaauuuuaagagauggguuucccuauguuguccaggcuggucaugaacuccuaggugcaaaugauucuccugcaucagcuucuuuuuuuuuuugagacggagucucucucugucgcccaggcuggagugcaguggcgggaucucggcucacugcaagcuccgccucccggguucacgccauucuccugccucagccucccaaguagcugggacuacaggcgcccgucacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggucucagcuucuuaaaauacuugaauuauagcacaaaccaccgugccuggccuaugugggugcuuuuaagauguguuuuuuuuucccuaagauauuugugcucuggugauuugcguuuaauagaggcuaauauuuuauuuuuauuaguuuugaaauaacaaauuauaaucaacucaaauuaacuacaaguuuaagguccacuuguuucuuuuuuuuuuuuuuuuuuuuuuugagacagaaucucacucugucgcccaggcuggagugcaguggcgcaaucucggcucacuggaagcuccgccuccuggguucacgccauucuccugccucaacuucccgaguagcugggacuacaggcgcccaccaccacacccggcuaauuuuuuguauuuuuaguagagacaggguuucaccguggucucgaucuccugaccucaugauccaccugccucggccucccaaagugcugggauuacaggcgugagccaccgcgcccggccgguccacuuguuucuuaucccucgucuuuccugcucuugugugagcuucuaccacacuggcuggcugggagagggaggagucgcuuguccuaagaaaugucucugccuggccaaggcucuuuucuugaccacugcauugacuggucaccacaugagaggggaucuucucuuagaaaccugggucuucugaaguacuucucuuacugcuugggagucaguuuuuugaaugugggguggggggggguuuuguuuguuuguuuuugagauggagucucagucugucaccccggcuauagugcaguggcgugaucuuggcucacuacaaccuccgccucccggguucaagcaauucuccugccucacccucccgaguagcugggauuacaggcaccugcuaccaugcccggcuaauuuuuguauuuuuaagauagacaggguuuuaccauguugaccaggccggucuugaacuccugaccucaggugauucccccaccucagccucccaaagugcugggauuacaggugugagccacugcgcccugcccucguguuccuuuuuacaguucacuuccauacuguuauauuugaagacauggucacuagagacccaagacaucauggguguaugcuucaggugucaucacagcugugugugacuguaaugaauauaggacauuucacaaauaaaaugaccucuucccucuucuuucuccucuguuuucagucacugcuucaaccaccugugagaaauuagaaaaagccaggaaugaguuacaaacaguguaugaagcauucguccagcagcaccaggcugaaaaaacagaacgagagaaucggcuuaaagaguuuuacaccagggaguaugaaaagcuucgggacacuuacauugaagaagcagagaaguacaaaaugcaauugcaagagcaggucugugcuuuugcagccagagcuugucugaggccucugcugcuuacuugaauccugguugcucuucacaucuugaugagcuucucuuuuuuagucuaauagguauaaaaagcauguuguuguuguuuauuuaagacagagucccacucugucucccaggcuggaggcuggaguacaguggcuugaucuuggcucacugcagccucugccucccggguucaagugauucuccuuccucaaccuccugaguagcugggacuauaggcacccaucaccaugcccagcuaauuuuuguauuuuuaguagagacgggguuucaccauguuggccaggcuggucucaaacucccaaccucaggugauccgccugccuuggaaacaguaucuuuuuaauugaauaguuuucuuaugaccaaaggaauguauuauguuaagugaaagaagggaagaaaaggaggaggaaaagauaaaauugaaaaaacaacccuuucuuucuacccagaaauaaucccuuguaaacauccuggugguguguugccaaacuauuguuuugcauuucuuucuuuuuuuuuuuuuuaguggcaucuguuuaaauaucccauuuuuuuuuucacugaauaaaauaucaaaccuuuuuaauuuuguagcucccuuuuuaacucaguuuuucauuuaguaaauaucuacagagugccuacuccaggccaggcacaugcuagggccugaguggucaagugacaggcgcagagcauguggcccugucacugugaaacauauccucguuccuggucauuccuugugacugaugcagccauuuccaucugucacccuggagagccucugugucuguguuccugaggguagggaaggagacagaggagaguugagcggugaaucccaguugcguugcucuucaugcauucuuugugugugcacauguggggacagagucucgcgacauugcccaggcuggacuugaacugcugggcuccaagugauccuccaccucugccucccagagugcugagguuacaagugugaaccacugcccugaccuuuguauguguugaggagccuuuaaacuagagcccacgcuuaccugugaagcugugacgucuccuaaugugguugcuuugcguauucaacuuaggacauuugguuuuacuguuaaaccacgguuuuguuuguugcuuacaguuugacaacuuaaaugcugcgcaugaaaccucuaaguuggaaauugaagcuagccacucagagaaacuugaauugcuaaagaaggccuaugaagccucccuuucaggcaaggaugcuuuuuuuccucuuuaaacagaauaaaaucugaaggaaccacaugauguuuuaagauggaaaugauucauaacuuccugcuucagcgaaugcccuguggccuucaggcugggguguucuugguuccuuuuugcgugguuuauuguuaacagaugccuuuucccacuaaggaugcaaauaauaguuacaaaugccagccuuguguuaaauaggaugggcuuuggaagacuguaaaggccauuuuggcgguggugguugccagcuuaggucccugggaaguggcaaguacaaguuucuaucuuguaauccacaguaaaggauccaccccaagugcuccugcacagcaguguugcugugaaaugucgaugccacuuauugaauagaaaaauagucuuuucuauuuuucaucugucaucagugggaggguguaagccauugcuuucagaacagaaucggcagugucgcucacagucuuucuacuaaaccaguugcaucuuacagagcagcguggaugagugcuaagaaccggcugugugaccuucagcaaggacuuucucaccacaaaaauagaguugcccaaagucaggcagaggugauaauguguaaaagugacuggcuccaggcagacuuguagugaacauuguuuuucuuccuuccugcuagaaaugaguauaauuuuagacuuauguuuagguuaugaagagcaaauugaaaagagcacaggguuuccagaccaggagucuggaguggcauuuaugagagccugcccugaaauggcacucaguguuguccuaaggucgcauggccucugugggccauggugggcuucagugggccucagggcucucagucauaaaaugggaaugucuacccuaaccaccucucaaggccauuuugagaacagauggccaauuuacauaaaagcauacuauagauguaaaguaacgucauacggcuucaucaucaaccccuacaucuauaugcuuuaacuguuuuagaguacauugaucucauagaauguuauugccucaaaaauauccguuuauuuucccagaaauuaagaaaggccaugaaauagaaaagaaaucgcuugaagauuuacuuucugagaagcaggaaucgcuagaggugggugaaugucaauaucccaguaucccccacaaaaaaaaauaucauuuuugauuuuguuugguuuuaauguuucuguguacguaugcugaguuucugggguuuucuuguuaacuuaaguuccacauuucauuguguuuuagaagcaaaucaaugaucugaagagugaaaaugaugcuuuaaaugaaaaauugaaaucagaagaacaaaaaagaagagcaagagaaaaagcaaauuugguaaguugugugugcuccuuuaucaguauggaauuuuucuucucaguugccuuuuagagucauucaaguacucagcagccagagaaauaacacagguugggaauccuucucaugucuggcaaugugcuuucuaagguguguaaaacaacugcuuugcuuacuggcgucuuguuuuaccauccuaaaaucugacauacggaugaaguccaggauguuucugguggucuaagcuaaaaagaaggaaacuaccaauuaggauuagaguuuuaugugaagacuuuauuuaaaaaaaaaaucacuguauugagauaaaacaaacuacaaaguucacucuuucuuuuuuuuuuuuugagagggagucucacucugucacucaggcuggaguguaguggcgugaucucggcucacugcaacguccaccuccuggguucaagcgagucuccugccucacccucccgaguagcugggauuacaggcacgcaucaccauggccagcuaauuuuuguauuuuuaguagagaugggauuuuaccauguugcccaggaaaaguucacucuuuuaacauguaaaauucaguggcuuuuaguauauucauaaaguuguccauuggucaccaguaccucuuucuagaacauuuuuaucacccccaaaaggaacccuggacccauuagcagucacuccccauucccccaaauuccccagcaccaggcucucccccgucuacuuucuaucucuauggauuuacuuauucugaggaaugaauagaaaagguugauuguagaacaugugguccuuuuaagacuggcgucguuuacuuaguauaaaguuuccaagguucauccgugguguagccuauguuaguauuucauuucuuuuuauggaugaauaauauuucgccguauggauaaaugucaauucugaaaaguacaaaucucuuggaagcugaaauuucuuguggcacauuuguccuuuuuccccagccuuaccccaaccuuugucuuuuugaaaaaaauuuguuuccuugcugcuucugccuuuaguaccacuguuuucauuucauguuuauacucugagacugcagaagcaaagcuuuucuccacuucaaaucucuggccagcucuagaaaguacauguguggaucucucagugagaccuucugcaaauaaugucauugggagacccucuagcuauuugauaacauuagaugagcuuauauucaaagaaacuucaaagcuauuuauucuagaagauucuuaggaagagucagugauuucaaaagaaaucuagacuuacaugcagggauaugcaggguauaaacuuuauugauggcucaggaaacagguuugaaagagcuuccgguacacaaaggggauucuucuacugcagccgcuuuugaaaagcuaaggcagagucagagugaggaacacagaagcauccaaccgcuucugucacguaagcaugcugaggcugcggaaaaagagugcgucugacuguaguccgggagaaagggaugggcuggcagaggaggaggagaaaaugcagaggguacaagucuuguaaaugcucuaauuuuaaaacugacgguaaguuaugccauuucccucuaacaaaaaugagguaggauucgcuauuuucaagguaaaaaaaaaaaaaaaaauccugcguacaaggguaacacuguauaaaauguaugaaauuuaaaaauugauacuuaguauuugcauguacuuaugggguacgugugauguguugagacaaucauagacuguguaaugcccaagucaggguauuuaggguauccgucaucauuaucauuucuuuguguuuggaacauuuuauaucuucucuuguagcuauuuugaaguacgcaauauauuauuauuaacuauagucacccuacuauguucuugaacacuagaaccuauuccuucugucuaacuguauguuuguaugcauuaaccaaccucuccucaucccaccccaccccaccucccaccauacacacgcauaccucuccuagccucagggaacuaucuaaagaaccuagaauuaaagauguauuagucccugcccugacccuuuccagcucuggaagcuuuccugaucuuuccugaguagggcgcuuaacccguggaacacguuuccucuuucugugugaaguaagggguuuggauuaaguaauccccgaggccccuuccuggauucucccuaaggauugguccagagcagaaaccaaugccccggaagauaagcuugaugaccacaccaccgacucuuaccuaagacguugcuucauuaaacauaucugaucaguggaccauaugcuguucuucuguagcauaaauuuugaaugguuuaguugaauuuccgaauaaagcaaggagugggugggcgguggugggaaauccacacugauggugugcucucagaggacgccuccccugauguagcauuuauuuuggagaguuuuguguuuuugagacaggaucuuguucugccaccagguuagaaugcaguggugcauucacaguucacugcagccuugaccuccuggcucaguugauccucccgccucagccuccugaguagcugggacuguaggcauaugccacuaugccuggcaaacuuguaauuuuuggagagaaauuuaaauaggcuguguacuccaugccguguagguacuggggugucacaauagaaaaugauaguauuaugucugcccuagaaguauggcccagucaacguagccccaucauaacaaaaauccaaacacucaggacauuguuaucccuguuguuuuccagagagccguauaaugcacugcuuuuucuuuccugaucaguuuguuugguaggagagaacuguuguucccuguucucccagaaaaugccaauaacugacucacagauugccucaucuccagccaagauucuguuuuguauguaagcaaaguuuuucucuugauacaauaacauguuugaugcaacucacauuuuugcauauuaaguuacugauaaauaagugaaauguuugcuuucaguauuaggaccagucuucgacauuaaggugcucuuguuuuucaccucuuucuuugaaauugcucuaagaugaugaacaucugucgcuugcuacuugucuaaugucucaaucuaaucaaagauucuuucuguuaagaauuugaacuauguggaauaagagcaguaucuugcuguguccuuuccagaaaaauccucagaucauguaucuagaacaggaguuagaaagccugaaagcuguguuagagaucaagaaugagaaacugcaucaacaggacaucaaguuaaugaaaauggagaaacugguauguuuccuucagaaugaaagaggaucuuacaaaugggguaauaugugugaaauugagcccugcauuuuagaacuguggaguuggguuaacugcuccuaaagauauuuagaaauuauacaaaagauaaaguucacauuuucuuuccaaguuuguuccauauuuauucauugcugccuccuagaauguuuucuuuuucaaggaacauguaaaacagcacccaguccuuggaaaaacuacaaacaaaucaggcuuauauuucagugguauuuuggaucuucaccugcauaagaaaaauguuuaaauaucuauguaaaaucaguacuuuaauauaccagccacccuggacagguuucuuagauccaaaacaguuggauacguuuaauagaaaugaauagaaaugaauuuaauagaaaugaauagcaauacuauuuaucaaaauucuucaucuugcuucuugugaauuagcaugugauaaaagaaucgugggcugggcgcaguggcucauuccucuaaugccagcaguuuagggagguugagaugggugggucacuugaggucaggaguucgagaccagccuggccaacauggugaaacccugucucuacuaaaaauauaaaacuuagccgggugugguggugggugccuguaaucccaaguacugggaagguggagguuccauugaggugagauggcaccagugcauuccagccugggcgacauagcaagacuccaucucaaaaaaaaaauugugcuauaauaagauuaauccauuuggacaaguagcagguguuaccaaaaauaugaauuaacauucacuuugcagugucuagaacagagaacgauguuagugugaguggcauguucaguguucagcgucagucuuggcccggcccugaaauacagcugcugccagccaggacucuaaccaaguuggcagaguuuggcaaggcagcuuaagugauccccgcccucgcggugccuugcuguugacuguccagcugccgcaugcuacuggccucuucuccccacagugaugagugacucaggcuucuacaagugccucauucaaacccaaaccagcccuggacaguaggggacaugggggaccucucugcugcuugguuuguguugguuuggcguuugguuuucuucuggagacuaugacuucuguugagggagauaacggccaagccccuguguggauauaccagcauuuugaauuaucaggaaauuuuuguaaaggaaggaaaggaacucaugguuguuaaugggccaaccuaguauacauaccaguuccugccaaaggucguccuguucgacugagucugguaucuucuaaucugguagucagggaugacucagaugauccuguuaauaggacugcuccauaugccauucaugcaucaaaacuuucaaaaaaucaugugcaauaaaucagacuuugcuguaaacuuaccaacacauuuaauuucugaugaucuacuauuuguuucuugccaugccccagagguauccugauaauauccuucagccuugcauuguguaugugugcaagaaugaguugauacaaugagagggagacccacuguucccuucauauuuguaaauuacaggccucugaugaaauuaagagacuuagaagcacaggaaguuuucuaagaaagacagcuuucccaugaaaccggcacugcccauaaucagcucugugacauuauuaggacuaguuucccuaggaugagauauuuaaaggacaauaccucccaaucucaaauuccagguuuuuuuccacguuguuuuaucugggaauccuucauaauuacugaacguagacuccuuuucuggaaagugauuuaaccugaacagguuguccugagcugcuucuggauaacaggaugucuuaagaacaaucagguuccaaacuaagcaacauacucaaagcgcguuaguccugcuacaaggacaaggacuuagacuuaauccugacggagcuauaauauugccucuucauaaagccuuaccuuuagaaagugagugggggauggaaucaggucuucaucauguuaagugauuaaauguccucaggcaucuuauccuuucaucucuccgcugaucaguuuguuugccuugaaaguucagccugcacagggcagcaagagaacagaccuaucuaucuucagcugaccugaggagacucguggcauguuacuucuuugauggcaugcucuaagagcucuaucgaauugaagcuuuguauggccacucagacgcaaaugcugaaaacuuaccaugaaacugaguucaaguccauaguaaacguugccagggacugugaauugcuggccugugaguuuucaucagaugugggaaucuuuuuuuuuuuuuuuccagcaaaauucaccguaaggagauagauaagcuuugauaagugugggcagugugucugcaggguuuauuucacauugaaacagaaagaggcaccaauucuuagagaauuccaaaacaacaugaccuggaacaaaucuguuacccacucguaucaauauuuaaguguccuggcauacauguuuuaaaaauacccagccgcucuguuuugcuguuuuaaaaucuuuuucaguauguuuguuaguguauaaauauuuuaauauggaauugcauuuuccuuaauuaaaucuccaaagugugcuugugucgugaggugccuuaagaaaugagggguuuuuuuuuuaauauuguauaaauguuggaauucuuguuuaugccaagguggacaacaacacagcauugguugacaaauugaagcguuuccagcaggagaaugaagaauugaaagcucggauggacaagcacauggcaaucucaagguaaaaauaaaacagugcuguuucucccgagcuccccgcucccuuggacauccaguguacuuucuggacacgcucuaccccugcaccuccuggaaauaugauggaagcagaugguuaaaagggcauugauuucucuguggaaaauaugauuguaguaguucaugcuuuuaccaaagcggccugaaaacuguacacugagacccaggccagcaagccugcucccacggccucuggcugccucugagaaugcuuucagacaaagagcaacacaaaaccaaauagaaaacagccugcaacauaagguagucauaaaacaugucgaauauuugcaaaaguggcucucagccuacuaugaaauugcccaaaaaguacaguuauuauuauauauuuuuuugagaugaggucucacucuucugcccaggcuggaguacaguggugugaucuuagcuuacugcagccuccaccuccuaggcucgagcaguccucccaccucagccuccugaguagcugggacuacaggcacaugucaccaugcgugacuaauuuuuguauuuuuaauagagacagaguuucgccauguugcccaaguugaucuugaacuccuggccucaaguuauccacccaccuuggccucccaaggugccaggauuaugagcuugagccaccacgcccggccuguguuuggguuuucuuagccagccaaauaccugugaccuugugcaggauucuguuuuaucccaaaggaauaauuuuggacuuuaaaguuucaaacgcuaagaaaaauuuuucaaguuuuuuuuuuuuuuacauagaucucaugguuucuggccuuuuucuucaaggcagcuuuccacggagcaggcuguucugcaagagucgcuggagaaggagucgaaagucaacaagcgacucucuauggaaaacgaggagcuucuguggaaacugcacaauggggaccuguguagccccaagagaucccccacauccuccgccaucccuuugcagucaccaaggaauucgggcuccuucccuagccccagcauuucacccagaugacaccuccccaaaguccacagacucucugaaagcauuuugaugcaggucugcaggacugaccccaaggaggaacgugggcacaagagguauaucagcacacgugugaucaccguaggguaacuggagcgucaccaccggcggaaucgcagcuucugagacuggaacucuggaggaagacuuuugccuccguccaaaagauuccuccaaaaaaagauuuaaaaaaagauuucggcaucgacacggacguuguugcacaaagcacuuaaagaacgagagcaucuuguucauugccuuuuucaccuaagcauagggggaaaaacucucagggcccuauuaagauuuauaaccuuuguaauguucuucaccacagacaccuucuugugaguuuucagucugacuguggggguggggggugugaaugaaauggaugucacagagugucaugugucugaugcagccuccucugcuguguauuaaaugucaaaaucugaauauaucuggauauguacuaaucaaauaauaaucaaucaaucagcauauacauuucagccaaagccauagaagaaaaagcaauaguugcuugaauuaugaucaucuaccaccaacucugcucagcccuguaacaggguagggagaggguauaacaggaagagcuuugacuugucccugucuauacauucucuguaucuuuuggggguaacuucuuggcaguuuuucaguguucagccaugucaguugaaacuagauuuuucuguagauuuuuuacuuacccaugugagccuaacacuauccuguaauucauuuucucaggcuauguguaaauguagaacccuaauuuuucuauaaaaaaacaaacuaacuaacuaacuguguaaagaaagaaaaagggaaguaccaauggguuuuuccaccuuauuuuuaccuuugaucuacccuugcagauuuaaccugucuucuucccucccauuauucucauuuuccuuuuaccuuucuccaccauccagagccacaaaagcaaaccuucuaccuccuaccuacuuuucucugggacaaggauaaaggaauaugauuuuccagagccccagagccagcucaucuuccaggugcugaaaccacuuuccaaauaaacuaaagccuggauuugauauuacaaauuuugggaaaucuuagaauaaagaacgagaacaaggaagucauuggcuaguauaauuaagaaagguaggauucagugcuuaccgaugaugcaguacuugauagaagaaaacagucugggaggauagcgcucauuuuucaguuacccuuuaaggagucccuuugucuuugggaaaguagcagaaugguccgcuucuuucccaugaguggaaaauguggcuuguccaacucuccuccagguugcauuucaguuucuuuccaaaacuuauuaccuccccuaauccugagacuuuggaaaagguggaaggaagaacuguugcuuuaucucccccucccugcaugugucaacauugugaugucaguauuuacuaaucuacauucaguggcuguacaaauaacagcuguaguaagaagagauucaggaugcuagaggugaauauuugggucauuuacauguacacuacauagcaaguugauacucauguugcauguucuuuuaaauuagugauuuugugucuuaagucuuuaacuuccaauacuucaucauguauguaaccuuccauguuugcuucugauaaauggaaauguagguucacugccacuucaugagauaucucugcucacgcuuccaaguuguucucaaugacauuagccaaaguuggguuugccauucauccccuaggcaugguaaaucuuguguuguucccugcuguccuccguauuacgugaccggcaaauaaaucucauagcaguuaauauaaaacaucuuuggaggaugggagagaacaggagggaagaugggaaacaaaauagagaauucuuaagauuuuguuuaaaccaaauguuucauguagaaugcaaaauguuggcacgucaaaaauaugaauguguagacaacuguaguugugcucaguuuguagugaugggaaguguauuuuacucugaucaaauaaauaaugcuggaauacucaagaauugcauccucugaccuacuucauucuucaaauucuucauuuuuacagcccugugacagcacaguaaaggucguaucuccucuuaguuuauauuucccaggaauuuccacugcaaccgcagaguuggucaugggcucacagagcuagagugagagguaagcucuucuucucuaaauucaaagcuaucuauguuugacaaauaaauuuuggcuggcuguaacaauuucugcuguauaagaaaauuggacaaacuugguaaauauuuuugaauaucguaaaaaaugucuaaacaaaguugaauguucuuaaucuaugcaucuauuucauauugaaagcuaaacuucuaaaaacuuguucuaguuauugaauagacuaaucuacaauuacaccuuugagugcagcaguuuaaaaaaaugaaguguccuugaauuuuuucaguaccuucauaaauuaacucacauuuguuaaaguugcuacuaagacaaaaugacauuucuaagcauuugagucuggaguuguugcuuguggguaaguaguugaacuguaucuaguacauuuuaaaauucuaauauauugcggugauauaaaagagaauacuugguauugacccacguaucaccaccaccaagucuuucuggauguauuuuaagucaacuuaacuuaaaaaacacuuaucccacuuuuuauuuuuuacaaaaacgugcucauuuaauagaaaugauugauuauauaaaauuguuuacacauguauaaaaacuaggaacacguauguagguaagcaaucaaaaucaugcuuucuguuagaaaaguuaacacuucugugaauagacuggaugacuuccuuuuaguuuggaugucugggucggacucacgagacgcugggguugggguguggugcuugacaucagccucuggcaaagcacuaauaaaaggaaccccaaagcugacuguguacacaaaugggcuuuccauaaguucauuacauuuccuuuuccaagucaggaaaacucaacagugguagcuacuguggucuguccuugaagauucugagcagugcaaauguaauauccugcaucaaucgucucaaagucuuccacuguaaugacacucugggagauucucguggugugucccaguccucuguggaucaaccuccaagugucuuggaucgucacaggccuuucauccuguuuaacgacacccacaaagacugaagcaagagggacaagcugcuauaaagagcucccacucacccaacacuguugagcguuccuuucagagagcaaagcacaugcuuauaaaagacuguuuaguaugcguagcucauaagcuguggaagcuucuacacuggaaucauuuuagguugcauuuuuuccaaacagcccuugaauuucauuacguuguuuggcacugucuuucugcccuuuucuucuguaagguuuuacuuaaucuaaaauguaugcuuuuagaacuccaaggaaguggaacugguauuaagcauaagcagggacaaaauuuuccacuggccccguucuucacauugcccacuuucuuuuccuagcuaagugguucuuaccuacagaacugaaagucaguagccugaaaaagcacccacuguauaaaugacuaagagcucccaauugcucagauuugagagagggagaaguaugauuaggccagugugccuuaggacucuagugggagaaaaguuguaccaaggauggguaagauaauguacuacaugacaggaccccuauuucuacaaagugcgauggucacuuuugagauguccacccaacuccagugauaagaacauaguauuuucugaauucauguaacagaacuaauauaucacuaagugaauaccuuuucucauaaaauaccaaauagcaauguggcggggaccucuauugaaaaucaucaauguccuguaaguaugaccaacacguuugauaaucaagugccugguaccaggaugccggaaaacacuauuccccagagacaguuauuuucuaccaaucacagcccauaggccagaaggaugucagcuacuuaaugugucuuguggaggccaaaucucuucuggcaacaaagggauuauuccgugcugggagcagagcuguuauuuuagcaagcagaacaugcacaagggcuaaauacgcugcaauugcuuuuaugagaagucuacuuuaaaauuaucucuggccucacagcaccuuuuuggcguggucuauguccacuugguggaugucugcucacagcagcuugccaugggcacagcuuguauagagaacacucuagccaagugaaacacaggaauagaaaggagcagcagaaagagcccuaugggcucucucaguccccaaggaagccauuucugacuuugucucacagagaucccuggagagggcuaccagagaaacugggaaaagaccacagggagaaggaaacuucuagcugaacuuuguaacaauuuugaccaaacacaguuuccuggacagaacucgggugagggggugaagcaggagugcagacacagcacagaaaccguggcagguaggagaugugaaaucugaaaacccuguuugcuuucuuauccaagaggcugguagccugggacaaguucucaacccugcucauccacugccuagaaacaaacucggugcuguuggcagggacagagggagugagaccggcccuuugggcuacgugggagcugggugaggccuguaacugcuggcuuucccccacuucccuggugaccugcaugacacagcagagcagccauaauccccugaggaacauaaccccauuggccugagaaccacaccgccagucccaacagcagccauagcaagacccgcccaaggagagugucugagcucagacacgccuagcccacccccaacuaauggucuuuuucuacccacccugguagccgaagacaaaggacauaaucucuugggagcucuaggguccugcccaccaccugauccucccuauacuacugcagcuaaugcugucuuuaaagugccaccuccuggcagaagaccaacacaaaacuagugcaauaaacgaaacuacaacuaaggacccucacagaguucauccauuucacuccccugccaccuccauuagagcagcugcuggcauccauggcugagagaccugagacaucaaaggacucuguacaggcaccacuaaguaccagcccagagcccaguaacucugcuggguggcuagauacagaagagaaauaacaaucacugcaguuuggcucucaggaagccacacacauaggggaagggggagagcacuguaucaagagagcaccccaugggacaaaagaauaugaagagcagcccuugagccccagaucuucccucuaccauagucuacccaaauaagaaggaaccaguaaaacaauucugguaguauuucaaaacaaguuucuuuaacaccccagaagaucacacuagcucaccagcaauuuauccaauccaaaaagaaaucccugaauugccagaaaaagaauucagaaggucaguuauuaagcuacucaaggaggcaucagagaaaggugaacuccaacuuaauuaaaucaaaaaagauacaggauaugaagggaaaaaucuucagugaaauagauagcaaaaauagaaaacaaucauaauuucuggaaaugaagaacacacuuagagaaaugcaaaauacauuggaaagucuuagcaauagaacugaacaaccagaagaaagaacuucagaacucgaacaucagauuuuuggauuaacccaaucgaacaaagacaaacaaaaaagaauuuaaaagaaugaacaaagccuccaagauguuugggauuauauuaaacaaacaaaccuaagaauaauugguguuccugaggaagaggagaaaucuaaaaguuugaaagacauauuugagggaguaaucaaagaaaacuucccuggccuugcuagagagcuacacaucugaauacaagaagcucaaagaacaccugagaaauucauugcaaaaagaucgucaccuaggcacagagucaucagguuaucuaaagcgaagaugaaggaaagaaucuuaagagcugugaggcaaaagcaccagauaacuuauaaaggaaaacaugucagauuaacagcagauuccucagcagaaacccuacaagcuagaagaaauugaggcccuaccuucagccuccuuaaacaaaagaaucaucaucuaagaauuuuguguacagcaaaacuaagcuucauaaaugaaggagagauacagucuuuuucagacaaacaaaugcugagaaaauucgccacuacaaacccagcacuguaagaaaugcuaaaaggagcacuaaauauugaaacaaauccuugaaauacaccaaaauagaaccuucuuaaagcauaaaucucauaggaccuauaaaacaaaaacacaauaaauaaauaaauaaauaaaaaccaagguauucgggcaacaaauagcaagaugaauagaauaguaccucacaucugaauacuaauguugaauguaaauggccuaaaugcuccauuuaaaagauucagaauggcagaauggguaagaagucaccaaccaaguaucugcuguuuugaagagacucaccuaacaaauaggacuaacauaaacuuaugguaaagggcugggaaaagauauuccaugcaaagggacaccaaagugagcaggaguagcuauucuuuuuguuuguuuuguuuuguuugagacagagucucacucugucggccagacuggagugcaauggcucaaucuuggcucaaugcaaccuccaccucccagguucaagugauucuugugccucagccuccuuaguagcugggauuacaggugcaggccugucuuauagaggaguagcuguucuuauaucagacagaacaaacguuaaagaaacagcaguuaaaaaagagaaagacggacauuauguaaugauaaaaggacuugcccaacaggaaaauaucacaauuauauauauauauauauauauauauauauauauauauauauauauauaugcaccuaaugccagagcucccaaauuuauaaaacaauuacuguuacaccuaagaaaugagauagacugcaacacaguaauaguggggaacuucaauacuccacugucagcaauagauagguaaucaagacagaacaucaacaaagaaacaauggauuuaaacuauaaccuagaacaaauggacuuaagggcuauuuguagaacauucgacccaacaacugcagaauauacauucuauucaucagcacauggaacauucuccaagagagaccauaucauaagccacaaaacaaguuucaauaaauuuaagaaaacugaaauuauaucaaguacucucucagaccacgguggaauaaaauuggaacucaauuccaaaagcaacccucaaaacauacaaacacauggaaauuaaauaaccugcuccugaaugaucacugggucaagaaugaaaucacgauggaaguuaaaaaauuauuugaacugaaugaaaauaguagcacaaccuaucaaaaccucugguauacagcaaaggcagugcuaagaggaaaguucauagcauuaaaugacuacaucaaaaagucugaaagagcacaaauagacaaucuaaggucacaccucaaggacuggaaaaaccagaacaaaccaaacccaaacauagcagaacaaaagaaauaaagaucugagcagaacugaaugaaauugaaccaaaaaaauacaaaagauaaacaaaaagcugauucuuugaaaagauaaauaaaacugauagacuauuaacaaaauuaaccaagaagauccaaauaagcuucaguuagaaaugaaacaagauauuacaaccaauaccacagaaauacaaaagauaauucaaggcuacugugaacagcuuuacauacucaagcuagaaaaccuagaagagauggauaaauuccuggaauuauaccacccuccuagauuaaaccaggaagaaagagaaacucugaacagaccaauaacaagcagugagauugaaaugguaauuuaaaaaacugccaacaaaaauaagcccagaaucagauggauucacaaaugaauucuaucagacauucuaagaacugguaucaauccuaucaacauuauuucacaagacagagaaagaaggaauccucccuaaaucauucugugaagccaguaucacccuaauaccaaaaccaggaaaggacauaacaaaaaagagaaaacuauagaccaacauguuugaugaauauagaugcaaaaauccuuaacaaaauacuagcuaaccaaauccaacagcauaucaaauagauaguccaccaugaucaaauggguuucauacuggggugguuuaacauacacaagacauuaaugggauacaccacauagaauuaaaaacaaaaaaucacaugaucaucucaacagacacacaaaaaacauuugacaaaauccagcaucccuuuaugauuaaaacccucagcaaaauuggcauagaagggacauaccuuaagguaaugaaaacugucuauacugaaugggaaaaaguugaaagcauuuccccugagaacugcaacaagacaaggaugcccacuugcauucaacauaguacuggaaguccucgccagagcaaucagacaagagaaagaaauaaagggcauccaaaucaauaaagcgaagucaaacugucgcuguuugcugaugauguaaucauauaccuagaaaacccuaaagacuccuccaaaaagcugcuagaacugauagaugaauuuagcaaaguuucaggauacaaaauuaauguaaacaaaucaguagcucugcuauaaaccaacagcaaccaagcugagaaucaaaucaauaacucaaccccuuuuauaauagcugcaaaaaauauauauacucagaaauauaccuaaucaaggaggugaaagaccucugcaaggaaaacuacaaaacacugcugaaagaaaucauagaugacacaaacaaauggaaacacaucgcaugcucauggauggguagaaucaauauugugaaaaugaccauacugcgaaaagcaauccacagauucaaugcaauucccaccaaaacaccaccaucauucuucacagaacuagaaaaaacaauccuaaaauucauguggaaccaaaaaagaaucugcagagccaaaacaagacuaagcaaaaaaaaaaaacaaaucuagaggcaucccauuaccugacuucaaacuauacuauaaggccauagucaccaaaacagcaugguacugguauaaaaauagcacauagaccaguggaacagaauagagaacccagaaauaaacccaaauacuuacacugaucuuugacaaagcaaacaaaagcauaaaauggggaaaggacacccuauucaccaaauggugcugggauaauuggcaagccaaauguagaugaugaauaagacugaauccuuaucuuucaccuuauacaaaaaucaacucaagguggaucaaauacuuaaaucuaagaccugaaaccauaaaaauucuagaagauaacaguggaaaaaccuuucuagacauuggcuuaggcaaagaguucaugaccaagaaccaaaaagcaaaugcaacaaaaacaaagauagaucgggcuuaauuaaacuaaaaaacuucugcacagcaaaagaaauaaucaguagaauaaacacacaacccacagagugggagaaaauuuuugcaauccauacaucugaaaaaggacuaacacccagaaucuacaaggaacucaaacaaaucagcaagaaaauaacaaucccaucaaaaauugggcuuaggacaugaauagacaauucucaaaagacauaccaaaguccaacaaacauaugaaaacguacucaacaucacuaaugauuagggaaaugcaaaucaaaaccacaaugugauaccaccuuacuccugcaagaauggccauaauuuaaaaauuaaaaaauaaucgauguuggcauggauguggugaaaaggcaacacuguuacacugcuggugggaauguaaacuaguacaaccacuauggaaaacuguggagauuccuuaaagaacuaaaaguagaaccaccauuugauccagcaaucccauuacuggguaucuacccagaggaaaagaagucauaauaugaaaaagauauuugaacacauguuuacagcaguacaauucacaagugcaaaaauauggaaccagcucaaaugcccaucaaucaaugaguggauaaagaaauguaguauauauaccauggaauacuacucagccauaaaaaggaauuaaauaauggcauuugcagcaaccuggauggagaccauuauucuaauugaaguaauucacaaauggaaaaccaaacaugguauguucuuacuguuaaaugcgagcuaagcuaugaggaugcagacauaagaaugacacaaugaacuuuggggauucaggggaaaggguuggggggaggggugagagauaaaagccuauacauuggguauaguguacacugcucaagugauggauacaccgaaaucucagaaaucaucuaaggaacuuauucacguaacacacaccuacuguucuuaaaaaccgauugaaaucaaaaaugacaaaauauauuaaaaacaaagagaacacucugaaggaccccaggaggagguuagauuagacucuaguuggcccagaagaugggauugaaagacugaggugggggcaggaggaaagagggagauccuucauuucccuuuccucccaauguccuuuuuuuuaaaaaaaaaccuuuuauuuuagguucagggguauaugugcaagucuguuauauagguaaacucgugucaugaaaugacagaucauuuccucacccagguauuaauauucagccuaguacccauuaguuauuuugcccgaucuucucccuccucccacccuccacccccagguaggccccaguguguguuccccucuauauguccauguagucuaaucauuuagcucccacuuaaaagugagaacaugagguauuugguuuucuguuucuguguuaguuugcuaaggauaauggccuccagcuccauuuguguuccugcaaaggacaugaucucauucuuuuucauggcugcauaguauucuuugguguauauguacuauguuuucuuuauccagucuaccauugaagggcauuuagguugauuccaugucuuugguauugugaauggcgcugcaaugagcauuacuguccuuucuuacuuaaggguuuaaaaaaaaaaaaaccugcauaugaagaggguacauugagcaaacugacuaaugaaacucaaucucuuauuuccuguccuuaaaagaaauucauuuuuaaauauaccgaaacaucuucaaaaaaaacaaacaauaccuggcccccaacauagccccacauguuucuugcacuucugaaguuauggcauauagcacuggguggggacgaagcugugaauuaaaauggcuggcugagaugcagaggcugagacgcaggggcugagaugcagguacaacacuuaccuucugcccugggaagauccaggugaacuccaccuccacaucgggcucccccaggacagugcagagcacacugaugucguccccacuuuucacuuuguuugaagaagccaagaugguuguugagggagggccacugggaacuggaagcaagcacgaaacaggcagagugagaccccgaguguaaccuugaaaacaaaccuacagaugcauucuuuuccauggagagagauggaauuuucugccuuucucacagcucccugaccagugcgag

SEQ ID NO: 15598 - RNA, 3568 nt, Homo sapiens
acuugccagccauggaaguaacuugcugaaaguugcauuaacagaagggcuuagagccaggguuuuagccaggucuguccaacuccugcgcucuuaugacacccgaauucuugacuuuacaaguaggauugagaaacagcucuguccuaugagacccacacuucugcugccauggaccaggccacccugcugagccuggacaccacugugucacugccuucuacuuguucugugucaauuauuaauguucccauagggaucagaaacccuuugguguuaggagcugacaggucaccuguuuuugacuacccugagucugaaucgugcucagcuuguggggaaugcguuaagagcuccucagucuuucuguggcugugacccaggaguacgugaaaaauaugaauaguucagaaauuuauaaaaagucacuauaaaaccucacacagucauuauugaaguuagucucacaaagugaagcauaguuuuuguuuauuggugacaauuuacaaaauacuugccagcuuagccucacauaugacagaugugaccagcaggcuccagaccacaccgagcugcaugcuggccccgucuacaagccuggggaaguguggcugggcuccucaaccuucacaacuuggggagguugcucagcucacaugaaaaucaguccucucuuuuucccuagggcacucugucccucuuauguugauaaaguggguuucccagccagguggcacaggggaugcuagacuggugugcguugggcaauucucuguggcaguucuggacaucuucaaggaugcuugucuaggcagaggacagauuuguuuccugacuacgguaauaaagaucaucaucuaccuguagggcaaagguuggaugaguugauuggagaagcagcccaucuuauaacucgagggguuuccugagcuugggguuccucagcugugauacagaugauacaucauaaauuggguugucacacaucaccuccuugggggacuugggguggggggcaaauggcauucccagagcaauacaguccuuugccuuuggcccaggagucugccagcauccaggaagcuguggcaggcuaggucauuagcuugcaagcaggguaaaaucucaggcccuucacagggccgcagcuuuggggcagcugggcagggucuaggcauaccagccuccaggcugccucccacagcccgggcuuccucuggggcuccuugaagggcagacugggacagugauacgguuugggccuguguccucacccaaaucucaucucgauuugucaagggagggaccagguggaguugauuggagcaugggggugguuucccccaugcuguucucgugauagcuagugagcucucacgagagcugaugguuuuaaaguguggugcuuccugguucuccgacuugcuucucuccugccuugugaaggcgucgucucccgcccucuugccuucugccacgauugucaguuuccugaggccuccccagccaugcggaacugugagucgauuaaaccucuuuacuuuauaacuuagcagugcgaaaacggacuaauacagacagagugggauagacugcaucccucuguguucucacaggcugggaagggagguguggggcaugcaagguauggagaaaguuaguaaaaaucacuggcccuguggaccagaagagaccugggccaacuagguuuugccucugucaaauacaaaauccucauaaggaaacuuaaccauucagcccucacugggggcccccccaauuguuuuucaccaagacccaaacuuggcuuggucgucccggucgucaguggcagcaauaacaccuggaacuuguugcucccauugcaagguugagcaauagcagcuggccugcagaucucacagacaagcggccuguggcacaacuggaguuuauguuccaggugcgcagaaugccgcacacagcccugcugcagaggugggagggaggcgcauaggcacugcggucuccugguggauucagcuccaggcagcaucccaaacauucacuucacauguaucugauuacuguguccauuuguagcugacaggccaauuuggaggcaucucagcuggcugccuaugacuguuguuaacaauucaagugcuuucugcaaaauagggcauuguuauuuuaaaauacuucauuggaauuuuuuguuuuguuuuguuuuguuuuguuuuuuugagacagagucaugcucuguugcccaggcuggagugguccaguggcgccaucucgccucacggcagccuccaccucccaggugcaagcaauucuccugcuucauccuccagaguagcugggauuacagguacccaccaccacgcccagcuaaauuuuguauuuuuaguagagacggaguuucaccguguuggccaggcugaucucgaacuccugacuucaagugagccgcccgccuuagccucccaaagugcugggguuacaggcgugagccaccaugcuuggccgauauggcaauuuugauugaauucaaaacucuucccaagauaauuuaguaguacauguaucaaugaaaguuaaauaaaaauuaguuuucaaauauaauuccaauuucuguaaauucuugaaugcuuguacaacacugcuuuaaauuuaucacucaauuaggcauacaaauugauccuuaaugauuuuucaaaaauuugaggagaucauaaagucucggccaagaauuguguauaacaauuucaaauagaaaauagguuauaaaaacacguuaagaaaauggccgggcucugugacucacgccuauaauccuagcacuuugggaggcagagacggguggauugccugaacucgggaguucaagacaagcuuggguaacauggugaaacccugucucuacuaaaauacaaaaaaucagcuuggcaaggugccgggcguccguaaucccagcuacucaggaggcugaggcacgagaauugcuugaacccaggaggcggaaguugcagugagccaagaucaugccacuccacuccagccugggcaagaaagugaaacucuguccaaaaaaaaaaaaaaaaaagucuauaguuuugcauuuuuauguguaauaucuccccugaugcuuuaucuucuguucauuacuuagacauuucauaauuaauauaaagaaaauguaaugaauuuuucaccaaguccauauauccccucucguuuacaaacacuauccuuuucaguauguacugggacauacaaacaggccaaaagguaacaaaucucacauuguuuccauugcuucaucaccagccugggugaccagcgacacaugacuuaacuccuugcauccccauaucugccuuuguaaaaugaggguuuagauccaauuuucucuaaggauuccucuagcuugauaaaucuagauuuaaauugugucucaguugcgcagggaauccaguagcagccgacacccaggugugguuggacucgucagaaccauuguagucuuuguuagucauacacaugcaugggugaaaucuagucaaaacuuucauaucaaguauuu

SEQ ID NO: 15599 - RNA, 28536 nt, Homo sapiens
acccuuuucguggcacugaaaagccccguccucuccucccagucccgccuccuccgagcguucccccuacugccuggaauggugcggucccaggucgcgggucacgcggcggagggggcguggccugcccccggcccagccggcucuucuuugccucugcuggaguccggggaguggcguuggcugcuagagcgaugccgggccggaguugcgucgccuuaguccuccuggcugccgccgucagcugugccgucgcgcagcacgcgccgccggugagugagcuugagccgaggcgcagagaggggcgugcaggugcgggcgcggauggaggcgcagguguggcggcgcgagcggguacaaggaacaccucgugcugggcagcuucuuuacgggggucugugguuucgugcacaggggugugggugcagagcgggcuggcgaaccccguccucgguagauucggugcuaccugcaacuagaacuccuuuaaaggaaauccuagucucugcaggauaccugggugugauucgcacauucuuagauuugagugaguguacuugaauaaccaguuccaggcccuugcauuuugaaguguuuaaauaaaauguuccgguggaccugugugcauuacucaaucaaggacagacugccugauggucaggugcuuucucccgaagaaguucaggaguucagcccaggauacugcagggccgugggaaacgcugaguggucccaagcuugggcggugcgagcagcccagagcaggccccaaagggcccccuguggccuuuugcacccaagucaugggaucgccugucccguggcucuuucccacgagcaagucacagggcuacggacuuccuaacugcaagagacagugagggacgagcgugacucuuucauuuuacagaagaggaaguagaccuagagugagaaaauauuuagccagagguuacacuguuguuuacugaacaugcguaacguccgagccucuugacgcccaguacucuuucauaauucauuucuuuauaaagcaaucagacugcguuugucuuugccaacagaaucggauaaguaggaaccuggcgcaucuggccugaggcuagauggugauggucuugaauaguuuagguagguuauugaaaguggaagcaagaugugcauugucuucuuuuauaccuguaaggagaaauucuuuaaaaucauggugggauaugauuuagccauuaaaauugauauaauguucagcagauaaaaguagaauccagaauaguauauacaguuuuuccuguaauaggaaaauacacagaacauguauguggacacgauuaaaggccuuaaaauaaaauugcuccauuguggguagggaauuaauuugcuugacgguaguugguuuuaugggaauugggagagacuuugauacuuugauacugucagggcccuucauugaaagaccaccaggaacacaccauaagcugaacaaauuggguuuaguguucuuugaggcaaaggagaccacacaccaugagcgacggacgguagguuauagaaaaaaacccauuacagaauuugaacuucgguugcaugauuugggguaagacugaggaaccgggcuuugcuguagauagaaugcuguuagaagguggggcaauucugacugaguaaagaaggaacagccauucuguuuagcacgagaaggggauguuugguguuuugugcguugcaggugcccuuguuuuugucuguucuuagagaaaaucuucaaguggcauugcuuugucuuggugugucaugucucagaauaaucuuauccgacguagguaucugugggauuguugauguccaggaggaaaacagagcuuaccuggcugugagugucagaucggcuuguaauaauauugagagauagcugugggacucagagcaguuucagguguuggaggcuguuuuuucuucuuucucaauagcuuuauuuauucuagcaaaaguauuuugauagcuauuuucagaagaagaauuaacaaccucucaauggauauaauaguucuuaucuagaacagcgauuaucaaagucuagucuggccacuggugucacuuugggaagcuguuuucacagguuuucaaugaaacuggaaaaauaagaaugcaaaacuaaaauuauuaauuuagaauguuaaucuuuacucugauuguauggacuucaaguuuucauuguugcaaacguguucuuaaaaauaacggcagagguagauguuaugugcauggaauuuguuuuguuuuaacaucuccauuuggcagaauaaaaauuuggacccuccugugccaaggccucauuaauuuuuuuuuacuggccuggaaaauccugggauccaugcacugaaggaccuuuagaaccuuacagaaguuuagugacuucauucucugagaagaauaagcaguuuuucaacuggagucauuauaugauaaacuauagccucaugguaacaaaagauauuucaaaaguacuuucaauaaauaugaauaaugagaagcagcuuuaaauuggaaacaagucauuugauuuagaacaucuguaaggauuuuuuguguguuuguuuuugaggcuuuucacaauauuccuaugugaagguccuccugaguuauucuucauuauugaauuuuuuaggagucuauuaagagaugauggugaagacaguggcacaagaaaugucuggagagauagcgccagaugacaucauccaggguucuguagacucuuauuaaggauucagaaauuuauccuaaaaaaugggaggaucuggaaccagccaaugggaggccauuagaugguuuuagacaagauaacauuuucacuuuaaaaagaugagucuggauuggaggucagcaaggguagauaugaggagacuaguccagaaaagaaaacagggugcguugaaggaugguggcgccaggggugagggagagaaguagauguucuagaaaaaaaucaggagggcgaaugagcugaaggaaucguugggugaggaugagggagugaggugucagcgugaccugcacauugcugaagugcuucgcugggcgaaugguggcauccguuccaggaaacauggggaggggaaagcuugggggcuaaagaaugaggaucguuuucauuugggguguauguuaaauuucagguggcagagaggcauccagcaggccacucggacuggcacucagaagagagacacugagagucacuggcauaaugauauuauauuugaagcccuuggagcagaugaacuuaccuagaaauaggauagagaaagagaagaaaagagaacuaggcaaaggcuaaguaacuugcacauguaugugucaagaagaggagaaauugccaaaguuaaaacaggacaggccgggcgcgguggcucaugccuguaaucccagcacuuugggaggccaaggugggcagaucacgugaggucaggaguuugagacuagccuggccaacauggagaaacccugucucuacuaaaaauacaaaaauuagcugggcauaguggcucacgccuguagucccagcuacucaggaggcugaggcgggagaauugcuugaaccugggagggagagguugcagugagccaagauccugccauugcacuccagccuggacaaugagcgaaacuucgucacagaaaacaaaaacaaaaaaauaggagaguaaguggaacaggaagcucagggaagagacugggacagguuaacuauguugaauauuauugagaugucagugguauuaugauguugggcaacuggaggucauuggucaccucgacuggagcaguguugggggcagaaaacagcuugcgguaggcuaagugugauuggcaggaaaggaacuagaggggagagauggcugcucugcguaauaaaucugacccacuucauaagaugugcgaagaugaaacguaauggcuuaguaauuaauugccaaaguaaacuuguaaacucauuuuuaugcaucagcuucucauacuaguuaacagcguaugucaacauuguugacauuagcuauugaaucagcuuuagcaaugauuuucacgcaguugccagaaaucucauagaccccaucuggccuaggaauuuauugcacuucaucugcuuuucccuacuucucccaaagagggaacacacagguguaauccauucacuuauucaacaaauacugcuugccuacuaugugccagacuccuaaacgcugggaaugcgucagccaaugagauagaugagguccuuccucucauggaggguuuauucacauuccuuugaccuaaauaucaguagcuuaauaggaugccaucccaucaaagcccagaagacaagugaaaacauuuucaagcucaugugaauucuuguacacguaggaaacaugccucuuuguauucaguguuucugcugaguuguacauaagaggacauuauaggaaaaacuugucugcaaaauaguuguugaugaauucaagaauugaaugaaugaaaaauugucuggcuagaguuguuuggcuucugguggguaugaaaacugacaugagguauguaauuuuagauuauccuucauugucucuuucugaguauuucaauaagacaagcacacaagggcuuucuggacuuuuaaaauucacuauuagaagcauacauuauuucauugagggucuccuaauucuuucgggcucaaauauuuuaaggagcuguacaaguuaugccauuuuuuaaggguauggcgcuuucauugagaccuuaauguucucuuuauauuuuuguguuuuuuuuagaauguuguguucaguagcucuguaauuaauuucucuuaaugaauggggaggacauucaaagaggcuuaaguuucuaucaaauaaccagaaaaauuagagaauuuucugacccaaacagucuuuuaaaagcacuuuccagagaguuuuuuguuuuuuuuuuuuuucugagauggagucuugcucugucucccaggcuggagugcagucacacuaucucgucucacugcaacuuccaccucccggcuucaggcaauucuccuaccucagccuuccgaguaccuaggauuacaggcacaugccacccagcuaauuuuugcauuguuaguaguaacggggauuucgccauguuggccaggcuggucuugaaguccugaccucaggugauccacccaccucagccucccaaggugcuggaauuacaggcaugagccaccaugccuggcccagagaguuucaaaugcauugaaauaucagauuuuuaccacuuaucuucacucuuaggagaccacugaggggcagggagaaagguagggaagggcagggagagagagagaaagagagguacuguggggagaggguuagagagaauugauucuaaguuggauuuuguuuccugugauaggguguacauaguauaccauccagaccacauaaucucucuucuuaucaucuguuucuaaucuuuaccuaucaucuauuuaaguuuuuaccugccuuaauagaguugucuguuauuaaacuguuuauaaacuuggggauaguaaggaacuuuaaauaacauuaaguaaguucauuauaauucuguuuuagggcuacucguggguuuugaagcugugucucccuguagaauucuuuuuugagggggaggaaguagcucuuuuuuccacccuaccccuaaaacuaaccuuuuugcauaaacgacuuaggcguucaugccaugugagccccugaaauacuguagucucauagcugccaacuuucuuauuuucugucacacuuauccuauuuccuugcagccagguucuaugccaauuucacguuuguuuauugcuaccaagagucguuaucaaccucagacucacuccacauguauuguugcuagcuugcucuuuaguucuuaccucuggggcaggucacauucucuccuaauacuagacagagcauuuucaacuuugcucacaguugucuaguaagaaaugugccuguaauuugauguuuauuuuggcuuuggaacccagggcgugcaaaugucauuauuaggaagggauaggagucauuacguuucacuuaauuugccgaguugauucuagugaucaccagaagcccugaacuacgcgcagauuauucuguuaggaauuaaauugaggcauugguuuuauuaucucugugggaagcuguuugauagaacagggaaagccauugacucugauucugucaccagcuguguaacuuucuacaagucacuaauggagcagggucuuaaguccacaacaugaucauaaaauuaagcacuuggguuaaguacccaucacaguauucccaacucauaggaaaacaauggucagauaaacaagaaaauguaaagcggaguaucuccucacagcagaacuuauuuacaaauuuuacaaaguaaaauuaaguugcaaccccuauaagucucuaaguagcucauuuauuagcaaaauaaggaaagccauuuaccaaugguggauuaccuaaauuguauucgauuguaguagcagaaguauuguguccagggaaaaugaaauuauuuuacaugucauugagaacccuuguccuggacuuugggaagaacaucaauaucaauuaaagaacaaagcaugugauuuuugagugauuuuucuugacugucaacauaccgauaacugaucaguuguugauauuuauuagaugaucauugccaaguuugaagugacugaagaguuagccucugaaucaucuguauaaaacaacuacaggcgaggauguuuucgaagaagcugagaaaauaaugauugaguauaaccuggaauggaaucugcuaagaucuauaaaaauugacaguaguaaaaauauuugugaguagaaaaaggcggaguugagcaaauucacaaaacuugugaacaugcgagguguuuaaagcucaugguuauuuauuauaguauuccuuuucagauauuuuguggaaaauauuggaaucucacauguguuauugaaccggcaauauaaaccaugagcuucauuugcucuuguggauauaaccgucaucauuucugugaauuaucagaaauagaggccggauauccugaugucucuugugacagagccauuagauagcuugcuagcuguaaaguuuugcagucuuugaguucacaguugagacugaaguuuuucuaaacgagcugcccccagccacuauuacugaacacgaauggcuuuggaaauuagcuuuugcuacagacuugauauuguuucuuaaugaauucaacgcaaaauuaccagacaaagccagacauaugugagaaacuuacagugugguaaggcaaauuugacagcuaauguuugaaucacagguaaugucaaccuacuuuauauauuccccauguuaucaaaaguuaaaacaaggugcuagaccuccauucuuacacagcuguccagcagauacauuuucugugcucaagcuacaguuccaggaguuuucugagcucaagcuacaguuccaggaguuuucugagcucaagcuacaguuccaagaguuuucugagcucaagcuacaguuccaagaguuuucuuaccuacucuacuuuaucuuauuuuggauuuguacuuuuuuaaaacaauuauuuuacuuucacagaacugguucuccagaggaaaggagauaaagacacuugauauguugaaugaguaacaaaagaaucauaaaucuguguggacuuuuuuugauaaguuuaggagaagguuccauuuugccacuaagcuuggacaacuuccccuaaaagagucuguucauuccuugucucaggcagugacgucaguguugggggccguccucaccucaaggagcgcagagucugguauugacaaggaacgcaaacagaugauuauaaagcagugucauaaacauguugaugagagugugcacaaaugcugugggaggaaaggaggguaugaauauuuucauauggaagauagaugaagacuucacaagaaagaaaaugcuugaacugaaucuuggaaguuagaaccagcaguucaccagguggggaaaaggcauucuagcaagagggaauagcacagacacaggcauggaagggugagagaugauaggaagugccugcguauggcuauaaauacuaaggggagugucaggagaugaggcugggaugguaaguuaccauggaaagaugaugaagggcccugugcugugugcccugaaaaucugguuugggaggcaaaucccaggacagguugcaacacacauggcugguaagugcagauaauacauccuaucaggucauuuacuuuuagugcuaagucagccucucuaacauaaauauuuuccaucuacuuuguuacauuuguucguuacucaauauauuugaaauauuagagccaaauuauaacaccuagcacuuuuacaaauugaauugaaacugaaaauccacuuaaugguuuaggauuuuagaaguuuucuuggaaagaaaagacuuauuuuaagaggcauugaaacguauaaaagagcaauaucagacuugauguugucuucacagauuaacuacuuuugaaauugcuuauuccguuggcaagcauuuguuauuuucugaaacuuaauuuucuuugcuuuucaguggacagaggacugcagaaaaucaaccuauccuccuucaggaccaacgugaguaaacaucagaugaucaaaacucccuuugaccuuugugaaguuuuuucuguauguaauaauugcucauaaacgaacgauagugaauaaaaucuuaagucauguuucccauuccgagacagagguuuguuucucagauuuguuuauuaugcauuuggcugagaucuuggacaaauaugaaaauaucuuccgauucaaaugcccgucgcuagacuaucaaaaucaucggaaagaaaaggauuuucagccagacgcgguggcucacgccuguaaucccagcacuuugggaggccgaggcggguaaaucauaaggucaggagaucgagaccaugcuggcuaacagugaaaccccgucucuacuaaaaauacaaaaaauuagccaggcgugguggcgggcgccuguagucccagcuacucuggaggcugaggcaggagaauggcgugaacccgggaggcggagcuugcagugagccgagaucgcaccacugcacuccagucugggcgacagagugagacucugucucaaaaaaaaaaaggaaaggauuuucauucuccacucaauucuccugucuaccaugaaggguuuuucucaucuuugacaaauguaagggcuguauuugaaaugaccugugauucucuauggugccuggauauaaaccaccaaauuauauuguaacaaaaaagcauaggcccucauaugugaaacguucucaaaauaaaccuuggcacaacaaagcugucgaggacaaaacaggauuggaacaccuaagaggaggaccaaugucaugauucaguguguuuaacauuaauauuuuuagucuagauuuuggucuuuccaaauccucaguguuuaaaugggccugugagaaagccauaauaacagcucacagaccccucagaguguacagaacagagaaaagaaggaacagguauaggggguggugaucuuuuucuccuacacugcccuuucgcugaaaguagccugcuguuuguagggggaaacaguacaacucuaucuagugauaucaagaugacauuuucaguucgugcaacauuccaaauuacuuacguuguacuguuguugucuaaacgauguauuuuaaauagccucugucccagauagcgugaaacuguaauaaacuaaguucuuuugacuuacucgccuuuauguagaaagaggccaguauuuggcaggaagcaauuuagagguaaccaguuuggauguuguuuggggccaguguucauuccagcucuuucuucaauggccugcugucugaaagucuuccuuucugucaucacuggcaucauucuggccuucagugacaugucugccuuacugauugauuaugucucucuguuggucucacugccccaauucauugaacauuuaaugaggugccuuccauguuugaggccguuucuacucccuuuuaggugcacuuuacaugugucuauaaauugaaugcccugcaaaccauaaaccuuuccugauuaggcauuuuacugacucuuauugccaugugcaugugagugugugucuaccuaugugcauacauaccuacauguauacauacauauguacuccaaaacacauacacguguauacauggacauaacuuguauguuucuuuccuugccuucauuuuuucgcuagcuuucuuuuuaucucacuagccugcuuuccuacacaaaaagccucggcuuugcucuuauccuucucuucucucaacucuaucaauggaucuugagauuuaggagauaacugugguauuuauguaccuuugaaugacaaacagacguucuguuccuuugagaucauccuuuucaauuaagugcguagauuugggcagcauccaugggcagauaugagggaagaaaaagauaaccuguuuggccagcaugacuagucaaaucaaugcugaagauaaaggaacugauagccagaucaccccugaguccaucugagucccauucagcauuucuuucccacugcucacgggaugccuagcacuugcucucuuauuuguauauguguguguugugucacuuggacuaguuuccaugccaccuagguagccauguggguucaggugauguugcugauauuaugaauggcauggacauugcaaacacuaagucucaaaaaugaugaaaugauauuucuuguuugcagugaaguaggaaaauaaauugugaugacuacuguugauugaauaccaaugcugcuaaguguuuuuuuuauuuuugcauuuuucauauagugucuucccugcuguuauaagguggauacucuuuuauucuuauggggaaauggaggcgcacaaguuaaauacugaaauguuuuagaaaacuguuuaacgagagguaaaaugugcaauuauggcuaagcuuuagucauuaaaauaauuugguuuauuagauuaaccaguucucucaaauucuaauuagugcagguuugaugguagagagguuuguggggucucaucauccccacuucauuguaaucccuucauuguccguuguguuguguucauccccucucaucgcgucucugagauccaugaaccuacccaggacucuaggcugaaaaagaaucaggaauuuauggcggguauagaggcaugauuugggauugguuggauguuaugaggugaggagcagcugauuggaguucauagggaugagaugcauaucuccaacaggccacugaguuaucuuugcuacuagacauagaaaucuaaaugcacaguugaagggagaggggagacuaguaauaccugcccauaauauggggaacaauaauuacuuacugaauugugggacaaaauuuuacaugugaaauuauggucugucagaaauggaauuaauuuguugugaugaaaaguuuuuuucuagaauauaaguauuguagcauuucauguagauaucagcuccuaagaaaauggggaacuugaaaaugcuuugagaagaacaaaauucguucacuaugauuuuguuuaaauguacauuuccaaaaucgaauauacuuuucugucuaaaucacaaccugaaugucugcuaguuaacaguuucauaaaaccucauacauauaccagggccccaaguuacacagcauuauuuagagaaccaaguaauuauuuaugauaguggaaauauaaauagaaccacaguucaugacuuagguaauaacccauccccagcuauggacauaagucuagauaacauuucuauuuaggagacugguaucauuguggcacauaccagagucacccugccagucucaggagcagaucaguggaacagaugaugguuauuuuuaggcauagguuuauacugauaaaccacuaacuggcacacccuuaaaagcuauuucaguuuaguaaccagggccagaaaauaauguuccuauagcaacaaaaauaguuguagaauucauccaccagaaauauggcccagcuucacugauaagugacuggauguugcuauauccucagaaauugcugcacguaaguuaaagaguaggaaguuggaggauaugacagaauacagcuugggcuuggacuuuguccaggaaaaugagaagagaagagguauauaguagggaagauuaggauggcugacagaaucaugaagguucuugaagcugaucgugggaagauaauacauguugccaucuggggcuuaaaaggugaucuuccugaaggcaacacuggagacauugguuuggcaauaguguuacacucucugagagagaauucugaaacuggaaaccaauuggagaauugucuagagcccagacuaaaucuuugcagauauuuaggagaaaaaaaaaauggcagguauuucccgucagugauaaucagguuagagcucuuaagccauaguugauuuuuucauagaaaaccaauucacaugaaccuucccuacuagaucauucuauuccaggauuucugugaccgcuuaugauuguguucucaaccuagaagcacuagguagagaaugaacuuucuuuccaaauuuugguuuggguaaccaaauucuacacugcuguuaagacuuugccucucauauauucuuauagauguaucuaacugacccucacaaaaaacccuuucaucauuucaagaugauacaccucucauuacagguacagaggugcaguuccaugguacaccauaaaucuugacuuaccacccuacaaaagauggcaugaauugaugcuugacaaggcaccagugguaugcuaugaugcuuaaaucuuuuauuucuuuauuuuuauuuuuuauuuuauuucuuuauuuuuauuuauugauugauuuuuuuuuuguuuugagacagagucucacucugucacccaggcuggaaugcaguggcacgaucucagcucgccgcaaccuccgccuccuggguucuagcaauuucccugccucagcuucccgaguagcuggaauuacaggcaccugccaccaugccggcuaauuuuuguauuuuuaguagagacaagauuuugccauguuguccaagcugaucucaaacuccugaccucgagugauccucccaccucagccucccaaagugcugggauuauaggcaugagccgccaugcccggccauauuucuuauuuuauuuauuuauuuuccccccaaggaccguggagauucuauauuaaaucuuuuauuucuaacuuuauuaaauauuauuguauuuuuaaaagaacacuucaugaaauuacccacagaauaguuuaaaauugugcuuuugauaccuuucugcccuauacguuaagugacagcagaggaaaagaggucauuccucuguagccuuuguucuuuuuuguaaacuuuaccuuuguuucuuucccuuuaugucaucucccuucauguaaauaauuaagaaucaaauucacuuuaaagauaaaauuagacuuacuguauuaauguauuaaucgaggccaggcacgguggcucaugccuguaaucaaucccaguacuuugggaggcugaggcaggcggaucaccugagaucagaaguucaagaccagccuggccaacauggugaaacccugucucuauuaaaaauacaaaaauuaggccaggcgcgguggcucaugccuguaaucccagcacuuugggaggccgaggcggguggaucacgaggucaggaguucgagaccagccuggccaagauggugaaaccccgucucuacuaaaaauacaaaaauuagccaggcaugguggugcaugccuguagucccagcuacuugggaggcugaggcaagagaaucgcuugaacccgggaggcagagguugcggugagcagagaucgugccauugcacuccggccugggcgacaagagcaaaacuccgucuuaaaaaaaaaaauacaaaaauuagcugggaauggugaugcacacuuguaaucucagcuacuugggaggcugaggcaggagaaucgcuugaaccugggaggcagagauugcagugagccgagauggugcuacugcacuccagccugggugacagagcgagaugcuguuuuaaaaaauauauauauaaauugucaaauagcacucucuuuuagcuacauauggguaagccaaaagguaaucuugacagcauuucauuaugucuuuuaguaagcauuuuauuuauuuuucagcuaaagguuauagugaauucucugaagaauaugauaaauacauucgugccaaguggaaaaauuaugcaggugguggaugaaaaauugguaagagauauuauuucucacaauaaauguuaagcacauagaaaaugcgcuguuauuuauuuaaaggcauaauucagcaaccucuucgcagggacuugggcaaaucugcaugaaucuagcucacugucagaacuucagagggacuuaaauuuggggaauugguaauauuaggguuacagcauagcaaauuaugguuucguaaaaggggaugggacuacauuacgacauugggcaaauaaccauauuucaucugggagugugguauuuccuucccuuuauguagugaguucacuauugaagacuugguuuuuuuucuuaagugucucagggacauccagagauuuuuuuuuuguagauaugagcaaaugacauacucagccuggccccuuauucuguagaguuccucaguagcucugacccugaaacucauuugggcugaguguuucugugcaaucaccaaaccauuucauuuucauccucaucaugcaggaagacuccauuucucagccccguuuuuguugacgcagaaccaaugaaacaccuagggccuggccccuagaacuguuaaagggauccucauugcucuugauggcagauuuugggcauuaaugacauuugggguugggcagcuuuuuuuuuuuuuuuuuuuuugagaccucaucucacucuguagcccaggcuggagugcacuggcaugaucauagcucacagcugccuugaucucccaggcucaagggauccuucugccucagccuccugaguagcugggacuacagucacgugccgccacacccagcuacuuuucugaauuuuuaguagagacggaggcuugcugugucacccaggcuggucucccaacuccugggcucaggcgaucuucccgccucaaccucccaaaguguucucccaaaguguugggaucguaggugugaaccgccaugcccggccuggguuggauauuucuuugucgugggcuugucuacauuccaggaugcccggccuggggugggugucucuuuuuuguggggcugucaugugcauugcaggauguuuagcagcucaggaugcccggccuggggugggugucucuuuuuuguggggcugucaugugcauugcaggauguuuagcagugucccuggcccuuacccacuggaugcugguaacacccccucaguugugacaaccaaaaauguccuuagauguuaccaaaucucccguggucgagaaucauugcccuagcggcugagugcuguggccacauccucccuaugacacuuguaccugccaagcaccaaacccauuaucccucacgugcaugcucucggagcuuuuguuucaggcuauccuuuauguucauacuuaccggacuuccucaaaacaaaaaaaugcuggcaggagcaaaagaggaugaggcccccacguuccccguaugccuuaaucuccccucuacucugaauguuaucagggagggcaacauugcagagaguuuuugugccacgccuuggaaucggacaauacuggguuuuaaggcuggaucagucacauacuagccuuguguccuagggaaaguuucuuaaccuaugaaaccucaguuuucucaucagggagaauaauaauuacuaauauauauuucauauggugguuguaaggguuaaaugacauacuguguauaaagcauagugcuuggauguaauaaguguuuaauaaauacccauuacgucacauuuguuuguuaaauggcuggaacauuccacuuggggaaugcuuugaguuccuagggagaaaaaaaauauguuuaggugacauuacauguaauuaccaaguugguuaaaaaagugagauucgugaauuuuaagcagauuaucucagcaaaaggccgugaacuuaaguugugaucuggauguuaguaguugccauugagaauaaauauaugauguccaccacugaauuugcucaaugucucugguuugcuaaaagaaugcaguuacuucaucuuagcugaagaucagccauuaaccaugacacagggcuauggauagaauagugcagguuuaucucugugagugugggaaggaaaugguaagaacgguauaugccaguggcuagagggugaauucgugcagagagauaaggagugcuuguuaugauguuuuuguggugugggucagguuaggucauccaaguggaauuacucucguuccugccuucucuggagaaugauggaaaaauaaggcaggaaaaacaaucugagaaucuggucucuguauaggggcccaauauucaguauuacauagaaucuuuuuauaacuacaugauguaaaaaugcuuuaaaaaauaauuccuaucacuuauuaugauagcaguaucuagaaaaaauuauauguccaagaacuagauuucaaagcaugcuuuuauuauauuuguuuauauuauauuauauauuuuuuauuguuauuauguuaaaugcuuuuauuaauauauuuguuuuccagccuggccuacuuggcaacuuuccuggcccuuuugaagaggaaaugaaggguauugccgcuguuacugauauaccuuuagguaaaguucacuuagaagcuuuaaaaaaaaaaguaauuaaauucuuuuacaaguuuccauugaggugugauauacauacagcacaggugcuguaugucuuagauauacagcacaggugcacaggucuuagauauacagcucagugaagcuucagaaaugcaugcaugcauguagccaugacucagaucaagauacggaagagcccagcacuccacgaugcuccaucaugccccuuugcagaaaauacugccuccuccaguaaacacuauucugaugucacuauagauuaguuuugccucuucgugaacuuuguauaaauagaacugaacaauaugaacuguccugugugauuucuuguauuucauuauggguggugugcuauuguaucaacaggguauuugggugguuuucagauuugugauauuaacaauaaaggaauuauaaauauuguaguacauuuugggggugucuggguacucauuuucuggauauauaccuaggaagugaacuguuguguuauagaguaauuguguguuuagccuuauagauucugccaaacaguuuuccaaagugauuccagcaguugacaaucagcagaguaugagaguuucaguuuucuccucuugauaauucuccucucgauagugucagucuuuuuuuuuccuuuuuuuuuguuagugucaaucuuuauuugagccuuuuuguugagugucgcaguaucgcauuuuaguuucaauuugcauuuccuugaugauuaaugagauugaacaguuuauugacuuuuuuuuuuuuuuuuugguuuucuuuguuucuuuuggagaagggcuugugaaggucuuuugcccuuuuaaaaauuagauugaaggaauuuuuuacauacuuugaauauaagcccuuugucagauauauggauucugaauaucugcucccagucuaugaccuucauuuuuauucucuuacuuuugucuuuugaugaacagaaauuuuuaauuuuagugaagucuaauaucucagucuucucuuuuaugaguagugccuuuuguauccauuuaaggaaucuuggccuaccccaaagucauauauauaugcuuauauauuuucuucuagauguuuaauguuuacuuuuuacauuuaggccuaucaucuauuuugaauuauuuuuguauaugcuaugacuuaugggucaagcuucagguuuuucucaugugguauauccaguuaguuaaacagcaucaauucaaaaggcuauccuuuccucagcaaauugcaguggugucuuugauauaaauauacaauacauauauauauacacacacacacacacacacacacacacaauguguaucuguauauacaaucaggugauuguauauauguuguuuuguuuggggaauuaaguuucauuuacauauuugucuuuuugucuucccuuauaucaauacuauuucaccucaguuacuaaagcuuuauaguaagucuucaaauuaggugguauaauucuuccaacuuuguuuuucucaauauuuauuuaaguuacugauuucucugagcaguaucuuuuauuuucagggagaagaccucacaugccauucguuaaaauuauucuuagauauugaugguuugggaagcuauuuuuaaaauuucaauuuaagcuuuauggcauguaacgaaaaauauuuuccccacgaccccaaaaguuuuaucuuuaagcuagcaaagcaguagugucauuauuuuaaauagccaacaguaccuucauuuuaugagaugauugagaauuugugaaaaucaguaguauuuaucaacaaaaguggcuaguuuugugugcugcuucuuuaaaaaacucauuuaaaagauagcauacuggaaauauguacuugcugccuuuauggaaagcaagucuaauuccuuuauuauguaaagaacucuagcaacucaauaccaaauagaaauaccuuauggauuaagaagaauaacaugauguauaagugguguaaauuuauauaauuauuauaaauuauuauaaauguauaauaaaauaacuagaauuucaccaaauuagaaauuuaauggaaauaaaauacacauuggauuugggugaaaaaaacauguugagcuuaacauguuaauguuaaaugggacagaaauacaaugugcugccuacuuuugaauuaaaugcuaaauagcaguauuauacauuuugggaaaauauucaaaaaauaaaauacccuagaauggaguuucuuggcagcucuguacuaauuuuaauaguucuugaaucuccuuuuucaccuuagaaauuuuagucacacuuuaaaaaucugggcaaaauauauguccagcaaacagccaagagccagauguauuaaaugaucauauuuacgcucccaaaagaaaauucaaaaugaagcauguugauaaacauuuuggaugugauguuggagaacaauugcaaccugcccagauguucagcucgcccgaaggcugccuccuuggugacuuguuucaucuugagucuagagaguccaggcuggggaagaaaaccaccuccagccggccguuccagcacagccccacuggccaaagcacacacucacacaaugaaaacacugaaacuuuuucuuaaaacaaauuuuucucccauugucaugguucuguauauuaacacaaaauuuucuuuucucauaggagagauuauuucauucaauauuuuuuaugaauuauuuaccauuuguacuucaauaguagcagaagacaaaaaagguaauugugcgcugagggagggugggcagcaugaagcacuacauaaagaaaaaucuucuaaaugaaauuagaacuucugaaauuugggcuugcuauguaaauucuguguauguugcauacagcuuuuuauuucuugguaaaauuuugugauuguacugaaaauuuuccuuauuuucagacuacuguacugccuauuaaaguugauuucagacaugcaaaaaaccuggaagaaauguugcagggcuagaaacauucuucucuuccucauaguuuacuucuacccaucuacaugcuuugauggaagugcucgcaggaggugcuuccuuaucuucguguaugucaugacaucuguccuuuucuugaggcccagaacacacauucucccauccuuucccagccaggcaacccaauggauaccagccucacuuucccauauuuuuccugacugguucccagaguacaaagcacaggacaacuucgcuaacucacccugaucuuugaccuauacucuggguauaaaucugccuguaccuuacccuugagauguccugcucuaggggaugaugccugaagggaaacauuugaugaaucacaguaauugaggcuccgauuucuguguccugguagaaccaugugauagugaaccaaaacaugaccauugauuccuuuucccauauucugaucuuaccuggaaacccgugcucucagauuuugugggguuaucuggcagauagacggugacaacagucccaucuggugaaggcuuaggauauuaggauguuucuuacuucuuauuguuugaagaaacaguugugaauaaaaauuaaucaaaauuagaggccaggcacaguggcuuacaccuguaaugccagcacuuugcgaggccgaggcgggcgaaucaucugagguugggaguuugacaccagacuggccaacaugguaaaaccccuucucuacuaaaagaaaaauacaaaaaaaaaaaaaaaguagccaggugcggucgcacaugucuguaaucccaacuacguggaaggcugaggcacaagaauugcuugaaccugggaggcagaggucgcagugagcugagaucgcaccacugcacuccagucuggccaacagaacgagacucugucucaaaaauaaauuaauuaaucaaaauuaauuguccagcuuugauuuagaaucuuaacugcuauuacacgucucuucugucuaccuucaaauaggucaucuaauacaugggagaaacauggauuuuggaguauuucuuggguaaguaaagaacaaagggucaggcauggugguucacgccuguaaucccagcuuuuugggaggcugacacggguggaucacgaggucaggaguucaagaccagccuggccaagauggugaaaccccgucucuacuaaaaacauaaaaauuagccaggcaugguggugggcaucuguaaucccggcuacuugggagccugaggcagagacuuuuuugaaccugcgaggcggagguugcagugagccgagaucgcgccacugcacugcagcuugggauacagagccagacuccaucucaaaaaaaaaaaaaaaaaaaagaacacagaacuguuuuggucuguaggaagaguagguuguguuauauugaugauaaguaagucccaagucacacccaaaaugugaucauaagugaagauaaauggauugcuugagugcugagacaagagggacaugcucuucuauuuuauguguccaucuugaccuuucugaaaaaauaagaauauuguaauuagcauucuauguuugaaucugaggcucacuauuuauaagcugugugauauugagagaguuaccugacuucucugaaccucaauuuuaucauuuggaaaacagaauaaauauaccauauuguaaaggucuuguuaggauugaucguggugacucgguaaauaaagcuccuaguguaaugccuggcccucaucaucauguugaucauuacuaucacuguguuucugaaaugucacugaaacaugucuuuuauagguggaacauaaauaaugauaccugggucauaacugagcaacuaaaaccuuuaacagugaauuuggauuuccaaagaaacaacaaaacugucuucaaggcuucaagcuuugcuggcuaugugggcauguuaacaggauucaaaccaguaaggagucuguuguuacauaauuauacagguagccuucuguccuguuaccguuauguaaaaguugaaaucuaagaauaugaggaccuaaagggaauaugaagccccauuucacccccuuguacuucuugucacuucauagguaugagaucucgugguagagaagaguagaaaggaaacggagguuucugagccucuucugggauaaagagcauguggcugggugucaagggcugggagucacaaucugauuucuaguccugggucuuccgcucacuuaggcaagucaggcguucauucucugcccuucaguuuccuguccaaaaagcguugccagugauaccccaccuacuuaucucacauacuagaaucaaaaaugcuuugaacuuuuuaaaaagccuuuuaugguuuugauuuauuuuugccuuccccauuacccaagcuaggccuuuauaucccacucugaaguacagugagcgacagggccuuaaagcgcaugguugauguuucugacuucguugcuuugucuuuuucucagggacuguucagucuuacacugaaugaacguuucaguauaaauggugguuaucuggguaaguagagcauucucaagugaaaugggaaucucagagcuuuuuuaugaggaaggcuggacugugccuucugguuacaaaguccaaccucuuccgguucccgacugguuacaaagucuaaccucuucugguuccugacugguuauauaguccagccucuuccggguccugacugguuacauagugucaccucuuccgguuccugacauuguguucaucucuuccagguauucuagaauggauucugggaaagaaagaugucauguggauaggguuccucacuagaacaguucuggaaaauagcacaagguaaaguguuucguugcuuuacuauuaaauauuuauuuuaaauuacucauauuaaaaaauaaaaauauuugucaagcuccagcuuaauccuuugaggaacuauugcagaauuucuuaggugaaccucugacacucauguggaauuacucauguuuucuucgugcagacuguguguuuuauagcaaauaaaugaauuacuuaaaaagcacuagggauacugacauuaugaaaggcaccuaugaauauuuuugguguacagaaaaaaaaugacccacacacaaaagaacagucauacaguaaaaucuucauuuaaaugguaguacagaccaggcacaguggcuuaugccuguaauccucacgcuuuggguggcugagauagacagaugacuugcacccagggguuugagaccagucugagcaacauggcgaaaccccgucucuauaaaaaauacaaaaauuagccaggcauggugacacgugccugccuguagucccagcuacucaggaggcugaggugggaggaucaccugagcccaaggaggucgagacugcagugagcugggaucaguccacugcacuucacccugagugauagagugagacucugucuuaaaaaaacaaaauaaauaaauacaaaauguacuacauauuaaccuguaaguuauaucuugccuugguauagaaaucuuacaauagcaaaacugccuuuccuucauucagccagcacugcguccaaauaaaugggcaucaauccuauuuuuaauacuucccagggaauaagauuuaauguuaguaguguucuuugauaacccacuucaauuuuuaauaguccuaauuuucaagaagguuuacuuucuguucucuaaguccuacauacuguaauauuauuucccuuuguucuguuguugagugaaaggcauggacaguaaggguggaagaugaucucuugaggccacuuuguuucuccuucagauuagaggggcuuccuaagauucccgcuucccaucucaguguucaccauacagggucagggauugcuuuucccagaggcauugcucaccauccuuuuuuagaaaacacauuguggcuggccaugguggcucaugccuguaaucccaguacuuugggaggcgaaggcaagaguaucgcuugugccaaggaguucgagaccagccugggcaacagagugagagcccaucucuaaaaauagaaauaaauaaauaacacauuccuuagauacuuguuuuucuuuaguuucuacagagcuaaacauuuccguucuaagucaucuaaaaauguuucccaccaucauccucagcaaacuaacacaggaacagaaaaccgaacacugcauguucucacucauaagugagagcugaacaaagagaacacgugaacacagggaggggaacaucacgcaccagggccugucaggggguggggugaaaggggagggagagcauuaggacaaauaccuaaugcauguagggcuugaaacuuagaugauggguugaugggugcagcaaaccaccauggcacguguguaccuauguaacaaaccugcacguucagcacaugugucccagaacuuaaaguaaaauuuaaaaauaaaugaaguuauuuacuaaaauuaaaaaaaaguuucauuuuucuuuuuaaauguuucuauauaguuaugaagaagccaagaauuuauugaccaagaccaagauauuggccccagccuacuuuauccugggaggcaaccagucuggggaagguugugugauuacacgagacagaaaggaaucauuggauguauaugaguaaguagguuuguuaaagcaaaagaaguagaaacaaaagcauacacugauauacuuugaguuuuaaggcauguagccuaagagggaaucucuccuuuuguaucuagacucgaugcuaagcaggguagaugguaugugguacaaacaaauuaugaccguuggaaacaucccuucuuccuugaugaucgcagaacgccugcaaagaugugucugaaccgcaccagccaagagguaccuuugcagggucaucuauagaaagaaacuguugccauuaaagauucccuugguucuggcauuuuucuuuggccuucaaguaauuuauaaacguccuauuuuucauaguaucucuagccacucuccacugauuuuuuuguuucguuuucuuaacuuaaagagcaaaauugugcuguacuuuccuuuucugguucuaaugcuggauaccacucugaaguugaauaacaaacaggcaagaauuuaaaaaaggggaaggagagagaggaaaguaauccauuaaaacuguuaccuguguuucuaacagugacucccacagaaacuccacugcggggauggaggggagguugauuaaagaaugucuugguuucugguggcccauguguguagauaaggcuguuggcuucuguauuuaacuuacugaacaaaacuauuuucuuguguuuuagaauaucucauuugaaaccauguaugauguccugucaacaaaaccuguccucaacaagguauuuuaaauguuauauguauauuugccuuuuagggaaagaauuuggcccuauguuuuaucuuucucuguuaucuuugaucaguuugagcacaaaagguguguucagcuuaggacugauuuuuuauuaaaaaauguuuuuguguggcuaaaacuguauuuuggaauacaagaaagaaauugaucacugaggcuugauaggucagaauauuguuuauagcuuuauuuacauagcauuugaauuaaggcuagcauuuuacucuuauugguaucuauuaaaaaucucacacuauauaacuaacaccuaaaugucaacaaaacaaagucugcaguccauuuucagacagagcucugugucuugguggguucggguuucccuuaaacuuuacuacaucuguuuaucuuuucccuacacuguaguuuuaaaaaaaugcaaaaaguuuccuaucaucccaccacucgcuaacaaucauucccugaacguucugaauaugccccccuaauuuucccauuuguuccuucuuuucuugguccuucuccacagcucucccuaaaguaaacaugccgccuuuacccugccaggacaaaucccuccggccuuuagcauccaggucacccuggcucucacaggaagccugccuucaguucacgggcccugccauacuugcguuuugccuauaccaucuuugagcaagucacaaucucgugacuuguguuugggugugugccuugugaucugggugccugcaguuucccccacuguauuggaaaugcuuuaaggauagggauagccaaagcuccacgguuuuuacuccauaggacaccggcaggucucccaggacugccagcugugcgucaaggaggguuaaggcagucuuaaagcauuggggguggagcaaugugcugucaggaauaagcuccuauaaggagcuggagauucuuuccugagccuguuuauauucauuaccugaaacagugauccuguugaaguuguuugcuuuaguuauuuggugagacuuuagcuaauuuuauaugauuauacuauauuaauauaaauauauacauuauauaacaugcuuugcauauauuaaguuauauuauuuaauauuaaauaacuucuaaagcaaauucuacaaguauagaaaugcuaauauauaucagaacaucucugaauugaaaacguccuuaaaguaaaaauaacuuuucuuucagcugaccguauacacaaccuugauagauguuaccaaaggucaauucgaaacuuaccugcgggacugcccugacccuuguauagguuggugagcacacgucuggccuacagaaugcggccucugagacaugaagacaccaucuccaugugaccgaacacugcagcugucugaccuuccaaagacuaagacucgcggcagguucucuuugagucaauagcuugucuucguccaucuguugacaaaugacagaucuuuuuuuuuucccccuaucaguugauuuuucuuauuuacagauaacuucuuuaggggaaguaaaacagucaucuagaauucacugaguuuuguuucacuuugacauuuggggaucuggugggcagucgaaccauggugaacuccaccuccguggaauaaauggagauucagcguggguguugaauccagcacgucugugugaguaacgggacaguaaacacuccacauucuucaguuuuucacuucuaccuacauauuuguauguuuuucuguauaacagccuuuuccuucugguucuaacugcuguuaaaauuaauauaucauuaucuuugcuguuauugacagcgauauaauuuuauuacauaugauuagagggaugagacagacauucaccuguauauuucuuuuaaugggcacaaaaugggcccuugccucuaaauagcacuuuuugggguucaagaaguaaucaguaugcaaagcaaucuuuuauacaauaauugaaguguucccuuuuucauaauuacucuacuucccaguaacccuaaggaaguugcuaacuuaaaaaacugcaucccacguucuguuaauuuaguaaauaaacaagucaaagacuuguggaaaauaggaagugaacccauauuuuaaauucucauaaguagcauucauguaauaaacagguuuuuaguuuguucuucagauugauagggaguuuuaaagaaauuuuaguaguuacuaaaauuauguuacuguauuuuucagaaaucaaacugcuuaugaaaaguacuaauagaacuuguuaaccuuucuaaccuucacgauuaacugugaaauguacgucauuugugcaagaccguuuguccacuucauuuuguauaaucacaguuguguuccugacacucaauaaacagucacuggaaagagugccagucagcagucaugcacgcugauuggguguguacaucuguguugguuuggaggagggggguuauuaucaagaaauacaagcugaacaucguaucugaauuaaauaacaaggguuauguaaguggguuauuaaauaugacuaaacggucacaaucuuacucuuacaugacugauaccaccucuuaaccagauacuaucaacccaauuugcagguguuuaaaggcaguuuuucccccagauagguggugcuuccacaaaacuuuagugauuccaagauuacuuuagugaaacgaggaauuauaagaggauuuacauuaaaauaggauuuaauuaaugaaaaaaaaacuuuacucagauuuucuaccucuuacauaaaugaagucaggucaacuugauguauuuuuuuguuaauguaauaaccuuugauaugccugauaguaaagaggugagaugcuaauuguuucagaccgauuucuccggaguaaaucaaaguuuacaagaaauaacagguauuaagauuuuaggaaguaauuguuuagugguaaagcaguuuuaaaauaggauauacaggaugagccuguuuauauaacacuuuauauauguacuuaugcauaacuagauacacaucuagaauaucaaaagaugacugggaggauauuaaccaaaaugcugacuguaguuccuacuggauaauggcaagugcuauuuuaauuuugagaggacaaaacuuag

SEQ ID NO: 15600 - RNA, 3377 nt, Homo sapiens
cagucgggucccggcagcggcugcagcgcucucgucuucugcggcucucggugcccucuccuuuucguuuccggaaacauggugagcggcaggccacggcgccugagggaggcggcugcgggucggucgccugcgcgcgggaagcgacuggggagcgacguccgcacccccucccccagcgccccgggcgggaugagggucucgcacgaaggggcgggcggugccggaaugcgcgugcgcgcccgugggcgccggggagggccggucuggacgucgcucgcgcuccgccugggcuccccucccccacccgcuggugcgcccgcgcggacaccggccgcggggggagggguucggggcgcgcgcuggggcgccccucgcggaacggccggcgucgcgccuuucuucuuaggggcgcgcucucgacuggagcaugcggcguccaaacccggcccgggggcggcgaggaaaaagcgcgcgagaggucucggcgcgcgcgccccacccaaggcuguuccugucugcgcgucacccucccucggcagccggguccgucucgggagcagguggcagggaugccugcgcccgggaggggcgggugcuggcgcggcgaggggugaugcugggaagacggggucccgguuggggcgugggugccugcgauuaaggccuugcaccgcaaggcuuggagggggcaucgcagagaccgcggcccguucgggagcgcaucuaacgagcugcguucucacccgugcaucgggcgagggcuggaacggcgcugucugucggcgcgugcgcgcacgcucaggcccggccgccggugccgaagcccugggccagcgaggccuucccggaugggccugagugaggguggagccgaguuuagggaagugacccaggcgggcaccgcccggaaaccaccccgcccccuguauacggcccgagggcugagaaaaccgaagguuauguagcuugcccaggcuccugccugcaggagaugggucugauacacccguuguuuuagggcgauuccacaggguuagggaccuggagaugcugcugccucucggauacgcguuucugcauuggugagggggccgggcccagccgaucuccuguccccgcccacuccggaugcggccgagucacguggccggcuucuucugcaguuccggggaguuugggggaccagauuuaccuuggauugccccucccucuccuggcucgggcaccccgaagcacgacgcagaguaggaagaguuuaaagaccucgaggccucugggcacuugaguuuggcauguuaauuuuuaucagcgacuucuggggccuagcaccauucccggaagaagggaguugucgggcaggguccuuaauggggguugcaauucuugucuugguugggaaagagccuagcugggaacaggggucguuuguguaguaacuguauuaagcaguucugguggguuuguuguaacuguucgguguccuuggggucccaucuagcauuguggggucuuggcucuuucugaagaggagucuuggcucagguguuuggguccuccauauccgaaguucuaaaucaccaguuuuauccaaaggcugagagcaaguacugugaguagcaaaugagucaguagccgguggaucuuuuaauucuggguucacauuuuggucaagguucugcuuuucacgaguuuugcauuucuauccuguaaaaugagggaagggguuguugaacuaggugaucagaggccauggcugccauucugagguugugucccaucugguucuuugacagugacuugggugggaaaacuagugacuugccuugggaagggcacuagugaccacucgggacguggacugagaucuucugaaaaaacaaggggcaguucccuagaauccuuuucuugacguauacguggcaugucuccuaggccuccgguguggcugucucugauggugucaucaagguguucaacgacaugaaggugcguaagucuucaacgccagaggaggugaagaagcgcaagaaggcggugcucuucugccugagugaggacaagaagaacaucauccuggaggagggcaaggagauccuggugggcgaugugggccagacugucgacgaccccuacgccaccuuugucaagaugcugccagauaaggacugccgcuaugcccucuaugaugcaaccuaugagaccaaggagagcaagaaggaggaucugguguuuaucuucuggugagcucauucuggcacuucuuccugucaccugcccccuuucucaugaugggaacuucuguggcuccuggucaacccagauguguggguuuggagggggaggggguuguaacaaaagacuccucacugccagcccaaggguuucucaaagucaccuguggcuuugcuguugcugggaguugccugacgcguguuucuguccagggcccccgagucugcgccccuuaagagcaaaaugauuuaugccagcuccaaggacgccaucaagaagaagcugacagguaagggccagcauuggugcugagugcccuucugcucuggccuuggcugcagggcagggugaauggcacgcagagggggucugcccccuugucuucgcugccugcuuguuccuuccaucugcuuugauuggcuccuucccagccacagaaacuacccccaccccagugcuuccugcucacagaugcuccccuuucuucuuuauagggaucaagcaugaauugcaagcaaacugcuacgaggaggucaaggaccgcugcacccuggcagagaagcuggggggcagugccgucaucucccuggagggcaagccuuugugagccccuucuggcccccugccuggagcaucuggcagccccacaccugcccuuggggguugcaggcugcccccuuccugccagaccggaggggcuggggggaucccagcagggggagggcaaucccuucaccccaguugccaaacagaccccccacccccuggauuuuccuucucccuccaucccuugacgguucuggccuucccaaacugcuuuugaucuuuugauuccucuugggcugaagcagaccaaguuccccccaggcaccccaguugugggggagccuguauuuuuuuuaacaacauccccauuccccaccugguccucccccuucccaugcugccaacuucuaaccgcaauagugacucugugcuugucuguuuaguucuguguauaaauggaauguuguggagaugaccccucccugugccggcugguuccucucccuuuuccccuggucacggcuacucauggaagcaggaccaguaagggaccuucgauuaaaaaaaaaaaagacaauaauaaaaaggcucauuaa

SEQ ID NO: 15601 - RNA, 3377 nt, Homo sapiens
uuaaugagccuuuuuauuauugucuuuuuuuuuuuuaaucgaaggucccuuacugguccugcuuccaugaguagccgugaccaggggaaaagggagaggaaccagccggcacagggaggggucaucuccacaacauuccauuuauacacagaacuaaacagacaagcacagagucacuauugcgguuagaaguuggcagcaugggaagggggaggaccagguggggaauggggauguuguuaaaaaaaauacaggcucccccacaacuggggugccuggggggaacuuggucugcuucagcccaagaggaaucaaaagaucaaaagcaguuugggaaggccagaaccgucaagggauggagggagaaggaaaauccaggggguggggggucuguuuggcaacuggggugaagggauugcccucccccugcugggauccccccagccccuccggucuggcaggaagggggcagccugcaacccccaagggcagguguggggcugccagaugcuccaggcagggggccagaaggggcucacaaaggcuugcccuccagggagaugacggcacugccccccagcuucucugccagggugcagcgguccuugaccuccucguagcaguuugcuugcaauucaugcuugaucccuauaaagaagaaaggggagcaucugugagcaggaagcacugggguggggguaguuucuguggcugggaaggagccaaucaaagcagauggaaggaacaagcaggcagcgaagacaagggggcagacccccucugcgugccauucacccugcccugcagccaaggccagagcagaagggcacucagcaccaaugcuggcccuuaccugucagcuucuucuugauggcguccuuggagcuggcauaaaucauuuugcucuuaaggggcgcagacucgggggcccuggacagaaacacgcgucaggcaacucccagcaacagcaaagccacaggugacuuugagaaacccuugggcuggcagugaggagucuuuuguuacaacccccucccccuccaaacccacacaucuggguugaccaggagccacagaaguucccaucaugagaaagggggcaggugacaggaagaagugccagaaugagcucaccagaagauaaacaccagauccuccuucuugcucuccuuggucucauagguugcaucauagagggcauagcggcaguccuuaucuggcagcaucuugacaaagguggcguaggggucgucgacagucuggcccacaucgcccaccaggaucuccuugcccuccuccaggaugauguucuucuuguccucacucaggcagaagagcaccgccuucuugcgcuucuucaccuccucuggcguugaagacuuacgcaccuucaugucguugaacaccuugaugacaccaucagagacagccacaccggaggccuaggagacaugccacguauacgucaagaaaaggauucuagggaacugccccuuguuuuuucagaagaucucaguccacgucccgaguggucacuagugcccuucccaaggcaagucacuaguuuucccacccaagucacugucaaagaaccagaugggacacaaccucagaauggcagccauggccucugaucaccuaguucaacaaccccuucccucauuuuacaggauagaaaugcaaaacucgugaaaagcagaaccuugaccaaaaugugaacccagaauuaaaagauccaccggcuacugacucauuugcuacucacaguacuugcucucagccuuuggauaaaacuggugauuuagaacuucggauauggaggacccaaacaccugagccaagacuccucuucagaaagagccaagaccccacaaugcuagaugggaccccaaggacaccgaacaguuacaacaaacccaccagaacugcuuaauacaguuacuacacaaacgaccccuguucccagcuaggcucuuucccaaccaagacaagaauugcaacccccauuaaggacccugcccgacaacucccuucuuccgggaauggugcuaggccccagaagucgcugauaaaaauuaacaugccaaacucaagugcccagaggccucgaggucuuuaaacucuuccuacucugcgucgugcuucggggugcccgagccaggagagggaggggcaauccaagguaaaucuggucccccaaacuccccggaacugcagaagaagccggccacgugacucggccgcauccggagugggcggggacaggagaucggcugggcccggcccccucaccaaugcagaaacgcguauccgagaggcagcagcaucuccaggucccuaacccuguggaaucgcccuaaaacaacggguguaucagacccaucuccugcaggcaggagccugggcaagcuacauaaccuucgguuuucucagcccucgggccguauacagggggcggggugguuuccgggcggugcccgccugggucacuucccuaaacucggcuccacccucacucaggcccauccgggaaggccucgcuggcccagggcuucggcaccggcggccgggccugagcgugcgcgcacgcgccgacagacagcgccguuccagcccucgcccgaugcacgggugagaacgcagcucguuagaugcgcucccgaacgggccgcggucucugcgaugcccccuccaagccuugcggugcaaggccuuaaucgcaggcacccacgccccaaccgggaccccgucuucccagcaucaccccucgccgcgccagcacccgccccucccgggcgcaggcaucccugccaccugcucccgagacggacccggcugccgagggagggugacgcgcagacaggaacagccuuggguggggcgcgcgcgccgagaccucucgcgcgcuuuuuccucgccgcccccgggccggguuuggacgccgcaugcuccagucgagagcgcgccccuaagaagaaaggcgcgacgccggccguuccgcgaggggcgccccagcgcgcgccccgaaccccuccccccgcggccgguguccgcgcgggcgcaccagcgggugggggaggggagcccaggcggagcgcgagcgacguccagaccggcccuccccggcgcccacgggcgcgcacgcgcauuccggcaccgcccgccccuucgugcgagacccucaucccgcccggggcgcugggggagggggugcggacgucgcuccccagucgcuucccgcgcgcaggcgaccgacccgcagccgccucccucaggcgccguggccugccgcucaccauguuuccggaaacgaaaaggagagggcaccgagagccgcagaagacgagagcgcugcagccgcugccgggacccgacug

SEQ ID NO: 15602 - RNA, 122053 nt, Homo sapiens
auaaagcucaaguauuuuauuaauaauuuauugucaguaagaaagacuggcuaaugguaguuuucauuaaaaaccuuuacaagaccauugcaucacaaauauacagacacuauaaaaacugugucauggugguuuugguucuaaacagguaugcagaagguccccguuacacuuuccaauaaugaaaaauguuuauaauucuaaauacagcaacccauguaagacauguucauguaucugaucucuccuucauccuauguacagcuagaaaugaaugacuacacugaaauguacuaacaaaaugucacacuucaguggaaaaagacagaaugaaacccugguuauaguaaaaaaaaaaaaaucagggugcuagauaauggcacugacaccaccaaaauucaguugaaacaaaugcacaaaauaucuuggaaaucuaguuaaaacuaugaaaaaucaaaucuguacauaaaauuuacaaaaaaaagagacaggaaaauuaaaauaaucaaaucuauauaaauacaugaaucaugcugacaacacaggacugauuuuucguuugauuauuuuaacacagacagauguaaaucccaaaagacguugggaaauggcacagccgaugaaaaccucacgaugacaguaguugggacacuggaaauggcuagcacguccagaggcgcaggauccagcgcagccaugcccauucggcucaccaaaaaaagcuuggaagcacugcugcaaagaacagcgcggauuacucacaucaccucuagguucacuaaagucaggcacuuuggggggaguugagagucagacuuccgugugcugcugggaauccaggggcgggaucgucaccucuucgaaguggccgucguccccgcucucauagucacucaucaugaccucggacuccacuucgcagcaggcugacacgucagagcaggaggcgguggaggcguacacagacaugggcaugcucucgacagcgggcgccucgaagugucuuugauacccuggcggguaaggggcaugggguucucuacaaguacuauucucaccagugccuuuuguuugagguucagacauaucgaggggauaaaaauugggcaaauacugauucaaguugaaccucugccgguuucuugaugaagaacccaagcuacccgcggcaggcaugucucuaggaggguggauggauucaaacugauugcugaauucgggcgguaacggugguagcucaucagcugcggggaagucuucuggggguggaggaaaaucacuuucgaugucguagccuccaggguaauaguccguaucgauggcguuuggaucugcugaguacaggggugucugcucaucaaucaccucauaguuggggaacucuuguauguccggcagaggaacgcuuggcauccaaucugauguaucccagugauacccuugguggaaaagaaaacagaugucaguguguuuucuccuaagcuuuugugccauggaaagagagcucaguguaucaaagacacaaagaugcaaccgcauuuaugccuucauucaaaguucaccacuggaaauuccucgucuuugcuuugaagacaucccccaacccacuccaguuuaaagaccccuaugaacuaggcucuaguucuaaaauguggacuuacaguuuuauguacgcaacuaacauucaaggaaacaaaaggaguccuaagagaaaugggaugcuagcaucuaaauuauauacauuuuucuacaaaugauucuaaccauccuucuggcuuuucuucuguagaacccacugcucuguaggaagaagaguacugauccagucucaggacauuagugaaauauccagugucacuugaucugcacuacuucucauuaaaaaaauacugauuaaugcaacuuaaaaaaauuuugcauuucuauuuuuuauagagacagggucucacuauguugcccaggcuggucuuaaacuccuggccacaaacaaucuugccaauucagcuucccgaagugcugggauuacaggugugagccaucaggcccagccaaugcaacuuuuuaaaguaauaaaaguaaccuuuaacaugcuaaaguuuagaaaauaagcuuccuucauaauaauguagcaaguuuaauauuaaaauuacuauuuuucauuaacccucagacaacaaauuaacuuaauauagguauguaucaaagcaugccaauucaagcaaaauacaauugaacaagcguugcaagauuauaacacagccucugauacacuguaacaaucaaucuguguuacuuccaaaaggacugugauccuuuuagacuauauaaagcaccacuauuuuaaaaaaaaacuuccaauuuuggaauaguuuuuuuuuuuuccuccuuaggauuuaaaaaauccuuggagaggcgggagaagguuaggcaauccgugcuucaaaugcaaugcgcacacacaugcagccguguacuuaguuacugcugcaaacacugggcgacccagcguagucagucagcacuggggcaaggcuugacccauuguuuuuagugaguaucaaugaauaacuggcaugcauaagucaccucuugguuugcugaggucaggagcagccaaagauucuuuugguggcagaguagaaaaaaaagaaaacauuuguaauuaaaacagucggcugaaaaggcaauaaagguaaguacacagaacaaugaaaacugcuuacagaggcccaaucagccauacagcauguccuuacgccaguaucuaugacaauuccaaauggcugagaaauguauguaccacaaauaaaauggaauauggaaguggaggaaagugacugcggaaugaggaaccagaaauuuggccagaaaacucaaauauuacuuucuuuuccuuguuucugacaaucacagccugaaaacacagaauuuccuuaggaauaaugaaaacaaaacaaacaggcucuaauaaaauauaaacugaucagauuacauaggugauaauccaaauacaucuacagcuacauaaugcacacacuuuauagcacacugcaacuucaaaggacauuaaauucagaggaauucauaggcaaacuuagauacuuaaagacagauguacaagcugaagaucucuccaaacuguauguauuuugaauaugcuuuaauauugacacugugagccauucccuaaagagaccacggcuacacuuaccccaugucuguaauuacacuugcccugccagggccccgcaucuauacacagaagcccagcaggaaguguaaccaaacgcauguaaaucccacuaucaguuagggccaugagacgccugcccaggcccuggcuaaccuucagguucucucuuugaaauggggugaaaauccguuagaguuguuaugaggauuaaacaggaucaugcagguuaagcacuguuagaaacuaucaauaacugugaaaguagacaucacagcagaaaaacggucacauccgugauuuuuuaaacaaggcuuucuaugcauucaacaguguuauaauuugggacaaauauuugauugauaguucacuucuagaaauuucaguaauuuuaaaagacuguggugucucuaaaacaugaauacgccggcauuuagguaacauguaucuacagaaucauuuuuaagucuaguaacaaaagcagcaauuccuuuaaacaaaaaaagaucaacaacuuuuguuacguaggcacuaguaauagcuuucaacuuuaaauuccaugugcacuucuuggauaugccaaaaaauauuugucaaugaaggagacugcaaugaaggaacuguugaaauucugcuucuauaagcuucaauaauauuuaaaaugcugaaggucaucaguuuaacacuaaaacuucacuagacaaaauacagguauguuucugauuugcccagugaaaacaugguacuucuuaggaaaagaaguguaggcgucaucaguaacuauaaccaugaacacuggaguaucuaagccucuucugccugauagcaaauggggcccagagcuauccucccuccuccugaaccuugacagcaucauguccuagcauaaaggaucccccgaacucuaugaugacgucuguguacucgauggccucuguaagcaguucucgagugggaucucuagaccggcaccaucagagcuaccugggaacuggugaaaaaugcaaauucuaaagucccaacccagaccuguuggaucagaaaugcuggugcugagaaccagcaauugggcuuuuaacagcccuccagaugaucugauucacauuacaguuugaaaaguacuagccugugucuuccccaugugaugaauuucagugcacuaauaaagggcuauuuuaauuuaaaauaauuuggggaaggugcucaauguccuuucuuacaacucugagcagauaaagcuucacauuaaauaauuuucacuaaaccaaauaugaaaauauucuuuuaccaugcucuacacccuuuucuuugaucauacucagggaaaaaccaaaagugaagagucaguuacagguuaauuaugaaagcuuuacauuauucaagucuuauuccuguacauacgaagaagaauuuuuguuucaaaaaaauuuuagguaaaauuacuucugaacuuuuucuugauugcaccaccuacagauaagcucuccagaucucauguaaaucacuaugaaugguaaaaaggaacaaagacauaacauacauugagauauuuuuugcaaagcacucauauuacguauauacacaccugcauaaaauaaaaggacucaacccccucaaaaccacaaacuguuuuuuccuaccauugcaauagcaaugcggccgagcucuacgacacggcugcugcaagacacagacacaagcacgagcacuuacaacuguaccuucugugcucaccgugucaaccacagcauugacaaggugcauuacggucacuauggaagcuugcaaaaagguacaaaagcagucaauuaggaacaucuucaguuaguuagaaaacagugcaugaaauaaaguuuuguauuauaccauuucuaccucagauuccaaccgaugagugcuuuaauacaaccacauaaugaugcguggucuccucacuguuagcugugugucucagagacuuuuuuaaucgagcuauauauuuguuauuauuaaucaaaggaauaacguaaacauauuuuauuggaauuuaaacaaaaaaacuuuuagcuuuaaauuuuuucacaauuacaauuaugcaucaugccaggccaaaacgauucuuauuuuaacaucuuacaggcaagacucgacauuccaagacuacagucugugguucgccacucuuccggcugcuuaaucacucacacauugucccccaaaaaaaagaaauugaaggagaaacauaugcaaucuaaaacaagaauguuuuugucccuguucugauugcuuucccugcaaauuucucgucuguuugcagauggacuaaucgcuggugagcuaauguacgaguauaggaggagacucuguccgucuguuuccuguguaaauucccuuuucauuuguguaucagauuguuuuaaaauaacuaugccaagguaaauauguacgcaugugguaggcagaaggcuggcccucaaauaguccacguccuaaucccaggagccugugaauaugucacuauacauggcaaaagggacuuuguugacgcgguucagauaaggaaauugagaugagggauuucccuggauuaccugggugggcccaguguaaucauaaggguaacuuuucugcacagaggcguucccaguuacggcuggggggagcucugcugacagaaggguggucaaugaaacacuguguugcugucucugagauggaagaaaccaagagccaaagaaugugggcagccucuaaaaaccaggaaaggaaggaaaacagguucuucccucgagcugcagaaggcaaugcagcccuacugaucgcaugacuuaagcccugugagacacagggguugggcuucuaagcuacagaaugacagcaacacaagucuacauuguuuuaggccacaaaguuugugguaaucuguaauggcccuggaaaaccgggaauacgacgcaggaacagacucucagcagacuuucaguuuacaacugauaauuacauuaugguaaugaguaaaauaaaaacacuccuguauauauguuuuuucucugcauuguacuaucuggaagcuaguuuucauaacuaauuugaccauaacuuauugaaagcacuugggacuauuuuuuuuuuugagacagagucucgcucugucgcccaggcuggagugcaguggcgugaccucagcucacugcaagcuacaacucccgggcucaggccauucuccugccucagccuccccaguagcugggaguacaggugcccaccaccacgcccggcugauuuuuuuuauauuuuuaguagagacgggguuucacugccaggacggucucgaucucccaaccuugugauccgcccgccuucaccucccaaagugcugggauuacaggcgugagccacugcgcccggccaccugggacuauuauuaagaagacugauguuccaacaacaagaacuagaaagaaaaugcugauaaaauucugaaauguauuuauaaagagcauuuaggggccaagauauaaauuauuacauaaacuggaaacaggaacuucuuagaauuaaaauugauaaaagacauaauucuaucuuguugguuuaacaagcaaagcuauguccauacacccuauuccuaaucaacacagguauauuuugauaccauauauacgguaucaaaauauaccuguguugauuaggaauagaguguguauauauauauauacuugaaaguauauauauauauauauauauauacuugaaaucagaaaugauagcacauacuuauagcuaucuuuaguuugaaaaaugacugcaauagauaaugacuauauggauuuauggacuauaugauguauuauggacuauauuacucuggauugaauaauuauuagugggguuaccuuuucccaccaauaaaauauuugaaauguauaacauauuaauauguuuaauaauaaacguauuacguuuauacaauaaaaauuaucauuaaacuuacuaauucugagauucaaaaauuuccacuaaaaacuacauuguguuacugaauauugacguuuuucucuacugguauguguuaauauggcaaagcuaguuaucaaugcaauuuacccuauagggaaaccagaucaacauaacugguggcaaagaucccacuguuaaacuuucuucauuagaaauauaaucaaacuuacuagcaaucucuuaaacugugcucuggcaguacgcucugauccaaaugggagcuggggccgcagugggguugggggaggagacaaauaaaaccuuguaauacccaaggugcuacugaaaucgaacauuucagacuaucacaucucuucuuagagggggugugugugugugugugugugagagagaguguguguuugugugcgugcugcgugguuaagaaaguugcgaggaagauuucugacaaacccacaaaacuggggugauauuaacuguugugaaaaaaagccaauauaagauuagucgaucagauccuucaaugaauauguucuucucuauuacugacaaguucaaacaccuauucauuaagaacaguuuggcuauuuuccccagcagacauucaugcaaguauguaugguauuguuuaaaagugguccaagaaaaaugaaaauauggugaggcuuuaaggguagauagugcgucuacauugugagauaacacaguaacacaacaagcaagcaaagcgcaguguugcagcacacugcugccucaccauugucaucgcacgauucggacuggaaggagcucagagacugcacuucagacaggcuuucccgggcacuguauggcugggaaggcuuuuccucuagaggcuucuuggaaagacagggaucaagauccaccacuuuugcuaaaaggaaggaugacaaacaguaaguauaugggccaagacgguuuuguucaccgcugaauccugagacacaccaugcauuacccaacgauggccugagauuuacucaauaaaugaaugacugaaagaaaaacagaaacaccuuacaaacucaaacgaagaaauaaaaaaccccugcacagaaagaccuccacaucaucuuagagauuauucauagaguagaaaucgcccauaagcaugccuauggguaucauuagacaguaaaggcugcuaaaauuuuguuuuaaaauaguauguacagcuuuaaaagaaaaaagcaucaaauauauguuaggucacuaauauaaauauuuccacuucgccaggucauauuuuuaaaaauccuagcaugaaaaugcucccgauuauuuuuuugacauauuaauaaacucaaaaaauuauagaugagaaccuuuaucaauuauaaaaugaaaugaucucuccagaauauuaacuaaacaugacuagauucaauuucuuaauuaaaauaacaucaaagccacaaugcuaacccagcaaucgggacauccaaaaaaguuucaaaucaucauacggauuucagucugagcauacuugucucuaaugaagaguacacacauuuugacuggacagaauuuguaaccucacuguuuaucucaagugacacuuuagugagaugaaaaaguggcucuuacugucauagucaaagucccagcuaggcuucuggauggagucgcugucagaaggggaguuugaagggggugggggaggcagguuuggcgccacgcugcagaccgccacugcuuuucggugcccgugcacagacucgggguuaaaagugcugaauucgggaugcucugggauagcagauccuucgaaggaauuucgguccagauuguuucuugagucacuuggaauacucgggguguaggaaauaggccggacaggcaccuggggugguaugucugaguaaauguucuuauuuagcuuggaaucaaaauacggucuuugcaagaaagccguagcgggucccaggugcuugucuuuagguucagccugaugcuucuuuuuccgacuaaucaucuuacggcagagaacaaacaccaccaccaguaaaaauaucccugcaacaaacacaacgauuccaauuccuuccgccaacccaauguuccacggcguggacacauacugguugggcgcagcauccucgcagugacguccccuguacucguggcugcaguugcagugauaggagccgugcguguucucacagagggccccgugcaggcaaggguuuccagagcacucgucgauaucacucugacaccugccaaggaagucaggaaugaggagagaccucuguagcauacgccagcguaugucaggcucaauccuuagagacugaagacuaaucccuccuugaugagcuaugugaagaucaaacccagauaaaagacaacuaaaaaauguaacgucgacaaccacgagaaaagaccuucuguggagaaaccaaucaugugaucgcaugcuuuugauguauauuugggaaggaaacauaucaagccaauauuaauggccauuuuccuaggaucaacagacuauuacaucaaccccauuggcuaaacauuaguuuuuuucaaguauuauauauacuguauucaucugcuugauaauucauuuuaaagagugaaaagauuauaaauuauauaaggggccaauaugaggauuaucaaaaucugacauaauguaguucaaaucacugaaggucuguugcaucugccagucaauaugacgcuaugaaaagguaugaaccuaaauuuugaaagaaaccauuuaccuuucuccccuaaaacccgaaucacacugacaaacggcgccauccaaacugucaaagcauguuccgccauucuuacaggguucaucuuugcaguauggacuaagcugacaccugaagaguaaggagaaacagacauaaaccucaugauccuauugcaaauaaauacagcaaaacagaaagcaaaacagaacacauuagcaaauuaacgugcagacuuuuuacauguaccauuauauguuuaagaauuuuauacuacaauugauuaugaaaguuaagaaaaauacacauaccucugaccaguauauaauccucuacacuggcaaacaaagccuccguugucgacaacacacgugcccccauagaggcauggcuuggaggaacacggauugacgcuuaucucacagugggucccuauguacaaggcacugcauuugcaguaauaaccuaaaucggcaaaaaggaacaaaaaaguccuaucacucaaugacucagaaaccuggucuuaauuauauugcuuuuuaucuuuauucuccgaggucuguaaaagcucguaaaauucucacucucucugggaaaaaaguuggcuacaucaacaagccuuccacugcugguauaaccaaaacacccagaauugaagagagaacucaguuagcuuuaguucaucauaaucugcauuaagaucacuaggucacacauauagaggaggaaaauacaguucuuuaccugagugaccauguacguagacagcaccacuuaacaucucaauuuauuugcaauucacaagcauuuaaggauuaaaugagaaaauaaugaaugugaaaagcacuuugaagacuauaaauuaccuuucaauauuuuuauuuuuugagacagggucucgcucugccacccaggcuggagugcaguggcgcaaucucagcucauugcauccucaaacucccgggcucagggauccucccaccucagccuccugaguagcuggaacuagaggcaugccacaugccuggcugauuuuuuaaguuuuuguagagaugggguuucccuguaacgcccaggcugccucacuucuagccucaagugauccuccugccucagccucucaaacauguaaagauuuaagaaaggagaucaucacaucuguucaaagcaguacgaagaaugucgacuccacuuugucaagugacaggugguguggcagaucuucuaacugccugccuugagggcacaccgcagcacagugcuuccccgccccuccaaagcuggcguggcuguggguuuuucucaggaugaagaacuguggugcccugggccagggccuuuaggagccagggcacagcugccauacuccuuuacuccugcuucgggaccaugggagugcaugucaggaaagcaccucucucagccucaucccuaagugacaaaaugaggacggccuccuugcuaaccugguuuggacguguaacuaauaugagcacaguauaaaugagaguguuucuguggggauggccuggcccacucuacgcacacagaaugcaaauauaccucccugagagaacagcagaaaaccaaagcuuuggaaaucccacuuaaugacaguauuauuuuugcucuguucauuauaccaagcucuauuugguaugacaacugucauuuuccuaacuguacccuauuauugguaagugggccuaacaggaguccagggugcaaaagacacaaaguaccccacuacgccagggcuucaagacagacagauauggcaacacuucaggagggauucagggccuucuggaaaaucauauucccaacuauuauugccagcaagaaucuagcaggcccccuacgcugagccauuagauaaaaggugauacaaauaacaaagaagggcuaagcgguacgaauucuaaauuccccugggccgaugacuauggaguuaaagaagaguucugagucacuugaggugccuccugcucgggcacugggagggcacugcaggcgcucagcagugggagccgugguaccugcagccugggcaccagaagggcagcagacccagcucugcccccguaugagggaugcugcucgcuuccaacacugacugcagugucugacaaaauuaucugaaucaaaagagaaaaaaauaaaaaaauaccuggggagcuuccccuuaaauguacacacgugcagcauuuuaaagauggcaacauuacggagcccaccuccagcaggugacggauugcaaacgccuccauucuggcaaggguugcuggcgcagucuuccguggccgucaggaagcagccuggagauacauccaccgacucuucgaugugugcauagcuucuggguuugcuguuuaaagggagcuccugcccauucaaauaaauggaguccauacaaccccugaaaccauuaccaacuugaggacuucuuccaugccuuguucccugcugacggauguggccaccaaaaaacacauaguuauccagguucaggguuuucagagucccuggggcugugcccgaugcaguaugaacuuggucuagaaccaagcgagcauaguuuccauucacuuccagggccacugcgugccacugcccaucauugaccugaaugcucugaacagagacaauuccagggccacuuccacagucaaacuuguacugcagccuuccaugaugaaucuaggauaaaagcaaugacuguucacauuacucucauagaaccuucaaugagagcaccugaucacaaaucuacaggagagggcuuagggagugaggguagaaguuaggccuuacauuuaaguacuacagagcacagauucauuuguccacuguauaaaucauuaaaaugcgucuuuuaggaauaucaaguuaaaaugcacauccacaaagcaucauggaagcgaauaauuaacuauuaacugaacacauaagcauuagguaauaucaaaagucaaaacugaauaauguuuuuaaaaaaggugggcaagauacauaacacuugaaacacauguaggaugucucuauaaacuguaacaguuuuuguuuuuugagacaguuucacucuugucgcccaggcuggagugcaguggcgugaucucaacucacugcaaccucugccuccccuguucaagugauucucgugccucagccuccugaguagcuggaauuacaggcguccgccaccaagucuggcuaauuuuuuguauuuuuaguagagagcagguuuugccaugcuggccaggcuggucucaaauuccugaccucaagugauccacccgccucagcuucccaaagugcugggauuacaggcgugagccaccacacccagccaacauuauuaaaauggggcaucaccuagaguuugaauguuaacugucacauggaccuaaaucucugucauggcagggcaaaaagagcucuucaucccacaaagucuaaaacuuguacaggcaucaaugaauuauuuaaauguggaauucaaccauuucacuuacuuuauuaucugugcaaauuaacaaucugaauauaaaaugaaauuuaugguuugaaagucuuccacuaagaugcaacgcuguggagaaacauaccuccaagaugcuauagucaguuccucgagcauacaugacaaccgcaugcguggaauauguucugagccucauggucaguuucaucucuaauuuguuuucauuuuccgucagacgguauuucacguagcuguuuccagucagugucauagaugaacucccugugaaucacacagaggaaaaaauaaaccagaaccaaguuuaagcauauuuuuuaaaguaugacuccccugcaccccuugagacugauuuaggguuuuauuuaagaugauaacauuuuacuauccaauucugugggaaaacgucuauuugcuuaaugaaaagcccagcaugacuggcucucuguuuggaaagaauaaauuugacgacugcaucacagagaaaugaauucuaaaguaaugaaagauuaaauauaaaaauguucaguauaaaauuauuagaagaaaauuucagaaaauaguuauacauagccucaaggugauuuaagaaaccuucucaagcaaaauaaaacaauccccauuccccaaagaagaugcaaaugucaucaaucuccacagauggcaacuguuacauaaaauuauguagaacugacuaaauaacaauugaauuucaaaaugacaagaggcauacuuaacaaaucaaaagauaacaucaauauaaaugauauaaagacagagguaacugcaacacugugaauguuaauacuccuaauacacaaguaacucuacacauugauacuaagaaacaaauaacccagaccaucaaacaacaugaacagguagaggccacagcagaggcaauacugauaggaaaugaacaaaugagaugaaaacuuuuaaaguagccagagaaaugcaaauuaaaauaauaauuagauaucacuucacacccauaaaauagaugguggggaauuuguuuuauaaucgaaaauguucaaugaugucaaaagaauggagagugaaaccuucauacauaacugggagaaauaaaaauuaauacgacuuuuuggaaaacuaauauagugauacaaaaaaauuuaaaaugucauugauguuugagauagcaaauucuaguuuuauaaucuauacaccguauagaaaugaacgcaucaguauguaaagauacauguauaaagauuucuuuaucugaaagaaagagaacaacucgaaucuuuacacauaagaacaauguugaauaaguacagccaugcuagaaaauauuauccagcuaucaaaaagaaucagguuuaaagguacuggcucggaaccauacgaaaggugcucuuuaccauacugcuaaguggagggaaaaggcaacagggagagaacugugugagauaugaucacucuugaauuuccaggaaaauuaaacugcuacauaauggcacugcguuguuagcuguaugucuauauaaucauugaagacacaggaggagggacaccaacuaugaaccaaggggugugcuguaacaagaggaagcaaaacuuacuacugucauucuuuauucaucuccacaucugucuucuuacaauaaacauacuuugcaauauuuuuagacuccaauaaagaagaaaaugguaagaaacaaugaaaccgauuuuuaaaaauaaaaguauacccaaccauucaacucucaccugggcacugaccaaaccugccgcugggacagacacagguguguuucuccucccagggaucagacacacauucggaucccucagggcacggaucaucuucacagccaugguggacaggugggcaccuucccucuucauucaaagaggggagaaagggaaaagauaauuaacagacauuucaagaacaucaccuuucauguauagccaucaaaggcuucaaaggccgucugaaaccaucugugacaccgacuuucauacacucaugugcaguaccuuugcagagacacaccgcugcccugugguggcggggagucacaaaacucagucuggcugugcuguguguugacaucacacuuucauccacagacaccuuuucaucgcagaacuuccaggggcaguccagucccgcgcagaguuucuggaauacauucaguauccuaacuccaaugauuuccucaaugucagucacggaagaguuaaucuugugcagaaguuguuuuguugagaucugagcacuaccugguuucucuacaaaaaguaagacguccagaugugggugagguucagaggacugcaaacuaacaaucuguaugucguuccuccucacacccaggauguuccguaaagcucgcuggaaguugcgccaguagucaccaacgaauucuuccggagugagguuggcaaagcggaucgcgauggugugguucaacaucuccugugugacuugucugauaugcacugugaugucggccaccgucgugaacuucccaucuguuacgcugacauugagaagguauugcccuaugucuagcuuuuugugugcuaucagcuugcccccugugcuggaaacagagaacagguuguccaucugagggucgagacuguagguuagaguaucauacacguccuggucuguggcauggaucuucccaaugacgccaccugaguauucuucuccagaagaggugaugaaaaucuccaggggcaaaaucgcaggcggauagaugcucuccucaauuacccuaaugucaauguaugucaaagaugacaacugaggcuuuccauuaucugccaccuacaagaaaagaaaaauaaaaucaccuuugucuauggcacuguuuauaacuucuucaauaaaaacauuuguauuacucaaguucccaaaaaauuacuaacugguagauacucauuucuccacacaagaaacguaucaaagaaaaggacaaauuucuuuauagcacuucacuaauucacacugaaacccagcucugucaaugacuaugacagaaucaacaaugagcuccuucaaacacagcgggauaaaaauggaagguauggcaaaaaacaaagacagcaauucuaugaaaguuuguuuuuguaugaaauguaagcuguucaaauagaagaggggaaccacgccaagcagcucuucucuaugaauccacaaccaaaccacaaagaaagccauucauaccuucaccugcaguaaguaaugaucuuucuccuuccucuugauggcagaugaugucaggaggacuccuugcggguuaacuucaaaagccuucucaucauuuccaguuacaauaguaaagaagaaggguggaccguuaugggaagaauccucaucuguuacuaccagcugcagcacgcugaagcccacuggcuuauuuuccugcacaagauuagaaacaaaauuaaacaaaaauccuggaacacagccaaaucuauaugggacagacacaugaguuuucuauaauauaaaauacauacaaaacaaagccuuucugcucuaucugaaaggaagagaagaaagguggagacgggagugugguggugaggaggagggaaaggagaagggguguagcgaaaagggaagaaaaaggaggaugaaggaaacaugguaagaaagggagugugaggaggaagagggaggaggggaagcagacacgaggaggagugggggacaggaggaagagcagagaggaggaggaguguaggagaagaagaggacuggaggagaaaaggaagagacgaggccaggcgcgguggcucacgccugucaucccagcacuuugggaggcugaggcgggcggaucaccugaggucaggaguucgagaccagccuggccaacguggugaaaccccgucucuacuaaaaauacaaaaauuagccgggcgugguggugggugccuguaaucucagcacuuggggcugaggcaggagaacuguuugaagccaggagguggagggugcagugagcugagaucgugccauugcacucuagccugggcaaugaguguaacuccaucucagaaaaaaaaaaaaaaaaaaagaggaagagaggaaggaagaggaggaguggggaggagaaagagaagagguugacaagaggaggaaaagugagaagggggaggaggagggguagugaggaggaggggugaugaggaggaguggcgacgagguggagggaggaggagaaagaguggagacagugaaauggggaggaaguggaguagggaggagguugggggaggagguggaguggggaagaggcagaguggggaggaggaagaggaggaguggagaagagguggagggaagaggaggaguggggaggggaguggggaggaggaagagaaggaggaggaauggagaagagguggagggaggggggaggaaugggagggaggaguggggaggagggaagaguggggaggaggaagagaaggaggaggaauggaauggagaagagguggagggaggaggaguagggaggaagaagaguggggugaagaaaguggaguagaagauggagcgagaaggaaggauugggggcuagaagaagagcaagagggaagaggaaggucaaggggggaggagagggcagaggaaaagcaccaguggcagcaggucugauuaagcaauaagcucuuaggaauccuagaacagugagaauaucucaaaaaucaaagcacggaaaggaaagagauaaaagcuuggcuuuaucuuuaaaaugcucaucuuuuaauacugauagcgacuucuugaauucuacguuucccauuuuucuagaaagaaaccuuuggauaagaaagaaaagcaacagaggccaauggaaaagcucauuucaaagaaccccaggaccaccuuggcacucgaagcccaccuggauaaugacacuguaguuuccccuggagaagacgggcgcguugucauugacaucggacacaucgauguucacggucgucguguugacucuggguggacugccauuaucagaagcuugaaccgugagcguguaaccugaaaucuuuucaggcaaaagacagaaugcacguucauuuucacaaggccgacagagcuccaaugaggaguguccuccugagaguccugacgggcaggucccagugagcuaccacuaucuguugcauccugccugugagcgaugcccuaaucuccuacaaacgagugcaugcaaguaauacacauuucccaacagcaagaauuaccaauaaugauuagauucucugaugccucuuaaauauguacuuguuuuguaaaagucuuuuaucuugcaguucuauuaacagaaacuaagacauaaaaguaauacaaaugauuaggacaagaaguuaacauaucucaaaugcuguugcuucgguaagaugggagcagccuuccuuagggccccaaguuugcucucaguggaaguagacagacaugagcugccucccgcaccuuagcgcugacucauuuccaaugccucaggacacuccagaucacccucccccucaauuucacacucggauuauacucagcugucuaaaucccucaggauuagcuugucaggaccucccacaaaagaaagaaagucaagugagauagcuucuuuuucagggcaguucccuauaaagcucugucuucuagaaugaguugugggagaagccagaaagcuggcuagaucccagaguauguucuacagaacguuaguccugcaagacgcuccaaugaaaaagaauucugcuggcgcauuagcuugggaaauaccacaggcuagcuccuuugguaucucacaauggacagaaguguauuaaaggaucuggguucuuuagucaaagauacuaaauuuauucugccccacagugggggcaauccuaagcaugcuucccaaauccuuagaaagucccuucucaacauucacacaucaaaggagaaauuaaagaauuuaaugagguaucucaucacuaucuccccccaaauuccuuuaaucuuagauacacccauuauucuucugaaauuucauucuuaaucaucaccaguguccuucucauucccaaaucgaaggcuucuuuugguucuccuucacaggccuaccucucugagguaguuccugcucagcuucccuuccuggacauaagucugcacagaugagugaauggauggaugaauggauggaugcauagauggguggauggguaacuggauagauagguggauggauaaaugggugaaugaauaacuguauagaugggugaaugaauggguaaguggauacaugggugggugggugggugagcaaauggguaaccacauagauggguagauggauaacuagauggacagguggguagguggauggauggauaacuggauagaugggugguggguggauggacacaugacuggauagauggaugggugggguggauggauggguaagugaauagauauguagaugggugagugaauagauaacuagauagauggguggguggacaggucgguggguggauggauggguaggugaauggguggguaggugaguggggagaugcauggguggauggauaacuggauggaugaauggauggaugacuggauaaauggguggauggauacuggauaaguggguggguggauguucagccuugcugccucuccuuauuuguucauauuuaucucaaucccucaugucacuucuaucaacaucuccaacggcaaguaccauaucuacacuuaggguuuuccagucucuaaaucugacuaaaaucuccaaauacuggcugaguaauucugccugaauaugcuauuucccuuuaaaaaccagcauauugaaaaccacauucauuagccucucccaucccuuacacguuuauaccucauaacuuuucuuuaaugguacuacccagucaaagcaagaccaaaaaaucaggcugccucugacaccaaugcuuucuacacggagccauaucuaagcuuuguggauucuaauuuuuccuuugcaaauaguuucuucauuugguauucauagacaccaaaauccacuggugcucaaguccuugauauaaaaugguguaguauuugcauauaaccuauacacauccucccaaacacuuuaagucaucucuagauuauaguaccuaauacaguaucaaugcaauguaaaugguuguuauacugcgggucgggguuguauuuuuuuuguuguuguauuguuauuuuuuauuguuuuucuuucuuuuucuggaggcagggucucacuauguugcccaggcuggucuucaacuccugggcucagugaauucucccaccuaugccucccauguagcugagacuaucggaggaggccaccacacccgacauuuuuucuuuucuaauacuuuucgauccauguugaguugacuucacgaaugcagaaucugcagauagaggggagcaacugaccuuccucagcucacaaaugcucauacccuagugccugaggcaucagguccaaaccucugguccugguuuucuauguggccaauaaccuguguguaaaauaccuuccuauuuuaucucacucugcuuucuucuuaugauuacuccaauacaacuggguaaaguccccuaaauauauuucuuggcuucuaucugcaugccuguguccaugcaauuccucgcuggaaauucccuucucucaaccucuaugauuuuccaaaccucugcuauuauuuaaaacccagcuucuagcuuuaggaagugucucagaacacuggaaccaacaguaauuccuuccugaaugcaaagcuuuauuauccaaacuuuauccuagcauggaacacauuucucacauugagaucuucauagugucauugcuuuucgaguguuuacauguugccgucaguucuugaggcggucaguccugcucacaccacgcccagcagacaagagcacaaggcauuucuaguuauugauguggugauuuguaaacaacguaaaucaaccuuuuucacuuaccguuucucggucgagaaguuuggucacuuugacuucuccccugacggggucaauugugaacgagcuuccuugguugccaucuauaauugaguaguggauguggcuguuggaagguccaucggcaucaucggccauaaccuagaacacaccacacuccuguuuaggagacagcuaagaagaggccuaaaccuauuacacaaaauuugugauauuaauagcuuagcuguuucuuuuuguuguuguuuuuuuuuugagauggagccuugcucugucacucaggcuggagugcaguggcacaaucucggcucacugcaagcuccgccuccuggguucacaccauucaccugucucagccucccgaguagcugggacuacaggcgcccgccaccacgccuggcuaauuuuuuuuuguauuuuuaguagagacaggguuagcuuagcuguuuuaacacaauuauucauaacaaagucagcaaucaguuggccuaacaaaagacacuuucaaaucuccaaaauauuuacaaaggccgcuacaaaaacuagauugauuuuacuaaaaacuuuugcaaagauccagaagauacacaguuuucacuguaauggggaaaaaauacacaccgugaugacagacugcucaagaacggcaucuucacugaugacugucguguaggugucuuggcugaacacagggguauuaucguugauaucuguuacauuaacguucacaguggcaacgucgcucagugaaggcgugccuccaucaguggccucuacuguuagguaauacucaugagagcucucauaauccagauucucaaugauaaauacggccccugaauagaaaucaaaauuacuuccagcauucugcaaugccaccacauuuucccacuaugacugaaauagaugaaugcuuuugaguacauuuaguuuucacuucaaaaguuuacuuaccauuuacguauguuuccuauuuucuuaauucaacaauuaaaaacuaugaaucugcccaucccuggaucuuuauuucucuuaauuuucaugauauucuucaugauauuuaaauugcuuuuccagucaacaccaccuacaucccugcuuauuauaaacaugaugauuguaucaucccuuccauaccauagcucacucgacuucacucuaauuuaaucaacaaaauaaaaacguaaaaauucuauugugucuuucgguuucauuuuuugucucaucuuuuuaaaauauuuuccuucucauauuuuuaaaauggagauuuauauccuuuuaacuucuagauaacccuuuauuuacauccucucauuuuuaaaaaucccuuuuuaaacaauuccuuuuaacaucuuucacaucauucuaguccuaaagagcccuaaaaauaauuuuauuauaaauauaaauuauauaaauauaaauuuauauaaauuauauaaauauaaauuauauaauuuauauaauuuauauaaauauaaauuauauaauuuauauaaauauaaauuauauaauuuauauaaauauaaauuuauauaauuuauauaaauauaaauuuauauaauuuauauaaauauaaauuugaauggagcaacuuucuacacuguuuuaagacuuaggacuauuuuaggccacagguuagcaagaugaugaagcauucacgcagcaggagucagcaguuccuaugccuuuugagcuuguuggcggucuuucccuaacugugauucaaaguacuccaacuguuauagacaacuagcaugauaacgaagucaacuuaauauauuaucagaagcccacuacagaaacuaaaauaaaaaagacuggaauuacuauuucacuugggaaguuaccauccaugagucugauuacauaaggaccucuacuauccccuauucuuaucuuuacuaacuugcuauaccuuacaucucaacuaaacuaauagaacaugcugcuuugauuuucuauuuuaaguuaauuugcuuguauuuuauaaugaacaugcccaaaauguauuaaguagaacuauaaucugaagccuuccaaacaacauucaaucccacuguaaauaacuaaaagaaaacuugauuugccuuuuuuagaacaucuacugacaacacagggucacuuaauacaaggcaacgugguuaagcaaaucuaguuuucuugguggaaugaaggguuuccucucagauacaugguagguuaccuguuuuagaaucuaugcugaauuucccauguucauuuccacuuauuauugaguaggugauuucugcauuugcuucaauaucccgacuugcugcauacacuugaagaacuucaguuccaacaagaauguccucagacacgguggcaccauauucacgguacucaaacacagggggguugucauuuaugucaagaacugauacaaucacagugccaguggcagucagccuccuuggcaagccuugauccacagcuuucaaagagaggguguauacugccuggaguucucuguccaaagguuuuucuaacugaauaauuccagauaauucguuaauggagaacugcccaucagcagagucaaucagugaguauaaaaucuuccgauuuaauccuaugaagacauaaaaacaugucaaaagauuuuaaauaaaaaaguuuaacacuuuuuuuuuuuuuugagauggagucucccucugucgcccaggcuggagugcaguggcgugaucuuggcucacugcaaccucugucccccagguucaagcaauucuccugccucagccucccgaguggcugggguuacagacacacuguaauuuuuguauuuuuauuagagacgggguuucuccauguuggccaggcuggucuugaacuccugaccucgugauccacccgccucggccucccaaagugccaggaucccaggcgugagccaccgcacccggccaacgcuuuuuuuuuuuuuuuuaaaaaccaaacaaaauuuuuuuagaaggguaaacgcuaauauacauuauucgcaaauuuguaugacuaugaccuuuaaaagguaaacaacuuacucuguuaaaacaaauguaaauauaauuucaugggaaucuggcuucuuagacuauuucguauaggagccaauaauacaguaccuaacaaaccuuuacaaaucacaucuguuuaucauugagcuuuggugacaaagaucugaaaagcaacacuuuugcuauucuucugaaacuucucagaaucacagcaugaguaucccuaaacugaaaaucugaaauuugaaaugcuccaaaaucuauuaacuuuaugagugcagaaccgaugcuuuaaaaaaaaaugcucauuggagcauuucggauuucagauuuuuggaguugggauacucaacugauaaguacauaaugcaaauauuccaaaaucugaaaaauauccaaaaauccaaaaauacuucuaguuccaacuauaauaaauaaggaauacucaaccugugguaugacugaagaaguuauucucugcuaucaaaugcuacaaauauacauucuauaguccaauuuucucuaaaaaaauuuugaaagguuuguaaaccuaucauaaagcauuugcuuccauuauguugcaaugaggcuaaaagcucucucuguccucaaugguuuauugacaaaauaacacaucacugauuaauucaaugggaugugaagaucaguuaauauucaguaaccagaauuuuagagaccucacagcaguagguucacugggcacaacuuuggaacuuuaaauauucauuaaaaauuaauuaauuauucuaaagauuuccuuccacaaggaagggcuauggaacaugcaugagguggagugaguggcacaggcugaaucugggguguguuuugaaacagaggcuccuaggaucucagugagcagcgucaggcaagagcauucccgggagauaccugcgucggcaucuguggccugcacucuugucagcagcguucccggcucuguguuuucaaacacggugauggcauaaggaucggcagagaauucgggggcguuaucguucacaucuucuagcgugagcacaauacuggcuuggcagaaucuuccuccuccaucuguggcccugacgagaagaugauaaacagcuugcuccucacgaucaagggggguugacguuuucaguucaccuacaaacaaaaacaaauggacucacuuguaauuuaagacgugacuugcaguuguacaucuuauuuccuccccuuuugucuuucaauuacuuagucugaguauucacagccuuccucuugagaccaguauuaucaaugacagauucaacagcugcaagaggcagugagcuccaggucuccaacccugccaggggcuagcucuuuaaguccugcaggucugaggccagggccucucaccuuguguauaagauugcacaggugaaacagcuaccaaauuuaccaaaauuuaaaaaauguuuaaauugacucaaaaauuagauucacauguucacaauuaguucuuuaggaagaaaauaaaaaggcuuaacaggaaacuuaguugaucccaauuuuaccaaaauacaaaaggaaaacaacucuauuuuaaaauaaauaaaaucccauaaaucauuuuguuuaugaaaauucuaaauuaugcuaaguuauaaauuuauggucaccaauucaagaaaauaugcuauuuaaauaaaauggauaaaaagcagaaagcuugaguuauauuuuaauuucugaggguuguuuuuuuuaaacaagugguauaaacgccuucuaaauuuuaaauccuuuuuucaauuaggugauauucuugcuguuuuuuaaaaaaucucaccuugaauuuuacgcacuaaauugcugguaagauuucuaagagaugucaacuucggagcaucagaauacauuugaaaagggcaaaauguaauuucaaauuuugugugugaucuaaaaucacccacauauaugauacuguuggaauauacaauuuauuuugucccaaacuccaucauuaccugugucuggauuuaguuugaauuuuucugcaccugaacccaauaacguguaaguaauuucagcguuagagcggaugucugcgucuguagcagagaucugcaugaucaauuuuccaggaaggacgucuucaggaauagugucugaauauaaagucugcaaagaguuuaaacaaaaacguuacauaaaagcauuaacaggcagcacaaacaucaagggaauaauggaaaagaaaucauucaucuuugaccacagaaaacaugggaaaugacuaaagauaaaaucccaagagcuuugaaaacgauuuuucucauaaaacauaaaacacaugugaaacaaggaggagccguggagcagccaccagcuccacaucccugaaagagccuggccugacauuuaaccuacaaaaugcuauuauauguuauuaagcugauuucauauucaaauccuuaugagaaaacguaaguacuaaucaaaaauguaaguagugcuccguauuuaccuaaaaacugcagagaauaaauaucugucguaucauaucugcucauuuccaaauacaggaauuuauuuuuugcaaauguuccuaacauaaauaacugcaguugagagagaagcaaguuucauguuaugggagaaaacgaagauucucgaaggccacagaagggacucugaugaaggcugaggcccuucuacugcccugcgugauccuggugcccucucuccucacaucugcccucaugcucaaacacggugaacacuuguuuccaguuccaauuauuuagaaauccaugccauaaauuaaaaccuaagacaaaaagauuaagauucuguugauuuucuuaaucugaacucaacuaccagugaaguacucacggaaaaguacuccaugaaaaaggacucaggaaaaaggguauuucauaauaggaugaauuuaaaggaucuagugucccagucuuauuccugaagaugauagaguauuguacugaaauaauaucaaagggcuaaaaaacaaccaaagacaguugcuguaagagagagagaaugucgcaccccuucugaaaauauaaaguacaaauaagaacuggaauuaacuccucaucccucagaaguuccccuuccccucaugacugaauauaaggguucuuccaucuuaagucuuucccugagaacagcccuaucacuuuccacagccacaagcaucucagacucacagaaccugugguggguuccaacuccuccauccucuucacaaucacauuccucucuacccagccuucuccuggcccagcacauuccuccucccugucacucucagccuucuucccugggcaggucuauuucuucaucacuucacucucugaucugccaucaggcauccauccacguccugcuaccaagaccgccaccuacacagcaucacgggacccaaauggucuguuucgcaucccaaacaucccagcuccacucgccacccugccuccccaaaguccucuucuccccaacccagguuggcacugcacugguguccuccucuuccuuccagcucagcucccuucucccuuuggaaauagcucucucuucuuuuucccuuuuguuaguauccucucaaaugaagucaauuuucagcuauccagagacaacgccaaguuuccacaccuuucccuaauacccauccaacaucucgccaucucucaaugucuaaaaaacauggucaacuguaugucucauuacuuuagcaaacuggaauuggaacucaacacggaacuccucuaaaaccagcccccggcucagacuccucuuugccacggccuuggucgcucccccuacucauguagaaagucgggcucgauggcaugcuggcuggcugucacaccagauggucuuccucggugguggcuuugguccuuucacuccuuccccaccucugccuuuccagggcccccuugcauccacuccucccugucuaaauaaugggcacgaugcuuccaaacuaagcuuaagaacucgucucaugucaucucuaccuuaccgauauaaaaggcuccaaagucccuauuuucucuaggaucgaguucaaaucccuuggaacgaccgccacugcccacuguaauccaguucacccuuuuccaagacucucagugcagacuccccacuucuggcaaacucaguggcuacucccacaaucccuccucacacuccauggccccuccccacccacuccugacgacccacuuacugccccccgaagcugagccagcccuuucucugggcagcccuucucacccucuggccccagggaccaccccugcucgagccacaugcccucaucuaaccuuggagggagcagcccuuccuacgucuacuuuuaguucccacugaauggugagccgcgcagaugcaggaagcacgcuguccaccucugagcuucuccagcgugcagaagagcagaugcccccaaaacagugucucacggcacgucggcacuuuguuucccgucagauccuucccccaaaacagcuguauccccauauuaagagaauccccucaugaaaagguuacagagcauuuucaguguuggaugcaacuggaguccuguccguaauuuaguuuucuagaaugaggcuuuugauuuauugagcauucccgcaaauaguucugaagcuuuuccaagucuuaccccauuuaacaccucugcuuaaucaguaagugaucauaaaacacaugugaauuacaccacagcgccaaaugauggucccauugaaagaauuaagaaauugaaauucauaacacacaaauguaagggaagagcugcuuaccuuuucacaaacuggacuguugucauuugcauccagaacuuucacuucaacuaucgcuuuugaugagaaggugccaucaguugccgugauaguaagaagguaauugucccuuuuuucccugucuagagguuucuucacauauaccuuccauucauucuguauaguuucaacggcaaacuguccuaaaggauccccuccuauuaaaucaauggaggaagauaauaaucaaauuuguugaaaggauaaaaauaaguaacagaaaaaauaaacuguacaaaagauguauaauguuauaguuuaaaagaauugaguauuaaaagaauuaauuuggcauauauuagccuuccaauuuacaaaaacaagggcagcauuaaaaugcauaaacauagcauuaagacuacuaaucauuuagccugcauuaaaacuauagauguuuuuaauuauauuuauuauacacuaaguauaagguucaaaagaaugagucacaaaaaucaaaaacagucuaaugaaacaacugguagcuuugcucagguaacaagcuugaaaugaggcucaacagauguuauuucuacguauuauuuuagauauuuuuaacuaaaaucaucccuuaaauccccaauuuccauacaauacagaucuuauacuuuaugcuucuaaaaaucauuuuaaauuaauuaaaccguuugguaugaauuuuuuuuaccuguuaugaaauauguaacuugucuguugaucucuucagaaucagcauccgugguacuuaagauggcaaucaccccaccuugggggucauccucacucacagucccuuuauagaucucggccgugaaucgugguggacuaucguugacaucggugacgguaacauccacaauggcuguggaggauagcuggaucuuuucaccaugaucugaugcaaccacuuuaaucugguaauugucucucuuuucauggucaaguuccuuuaaaguuguaauccagccuguuuccauguuaauggcaaaggauucaaugacuuccacacuuugugacugauccaggcuauacauaacuuggccguugguuccugagucagcaucagaugcccugaucugaauuacucuacuucccccuggcagguuuucaacaaugaaugccucauauggacuagauucaaagaccgggcuguugucauuugcaucuuucacuuggauacuaacaucuacagaagccaccaucucauggucaucuugagugcaccuggccaguauggaaaacugauaccacuuaguugucucaugaucaagacucuucuccaacuucagucucccgcucugucugucaaucacaaaggacucaucccuauugcuuucuggaguauucccuuugaccaggcuguaaagaacagucccacuauguucugcucggaugagaucuaucucuguuccaauaggcacguccucugacacuguaaagguauagaaagguucugaaaauuuuggaagcugcauuuccgguggaaggauuuuaacauagacaagaacaacagauucuuuugauggagacccauuauccacagcucuaacaaagaaagugaagaauucauuuuccaagccaaugaggcucuccuuuguagugauuacgccggacaguuuguuaauuuccaaauucucuuuuacacuuucagagucugcuucaauggcauaggugaugucggcauuggagcccucaucggcaucacuugcaagaacuuuaacgacugaagucccuuuagcagcacuggacccgauauucacuucguauuugguugcucgaaauuguggugcauugucauugucaucuguaaggaugacauucacggugcagaaagcaacuuuuccuccagcauccuuagccauuaaacggacugagaucacuuucuccgccgggguuucucgaucaaguuuuuccaaaguaaauaucuguccucucucauuuauguaaaaucugucuuuggcaaagucauuuacaauaugguaaguaacgugaccauaaauaccagaauccccauccguaguuuucaccuccaucaccaggguauguaggggagcguuuucagcuaguuccacuucauauucguucugaaggaaagcaggacugugcaaauugccuccaauuacaguuacaugaaccuggguggaacuucuaaaaacuccaucagacacugacagguuaagacuguaaaauggcuucagggcgugccggugcagguuugagagggugauaaucccuguugcacugucaaugacaaaauguuuaugaucauugccagacagaauggaauacugcaacuugucuaugucugaacugucugcaucauaggcuuuuacacaggucacgaaaugcccaugaggggcgugcucgcuaauucuggcuucauaaaucuguuguucaaagagugguggauuaucauugaggucgguaacguccaccgugacaaucacaucacugcucagcgugggcauaccaccaucaacugcccucacaaaaaucgugugcugccgggacugcucguaauccaggguucugaguagugagaugaggccagugcugcugucuacaugaaaaugaucaugacucuugcugugauucccaaacaucugguaugagauuccucuauuugguucugaaucagaaucgguggcucuaacuugaacaacagacguuccaauuacagaugccucagacagggucaccgcauaagacugcugagcaaacacaggaggguuaucauugaugucgucuacuaugauguccacaaauacuucagcaugagcgcccgucaaggagucaguugcgcguaugcucagcuuauaugccgggugggccucaaaguccagaggagcuaugacauugauaacuccaguauugaaguuaauagugaacuggcugaaagggucuccgucugugaugcuguagaacacuuucaggccuuccgggcuguuagccugcacguggaccacagggcugugcaccuggaugcucucugcaaucucugcacuguagaaagguuuuucaaacacaggcauggcuuuauucaugacagugaucggaacgauaacuuccgcugaaaaggccggguucccuccaucuuuugcaaccacuguaacaagauauucuuuauuuaaggugucaagcucaaauugcuuuuucagugaaauuucacccaaggguccaauuugaaaguguucaugauguuccuugagguaguaaugcacuuccccguuucugccacugucucugucuacagcagugacauagcgaaugacauggcccaccucaguguccacuuuaacaacggcguaguagggaagguugacaaacaccggcgcauuaucauuuuggucuucuacaaugaccuucacgacaacgugggccacugcagaaggcuuauguuccucugucacuucuacaaccacaucaaacgccuccugcugcucacgaucgaagggcgugccagugguugacagaacuccugaagugcggcuuauuuuaaaucugcgaucuggguugaggaugugauaaaacaaaggcucauugauuggauucccaauagcaguaaugacagcuaauguuucggccucgguggaauucucuuucacuaccgcagaguagacauccuggguaaacuuuaggugacuuucuuugcuuucuuucacauuaauuuugacagagguaaggccggcaaaucugccaucggaagcucuaacgguuagcucguagcggcuucuuaacugaguuguguuuuggacagugagagcaccagucuuguaguccauagaaaacuucuccccgauguugccuucggugauggaguaaaucaacugugagaaugcacuugaaucagcaucuguagcauuuacugugaugacuuuuacuccuuuguauguugguaacaaaagagaugcuucauauaauggcuuggcaaacacaggggggcagucauuaaugucaauuacauguacuguuacauucgcugcauacucagcaaauaaacgugggguucccaugucaugcacuuggacgguaaagugaaaaauacuuguuucuucauaguccagacuuaguacuguaugaauagcaccagugcuagaaucaauagcaaaauauguguguacagaugguucaacaaugugauauacaagcaaagcauuugagucuuuaucagcaucagcugcucgaaucaccagugggacauuccugucuguuaggaccacgcuguuaauugaggcugauucacuaaugaguccuguauauucugccugcauaaaaacuggcgcguugucauucucauccugcaagugaacuagaaccguuguauuaguggacaaaccagccauguuaguuccuuguauuaucaauguguaaaugggcaaaguuucaaaguccagggcuuucugagugaugauaguuccagaauguggauuaauaucaaaagcaucaccuguauuuccaucuuuuauuucauacaccacugaugauugacuaugggcuguaaccaucccaacgaaacucccaaugcugacaguuucacuaaguucaacagaauauucuuuugauguaaacuucggagaggcguugucagcaauugugacaaagauacgcacagaaguuauuucacucauugguggacugcccuuaucuguagcuuuuaccauuaaaucauacuccgcuugguuacuucgaucuaauucuuuggcaguuuuaauagagcccaagacaggaucaaucauaaaagaauuuccaauauuuccuggaaggagaggaaaaaauacauguuacagaaaaacacaaggggcaguaguaguaguaguuagagaaacagaaacaaaguauccuuaaaaauuauauucugaaauuaagcagaaacucaggggaugucaauauuugaauggaaccuucaacuuguuuuauuuuuauccaccuaaaaccagguauacuuuacagaauuuuguccauaaaugaugaaaaacaaaaaacagaagaaacagcacucugcucuuagcgaagccaaaacucccucucucggcugcacugggaaugugugguggaaagacaaggcuauccuuccacaaagcaguugagugagucacuuuccaggagucccucaaaacacuucuggaccacauuuguauuuucaacgguuaugacuuacaaauucuuaagauauguauucauuacgaaagauuucgauucaguaagaaauugacaucaagcuucaagagacaauuguccauggauaaauguguguaacccaccccacuuuacagguuuugaagauugcaacaacauucccuucuuaucuuuuucaggucaacuuauccucuaggucagugguuuuccccugggggcaauucugcucccuaggagacaucugguaaugccugcagacauuuuugguugucacuacuugucggaagagggugcuccuggcgucucguggguggagaccagggguguugcuaagcauccuacaacgcacaggacagcccuacacaaccaaaaauaucugguuccaaaugucagcagugcugaagcugagaggcugcucaaagauagaguguuuuaccuccuuuucuuuggaccuuuucaggcuauacuguauguaucuuuagcugcaaccacaacuccagaauauuguauaauuuuguaucaucgacugaaucuucaaagaaacaagcaguucucuacagcccuuuuggauaaaucaggguggcguugcagguucucagguuuaauccauccacgagcccauccuuuuucuguuucaugaacaagcacccagaauucaccaucccugucauagcacagaauuuauuuuccccaaaugaacuauuauacuuacccaaaacaaagcucacuugccacuuaacugcuuucucagauucuugcucuagguuugccacgaguguggcauuucacagaccagaacugcucagugugagcugcacaccagggauucaccaagcacuuuguucuccacaucauuaacaggaaacacuuccucuacagucuucacuuccuuccuuucauacauuuuccaaaaauccacggccauuuuuuagagaccagauccagccugcuuuucauuaagucuuacuggcucugcauccgagccccaaggcagugccucagucugcaacaggguggaggcccaggguuucucuaggcccugacgcucugagcugaacccuggccgagaacuggguccugcugccucugccaggcuuuugagacacuaauuuccggccugucuguacuuaugagucagugaucccagguccuuccugauugcauuuuuggccgucgucagaacgccaagauccuuuucucaucccaccuguacaucacccucacugucuaaaauugugacugacugccuggccugacacaggagacuggggcagccauggugacucucuucaucccugccccucagacuucccuaugucuguacucaccagcugaccuaccauauuuuauauucauucuucuauauccacuucucucuuauuguacaggauaaucuuaucuugccgaugaagcuucaaauaugcaaggccucauguggaggaacgaagagacuaucugcuguggaggaggcuggugcugcuagaacacacugcuuucugcaaaacuugcucccugcccuccagccaagugggcauucucuuuguccucaaucaggagagcacacucaucucagagccccagugucugaugcauccucuccuggaagagucuccucccgcuauucuuacuguuucugucucaucgcccuguguuuucuuuacagcauggauuacaaccuugcucuuuaucggccaugcaagauucagaaacauccucuauuaucuggggcaucaugacucuggugaacacagcuuggagcaugucacugauaacaagguuaaacaggaacccagcucgugaugggauacaugaaucccacauccauauagauuaaggcagaaaucaucagauuugcaggugggaaagcagcaucguguuuaugugaagaaacaaugagggcugcugagugguagaaagugccccugccuggccuaacaacagguucauucacagacacugagaugcacuggugcuguugaacgacuuccuaagguggcagaaaaggucuguacgaggcugggggcuuauucacugacuuuagcuacaauaugagugauuuuuaaacaacuuuaaauuguucccuguaugggaacagggcaauuaucuagacaaacaggcuaauuuuuacucuuaagcuauuaaguauauuacacagaacugugaaggggagucuguuucuuccccuguagacacacacuggauguucagcuggggccccacugacuggcagaguggcacccuccguugacucucaaggcaauuacuuaaguuuggggaggaaaaccaauucuaaucaauaaguauauuuauuuauggaguaucuucuauuuccagguauuaaaaugguuuagaaguagugcucuaauaaucuacuuuuuuaaaaagauguaagaagaaaacacacagaccagaguauggcacugacaugucuccagcauauaacucaaugguuacugaaaauaucucuuaauuaacuccuuuuucccugaauacuccuaaucagaccaaaccuuuuacucaauuaauugcugcuaauuaaacaugcaguguuacguacugaauuuguaacuagucuuuuugaacuuuaaauguaaucugacacaaauuagaagcagauaauuaugaauaaacuuaaaugaaaggcauuuguaugaacauuuuauaguucguacuauuccaacagauguccaccuccaucuccaacacaugcacacaccccuuccacaaaauucuacugcauuuuaaugguaguggucuccuacaaaguaacugcugagcauaauuuuuauauuaccaaaacuauaaaaauagcaucuuaaaaguccuaauucuaugccagaauaggccauugguauuaucuauucauggaggagggaguuccauucucugaauaccagauuccuaauccugucagucauuagaagcauucaaagaaugcacaugcuucuacucagacaccaacaaucauauuuuaaccacccaguuguugacaauuaugugaaagcuaaggggaaguuuaacauuuucuccuacauaaacccagucaguuugucuaugacagaauuacuuuauugaaguacgcaggcaugcacaaauggaaugcacuguuuuucuaacugcaaauuucucaaccaguggaaaaaaacuucaucuuuacucaaggcacuaacuacacuacauuuuaacacugcaaucacaggcaguguaugagaucuuauuugugacuaaugaacucgauuugguuguuuuaagggaaacaaaugaaauuucaaauauguuaaauaaacauaguuuaaccaccuagaacacaucaguaaguuuuuuaaaauuacucuccauuuccucaaauuuuuauuacaugaucuauaauuaaucuauaccuguaccaauucuaaugccuaggagagacaauuucuaaauauguagagcuacagacuuaaaaaagaaaacaaguuaaauggaauauuuuaauucucuaaacucauuaugaagaagacugaaagggacuauauuccuuguacuaacaauggcacugaagaaaacagaaaacuguaaacugucuucccaacauuucaucacuuucagaggaucuggcaugagcaggaacauccuaaagcaacgugacuucugauuguacagacuguaugcucuaaagcagagcccuguuucuaucgggguggaacuuuuacaagacacgcauuguggacccaauggcaacgccuacguaccaugcccaggaggaacacucccaacauggcaccuggcacauaaagugagcuucaccagcccacagaaugaaugaaugaaugagggaccaacauggcaccuggcacauaaagugagcuucaucagccuacagaaugaaugaaugaaugaaugagggaccaacauggcaccuggcacauaaagcgagcuucaucagccuacagaaugaaugaaugaaugaaugagggaccaacauggcaccuggcacauaaagcgagcuucaucagccuacagaaugaaugaaugaaugaaugagggaccaacauggcaccucgcacauaaacugagcuucaucagccuacagaaugaaugaaugaaugaaugagggaccaacauggcaccuggcacauaaagugagcuucaucagccuacagaaugaaugaaugaaugaaugagggaccaacauggcaccuggcacauaaagugagcuucaucagccuacagaaugaaugaaugaaugaaugagggaccaacauggcaccuggcacauaaagcgagcuucaucagccuacagaaugaaugaaugaaugaaugagggaccaacauggcaccucgcacauaaacugagcuucaucagccuacagaaugaaugaaugaaugaaugagggaccaacauggcaccuggcacauaaagugagcuucaccagcccacagaaugaaugcaugaaugaaugaaugagggaccaacauggcaccuggcacauaaagugagcuucaccagcccacagaaugaaugaaugaaugaaugagggaccaacauggcaccucgcacauaaagugagcuucaucagcccacagaaugaaugaaugaaugaaugagggaccaacauggcaccugacacauaaagugagcuucaccagcccacagaaugaaugaaugaaugaaugaaugagggaccaacauggcaccuggcacauaaagugagcuucaccagcccacagaaugaaugaaugaaugaaugaaugagggaccaacauggcaccuggcacauaaagugagcuucaccagcccacagaaugaaugaaugaaugaaugaaugagggaccaacauggcaccuggcacauaaagcgagcuucaucagcccacagaaugaaugaaugaaugaaugaaugagggaccaacauggcaccugacacauaaagugagcuucaccagcccacagaaugaaugaaugaaugaaugaaugaaugagggaccaacauggcaccuggcacauaaagugagcuucaccagcccacagaaugaaugaaugaaugaaugaaugagggaccaacauggcaccuggcacauaaagugagcuucaccagcccacagaaugaaugaaugaaugaaugaaugagggaccaacauggcaccuggcacauaaagcgagcuucaucagccgacagaaugaaugaaugagugaccaacauggcaccugacacauaaaacgagcuucaucagcccacagaaugaaugaaugaaugagggaauggcaguggaaaacagaccaaaaacauccugcuaugccaggacugcuuccugguggucccccuuguuaucccgacucuggaucucuuggccucugggucccggaaccguccaggaccgcagcuccagcuguuuuuuuugcugcccuugcugccucaagccccaccccagcaggccccagcucuggggucuaguccucaacccaauuccaugagggaaauccaccuguuaaaggcgaguggcaaaaauccagguaaauguggaaggggugggaggggcacgacaccucuuucugagguuucagccaauuacaaugagaugagucaacacuguuauggagcuuccugcucugcucaagagaaaauacucucugacaaaaaagugaaacguuaaauuacuaggcaagcagcuuccuaaguguguuuaauuuaaccaauguuacagaagaaacugugguuaaaauaauuucagaaauacugaauuggucaaauaaaguuuccucuacuacguggcuucucagagccuugaacugggcuaauauugugaaucccccagaacuucccccaaacucucugaugggcuaaaaguuaaaaaaaaaaaaauuccuuucuccuaacauguaaaauuguaucuagagaucaauuuaagccauuuuugcagauacauagaaaugcuucaauacccagaacugauuuuggaaaaguagaaacagacuuuuaacaacugcaaauuuaaaaugccacugaaggcuccaaaaguaccugacucgaucgaguacagcacuucagcauuuuucccuuuguccuuguccagagccgucaccugcaacacaacugagccaacggcugccgauucauaaacccgcccuuuguaggaggaagcggugaaccacggggcguggucauucgugucgcugacauugaccacaauccuugcaaaguugcguuuuacaggcacaucuugaucucguaccuaaaaagaauugacacauuaucaaucccauuggugcuuuccuuauaacuaauuaaaaaucacgcucgaacacacaaaggccucaggaccaaauggugggaggagagcggguagagcgccuaccaugaccgugagggugugcuggugaacagcuucaugauccaguuucucagaaguauagagagagccgguugcaggaucaagacgaaauuucuugagacucaguggaucucuacugcucugcagaguguagauuaguuuguuuuucucauccugauccacagcacugauuugcaaaauuucuguuucuggcgcuguaucuucaggaauaacaacuucauacuuugauguagaaaacugaggacgauggucauuugugucuauuacuuugaugaauaccuguaauggaugacaaaaugacucauacaauauuuccaauuaugaauguuuuaauacuuaaagaaccaugaacgaaagucauguauauugaaacgauacuguggcaaaauaaaauacgagaaaggcaacaaaaaccuagaaucauacauuucuuaaaacauuucucauugguauauuacuuaucuaaauaugaguaagauaaugaugaccuuucugcauucuuauaacuaacucugggacaaaauauguauugauuuucacacuugccacgucuuuacgugggcuuaacuucucuuacgccuccacagagaagguaucuguaggucacucauguacggauaacaauuuaccaggauuuauagaagacuaauuucuuaaaucagauuuguaucugcaacuaccaacccacugagguaagacagaugauuacacuauccaaauuucucauucucaucuuugacaucccaagccccugaucauagguuuuuuuaauacguaaaaagaaaaaauaagaaauguguuuagaaaucacuguauuucugugaucauaaaccuacaucuauguaguaaauauguuuacucccuaaaaccaauuuagucaauagauugaaaaaauaaacucucuuaacuaugucuacauaaaguaaaaaccuuuagaggaaaaaagcaaauguuaagaaacuugguacuaagcuaaauuagaaacaaacaaaacuuugacaguaagaggauuaauuuccauaaugaaaagacguauggauuuggcacagcggaaaucacugccaauuauaaaacaugcuuuagaguuuaagaagaagaaaacugcgcuucgugggggcauauggaacaaagggaucugcugguccaagcagcacagggggccagggucccaggcagagcggucaaccacauggugcaggccaugaacagaggccuuccuuccaugagggcuacaucaguguucucacagaagaccaaaauaucaaggauguuuuaguuaaauaaaacguaacauuacauuuuguaugaauuccagaugcauccaccaaaccacggaaagguugcaugugaaagcuauguaaaccuuuaaaacuacagaugccucacuuuuacaggucaaugaugauccagaagggauggcuauaaaggcaauuaccauagauuagauuacauauucauuuccacuauaaauuuaaaaauuacuuuucccauguaguggguacugagcagagaaguuuaauccugcuccaagcucaagcauuauuaaguagaaagaacuggaagucaaagcaauucaauugaaacacacggauugugcguuuccaugcccaaugcuugccugggugugaaaucagcaugcaauggucucugcccucauagagccaccaggcuuaccaggcaauguucugcacaugcacagccuaaccaugucucauauauuaucauguaaaguuuuuaagaguccagagacuggcugagauauucagaaagcucuuaaggagauaaugcuuucuuggguacauuuuugguuggcaggugaguaaguaugaggaagggcugcgucaacgacaugaaggcaagcagugggacggaacauccugccuuucagaggcuggagaggacuuggaacucaggggugauacaguaaaggagcaagaagaaggcagagucaaauacgcagagccucgacuccagaacugaugugggaggacuacacagcuccuuuuggucagaagaaacucgcuuccaacaugaguggcagggaugaagaauggcgacuggaaggugaauugaguguuggugggacaagagcccaaaccagugcugaugugcaacaagacuauggcuuucugcgugcuuacugggugacaggcucucagaacgugaagaacaagcacccugcgggucaccucaucaaccuuccuaagaccuccaaaaggacgauuaucaccacccccacuuuguagaugagaacauggacacacagagaguuacagcuauuugcccauggaaaggaguacaagagguggagccgggauucaaaccaagugaucugcuccagaggccacgaugcugaugcucgagagaaaguuaaagaagauaugaaagcaaaguuguuugaaugaaagaaaaaaaagguaacuggauuugguaaguuaccuggagauacaagauaaagccaagugacuggaaucaauggcggucagcauccuaagccacacacgcaggacaggaaagccagagaagagcuguuuccgcagggcacuggcaguucucccacuguccugccgccuaccucugcuggaggcugcccgcuugacucaccaacggcucaccuaaaccuucucaaaucggcaucugcugccccugaccuggauacacaauggcugcucuguugacuucugaguguuacuuccaagccccaauccauccccgagguauccuagugucucaccucccagcugaccccucugcucuucaauccauccccgcaguauccuagugucucaucucccagcugaucccucugcucuucaauccauccccgcgguauccuagugucucacugcccagcugacuccucugcucuucaauccauccccgcgguauccuagugucucacugcccagcugacugcucugcucuucaauccauccccgcgguauccuagugucucaccguccaggugacuccucugcucuucaauccauccccaugguaucguagugucucgccucccagcugauuccugugcucuucaaucaauccccgcgguaugcuagugucucacugcccagcugaucccucugcucuucaauccaucccugcaguacccuagugucucaccucccagcugacuccugugcucuucaacccauuccugcgguauccuagucucucgccgcccagcugacuccucugcucuucaauccauccccgcgguauccuagugucucacugcccaggugacuccucugcuuuucaauccauccccacaguauccuagugucucgccgcccagcugaucccucugcuuuucaauccauccccgcuguauccuggugccucucacuguccagcugauuccugugcucuucuccagguggcagcugcugcaccccccucccgcccccacccaaauucauauuuccagguucucagcuaaagaggaaaaauaaucuaaacacaaaucauucccuuugucccacaccuuaacaggucaaccugggcuacuguucucuuauaguccgacugccuuucucugccagcgauuaggauagcaucuacagccuaugacaauggcccaaaaauaaguuacagaaguauaaaggaagcaaugaaauuuaagauauuuuguguuuccaagaaagaaaacuagaauacacuuccuggguuuuauagggauuuuaguuggugcacgugauauuucaugcuaaacuuuuaacugcacuaauuaaaaauauaauuauugggaaagaggugcacuguuaauuauucauagacguagggucuuuaguaaugagaaugcuuggcaaagagggacagcuccacuguuuaugaagcuccuuuuguuagauuucuggguagucgauucugugaauuggucuacaguuauaccccuuaaauccuucucucagaauuauccuauuagauuuauuacaauuuaugauguuuuuauucucauuuuugugcucuaaaauuuuacaagggcuuauguuuaaagagagaaaaucaauagauuuugcuugucucuagaaugagaacagcuaccaacuaaauugaaauuuugacaccauacuagaacuuuuacaagacaaucucaaaaugaccccaaaagcauauaacauacauguaucaauuuuauauacacuaaaaaucacaagcauuuggagaaagaaauauuuuuguaaauggcuuuaaauuaucuacccauuuauuaaucgaaaagacaucaccgacuauaauuuuuaucuuuuaaugcagcuaaaugaguuagcagaugaucugucuugcuuaguacuuaaaacaggauaaucuaacgcuagaaaauuucaaacucagaugcaccuuguucucugacauuuaacuucuuucuuuuucauuuaggccacaguagauuauaaacaagccuuuagcuucugccaucccaguguaagcuccaagagggcaagauuguugccucuucuguuuccuacuauucaccuuccagaauggugccuggcauguaacaaguguucaacaaauacuugguaaauaaaugagugaaugacacucugcuugcuccugaaaccucaggaugcuucuucuaucuaggaauauuccuucuguacacuccaaacggcccacacugagaaccaaagaaaaguaauaagaaagaacagaauuuaaauuucacuuacaggauuuuaacacuuaaguuugaaauccccauaaucuggccaucucaauuaccagauaggaacaaauaaaggugguaaaggaauuauuagaacaauuuuauuaguuauuuuauauagccaggaggaauccaaaaaaaagugauuuagaagauuaaucacuuuaaccaguuuuacugaaaaugauuuaaacaauucauucucaacagugauguacuugauguuaacauaguuuaaaaugaguguaaaauucgaagauuuugaugguauaacguugguuugguuugguuuuugaagucuucucucaaaauucucaaaacugcuuaauuauaugcaaaacccaaauugggauauggaauuaauuuucuuucccuaaauaaaaauucuuagugugcauguguguaaacuucugauuuuagacccucacagggcagaauccaccgcucauauugcccguggaccccuaagucagaacguuaucuccauccuccucugacaagugugucauuaguaauucacuuaccugagugaggauaguggugguuccaucuguagccucgacugugagguuguaguuugacuucuguucugcaucaagagguuuggcaacaaugaugguuccaguucccuuguccacaucgaagugacugucguaguugccaccuaauuuggggaaaaaaaaguaaaaacaggucacaggauaacacucuguaguuuauucuguggcuuucucauacuuaauggcacugaaaaaucuucuaauauacuagcaaagagcuuccaaggaggagcauuuugaaagaaaagaguggccaauuagaaagacaaugcuuguuaaggcaaagugaacccuaauuguccaggaagcaacuaacugaaagaaagcaagaaagcaacucugaaaacaaagacauugcuaauauugccaaugaguuacuuucaauuugcuuuuucagggguucugaauuccucuucaauuuguaucucaguagauaccaucacugggccauuuaaaagcuuacuuacuaacaaaacuuucugauacuuugagcaaauugaccuaauaaaauagcuauuaaaaaucaauguuaacucuaaaaaaaauagcggucguuaacuuuaauuaguccuggcuacuauaaacuauuugaaaagaauuuuuuuucucauuuuugacaaacacaaagccuaaugaaacaaaaguuucuauccuauuaauauuauccaaauauuuuugauaaaacucucuuuucaaauccaucgaccuagauauaaaaugaaaugggaugaaaauagagguuuaaugucaugaugaaauucuacuacuaaaucuaaccaagaaacaaaacaacacacacgacgucuuaagagaaaccuaaaaccacggagcuaggugagcauuacguggcaacacgcuggcgagugggaugggugaccaugcgcacacuaugaaaaaaaaaacagcgauggaagauagucacuggaaauaaaaaaguaaaaaaaaacaaaaacaaaacaaggcuuuuauuuuagaucucauaaucugaggcaaauuaugugaucucagcagauaccuucugcuguacaggucgggucacaagucaucugaaagauguaaaaaacuucucuagcaagcgugucuccuggcacagccaaaaagaagcaagcgcgcauggaaagcaagcacagaauaaaagcaaucaaucaaaccagguccaagcacagcaagguuacacagcgaggucagguacugcacagcagcagccuguugaucuggaaaugugauaaaaguuaacagaaagcaaacaaacgguuuugagcaucguuaacuacgaaaauagucucuuuuuccccuucccuugaaaguaugcuguaaggguuucacaggugcugaugacaucaauuucacacaaucaccaaauugguaaaacagccaaagcauuuagcaugaaaguuccaaagguaaggccuggccuggccugacaugcccaguggucuggguccaucagcugcaacuuuugggggcuucggguuagcaugacuaaggggcagaaggggaaaaauggacauaaagucccccccagagagaugaaucgcaacagagacucuuguucuuaaauacccuuguaacuaaaaugugaggaaacaauaaaaaaaaaucuaagaugcaaacucuaaugugaaauuuaaaaaauacguugaauaggguauuacauucaaugucuuaucuaaacuacaugacaaauaagaagaagaaauggcuuuagcaaguaaacuuuacuggaggaugaaauaaucuaaugaauccuccuaccuguugaaaaugagguaauauaaaacuaaaaacccauagcugguaccauaacuuuguaccauaagcugguaugaaucaaaauuuguaagcuuauucccuauuaaauauugacaugugacagucacacaggcauaguuacuuuaaauguuccaaucauauucacuaaaaauaacaaugugccauagguuaugcaucaauaaaaauaacaaugugccauagguuaugcaucaauaaauaaacaguaagaagcugugcuucuggaccaaaacauucaaggcuuuugucuguaacucuuugacaaacuuuuacaaaauuuuauuuuuauaucaauaacuugguagaauagagcaccuauuuuaagcaaguuuaacauaugcuauauauugugaaaaauuuugcaaucaaaauauuauaguugaaagcaaauucuccaccugucgaucuuauucccaauuuuaaauccugacuugugcccaaaacucaucaaaccguaugcagguucuccucaguguaacccauacggacaacgaaaaugagggggaaugcuuaccagugaugucaaaccaaagggguaugccaggaggcuccacagauauuacuccaaucaugugagcaacggggucacuuuccaucacaguaaagguaaaaaaugauucuucaaaugaaaugggcuccagggacgguuugggcuuggagauccauucaauauggagucuggugguugaugacuuuugagggcgaccauugucaacugccuuaaucuacaacauuugggcagaggggauuaaaaacagcaaaucaggaguuacaacccagaaaugaaugaagcacagacugguuuggucuuaaacugagccaauuucaaacauuucacauuuguauucuguguauggaaugccugacagaagaacaaugauuucaugaccacauucaacauaaacaauaagcacccugauucucaaacguuauccggcauugccuaauggggccagcaggucacaaacacuucagccguuuacaaaauagaaauaaaguuacuaaagaaaaaauacaaaauaagguuuauagucacaacauaugaaaaauuacaguacuacaaucuuaacucacugaaagaauaucauauucuccagcugcugaaaaccucuuggacgaaaccacuccaguuuucgguucgaugaaaaauuugccaugcucauucccgucuucgaugcuguaggagauuucugcauuggggcccucauccuugucgguggcuaugacgugauagagcggcucccgucuggcauuucuuucucggucuggcuuuucccgcucagggagucugauuuuguagaacuuuugcagaaacugagguuuguugucauuuucaucaaggauuuucacaaugacucuugcaaugguugauuuggggggacuaccauugucugucacaguaaccuguuuuuuuaaaguuaacagauuaacauguuaagauauacuauauaaaaagugagcaucuucuuccucaugcuacuccgcauguguguaaagcucugcauuuugcagggcacgaugacaacauacacagcagaucuucauuccaacaacagggcuguaaggaggugaggcagcaccucccaucucuacagggagagagucagggggccgggcauggcuaagaaagaaacagcugcaccccugcgcgccuuccugaccacgcaggcucucuucucgcauuaguuuaaguggaaagugaaccucacccaaauguuaagcuaccaaaaacuuaauaccuuuaggccauggaagagauacgugaagauucugcuuuacacauuuaaagagucuucuuaaaaacaacacacucuacauacuuaaaaacaaaauuuccauauaucauguuaaaaauguuaaacuucaucaguaaaauaugcuaaauugucauuuuaaaguauguguuaaauaaauaguacaccuuuuaauaccaguaaucaccauuuuauuuuggcuguuuuccucuacagauuuuuauaggaguggaccuaaacauuuaaauuuaagaccaacucauuaaauaagauuuucgguaaaauaacuuucauuuuaaguaaacuauccauauauucuuauauucuauuuaggaaaaaauaucagagagucuugaggacugcacugaugacuguuucuaugucccuaagagaccauuucacccuuaaaucaaauguucacguuuacgucaaugggcacauuaaauauaacgacauuaguaaugcuuauucuccccuauccacaccccuaccuucuucccaacugaauuaccaaaacacuaaaaacggucaaggagacugaagucuggcaguuguaaacccuguuuauuaaagugugacuauaucccgauggugccugucaaaaguauuuaaguaguugcuuuauauuauuuaccuuccuaagcuuuuucaaaauaaaacauuacuauuuuaauuuuaaacucucgaaacauuuccuuuucaucaguuugcauaugagcuuuagaaaaacaagaaagagaaauacaagcaagcacuauguuuuuuaguauucaucaccaaauuguuccuaacuuuggguucaagaaccaguagcuagucacagcuuucaacauguaauggagacacuaucuuuaagacagccaaaucaaugccagcacuggcucucaaauauaccaccccaaaaggacccuacugaaaaauacacuaauuauguauguugaagggaaaauuuauuucccauccauguccaaauaugacuuucaaagugcuauauaucugguaucugcuuccaccuagccuuugauauucacggagaaaagaggacucuggagugacguaugcaauuaaugugaaauuugaaaggacuggagcaaaaugucaguguaacuacugcucuccuaucuucccaucuguuuaucuuugucagugacugcauuugccccuucugucaauccuuguagugacagaaugaaaauucaaaacuuugcucuaucauaaagaaaaugaauucaagcgaacuuuacacccuaugaacuaaaaacucagauguaauacaugaagcagcuccuaauggggaaagcacuguggcugugaaaccaccuuuuccagaggguauucccaguucccaaugcacacacacacacacacacacacacacacauacacugcacaacuauaaaaacuaaguauuuacugacaacguuaagaaaauuugaccaaggauaaaaugaaauuaagcaggcagcauuauaaacagcaauauuaaaagaaauuuucaaaaguuacaguuuagaauuuugucacuuauacuguuagaguggaagaagagcacugauaacucaauuaaacaaaggcagguggccuuuuccaaggcuggcuccgauaaugaacaccagucuuccacacgggacagagagaugucucuacgccccucucugcggucugccugucucucagccgcuuccugacgacacggcccagagaucucaucaaccugauguccauguuacgcuccaccuucccucuccaaauuacucgcggccuuuuucugcaauguauuuacuauuagccaaaaaccaggugaccaauacaugauaacaagcuguggguuuucuaaggacuaaaaggcauuguaaauuauccaugagaaugagaagccuuauuagaacuuucuagaagagcacaucugagacuucaaucuacuuuuacuuuugagguauuuaagaagcacaaacuaaguaauucauaguuuaaaacgcaaaaauaaugcaacuguuuaagagcaaaaaaaugaaucuggaaacaaauuaccucuaguuaaaaagguugaaacagaucuauaaauaccaacauaaauauaucucaaaaacauaauaguaaggggaaaaaaagauguauacagaaaaauaucacuuauguaaaugcaaaugaauuccacaugacacuguuuauagaucuguucgcccccugugugugcgcaagcauaaaauacaaagaucugaauccggcccaugacaguggcuguguauucugggaaugguauugagggauaaaggggacaagagcuauauucauuaacaauuuccuuauauuccuuuuuccuaacaaccaguaaauaauauuaauacaacaaaauauuaauagcuaagaauacugguuaaugggaacaagauuguucuuucccaugauacuuguaacuacgaaucuuuaaguauuaaagauaaaaaaaaaacuuaccucuaauauguguucaucuugcuguucucggucuagcuuccuugacguaguugugaugagaccuguaaaaugauaacaguucauuaauccucacaaaauaaggucaauuacaaaauacugcaauuaaaaucacacucuuggccaggugcgguagcucaugccuuaaucccagcacuuugggaggcccagggggguggauuacuuaaggucaggaguuggaggccagccuggccaacaugaugaaacccuguaucuacaaaaaguuagccaggcaugguggcgcgugacuguaaucccagcuaauugggaggcugaggcaggagaauugcuugaaccugggagguggagguugcagagaucacaccaaugcucuccagccugggcaacaaagugagacuccaucucaaaaauacaauaaaaaacaaaaccauacucuuguaaaagucugagcaaauuucuucucaagaaaaaaagaagaaagaaauuucuuacuaaagaaauuuaauuuccagguacgguuauuuugucuacaaacaacaacauacuuuauacuuucucacuuuaaugacucauauuggauaaaugacaaauaguaagaaaguggaaaaacucaaaucaguuacauuuucuauuuguuagugguuucaauauacauuuugucagaaaagauuuuuuaaaagugagaugaaguuauccaggauuucaaucucauccaucuccuuuaacugcucaagagauaacugagaguugacagaaaugacuucuauaacuauauuaauaaggacuauugaaaauaaaguguuaacucuaauuuauuaccuuugaauuauccacucucauaaauaaagaacuguuauaaaaaguaauguaauuuuccagguaaucuugcucauuuaauuucccauaaaagaaaauuaaugauccucaaauucuguauucuagaaaacaaauuuccuaucaaacuagaauaucuaugaguuuugaccucucuugagaacuuuaauaacugcucaacugucugcauauuuuggaacuagaaggcaauuacaauuuauaaaauguauucuuaugcuucaccaaaaccacaaacaaaacuccccuaagcacuaaaaugucguccccaaucuguguugauggugaacaggugcaugcaggaugaucugcaccuccgaccuuaaaaccagguggagccuguguggcaggacaaucaccagggcugaacguucuccucccagugcugcggcuuuuuucucauauggaaauaccuuaaauaauucacauuuaagaauagacauuauuaaucuaauuuauuuucucccauaaucuuuacuaauuucacagaacuaucacuuaagggauauucaacauguuucucugcagcaauaagugaaaggcuuguguuuucacuuaauucaaagguuuuuuuccuuaaguaguuacuaagaaucuaaaucaacauuauuuuccucacaauucaacgaaacaguguucucuuuuuaacaagggcaacagaaggcuauaucauaccuccacacugggguuuucccagaucauagguauagauuaaaaggugcuaaagggaaaugcuucacagugcuuacggguguaaaaaugacgcuugaauguggcacaagcuuaauuuucauuagucaaaaaccuuuuaaguuaaucucuuuuuuuccccaaucaaaaauguaccauccucuccuaacugugguuguaaauaguucaggaacgacaaggagccccuugauuagucccacaucuaauuauuguaauguguccaccaagaaguugugauugaugguaacaucacguggaauagcagcuugacacguucccaggaaaacaguauucuucugcagagcacuuaaucacucaccaacagcacugcgcaaauacuuaugagcaaauacaacuccccacuucacgauuuacuuagagcacacaagaaggcuaaggaaagcuguaccuguguccauacuaccaauuccacauaaaaaggcugggcaugguggcucacaccuguaaucccagcacuuugggaggcugaggcaggcggaucaccugagcucagagguucgagaccagccuggccaacauggcgaaacccugucucuaccaaaaauacaaaaaguuagcugacaugguggcacacaccuguaaucccagcuacucaggaggcugaggcagaagaaaagcuugaaccugggaagaggaggccacagugagccgagauugcgccacagcacuccagccugggcgacagagcaaaacucugucaaaaaaaaaaaaacaaaauccacauaaagccaaaaggcuaccugaccaccuccuuccugggucugaaauuauuugcauguucuauacuccucaaauuaauucuccuccguuaacucagauggagcuuuaauuucaucccaaugcaaugaaugguaauauuagccccuuucuuuccacuucagccugagucacugccucacccuucaguuuaaacugaagcggguuuaaacuuuuaaacucacugcagggccuggcguggguuccugcugcugcauucuccaaguucuaauauuucuucuaucauaauauuacuccacaguauuaaagccccucauuuaaaaauuagucuucuuuucuguacuggaaaacucacgaggacaguggcugucuuucuugcauagcuugcucacauagcuaucucuccgucauccucaagaaacacuuaaacgugugaacaugugaauuucuuaaaacuaugaaugagcagaauuaaaaauaugugcuagagugagagagauaaacuacuguaaaccugaaaaugauacaaauccacagcccauaagugagccaacagagaaugcguuaguacauauuuauaggcagcgugugccaggugcugcgauggguggcuaggugcugcaauggguggcuacgugcugcgauggguggcuaggggcuggcggcacccugcggguauuuagaagcacagacccgaggcgcagggaagaagcugugggcauacagacaggugugacucagaccacacccacagaagugagcauaauacuaaagagaacagugggccuauaaaaacgguagagaaaauagcgggccgaucuucaaccuaggaagcaaucugcuggaagagaagcuucgugucccagaagccaaaggcagacgauuuuaaggaggacguacuuuggaggagccuggaagaaaagagaaagugaggcaggaaguagaccaggagaaguauuacuuuuacgaagacgagauugucucacauguaacuguaaacuagagagaagacgaagauguagacuuccacuaacaaauacagucaccacuagccuccugagaccaguggaauuuaaauuaauuaaaauucaguaaaguuuacacuucaguuucucaaucacacuaagccaaauuuccaggguacggcagcccccaggggccggugacgacagcauggagcaaggcagauggagaacgcgcuccccacggcaggaagcucugcuggacggcaccggucuacucaggaggcauaauucacaaaucaagauccugcaagaaacccugcaggguggguuuacuuuucugcggagaacacguaagauauuucagacugacaaaaacaaacaaauaacaacaacaaacuuucuuucuaaauucacaacacuuagcaaaaagaaucuuagcaaggcugccguagugcuuuucccuaaugccaucuccagagagaggccgugcaugaguguccuauggggguggcaccaggugaugcacccccucugcgaaaaauuacaguaaaauuagggcuuccugugggauuuucauacaaaaugaaaacagaauuuccuaaugauguaauuuaauacuaggcauucugggugucuuuucgaggugcgcuuuaccuuacagcaaucaaccacacugagugccuaacaccccggggaacgcuacccgaacccccugcacucuggccauacaagacaaucuaccgaguguguucuguguucacacucauucacgccucugugagcaucacuccugcuccucaucccccccccacccccacccacuugaaacaucgacuucaaacauaauucuaaaguacaacugcuccauauacccacuacauguuauuaaccuaguagguaguaaguguccuaguaaguauguccacuucuuucauuuucgacaucugugcucaucugcaauauuuuuugccaaaucccagaaagauauauacuuaaaggaaacuguacagaacuucagaacuagacagaaaccuuuaagauuaucaaguugagcugccugaaccaaagagaaguuaaaauuuuccaaggccacuaguaagucauuaacaaagccaggaguaggauuucguucucuugaggcucagaugagcguuuuuuucucccuaucacaccugacugcguaauuugcuguauuauaguauuucaacacuccaugaacucugaacugugacuuucauaaacuguaacgaaaaaaccaggaaugacucaucauuagucauuuaauagauccaaaaaagcaaguuaggagauaaaagaggcaaaagcagaaaaacguauaugcaacuguuuucuuuuuguaacuuuguguuucaucuuccucuucugccaagcacugauaauuaaaaauagaaaggaagaaaaacuagaaauuuuucuuuccuugguccagaaaaacacugcauucuauauaauaaaacuaugauaaauguaggugggcugagacagcagacacaguauauucucaccaaugagcaguuaccaguucaccccagaaauguaugcacaaugcaguaacaaaguuuauggcacuugaggaacaucauuaaaaaccacucauggccuuucaacgccacuuagacauuuagagaugaguucauuuagaacagagagaaugucagaucagcuauguuucaauauaaaauugugcucuuugacauuucuuauaaaucaguaacaaaaccaucuccaaacuucucaaaauucaagagauaaaguagacuucgcgaagcagauagacguaaaagugaacaucaaaggacuaguaggugaagacagucaugugacaugguccacacagcuggagcgaugaaugcauucagucaacuguguuguacuguccacucagaaaguggagauaagacagucuuguuugcaagaaaccaggaugaaggcuagaaguuggcaaagacuacuuuacaugugagaaacaguaagacaggauagauuguagggcacugacagaaaacacagugcaggagcuacacacagaaaacaggaagcaggaggaaggcucuugccagcaacucuguguuccagaaaaguguggacuugguuggaagagaagacacguggucuagucauucgugcugcuccaccauugccugacaugugagugaggccaccgaggaccagcuggccaccagccaagccugcacaagaguggaagaagcacccggcagaacccuaaauuaugaguuauuucaagggcggaagaacugcccagcagaacccuaaacuaaauuaugacagcuauuucaagccacucaauuuugacaguuuguuagccaagguauuaugcuuuaauagauacuucauuacauauauauauauauauauauauauauauauauauauauauauauauauauauauaugccuguaaaaaacugagauauauccacauauguauauguguauaucuucacauaugauguguaaauaugugaagauaucuccauuuuuacaggcuuagagagauuaaguugcuuacucaacgucauuuagcaaaguauugaaguuggggguucaauaaaucuaguaagucuacauuaaaagugaaagaaaccagggagggacugaagacugugguucuguaaaaaauaaauuucaacaucagcacaguggauaaaaauggauggcauaaucccagcacucugggaggccaaggcaggugaaucacuugaggcuaggaguucgagaccagcuuggucaacauggagaaaccccaucucuacuaaaaauucaaaaauuagcugggugugguggcgugcaccuguaaucccagcuacuugggaggcuaaggcaugagacucacuuggaccugggaagccgagguugcagugagcugagggcggaccacugcaauugagcuuagguuacagagugagacugucucacaaaaaaaaaaaaaaaaaauauauacacacacacacacacacacacacacacacacacacaugaaagauggcagcuagaaaaggaaaaaaauaggauuucugaauaggauucagguccaacugcaacaagagagcaagcacuugcaaucuguaguacgagucaucgaugaccccacacugaaagacaggguccuggcucuaaaggaaggaaucucugcagcccuauguucaccucacccggcaggaaauuuacuuggaacacuuuucaauuacucuacuagagaauaagcacaggaagggaaaaagaucaaggaaaaaagguaaaaaucuggucacccgauaccuuccuuuuacucugauuauuuuccucuacccccugcaaugauuuuggccuuuccgcccuuuuauuuuacaauaauucaugaaccacagccauacacguucuagaaaagcacuguccaacagaaauuucugugaugauuuguguguucuauaauuugcacuguccaauaugguagcaccuggccacauguggccacuaugcacuugaaacagagcuaaugucaccauagaacugaauuuuaaauuuaaauaauuuaaauuuaaauagucaccaauuaugucugauccuuuauagcaucuccaauuucaaaugcugccugucaaaacuaaaaacuuuaacaucugcaauauucaaaauccuuuucugugguuaaaauuugaagcaaaaaauauuuaucuaaauccaaauuuuuguagacaucugucuuaaaccuacauagaaaaaaaaaaaaaaaguaaaacuuuccuagauuuugacugugcugauacugcccugccaugcuccugcuccccguucucugcuaugagucuccacuuggcucagcgggcgacgaagaggccugcuuuagaauugcugguguacuacuucaccugaacacguaccaaucaagaggcucugugcuuagcugugacuuggagaaucaugacucuacuaauuuguuuuguuuuugcuucuuuuuccuaagcacuaaaagugacuaaauuaaaucuauguucauaaacaguaguaaugucauaauguuuacgaucucagucacccacuuguucacugugcacugucauucaacugcucagaaugcuguucccaaaugucaccaugagagacauauacgaaagccuaagacaaggcucuuguccucaaaggcauacaauuuauuuaaggaaacaacuaccacauguaaaaggcagaggugaauauuaaacuguccucucacaguucgcuuuuuagccaccacuaauuauguguuucccaagacccagcucugggguaggcauuuuauaugcgucacucucacuggauacucacagcaacccuagaagggagcuaccaauacacacuaccuuuauuuuuaagauaucugagguuuagagaaguaaaaucauugccagcuaaaugcaaagcugagauuugaccccaagucugucugauuccagaguccaagcucuuaauucacauagacaacucuaaauguaucaaucauauuuaauauguauaaugauuauacaacaaaauuauucagugaucucacuuucuucuaggauuagaauguucucuccaccaagcccagcuccuuuugcaggaaggaguccucugggcuccaucccuuucucacgauguuguauuaaucauagcauuauucugacaaacccuugacugcaggcacgcacuucagauacauaccauuuucacccgaugaugucucugaaacacuuucauauauucuacuugauacuaaguuuaagaacuguaaucauaguauuuuuggugguaaaggaagugucuaguuuaaguuuuagggucuucaguguaauuucuucaggaguuguuacuaccaggauccggaaguuagauuucuacccuucaauccugacuguggcagggacugcucccagggacauucagugugcuuaagaaucagcaacauuaaggacaauuacaauaaaacaccuguaauacacucaugggcggacugugaaacuuacacuguuuggguaacuuuuagacaaggagcacuacaaaaaccagcaaggcaaggggcugaugagacaugcauauguguguacggauguaaugugugcacaaacuccugugcacagaagcugugacacguucaacccugacauauuacuucuggcuacuccugggaaauggaacagguagcuggagggaagagaggagagaggagggaagagaggagacaggagaacuucauuuuauacacuacuuuauuguggccaucuuuaaucuuuaaugggcauauuacucaaauaaauuuaaauauuaaaacauuuuaaagcucagagugaaaauauagacauauuugauggcugaaaacuaaacuuaggcuggaaaaucucaaaucaauuauuuuuuaagccuuauauacacuaauauauggccacacauauaaaaaacucaaacuccuuagaaauauugaaguggcauauccuauaugacuuuuucuaauguuuuugaguugcagcaaauuuuuaaugaaauggaucacgggugcuaaguauccucuuacuguaaaaauaaaguuugcuaaagccagagggucuuucacgaugcucuagcccaaauccuguaccuuaaaacaugaggaaaugaggucuaggcauguggaauaauuuccugaaggucugagucagcaggagaaacuuuccuaccaaggaaaguguucagaaggcucuacugcucgagccuuuuccugcagaggugugcaucgggaucauggggugugaaugccaaccccccuucuucccgcuccaugccagagccaccaaaucacacucuccacucaugaggacccagccuguaccaucucaugaagguuucccggugauuccaucccaugcugaccuccucaguacaggugcugacagaaguugaaaaaaauucacucuuuuuuuaacaguuuuguuuucagucauuauaauaauuacuacuggacauauucuggaacaaagcauauuaucuauuucuuuaaaauacuauuugagauacagagaaacacaauaggacuauggacauauaagaaauacacaguauuucucaaguaugguucuuaaguaccauaagaagcauaauuaacauugcaaaaaaugcaacaaagaaguggccgggagagcccaccugaagauuccaucuguucuucaacugcuuauuaaguccuaaaacaucacccagaaucuuccugacaagucugcaacuaccgaccaaaucauuaaagccuguuagaacaaaaguuaaaugaaauguagucuuuacaacauuaaaaaaauuaagaggaaucuaaauggcuauauacauuuccauugaacagcauauuuuccgucuucuuggaaauaccuuugugguggauugaaugguggcuccugcccaaaagauacauacaacccuggaagcugugagugugaacugauguggauaagcaucccugaagauguaauuaagaaccucaagaugagaccaccuuggauuuaugguggacccuaaauucaauagcaagagucuuuuuaagagaaagguagaggagauuugagucagagacccagggaagaaaggugucugaugacagaugcagagacuggagugguuccgucacaagccagcagguuccuggagacugggaggagcgaggauagguccuuccuuagcgcuuucagagggagccaggcccucacggcaccuggaauucaaacuccuggccuccagaaccgcgacagaauccaccucugucguuuaaauuuauggaaaguagccuuagggaaauaaaccuuuuuuaaaaaaauuaauggcuuuauugagguauaacugauauaccaaaaacuacauauguuuaacauauacaaucugaugagucuggauauacauacuaauacaccuuuuuauuuggauagcaaaugaaaguacugaaaaaauauuuucuaaaagaauuggguaacacuggugaacaauuccauuauucagagauaaccacuuuuauuaccuucuguauuuuguuagugucuucacuugaaauguuuuauggcuugguaggcuuaucacucuacacacgagacaaaaagcagaggauuaaacaaguaacucagcuccaaaggugaucugggaugaaacaaaauucccaaguggagucaugcuuucccucaggaggaggagagagcaggaugccucggcucuggaaugggacuuccuuaacaucucuggcugagaaccacaacucagcuaagucuuuuguuuucaguuaugaauauacaaaauaugacacaaauuauacaucaguucugaguauauuauuucucauauucuuuccucuccauaacagaaaaaaaacucccuaaauauugacuuaguaacucuauuaauaauuauacauucuagcuucaugccuguaacacacaaaaguuccaacucuaaagcuguuucaacuaaggaccaagacagaacagacucuuugauucugaguaaagcaaaauagccucucuguccucaagaguucacuucaccagcaacaugggccucaggguacaauaaguuaaucaaaauuuuuuuuacaaaacuaauuugccuaauguuaucauuagucagaaaaacuuaccugugcucacccuguguuuacccaaacuguccuuucgauuuuaaccguaccucuugcuucucuuauacagcagcuaagaaagaacaguaaaaaggccuaauaccaggaaaaaugaacauaaauuacauaaauagggaagauaugagaggucagagauuuaaguaaaagugcuuuagaacuuuacaggacauguguuacaaaucuugggcuccuaaaaauuguuuuaaauguccaugguucaguguugaaagagagcuugcucugaguuagguaagcuaccaaagaacuacagggaccaaccagaugcauggaaaacagagagggcaacaccacugguccagggucaaccaacugcacggaaaagagagggcaacacaauuggucauuauuuugauuuuuacaaugaaguauuaaauaauuaaauaauuuauuuacuauuauuaaauaauuuauuuauuauuaauaauugauaaauuauuugaugcuucauuauuauucauaaauuaauaauuaacaaauaauuacuaaauuuauuuauuaauaauaaauuuauuaauaauaaauuaauaaagcaccaugagcuacagaaauaacagacuguaacuguggaacuccagauagcaccugacugucccuuuguaaacaugucauccauggaacauucuagucuacggaucuguacccaaccagcuuaaauaaaaugaaacggccccagaacaaagcuguguaugugacuuagagaucauggcacaguccugagagcuguacaauggguggacagaaggcgcaagugagcgggagugacagaaacuacaucaagggcagcauuugucugugugaacugcuaugccuccucuuccaaugggugaaagggaaaauccuucaaauguggcugcuuuuaaaaaucuuucaugaguaucacgccugguucugugguggauacaauaaugaaugaaggugguccuggcccauaaggaccugagccaacacuggauccccccgaaacacacaccagagccaacacugaacaugcagagccgacaagccgacuaguccaccggcagggaggcgucacguccuccgcuucugcaaaacacagauugccuugcuggccacgagcaaacacgcagcuucuccuucacuuuaucacucagcacccagccccucagagcucuggacugugagcucggagaucuccgcagcaccgcaccgucuuuacucaggugguguccuaagaccacacgucacuacagccggcugcgcgcucuuucggcagcuguggccgucucagcagcuauuguuugucccugaaguacuggugccggcaggauuaggcguggagccaaaaauggaauucuauucauagacuggcgaggcuggaaagcagcucagaacucauuuaguucaaacuuucagaguuccaaagaaaacacuaauaaaauggaucaaacgacuagucuaaagucacauggggagucauacagggaccccauacccuagucuucagacgucucuucugcuuucaauucuaccuuacuagcuguuucuuguugaaaauugauggcauuaaaacauaagaucgacagcaaaacucaauuuacagggaauugccuucagugauccuauaaaugucagauauagcagggucagaagaagaggauaggguacacaacccauuuuauaagguuaacaucauguugacauaaaaagacuaaucucaggcacccaaaugcaaaaucuuaacuauaauuuuagcaaauaauauucagcagcuauagaaaaaccaaaugcugacagaauuuaucacaaagauucaaguuaaccaauuugcggaggaaaaaguuugucaucaucaacaucggcagaaauguacugaauaacauuugacuucuugcaaacuuuagggaugauauacuucacuuauuuuauaaaauaauaaugagcaugagaaagagauaggaaaaaaaucuacagauuccuccuuaaaauaucugcguaucuugguaaaaagacugcaaauagguaauuuuuuuuuaaaugaauuccugccauugaaaugcgacuggcccguccuuuccuuccuuugcagcuaucaaauguuaccggaaaccccuggaaguuguuugcagcuuuagcuauuuccuauugcaguuuguucaguauucguuccagccacaauaaaaugccauuuacucugguucagaaaaaaauaguuguaaaguguuacuggacuaacacaugaugagcacccaguauaccuaccagcuauucuaccauuuuguaacuuuacugcgugcuuuagggauuaccacacauaaacuauacaucgcugcccagucugcaaucacaaaucacauuuccuauaguaaacauaaaauaauucuauacuaaauacaggauuuuacauguaaagaagcgaauaaaaaacagaacacuguauaacgccguccucuaaaaagcauaugaaauggaaacugaguaauuugaguauaacaugucgacacagaauaagagaauaaacaaaaugggggagaugauaaagaccugcuaaguauacuuagagccaacuguuugagcugaaauugggagcucugaaaacuuaacaggacacaucaacacagaaaaaguaggaaaaccucaaaaucuaggaaaauuuaucuucuaaugagaaacaauuacuucccaauguagaagagaucuaacagucuacuaaccaacuugcaaaaucguaucugagaucucaaccuugauacugauacucuaauugcucuauuuaaagaauaauuuuguuauuaacaaccaagagaagugaaauacaaacauccuuucuaagcacucuugcuuagagcaacgggagggauucaauuuuuacuucagaaauauaaaagucuaucccuucaaaauaauuuuaaaaaucagcaaucaacgaaauuguuuaacuagucccaccaguaaauacguccacucaucaggagucaggaaagcacaguagcuuguuuuuguguggcuggcuagugaagaauggcuuuugcauuuuuaaaugguugaaaaaaacuuuugugauacaugaaaagggcagaaaauucaaauuuuauugaauuuauuucguuuauuuacaaaguuuuacuggaacacagcggugcucacucauuuccguaucaucuacagcagcuucugggcuacagugacacggcugaguggugugacagagacuguauggcccacaaacccaaaagccccguguggcccuuuauagaaacaguuugaugaccccugcgguacaugcuucauaaaacuaaguuuaaaaaucuaguguuacuuaaaaguuucccauuuuuggucugauggcaccauaggaauaagauuagccugaaaagcaacuauuauaugaaacagagucccucaaugcaaagaguagauaagagacagaaaaacuggcuccacaaccacauuuacacccaaaugcaaaggcacagggacugggaguggcaccaugcacugagaagcggcagccaggaaauucacauugccugaccucugguagcucugaccucugugaagucuuagauuauuuguaaaaugaagaaaauguaaauaaggagcacagcaggcuauugguaucuguagucaccaucucacagggcucuuguaaagaugaagucuguggaagcugcucguaauagaugagacacacuugucaauguuccucugacuccuaacgaaaguucuguuccagcccuauccaaaagugauggcaagacacaguagacggguggaagagugguauaaaaaaagacuucagagaaugagacagaaaggggcaaaacaaggaaaauuaggcuuugcugguuucccuugggcuaucuccuucaagcucagcucuccaagggaacaggcaugagacagcugauggaccagcaggaccagcaagauucuaacagugcaaugugcuccacaauaaugagaugggauuuugaguaaggaucacucuccaaaauacaugaaauuuuuacucuacagguugggcgcaguggcucaugccuauaaaaaucccacuuugggaggccaagaugggaggauuguuugagaucagaaguuggagaccagccugagcaacacggugagaccccugccucuacaaaaaauauaaaaacuagcuggucgugguggugcaggucugugaucccagcuauucaggagaccgaggaaggaagaacuugggcagaggaguuugaggcugcagugagccaagauggcaucucugcacuccagccuggacgacagagugauacacugucucgaaaaacaaaaaaaaaaacaaaaaaaacuucacucuacaggauggaggaaggaaaaccuaagaaacauuaagcugaaacaaacucaaaacacaaaaccuccauuaagaagauucacuauuuaucaaaugagguuuuuaugguauauacauauugaauuguguacuaugugauugcauuauguauuuaaaaucucaggaagacagaaauacagguagcagcugucaaagagccuaaaaccuuuuaagaugcaaauauagacacacagaaaucacaaacauacauauauagucaaagaggaugcccuguaccauuaacuacuaaacuuuucugauaaauuuauuuuuagucauaaauaaauuucuuucuuacuguauuuguucucaaagaggaagaugaaugagaagagguaaaaaguaaacauugguuagauaaaaucaguagaccagugaaauggacagugaaagguacauggauaugcacauauauuccuauaauaauguggcaaguucaucaguaaccacaauaaggugauuuuuuuuuuuuuugagaugcaaucucacuguugccuagguuggagugcaguggagugaucucggcucgcugcaaccucugccuccuggguucaagcuauucucaugccucagccucccaaguagcugggauuacaggugugcaccaccacacccagcuaauuuuuguuuuuagcagacaugggguuuugccauguuggccaagcuggucucgaacuccugaccucaagugauccacaagccucagccucccgaagugcugggauuacaggcacgagccaccacacccagccaaggugcucuuaaaagcacagcauccaauacuguuauggaaaaacccaagaugcauauccauguauacaguaugcuaucuguauaaaaagaugaggaaaaaaccaacauauucuuucuugcuuauauacaagugaaagaaaaugcaaacacuaguugccucuaaguagauuuuauuauucagguauggugaggcaacagaucagguacgaccgccaguaccugaaaguaccugcaaaggcaguuugguacuuccccaagaggaggccauaccaccgccacugaagguggcaaaggccgaaggccgugcugggccauacgggaccaugccaggguuggucuggagguggaaggaaccgggaaagcuugacugaggaucucacagaaaggcaaggugagacgcucaggacuggcugguuuaaguaauuucaaaggcucuggggcauagcuguccccaguugucuagcacuggcucugauaugacuugggcgugacacagauggugguguggagugggacucuggacuggucagcuugcauaugaaaagcacgguccugcaccagucaucugcuaucccgaguccuggaaggggcaguccuuccccacucaaugagggcccagaugccacagcauucaggauacagaaaauaagaaaagagaguuaauauacuaaggaagggaacggagugucuggagaacugggugaaaguaaaaccugacuggguaucuuccuguacuauuugcacguugugccaugugauugcauuacccauuuaaaacaagugauagaauuuaugaggugugcuacccacacauacacauacaucacaaacacacgucacaaacacacaucugccuuccggccuugcugagcaggguaaacugaugaugaaugguaccuggggaaggaggacugagaagugccauuccggcuacuggguacaacacaacagcacaauuugggagggacaaaaagugcauacauaucuguauuuccacaaacuccagaaacauaaccaggauauugcuaaguuucgauuuaaaauaaaccuagaaauucaguuuuuacuccaagacacagaaacccugguuaagaagauucacuguuuauuaaaggagguguuuacaguacauacauauugauggcacuucuaaacuuaaaaaggcaucuuuuucugauuuaaaagcaauagcugaccuuccacuucuaguaagggaucagauuuaugcuuuaacauaaaaccaccaagaagcagacaaaaugaaugcacuggcaguugaaaggacacuagacaucaggcaaagaaagacaaggaucccugagagaaacagaugaggggacacccacgaucgcagcagcuuucugccuugagacaguuuccagacagcuaugcaccccuaugugauguccaagagaaauggaaguauguguccacagaaaggcuuguacucaauguucacagcggauuuacaaacugccaaaaacuggcagcaauacaaaugccuauuacuaggugaguggauaaacaaauuauaauauuaaucuaucuauauaaaggauacacagcaaugaaaagaaacguagucuugauacacgccaaaacaugcaugagucucaaaauaaacaugcgaaguauaagaagccuuaccaaaaagaguauaugccaugugaguucaccaagauaaaauuccaggaaaugcaaacuauuauuuagugcuagaaagcacaccagcauuugacuagagauggaggugggaggguugggagggggaauacagagaagugugaggagaccuuugggaaugauggguguggucacugccugauaguggugauguuuucucagguguaaaagcuaugugaaagcuuaucaaauuguagacuuuaaauaugugcaauuugcuguaagugaauuacaccucaaaaaagcuuuuuaaaaauaaagaucaauacuugguuuguagcaaaaacgugaaaaauaucaaacauacagauaagagagcaagaccauggucucuucuaaaggacacacaugucuaaaaguaacacuucaaaauuauuaauaaaugccaauuguaaguugcauaucaacucccccaaguucaaagcaauaacuuuaacuaaaaagacucuuugcaaggguggugucgauuucccgagguuguucgugaauaaugagucaugagaagcucacacuagucucuuuuguuugggacucccuuucuucucuguccuugacacaccacaaagcugugaugcuuuuguuugcaggcgcugcagcugccaaggcuccaaucugaguucuaugcuccugucucucuuccaccuugagcaagugcucaacuuaaguuaaaagaagcacauuuacccuguaacugaugauggacacagucaaacaaaaaauguuauaaaaauuagcaaugucaacaaaagugcauauaucacaaaaagagaauggaugcggucuuucacuuguaucuccuaaaaaugaaaacccacugccccccuacuugcaaacaauauaauaagaaugucugaaaugcagacagacaguucuuggcaccauaauuaagcacaaaaaccuugaagagaaaaaacauucaaaaaaguucacucaaacuugugguuuagaacacaaaauucauaagcucacucacuaaacccacuccuagaaagcuuucuuguugugacuuuuaaaauauuuuguuacacuaugacaaaaggggaaggagaaaaagauauugaggagaugucucccucuuuuccaaaaagacuuuuauuuaaguuuauccaaaauguugcaaggcaguuuauacugacucaaaaagaggucacuuuuauuaauaaaaauaacaaauauucucuuuaacccuuauucuggcauucgagguuuuccacugaggguagccgucucccauacacuuauuucuuggucuccaacucaccauuccuucaaauugucgccgacaugaaaacaucuccuaccuccucuccaucaaucuauuguuaccaucuucacaaucagcccaguacccguuccaaggggcucaucuucccaacauaaccacugccaguuucccacuuccaccggacccgugagggccccugccacgccuccaccggacccgugagagccugugccacacugcugcacacaucuguucuucuugguuauuucacuuuuguagaugacgaacuuucaaagauuugguaaaaaaauuucauaguucgguaaauaaacacggccacgcacugcauaacgacgugucaguuaaccacgggcugcauauacgaucgaaccgcacauacgaccgugguugugaaagauuaauaccacauuuuuacugcaccuuuucuacauuuagcuauguuuggauacacaaauguguuacaacugccugcaguguucgguacaggaucacggcauacaggucuauagacuagaauagaccaucccauacagccuggguguguaguaggcuagaccaucuagguuuggguaaguacacucuacguuguccacacaacgacaaaaucgccugaugacacguuucucaaaaugcaucccuggcauucagccucccaugacuguacuugaugcauaaacaaaugcuuuaaaugaugauaacuguagguauucucuagcugcuggacguuuaggauaaucaccagggucccaaauucauguuucuaagaaacaagugggcccacuuuauucuagcaaauguguuuauccaaaggcacaaguuuaucagucuacuagauucuugauugucugacauucauuaacagagcaaccguaacacccgcaagaggaagcggcuguggcaccuguccccugaacgacgcugggcgcuccugcacucuacacacacaagcccgcuguggcacuuguccccugaacaacccugggcgcuccugcacucuacacacacaagccggcuguggcaccuguccccugaacgacgcugggcgcuccugcacucuacacacacaagccggcuguggcaccuguccccugaacaacccugggugcuccugcacuuuacacacacaauccggcuguggcaccuguccccugaacgacccugggugcuccugcacucuacacacacaagccggcuguggcaccuguccccugaacgacccugggugcuccugcacucuacacacacaagccggcuguggcaccuguccccugaacgacgcugggcgcuccugcacucuacacacacgagccucaacaggggacagaaacaccaugaaucacaaaaucgaaggaccuggaagucaguucgccccaagaucccagagggaaggccucacuaugguccggaucucuggauuuccagcccagugauuuccuugcucagccguuaaucauuaaguaacacgauuuagggucuccagguggcgagaugggucagugacucccaagcacuauuuccuaccggacggacuuucaucagccuucacaaucaggccgccaugauacugaccuaccugggaacagucugcuuuaaagguuguaagaagacgaggcauguguacuucaggcccugaggaucacaccccaacuuucugcugaggugggggaagagaagcaucuagaaacagaucuaaugaagcuauauuuacuauauuauuuaauaauuccaugcuaaaauacuguucuucaucuucagagacuuuaggugaucuguggaauguugagacuucuuuacuaaccacagaguuuuuaacauacuucacaacaaauacugcuguguacuaacuaugguauccuccacuauuaccugacuucaacucauaaggaaagaaagccucugugugcauugcacugaauuuccuccugccgcccugccagcggagugccugugcucccgccggggcugggguguggcuguggacaccuggagaggguuuauuccuucugaagacaacagcacagacaucucugcaaacaccuuuucuuuagaguugucagaauagagagauuuaaaagggagaggcaaugccauauuaaucauguuucuacaacaagacauaacaccauagcagacacaucaucauuucuggggucccaggaagaaccaaggguuuucaaggcuccccacagcaaugcuaagcuauauaaucuccucaguuucuuucuccuccuacuccucaaacauauauuaugcccagaccuaugccaugugcucagauaucccaaaggauauuucuugcuugcucaucuaucucuucacagaggacuuacucuaaucuaaaagagagacagaagacacaagaaaauugaaaacacugcuuagucuaauucaucaaacaaauuacuauagggguaguucuggucuugaauugccaccugagauaugacauauacguguguuguggggagggguacauauuuguuucuguccaugguuccuggcucguuaacucccagaaccccuguuagucuuugguuauaauguuguggcacuuuuugccucaggaaacagaaucucucuccgggccaccugccacucuccuuucaccugccaaggcaggacuccaaucugacugugugucauaagccccucauuccagagagggucccgcuccauauccuggaggcggaaacgcugcagacagaggccaagaacaaucucaagagacaggccuuugucaaccacauguugacauggcuguccgugcgucaaucaugccuaggcaaugaagucuccauaaaaggcccaagaaagcagaguucagaguuucucaccgcugaacacguggaggcuacgggaaggugaacaagaacucauccaggugccgggagggugguacacccugacucuaccgggacagaaaugccugugcgugggacccuugcagacuuugccccuguguaucucuucaucuggcuguuuauuugcauccuuuaaaauauccucuguaauaaacagguaaauguuaaguguuucccuggguucugugagccgcuccaauaaaguaacagaacccaaagagaggucaugggaaccgucacuuggagcuggugggucaggaguuucggaggccugggcuugaagagagguuaugggaacccucgcuuggagcugguccgucaggaguuucagaggccucggcuugcaacuggugggaagaagugaacacucuugggaacugagcccuuaaccugcagaaucugaggcugucuccagguaaaaaaaugucagaauugaaugagaggacucccaagguguccgcugcuugguguguaggaaauccucccccccgccccccggccagccccccaaacacacacuuggucccagaagucuucugugaugaugauuguugagguuugggaagaggguaggaaaacaucucuuugaggguuuuuguucacacucacauugugucaaucaaggcuuuuacuucuagauuucucucucuggaggucugggaccgccacuagagaggcauacauacauucuggacuccaaauucauccucacaauucuuauauaccucugacuuuucucuuauguuugacaaugccuuuaauuuuucaguacuuaguucuuagcucacuuuugcuuuauuucacaaggagggugaacgcagucaccacuugugcaguaaaggaacaaagauuagaaguuuauaaaaauuucggaggaggauuuugaggucauggagcuaucuucuuggaagcagggaagucagucacagacaucgauggaaaaaaauauuagaagcaaaaggccuggggugucacuucaggaaaguaaccacuuccaaucugaaaacuguucaaucccaaucccuuaccaccugcagauacagcacugcucuauaggaaacacuuaaaacauuaaaaaacuagccaacugugaaauaaacucuuuuaauacucuuuacaaaaagccgacuuaggacaauucaaauucuuagcagcaguagaauuugcuguaaguuuaagauauaucacuaauuuaggagcuauuacugaaauaacaauguuugcuuuuuaaccugaaagugaaacccuacuaaugagcauaaucguaaaauagcuuuauaaaagcaaacucaaaguuuaaaaagcacauuuaagcuaauuuuuuuuuuuuugagauggagucucacucugucgcccaggcuggagugcaguggcaccaucucggcucacugcaagcuccgccccccggguucacgccauucuccugccucagccucuggaguagcugggacuacaggcgcccgccaccacgcccagcuaauuuuuuguacuuuuacuagagaugggguuucaccauguuagccaggauggucucgaucuccugaccucgugaucugccugccucggccucccaaagugcugggauuacaggcgugagccacugugcccgguuaugcuaaauuuuuauccaaaauaaaggcuuauuuugaauaauucaaaaggaaaacaauuuaucaagaaacaaaaguauguaacagauaaaugcuaauucuuacuuuucccccuaacagaaaagcauaagcauaaacauuuccuauagcaguauuaacacauaccuguuuuaggauguauugaaaagaauccuuguggauuuccacuuguaauuuuguacaugagcuugucauuagagcucgaaucuggaucaaaugccucgaucuggaccacagauacaucuuuaggagaauuuuccaugauuucuggguaauaaacaggcucugaugucuguggugcauugucauugacauccucaaccucuauguagaucucuaugaacgaugaaagaggcacgacacccugaucgguugcaaagacuguuagccaauaaugggaggucgauucacgguccagucgaucugacgucucuaugacaccuacagagaaaaaagaaaagcguaaagcagcacaucaacgaccaaaacugccagcuucagaaagugucaacaacuacggcuuacugagagcuuuauaugucucuuacuaggugcauaaccuugagcagguuaaccagccuuucugugacucagcuuccuuucuucuaaaauagagacaauaauaguauauucaacuaacaugcauauaaugauuagaacacuuggcacauaauauaggcuauaaaaguauuuguuauuagaaucaggugucaggcacuaaauggagcacuuuaaaaauauuaucucacugaagucucaaaauaggugagcacuaagagaucaucuaauggcccaacacuucauuuuuccauagguaaaguuuauaguugguugagagacgugcugacuuuccuggaggcuacucaggaagacagggacaacaccagagccauggcccagaucugagaccccacaguccagcacccccgcuccccacacugcaucccuguggcggccacugucuaaggaaaaaggcaggagcagcauccuccagaaagcucggucugcacacacaccccuucucacaguggcuaaggaaagaaacugcaaccuucaaaguccacaauaaggggcugcucagaucuccugaguguugagguccuuuuauuucuuucaaucgccucaaacaaaugggaagacaaccagcaugcuauaaaaauauaaacuacacuauaaacuccaaaagggcagaggccacaucauucuuaaauaccaguauccgcagcaccuuacacaaagcacaauaacguauuaaauacacaagugaaauaucuaaguaucuuaaucaggguugguauagaaaaguccucaacugggacccaaacuaggauacauuucuuaguaagucaacuagcaagagaugaaauuauaugauuacaaagaagaggguuagaguaucuguaauguuuugguccagccacugaaaccagucaaaacuuaacuucaagccaggauuuaccuccucuggggauaagaaguagaaauauccauuucucuuuggcaagucccaccuuuuuauucaauggugcaaucucgcccuuugucuaccaaaaacauaucacugcacuuuuucucauggauugaucacucgggacuaaagauacuuucaguguucuucuacaccaugguacaggcuggacucuggaaaugcugaagcucuagaaucacugaaguuucccguuaaacgcaaacuacugugagaaaaauaaccaauuaccaauuuuaccuaugcucagcaaugaaacauuugguugagaaaaauacacuguugcaauucguaauuuugaucacacgaaauuaaauauuaacuuauucgagguuaauaucagaaaaacucauuuuuugaaugaaugauaauuauaucuaauacucccaaaaggacucacaacuugaaaauagaaaacuuagcuaaauaaaaugugaaauuaucauaaaaugaaucuuuauugccauucagaagcauuacaaugauuuguuauugcuucauuauuucauacugaaccuucagaaaggggguauaauacugcuucuagaaacauggaagaaaccucagaaccaaaugguauuucuaguucuagaucccugaggaaucgccacacugucuuccacaaugguugaacuaguuuacagucccaccaacaguguuaaaguguuccuauuucuccacauccucuccagcaccuguuguuuccugacuuuuuaaugaucaccauucuaacuggugugagaugguaucucauugugguuuugauuugcauuucucugauggccagugaugaugagcauuuuuucaugugucuguuggcugcauaaaugucuucuuuugagaagugucuguucauauccuucagccacuuuuugaugggguuguuuuuuucuuguaaauuuguuugaguucuuuguagauucuggauauuagcccuuggucagaugaguagauggcaaaaauuuucucccauucuguagguugccucuucacucugaugguaguuucuuuugcugugcagaagcucuuuaguuuaauuagaucccauuugucaauuuuggcuuuuguugccauugcuuuugguuuauugcggcacuauucacaauagcaaagacuuggaaccaacccaaauguccaucagugauagaccggauuaagaaaauguggcaccuacacaccauggaauacuaggcagccauaaaaaaggaugaguucauguccuuuguagagacauggaugaagcuggaaaccaucguucucagcaaacuaucgcaaggacaaaaaaccaaauacugcauguucucacucacaggugggaauugaacaaugagaacacauggacacaggguggggaacaucacacaccggggccugucgugggguggggggaggggggagggauagcauuaggagauauaccuaauguaaaugaugaguuaauggguaaagcacaccaacauggcacauguauacauauguaacaaaccugcacauugugcacauguacccuagaacuuaaaggauaguaaaaaaaaaaaaaugaaauaaaauaaaauaaaccucagaaccaaauaaaaaugagcuaacugguuccuccguacagcagacaacugaagaugaacucaaacaugcuucccuguucucuaacccaagcauaaugcacacacacucaacuggucugcuaaauuagcaaaauuauaucugucuguaggcucaaauaauaaccuuucccaguuccucugauucaucacaucuauccacagauacaaagacgucaggggauaacagaauguucucuccgggaggauuacacauuaacaaaauguacacaacuccuccugugugcugcuacuucauuaaaaugcaauaaaauucacuugacaggugaaguauuauuagaaaaucucaagaagacagguacguggugcuuuuaucuaccucuuuugaguucuaauccuccaacaauucaugcuuccaucuacuguuuuaaaaugugccccucuaaaugugacuagaggcauuuacaaacagugauaauuacagaaacaauuugcucaguguuuacuaaaugccaggcccugugauaagugucuuacaugcauuaucuuauauaaucuuuacauccaaccugccuagauaugugaugcuauuaacuccauuucacuaacgaaaaacucagauugagagaaaugaggcacuuucccagggccacagugaauggcagagcuggagugugaauaccacaaaucucaucuucagcgccagcaauauccuugucaguccuacggcuguuaugacaaaagaguaaacaaaacuuaaugugguaauuugggaaagaugagucaaacuuccuauuucauccaccuguucuacaugucaguauucagcaggaauguauuaaauguucacucauacacaauagcuuucucuaaucucaagggaaaaaagaauuaugaaauggaaguauaucacccucacaucugagguuugcaauuacagauagaaacagcuaugauuuuuccgucgugccuuauuucuaguucgggccguaagcguccagacugcagugugcaauucugagauggcaucugcugguccccaccgacccaucagcuguacaaccagggggugggggacagucauguccaucaggaggggauugucggccuccccgguaaucuacggauauuacuaaagguuaagacugaggcaacaaagcgacucuauucaaauaucggagauuguguaauucgcaauuaaaauaguaaguaugaaugagugagaugcuggauguuccuauuucaugaauucaugacuguguacuuuuauaaugccuaucgugauugcugagauaagcuucugcuucgaugcauuuuaauuauuaccucuuuguaagauaaaaaaucacugaauacaacuuacggagaacuauaaaguaaauuucaacugccaaagggagaggagggcacaccgaagaaucuuaucuucuaaccaaaauccucagaucccucauguccaccaaucacgucacuagaugcuuuaugugcauuaaaucauugaaagaacauggaaguugcaugauuuucaucccagcuuuacacaugaggaaagagaagcuuagauccauuaagaaacuugcuuaagcccuggagugaugaggaaacaaggccagggucaacagcuaacuggugggauccggagcugagccggacagucugacuccaggccucagggucuucuccacugagcggugggcuguugccacuaucaaucaacagcaacacugucggacaccaaaggugcuggggaccugguggggcuauaaccaugaggaaaggccacaaggaguuucccaguguggaaggaagggucuuccucaugcaugcaggacaacagacgggagacgaucugaggauuccgcucagaguuuugggguucaguaccuaggcgcuauuauaggcacugcacaaaguggguggaaggaagccuuaagcgugccaaguuauuuuguuuuccgcuuuuuaaucugucagcccaguugcaugauacacuccucaagaacccugggcagaaacuuccaaaguggaccuauggcacuagcccgagaucucuaggucaaaaccccgaagcuucccaucuugaaucagaggcaagacgaagguccaggauggcugagugagagucuagauaaugugcaaagaaagaccagggguagagcuagccuucgccaucucaaaaucaagcauuagacugggaacgccuucaaaacccuccagugcaacucccuuguucuuaaagaacguugaaaugauuuguccaacuccaagaagcuaaacagguguaguucagaauccagagugaaggacuuccuuaaucagggguucaucacgauccaaaccauucuuuaagggaguccugguuucugcagggagugacacaccagcugucuccaaguaugaccgaagcugccuuuacucauuaagucauuagcaguucuuguuccuacacuucaucaugcuuucaccaguccuuccuaaagccacgacuggcauuuacagauuacagauugauuucuucuguaacuuuagcaguuaccucaauuccauagagagaaacaaauuuucacauuuccauugggaagacuucuaauuagugccuuuaacacagagaaaaacaaaaauaaaacuaaagacauccagucaucacuggaugugaaucaaacuguggucacucucaaaccucuaucccugucuauuucucuuuauccaugaaugucuaccuaucaacuuucaauaaguacuuuuuuauauaguggguuauaaacucacccuggagacaaaaggaaccaacaaaaacuauaguuuuuacagguaucuuucuauuuacacauauucacgaccucaccuuuuugggcaccuauguauauccacccccaaacucuucucugcggucucccuccugucuucggcaucuccuccccucugcgcuccccuccuucuaccuuucugaaagcaaacacagcaugcggccagaaggugccugcgcccaggcugugaggagggagggcugcagcccaggccuuccgcaggauucccuccagccagaugccgggagcaacagagccgugagaggggugacagggaaacucugucgccacucccgucaggagguugccgugcacacgcagugagagcggucgugaugcugcugcgugaugcuaugacgcagauuuggagcacaggagacagguugagacacgcuuguuacgugugccacucagcagugccaucagaaaucacggcuuuaccugaaugaagcauuacggaaggaaugaaagccuagcuuuccaaccucgagaauacagugaaguuguuaauaaccugaaaaauccgaaagaagccggaaauuuggaguuauuaaguaagaauauuuaucauuccaaacauacucuccaggauuucaaaaccaccaccagaugucacuauggaaacucacuuuaaauaugcauccaguggagaacgagacugaagggggaaaaauguaauuucuaaaagagcuuaaccaagauaguugaaaauagagcucacagcaaaauuucuguauggaaggauucauuaauguccacuuacuuaacuaaacggauacugacguugucuuuccacagccugauuauucaaagguuauaggguugcuccaauaaacgguucaaaaguaaaucacaguuuccaauaauaacuccuacuccccgccacugcuggccccugcugcuguuaaggaauaguccuugaucaggaaaggccagcauucccucccgcugacacagguggaacaggacucuugcaacacaguaaucuuuaaggcaaaaauaaaguuauagcuaugauguuugccaaaaauaauuuaacugauucaaauucccauggccacagaacaccuuuccuccuagaauuuuccuauuuuaacaggucuuggcccccaaucaagccuuaaugccaaggcuuucaacaaagccucguuacuucugacucucagaaauaccuaucaucagcaacaacccagcaacacaaauuugcaaacgcuacccuccuuucugauaugucacauacuuaauguuuuaaacuuuucauacaacugcuuaaggcagcaauuguauuaaaagcugcuuuguucaaucacaagaaaaacuuaaaugugagauauaauuuuaacgauauuuucccuacaggcaacaacagacagaaacucuuuucuccaauucaauacccucagcguaaacaggguaacucuuuugaaaauaagcauuuucccaaauaugaaaacaauacucacggaaaaagaagagacauaccaucaacacacuagagagccaauaucucuguugcugcaauuaaucuauaaacgguuauucaauuuuuccugcuaauuaugcaaagacuaaacaucucagaauugucauauuaaauguuaaucacuaaaaacaucaauucuuccuuaaaauuaaauuuuaaaaguagauuguaagcuuccuauuagaaugcaaacuuuuuaaggacaaagaauuguuacguguuugguucaaggccgggucaauagugagugcuuauaaaaaaugauauccauuacagacaagcaaaggaggagaaacagucgcaggcaagaggagaccagagagacguaacuaaaugucaugugggagcuuggaccacagaaggcaccuuagguaagaacucagaaaaucugcaucuauuauggacuucaguuaguaacaauguaccaauacugauucuuuaauuguaacaucuuacauacucauguaagaugucaacaacgugagaagcuggggcagggagcagggaguuaugugagcauucuacuuucugcuccauuuuucugcaaauguuuuauuuuuuuaaaaaguugucuaugagagcucauaauauguagauuguuuccuuccuucaauuaaaaacuuuuuugaacuuaccuguuuuuaaucucguuuucauuaaauacuagauuuagacugauguuaauauuuccacaucuugaugauaccuugagagccuaauguguguauaagaaacuuuacauguuaaaggcuaaagauuuaaauaacaaucuaauucaaaauauaauuuacuguaaaauaauaaaaaaauauuacuuguuuugccuauuauauacaaagaaaagcuguaaaacgaguuuaauauaaaaagcaaaauuucugcaauuuagccuuucuuuaaaauaacugggccgggcaugguggcucaugccuguaaucccagcacuuugggaggccgaggcuggcagaucaccugaggucaggaguuaaagaccagccugcccaacauguugaaaccccgucucuacuaaaaauacaaaaaaugagcugggcgugguggcaggcgccuguaaucccagcuacuugggaggcugagguaggagaaucacuugaacccaggagguggagguugcggugagccaagacgugucauugcacugcagccugggcaacaagagcgaaacuccgucucaaaaaaaaauaaaaauaaaaauaaaaauaacgauacuaguuugacaugcaguauuaucucauaaaucgaaaccuuugaauucuuuuagaaacaauacaguagaucgugugugugugugguguguguguguguaaauauacauuuaauguucuugcuucugccaucaguuggcaaauuuauguuauuuacuacuguggacuaaaauagaacaagaaaugaaaaaggaggagucuauugggcugaaggcauuuaagauucuaaaauggcuauucagucuacuuucucagggaaugacacaggaaaugcucucagaacuaaaaucaacauuuguuacuuuccuuucaccugaaguuuauaagauauuacuauuuacuucacugguguugcuaaucauaaaacauaaggaauauguaaagaccaauguuuaaugguuuauuuugcagaagaaggaaaaaaacaaguucuaguacuuuuaaaaacaauguucuauuauguguguauacauauauuaauaaauaaaauuuuaauugcuagagaccacuucuauaaauauuuuauguuuuugauaauaaaagaaagucaaaauaaguaaaagaaaguaagucaaccaagaagcaucccucgugggccaaucaaacugcuaggcaguauacuaguguaccguacaggugccucucugcccccuuacagauaaaaauacaguaaaucauguauaauuucuuucucuccaguuuaacugaagccaugacacugaccaccaugacccaaucuuucaaaaccagugaugugccaugagugccauuuugugagaagccauuuguauuuugagcaaacucaguggccugaugaugacugacagggauggcaacauaacagcauacauggacucaagauauagcagagaagaacuucuuauacaucagcucauuuacuccuuacagcaacccuaagaaguagguaacguuaucauauccuauuucacagaaaggaaacagacaguacaagcaaccugccagaagucacacaguccauuaguggggaacugggauucaacccuaaaagucagguuccagacaaucgugcuaaauguuuggagucccugccuguccuucaauuggagggaagauuaaggggcaacugaacacaaccugcaaauuucaccagagaaguugugacuugaaugcaauccagaaauguagcugccagaugccguuuucccaacauuugaaaaucugggcuaaagcgaauuucauuguaucgggagggaaaaggaauggacuuauuauaugaugguacauacacagcuucaaaaaagaagacaugcauauuaauuacacagaagaaugucagugauacagaaauugagagaaaaauauaaacguauaaaaguauauaaaauaugaugcuacugcuguucagaaaaauuuuuuaaacacacauacacaauuauaugugcagagaaaaaaggucugaaauaaacaaggugaucagcagauaaauccauccagugaacagaaacuuuuuuaaucuguaaauuucuguaaccauggauuuaaaaaucuauauuuaaaauguauacaauaaaagucaauuaaaacaauaccugcagcccaguaucagaagguuuuauguacagaaccucccuguuuuauuuuucugucuaugucuuagauguacuuucauuuuuaaguauuucuguuucauuugaguagauauaugacaauggauauucuggcagcuucgauaacuaacacugaaguauuuauguagguaacuacuuacacaaagcuuuaggucuaggaaauucuauaaucacauugcccagaaugagaucauaagucaaugacaaaaggaaaagcaaaaacacaacugucacuguuugcauuauuuagauugccuauuuaaaucauuuuaauuaaaacauauaccuaucaauucuuuuaauuaaaauugcugcaauaacuucaaaauuagcugaggaagcuuucugacuugcaaacuuacuaaaacguaguauuaauuaaguacauaaucagauuuuaagcaucauguuucaagcccagggauuucuuuagcucugcaaagagucauucccaggguaagcucugcuaaaccauguugucccgcuuuguugaggaaugauuccaaguucugacuucccugucagaaucacugauauugucaaugacggcuuuuguggauaagcucuacuguuaaagaggaucacccuuggguaucaaaacuuaucaucuggacaccuguuaauuggauaaaacuacauccacaagacagccuucagaagcauuaagauacagagaauauauuuuaccuaccaauggcaaugcuucuggaaguuuguuucaaauuucagaagauacgcaauuucaguguugauuacucuucuccccuuauacggacuggaugcagacuuaguaaaagcuuuaauaugccauauuguuuaaucuucacaauuagcccaguggucucuccccauuuuccauauucagaagcagaggcuuaaggcucaaaagucacuggucugaaguuauuuacuccguaauaaaguaaccaaugaauuaauggauuaccuuaccaguuagucaucuuagagcuuuacaucuaacaacuuagccugaaaaguuaaggaagucauccucaguuauccaacuuugguagcagagaagccagaaccccaaaccuggcugacuggcuccagaguccacacauaaaaccagaggguacuaucuccaugagaugcagaguugugauucaacagccaggucugacucucaucaaucaaucacuguuaguggaaaaacaggcaacacauccaccaagguggaccagcacuugccuguggugggaggagcgauggaacuuaaguuauaacaacuaaaggaaggccaaacagaucccuguauagaguucaagaacuccgugugaccaggcccauuuaggauaaaaaagaaaaaaggauauuaaaaaaaauccaacacugcucucuauuuaggaaguuacuguguuuaucauaucuucuuuauguauuaaaaggcggccagguacagugguucacaccuguaaucccaacacuuuggaaggcugagguggguggaucacuugagcccaagaguucgaguacagccuggacaacauggcgaaaccucgucuuuacaaaaaauacaaaaauuagccaagcaugguggcaggcaccuguagucccagcuacuugggugccugaggcaggggcaucgcuugagccugguaggucaagguugcagugagccgagaucaugcugcuguacucaagccugggcaacagagugagaccuugucucaaaaacaaaaacaaaaacaaaaaaccugcauaggcuaaauuaacugaaauauacuagguguaaguagguauauggcauuauacuaacaauacugaaucuaacuacgagaauauuauaacugagucuugaauacuguuauuaacuauaaaaaaacuagagugguggguggcagauguagagcucugaaguguaaaucagcuguaaaaguuuuguggcagaucaacagaaacguuuuaaggaaaaacccucuuuaggaaagaaaucucauuaagaaaaaaaaaaaacuagccucagcaugguggugugcccuguaguaccaguuacucaggaggcugaggcaggagaaucgcuugaacccaggaggcggagguugcagugaguugagauugcgccaccgcacuccauccugggcaauaaauaaaaagaaaaaaagaaagaaaaaccagccagauguaguggcucaugccuguaauuucuccacuuugcacucugggaggcugacgugggaggauuacuugagcccaggaguucuagaccaggcugggcaacauggcaaaacccugucucuacuaaaaauacaaaaaauuugccaagcaugguggcacacaccuguagcuccaggcugaggugggaggaucacagaggcugcagugaaccaugaccacaccacugcauuccagcccaggugacagagugagacccugucuaaaacacacacacacccacacauacacacgacccugucuaaaacacacacacacacacacacacacacacacacacacacacacaauuaauuuuuaaaagcuguaccuuauuuuucaacaagggacuuaauguuguuuguacuggcuuggaucuuaaucuggaaccuggcuuuauugauuuacaccuguuuuaauucauucaacacagaaugaguuccuaccacaugccagguaugcuacaaggugcaaaagaaacaaaaagaagagcaaaaugagguccuaugagaagacaguuaaauaaaagaguaacuuauuccuuggaccagcagagagagaggaaaagaagggcaccuguuugagaagggaaacagcauuuuaacaacuagguacuuuaauaauuauuuuccauuuauuguauaaguaucuuuuacacaaagaccaaacaaauccuuucuucaguuaugaguuccugcuugaauuuuauaaugcaacauguaauaaagugauuuuaaaaaaauaaaugucaauucauuuugugaaaaaaaaaaacaaaaaaaaacagggagaagaggauaugcaagaaaaauggcgaguuauacggaugaguuaauuuuaucuucuuccuguuaauauuuucuaauguuucuagaagaaauauacauguauuauauaaaaauauuuuuuaaaccaacguguauaaaggguuaaucugaagcauauaaggagaacuuaaggaauuucagaaauguaaaagcaaccuuuaaaaguuaagagugacuuacagguuuucauaggcugaauaacaacugccuaaagcucuuguacugcaaaguguguuccagcaagaagacaaggcacuauucaaugauuaaaaugucaguugaaaugacuaagccucaugccaaacuccuuaaagcacucccuugcuaaagaaggaauggaaugagauuccuccuguuacagucaagcacuacauuggucucuguauaaacagaacucucuccaaagagacaguugucucuggaguccuagaaugcacacagcugguggaagggccaguuuuccuguuucuaagguuuguuuaggcaccuguaaacagauuauaaauacagaaaaccgcaacuauugcucucaaaauaaacccuaagaaucauaugcaauucaguucuacaaaaaggaagguguguuuuacaugaacugaaugcugacugaagcaaauaaaagucccauugacuuuuuggucccuguggucauggacuguauguauaagcugccccccugcccauccauucccaaguagcauuuuccuuuacuccagccuccacuuuuaucaaauuuuuagaaacuucuuuuucuauuaaauuuuauuucaauuacaaagcaguucuuaaauuuuaauucaaaucuuuaaacuuuaaaaauugcaaacugaagacgaacuacuuacaagcaguguucagcuacuucuaauacccaauuuguugccaaaaccaauaccuguaagaacucagaagcuuaaguuaggucaagcuaaccuaaucaggaagugauucacggacacugauaaccuaggagaaacuucagauauguccuuuuaugcuaacgcuucauauuaaaucaaacagcccuaucuaauaaucuaaaugcacugcaagauuugauguuaaaccuggcuaagaaucuucguuaaggcaaaacaucaauuuguaaaugcauauuaaucccauaacucccguuuucuaaauucaggguuuuuuuuuuuaaugaagaacgguguaucauauaacggaagauuucuaauuuuauauauguuuugaaaucacaaaagagggcacaccuguauguaucaggauucuaaaauugagagguaagcaaucaaaacucaacaaaccuccuacaauacccaguauaugcucagaaacugaacaaucuuaaccaagauuucuuagugguaacuguggggcagacaaaugaaguauuuaauaugcacuauuuuaugcaaacaggaaacaaaucucauaaaguacuuugaaagagaauuaaaacaggaggaaaacggauuacugcuaauucaucacuuuagagacuaugaagacaaaucuugcuggagacauuaaaagacuauauaagaauagauuggcaagucucaaauaacugucauguaucuacauuacuaaaaauuaaagcacagaacugaaacaagaaaaaaugaaaaauagagaauaacugcaguaguucuuauauuaucucuguccuuaacuuucucugagagcaaaguuguucauuaagagagcuguucuuuaacaaaguaauaauaaacauuucauuuuaaagugacauuuucuucuuuaauacuaaccauuaauaaaauaaagugauaacagaagauguagaauaugaaaauaaacaucacagggauaucaagcaguugaugguauuugaaaagcauauauucaaacuaaccacuagaaaaaacaaauucaaaaacacacaaguguucauuauaacacacuaguuguaauuaaguagcagggugguuacuaaaauauacguaucggagaagauaaaaauauaaauaaauagcuaggcgcaguggcucaugcugguaaucccagcacuuuguaaggccaaucuaguaggauccuugagcccaggagguggaggccagccuggccuacuguauuaauuuauuauaauauaauaauaaauaaauauuuauuauuguaaauuaauguaauagaacauuauacaaugucauuauagacaaauauauucuauuaucacuuuauuuuauacauguauagcuauguaaauauauuacauauauugucauuaauaucaauuauuguauauuauugauauuauguauuauauauguuauuaauauauuauuacuuuuauauacauauuacauacauaaauauauauacauaggccugcauauaagaaauuacaggggaauggcaaggcugcggagaaacaggaacgcuuuuacacuguugaagggaauguaaauuaguucaaccauugggaaagacaguguggcgauuccuuaaggaucuagaaccagaaauacaauuugacccagcaaucccauuacuugguauauacccaaaggaauauuaauuauucuacuauaaagacacaugcacauauauguuuacugcagcacuauuuacaauagcaaagacauggaaccaauucaaaugcccaucagugauagacuagauaaagaaaaugugguacacauacucgauggaauacugggcagucacaaaaaggaauuacaugugcccuguaauuucuucagugauuggaacaguaaaaguaccuuuuguuuaaaaaaauauuuaggcugggcugggcacgguggcucacgccuguaaucccagcacuaugggaggccgaggcggguggaucacgaggucaggagaucgagaccauccuggcaaacacagaaauacaaaaacacuaaaaauacaaaaaaacacuaacacuaaacaaauaacacuaaaaauacaaaaaaauuacccgggcgugguggcgggagccuguagucccagcuacucgggaggcugaggcaggagaauggcgugaaccugggaggcggagcuugcagugagcugagaucgcaccacugcacuccagccugggugacagagugagacucugucucaaaaaaaaaaaaaaaaaaaaaaaaaaauggggguugggggaaccccacacaucuggugucagaagcauguucugagagucuaauucaggaaacugaguuuguuuucuauccauaagcaggaaguaucucacaucuuauuuagaaaacugucugcuuuuuccaaaaccuaaauacaaauucaacaugggaaaaaaaaaaacauagcauaguacuuacaacacuguugccauuccuaaagcucaaauauuuccagcucaugacaguaucagauauauggguucaaaaggaaaagcauguuaucaagucuacaguuuagaagaugauuuuugaaaaaugacuuugugcuaaacucuuggauugagauugccuuuucauucagcaauuuaugaaagagguggugaagcaaucguauauuuuuucccacuuauuuuacuacauugguugguuugcuguagcaggcuauuuguuaaaaucugaaacucaagaauuuuuuauaacgugccaucuaaagaacuacuucauaauuuuauaaauucucaaucaaccauaauucacaggcccaguaaacuaaccuguuuacugcuaacuguacccauuaauagaagaccaugagugucuuccaaugcuuucauuaccuaauuggaacagggaaauaucccaaauaucccaacacgacugcaaauuuaaagccucgauuaauuuaaccuaauacugaagacauuugacagaugcucccuugauaagccuauuuugaaauaaugcuggcauaucccuggcuuuaauuauuguccuuaaaaaagaaauacaacucaacagacuaacacaaucuguucaaaagagacacgcaaagggguaccaguguugagaagcaaaggcuaagccauccuauuauguucuucaauaagauaaaacuaacaaauuccaguaauauagcauauaacacaaacaugaaaucugacuaugacugaguuuaucauuguuggugacaccacugugaaaacacugaauaggcuuuaauuacacacgaccguuucuguaacauuucucucuucaggcaccacuccuccccugccccucuggaagggaagaaaaacacucccaaauaccuuuacaaaggcacauguggugggcagccgaccucuuacaugaacacuaccucauaaagcuccaagaccaccguaaguucuaaagcaugguguuugguuaucuuaaauaaucaaaccaacgaaucagcaaagaacaagaguuaaaagagagcaguaaagaucaucuagugcaacccucuaauuuuacagacaaggaaguccagggaauaaaugacuucacaaguuacuagguugcagagcuugaaucaaagccauaacuggaacccaaaucucuugaaaucucagucuacguucgagaguggcaccuaguagagaggugcacgcuugcauuaacacaaaucucauaagacugaaaucggcuuuucugauuggugagggaaauggcucacauuaggaaaagcaaaagucaaugauacuaucucagaguuaaugaucugccaaccaaacccuaagaaagcuuaaaaaauaaucggccuuaccuuaacaugguaucagugacuuugaccuaggcacacaucucaaucacuggucaagaguaucaccgaauuauuucggaauuggagagggaaacaagagugaauguagguuuuauucucagucuguuacuucaaaguauuggccuuauaaucaaccauccuuacagcaugccuguuaacugucccaacucagcauuuuaauaaaugugugacuuuggcaauuuauuauaccucucuauauuuacuauuuauaucaauauuuauuauuccucuuauuuaaaagugggagauauauggguuauaagaauuacuauaaaaauaaagguauuuaaucuauugaaucuauuuugauguuugagaaacuaaagcaaaaccaagauuuaagaagauucuuaaagagguaugacaccuuaaucccuaaccucuguauuuccaaggaugcuauuauucaagacagaaacuggcuacuaacagaaaucacacgaugauggaagcgguguucggaagagaacuuagaaucacuuauuguagagcccaggugacauuccuuaucaagacaagggaccggcauuagcagugcucuaaagugaaauacacacauacgugcagcacagaagaaagucagaauccacagcaacguuguucacugagacacaucgaugaguuauuucaacugacagcguaaagcauuuuuaaccugaaacaguaugcaucaauaccgcugaaguggcagugaggucugccacaaacuuucccuccagccccaaaugaagagcuacuuuuauaaaacguuucaaaguuucauuucaaacaugaaaggacaauaaaaaccaggaaaagucaaauuaggaauuucugggacacagaaaggaacauuaguccaccuuugccuccauaacuaucuuuccccacuuauuuucguuacauuuugucacaacuacuuucucagaacugguuacggaucuauaaguaaagacuaaccaaguucaaaagaagucauugcuagaagauaucaugauuaccaaaauaaaaguaaagcauaauaguucguguuuagucaccaaauauauaaaauuauuaguugucauauggaggcgauaagggacguuggaugaucuccuuaucuaacagcugggaagaaaaccuagguugccacccagauucaggacuaggaaucaggcaccuccuaagauuucuuucaaaauauuauuacuuaucuucugaauugcuaaaaguuguaaauguuagccgggcgcgguggcucacgccuguaauccuagcacuuugggagacuaaggcggguggaucaccugaggucaggaguucgagaacagccuggucaacauggggaaaccccaucucuacuaaaaauacaaaaauuagccaggugugcuggcaugugccuguaaucccagcuacucgggaggcugaggcaggaggauuccuugaacucgggagguggagguugcagugagcuaagaucacaccaccgcacuccagccugagugaaagagcgagacucugucucaaaaaaaaaaaaaaaaaagaaaguuguaaauguuucuaacaugaugcguaugcaugaagacagacuuuuugaacuaaaaacaugcuucugaaagaaaacaacuuuuaaugauuuguuuuuaaaguaguuaaaacagcaaucuuauuucaaggguuuacauccaaaagaaagucuguuagcaaagaggacacugggucuggcaggacauggccacuuaaagaggcagcccggcagaucagaggaggauuuuccuucuuuucuccaugucaucagugacuacaaacaccacugagggccccaagggggaaccaggcagaaagccuggacugggauaaaaccuagcgaugggacuccaggacagcaggacagucagcagcaggaaaaaggaagagugugugccacaaaacggaguccucuccugugguaaggcagggucacucccguguaaggggcccuggacugacugcccugguauuccuaccauucccuucagccacagaccacagccucauguccuggccacgcaccuaccuuaacuaccucaucccagaccuuccaccauacaagcuuguguuucagggcuauuauucccucugauuaaaaauugucuucaaauaguuggcucuucguucuugucauucaggugaccacuccaucuaaggaggccaugcacacccugcaaaaauccuuaacacaugcccuguuuuccuccacagcaccgcucagcugaaacugugcguucuuuucuccucaucucuguguugacucgugucuccucucuccagaagaauagcuccaagaagggcacagcaccauccaccuugcaaacuguggaguccugggcuccaagaagggcacagcaccgucuaccuugcaaacuguggaguccugggcaccuagagcagguucuggcauucuagaggcggucaauaaacgucaacuaccagaugaaugaaugcauggaagggcauucacccaagccuucuuucacccucucaaaucuugccucugugaaauuuuccgaaaguuuugcuuucaaaggccacucgugauuucuccaaagccuuuuuccuuccaggaccuacagcaggacuugcagcugcugaccugcggccccuggagcaggcacacuugccacucuucucccucccacucucauuuccccacaaccuccuccuaggguucuagacuaguccaauacacgacuucucccuguggucauggacccaucaaggaucaccagaauggagagcuucauucugcucccucuggaguuauuauuaauccuuuuggguaucagagaucccuaugaaaaauguaaaagugguuaaauucccucagugauccuuccaaaaagauucagagggaauuuuuuuuuaaucacaaaacauugcauguaauaguuaacaaaacugaguuuuucagcuguuuuucaauagcuacaaaacaguaagauugcuacuucauuaaauccaccgagccaacacacaggcauuacauaauucacuuauccaaauaauugaauaaguaaauuaacaguuuaaauagaacuauaaacauaugcuuaccuacugaauaaaauaagccaggauuuuucuuguuuacuguauuuaagaauguauuaaaucuguaagaaauucuucauuacauaggagucuuaacugccaacucaggucauuaugaacuauggguauuugacaauauuaaacuacauucucuuguuguuuaaucgucucaucuagacugaaucuccucuccaauuauaacuauauccaaucccagaugaaggucucacugcacaguuauaggagugcuuccgugcuggacccugggaaggggaugcuuuagaagggccaggacaguaucugcgaggggcugaagguacucuugcagauuuccugucggcucucguaggagacguaggaccaugaacugugcuccuccccgggaugcaccugccuccgcccgaacacugccaugcacagaaaauggaacugacgcucggcccguuuucaacagaaugaaacagcuaccacauuucuuuaggacacuuuaaauaauuaccauguauuuucuaaagcaacuaacauuccucucacaagugaaugacuggauguuaaucacuaacuugggggauaagagggaaaaaaaaaaaaacccaaacucccuuuaccccaccaguauuaacgcagcacagugaaacacuuucagacacguaauacaaacaggguaacaauuguuuuaauuuaacaaauuuaaacaaaaacggucaccucuggauagggcguaacauauuaaacagaggaggcgugguuuucauuugcuacucuguuuaguuuugacuaacuggaaaugcucaucucuucuuauuucggcaacuccuuuuaugccacaaccaagucaugaauucaggaaggaagcaggcaagucugauuugugcaugaaacauuaucuaaagggaagaaagucagccagugcccucgcuaaucccuugggcaagaaagguaaaguauacagccacagucucaaagccagagugacacaggaguaaccaggagcgcacauuccugccuuaucuggcguuacuuugauucaccucaccuuucuuucaugacaggaagggcacuccaagggcauuacacugagaucaaacaaagcauuccagaaaggcaaaggcucuucucacagggaaaggaagaauaagucuuacauuucaugaaugaauaagcuguaacgaaacauuucuauauccuuaaauaaaauguccaauagcugauaggauacggaaccguagagaacguuaaaccaccaccacaauaagagcaacuuagccaaaccccucuauuuuucaguaacaccauaaaauauaugaagguuaaaaauuccuaucucaaaugaaacaucuucacuaagauuuucuaaaauucacagcagaguuucuaaccagcauauguggccugggguugcuuuaguguuucugauuauauuccuuagguaaggauuacgcagucaguauuuuuugacucugguuaacuuuuccuuugacugcaucucagagguuccuuuaacuuuucaaagcacuuaaccagugguuauuuucaaccugcauaaugcuuucuacauaugguauucuacaauuaaaacauaacucugauuucuauaaaaccaacauacauuugguuacuguaaaagacagucaagacaucuguaagagacucguauucccuucaacugaggugagcauugcucucucuacuaaaaaagagaauacuggcagguccugagcuuugcucuaucugguagguugcauuuguagaugaguccgucucuaagcagccagcaagcuguaagcacaccgguugugagaaucuguauaaggaaaucuacuucccucaguuaaacucucuacaccaaaguaaauucaucaaccucagauuccuacucuaaauucuuggacucugacucacuuaugacaauccuggaagcuggaacucaaauaucuaugggcagucagcaaauaaaggccugaagagcuguaaucaaccaacuguuccauuaaaacagacaacuacugucugguuuagaaaaauaauggauuucuuacuuccagaugauuaaagaugcauucauuugguacugcugccuuuagaagaguuccccauggugcaggaaggcagaaaguuugugcaccauaauuauuugagaauuuucacccccccccgacauucugaagaaaacauguagcgauuuuuuuccugcauucuuccuccacauucaucauuuuauugguaaaucagacucuauauugcaguuuuuaugagauaccagaauuauguaaguaugcaacacuaagcuaaugaagaauaaaauaugugucaauuuuugaaugaguguucuuuuuuccaagggcucaaugaaagcaucuuggcauaauuaaaucaauauaguaaucucaacaucugggccugcucuguugaaaugcaacccucugccucaauacaaaucucauuuuaauauuuaauuauugaaucuauugccuaaagucagcaacuuuaaacugguuugcuuagcgcuguuuuuuuuaagcuguucuuuucccaacugcauugugaacagaacccugugccuuuuauccgccucauacucuuuuccaaguucuuaacaugaauuaauagcugccaaggaacugcuuauugccuaguaucacauccuugauaauguguucucagaugaucccaugaaacagucuaucuguuuggauccaaucacuacacugcugauuauacacuauggacacaggugagugaauuaacucauagggauacuugggaaggaaaagagaacuuauauucuugauuucaacagcaaaauuacauuuuuaaauuuaauuugacaagccugauagcagcgaaaacgaaaaauucaacuacuucugauuuuacgaaguagcaucuggccaaugaaaugaagagugaaagcauguuuuacagucuguccaucccucauuagccuuuaucuggcauacaagagacgcuuuuuaaacaauuaauuaaugugaagaaauaagccucaauaugcacuggggacaaagaucgagaaaagguaaguuaaaucagagaauaugaucccaaaaaguuggguuauaaaaaucagaauuuuuaaacacacaaccagaaccacagccacaaaacuaacaaccacuguuucaauuaugauaguucccugacugaauuaguauuuuccacucauaaaucugccaucauuuugauuucuguuucuaaauccaaauauucaguggcagcaagaaugcagagaaaugggcacucacaaacugcugaugggaugucuaguucucauaaaaacaaacaaacaaaaaaaaagaacagcuuuuaaaaauuucauuaccuuucacccagcaauuucacuuccuguuauuuacgcuaaggcaacagagauacacacaaacaaggaacuuacauauucaaaaauugaguauuacuauacaaacaggaugagugucccaaaucaaaaaaucugaaaugcugcaaaaucugaaacuuuggagcaccaacauggugcgcugggcauuguggauuucagauuucuggaugugggaugucaacugguauaaugcguauaucucaaaauccaaauaaauccaaaacacuucuagucccaaguauuucagauaaagaugcucaacuucuauuagucugucucugugcuggcacucuauauucuaaaaaucacauucuuuaagaauaccuaccaaccagaaaauguucuggauauagcagaaggcagucaacaaaacuacacguucaguaaauguuuucuguucaucauuuuuacaaaucccgcaccuggcacuggaaaggcaucuuugugcagguacauaugaguuaggggaaaaguucaccaggguucuagguaguaaaauuuuagucauguuuucuccuuuccaguaguuuacauuuucccaggcuucuacaaugacuauauacugccuuuuuauuggaaauaaagaucauuuuuuuaaugaggggaguucgcuaauucuguccaaaugcuauggagacucaaagcugaaaaaaaaaaaaaaaaaaagccaacacuauguaaucauuuccaaauucccuuuucaugaccuuaaaugggacuucuaaagcuaagcagaugccccagcaggaaauaaauuugcaacucaacagaggcacccacagagauauggcaagaugcaccuucgguggcuuuggcaauaauuuccuuucauuaugugugaaggaaucuucacucuccagugcuucucaagucaaagagaagccuguagaaguuaauagguccuuaauauguaucugcucccugaacugauuccuguucauaagguaaucgcggaccccaugugguccuuucacaggggcuucggcaaauccccugcagugagauggccccugggcagcucuguuuucugcagaccaggcugugaccuaaucaauaggguuccaagcaagacaaucccuacauucaacagcucggaagaaaugaagggggacgcaauucaagcuuuauugacgaauuccauuuaccugucacaaugaugguucacccagcaagaguaccccccccgcccccccccaaaaaaacacacacccuucagcugcuacaguagacuuuccagccagcagccggcacaaaauaaacauauuuacuuaagcuucagucacaacucuugacgugaaacugaugaagcccaaaugaaacagguguaucugugagauacaaaggcagcagccacaauguggcaggguagguuuucauaaccuguauucguuuaaacccaaggacacaaaaaguaccgcaauaaauauaaagcagaaaaucaccccagcaugcagaucccaaaauuuacauggaaaauuccauaaaccugaaaaugaccuuuuuaacucugaaaagaauaaacaggccauugaaacaacagaaaggucaaguuuacagaaagcaacuacuuuucaaaaagaagugugaaaagcauggguuuugaauuaauuauacauguuagcaauuguggaagcccacagaaacuuuacaguuaaugaauaaagauuucacuucacuuggaaaugauggaccuggucuaaauaaaucuuuuggaaaaucacucuguaaaaauaucacuuuaagaugucauauacuuucacauaaagaagauuuguaucuuguacgucaaaucaaauuagaauuaugcuacaaauccaaauuaugccccccaaaaagcuauuuaaaugagggaacuucaauaacaaauguuuauccucaaaaagacacaugauuuacucggaauuuuacaaaagcuaucacuggacauuuuuuuucuuuuugcauucacauccaaugacccaucauggacaauuuuuaauugaaaacaaagucugauuuuaaauuaacuucugggcuguuuuuccacacucauuaaccaaagcgagagagaguccaagucaaaagacuccaaaaugagcucacacacucgcuuaacaucacaagaauugcuucacuguaauauuuuuaaagccaugccaggaucuaggccaccagccucuucaacaaauaaauuuucagcaacaccaguguaauaggcuuuuaacauccucauugaauguccuuagcccaggguaucuggcacccacccacaccaggcuaauucaacaggcagaacuacuuaacucuuccacuuccuuucccacaagggcaugcacacccgccacacgacucgacuccgcacaccaccucaccugggcgaucaagccuugcuuuguugguggugaucucuuaauauccagaggaaaauuaacacaccaugugacucuuuaaaaagacuaccgcacucacaagcccauuagaagaucucauaccuacuuuuucccaucacccaaaugaagggaaagaguaacuuuccuaucauuuuuucucagguuuuaguagccccuuccucaguuacuauucaauuacauuuucccuaucccuauaggauagcuacaaauaaacaaaaaacauguuacugcauugcguuacagaaaaguguaguagaauucaaagcuguauuucucuaaaaagaaacauuuuaaaaagaagagcaaacacuugagacuacagagauaaauuauacuuguuaggcaugaagccguuaucucaaguuuacuauucauuagaaugcugguaaucuuaggacaguugaggaaguaaaaacaaucagaaacaaaaccauucccaccaaccccaaaagauuccagcauagguaauuugcaaaaaaauuauaaccaaagugaaugaucagagacguagcucuaggucacuuauuucguguacgucauucacagaagaaaaucuaauagccugcacgguggcucacgucuguaaucccagcaccuggaggccgaggcaggcagaucaucugagguccagaguuggugaccagccuaaccaacaugguaaaacuccgucucuaauaaaaauacaaaaauuuagcuaggugugguggcucacaccuguaaucccagcuacuugggagacugagguaggagaaucacuugaacccaggaguugcagugagcagagaucacgcuacugcacuccagccugggcgacagagugagacucugccucaaaaaaaaaaaaucuaguagcccacuauccaaauuuaaagucacaaauaucuuuaaggcaguugaacucuacauaagucucuaaacuugcauuugaaauggggcuagucgaaacugaaauuugcuguaaggguggaauauacacugauuuaaagacuucauaggaaaaaaugaauguuaaaggucucauuaauacuuacgcuaaucacaugcuguaauuguacuuuuugauauguuggacuaaauaaaauauauuauuaaaauuucaucuguuauauucuuuuuuauuguggcuacuaaaauauauaaaauuacaaauaaagacaguacuauugggcagugcugcuuuugaccuguuauacuaauucauuugauuuaaaaaauaacgaguaacgguaaaaaguggcagaauuugcacaauuuuguuaauauaaauuguaaaaaucaguucaccuuucacauaugagcaccuguaucuaaaaacaguaaacuuuggaauauuucuaauaagugguuucauggucuacucugggacaugaaucacuguuguguuuuguuuuagcuuauacagaguacaccgugcugauuaggugccucuagugcagauucaucucuaacaccaaaagaaacaauuuaagacuuuuauucucuucgcuaacaugaucuucuauauacuauauccaagacuuacuguuuaugagaauaucacauuuuaagucaccaucucuacauuagguuucuaacaaaguuugucaacuaacuuguuacagaaucuucauuucauuucaugagaaaauuuuuuguuagaaacaaggccacugagccaggcgugacaggcauguuggcucacaucuguaaugucagcgcuuugggaggccaagguaguaggauggaucacuugagcugaggaguucgagaccagccugggcaacauagcaagaccccaccucugcaaaaaaaguaaaaaaaauuagccgggcaugguggcauaugccuguagucccagcuacucaggaggcuguggugggaggauugcuugagccccggaguucaaggcugcaguaagcccugauugugccacuguacuccagucugagaaagugagaucccaucucuaaauaaaaacaaaauaaaauauuaaaaaaaacagaaacaagacgauucguucugacauuuaaugaucacugaaccuuucuacaagcaguaaacaauaaacauguaugcuuuacuguggcuacuauuuuuuuuuaccuauaauaaugauuauuuuuaugugguucuuuuucuaaucucuuugaggagaagaauggcagcugggacuuacuacuucucuaaaaaucucuguuaaagaaggccacaaguuuguuuuucuucccccccauguauaugucaauguguucaaagacauccacucccaaaauuuccaaacagaaauaaugucaaaaugcuuagugagucaauacaguuacacguuucuauuucaaauccuaagauuucuauuucaacuuaccacagagcacuuuccuauuaacuguugcacauacgucccguaacaaacaacucuaauauaagcuaaaauuagcaaaauacuaagugguauuaaaauacaucuuagguuauuuauuuauuuauuuauuuuuuugagacggagucucgcucugucgcccaggcuggagugcaguggcgcaaucucgguucacugcaagcuccgccucccggguucacgccauucuccugccucagccucccgaguagcugggacuacaggcgcccgccaccacgcccggcuaauuuuuuguauuuuuaguagagacgggguuucaccguguuagccaggauggucucgaucuccugaccucgugauccgcccgccucggccucccaaagugcugggaaucuuagguuauuuuuaaaacuuuuccauuuaagcugaaacuuaagcagagaugucagagggcugcaugaaaccuaaagauaccaaaucaacacuccuauauucucuccucauuucggugucuauuuccacgccccccagucuuccauggacuuccaauuccauuuccccaaguauuccauucucuacgggacagcaauaaaucaaugagauaguuugugacaaauuaauuagcaggaaguggugcuaaugagaaaaacgaacaucugcaggccaaagucuaucgugaagaaccccuugcugcccuuuaccagacacuccaucucuccgccuuucacuuuagaaacacgauaacuggaauucuccaauuccuuuggggguaagaaacuucagagaucuuugugauagaaaaugaaguaggaagacgauggaggagcauugcuuugguaucuucagacuucaagcaucccccugguaucucugcuuacguucuaguuuaaauggaaaugugcuaaaaauaacuugaagauauacuguaaugccauuacauguuugaacaguaugacaaacuuaaaguaucguuauguaagacagaaaaguuuuaagaccauauugauauuuucacaauuuucacaagccuuuauauaguaaugcacauuuaacauucagaagggauucccucaaagggaaacgcaaucggguaaaagugccucuggaaguaggaacaugaacacaguacucggcagcuccucucagcaagguuagccuaccucccuaccuguggcuggaugaacgaacugugucacagcacgugggagaugacaguggaggaguucugagccuuggcccagcggauuugcugcuuuccucgagcacccagaaccccgagaccaccauguaaacggguccaggacaggcugcgggaugaucacagacacagggccuaggagcugcugccugcagcgaacacccagccaccuccugggagcagggcccucgagcucaacagcaacugaucaaacaugagucagcccguggaaaacagccaaggaaacacccagcugagcccagcccaaaucgcccacccacagaacggugacccaaaugaguggaggcuguucuaagcuaugagguuuugggaugguuuguuucccaacaaaaggcuaaaugccauucucuguaauuuccuucacaauacuuaauauuggcccaaagacaauaaaacguuucaguucagcucuggauuugccuacacuuauuccacuugaguuucucauguauuucaucuaaccuaacagccaucuccacauuccucacaagauucaaccucucccagacucaaccugccucucaucuaacccaaccaccaucuccccacucuucacaacacucaaccucucccaaacucaaccugccucucaucuacuaauccaaccaccaucuuccuauuucucacaaaacucaacaucucacaagcucgaccugccucucaucuaacccauccaccaucuuccuauuucucacaacacucaaccucucccagacucaaccugccucucaucuacuaauccaaccaccaucuuccuauuucuaacgaaacucaacaucucccaaacucaaccugccucucaccuaaccuaaccaccaucuccccauuucucauaacgcucaaccucucucaaaugcaacuugcuaugaacagauuucuacucaaauacacagugaacaacuuccacaacgguuuccuuuccuuccuuuaaucauccuaaagaguuacuuuuaaauagaauaaugaaguuaacugaacuagcuacugauaauuuucuauuuauaugaguggaagguuuagaaucagaguuccuaaguagcaagaagaguugacaaagaacaaaugaguuuuuaaaaaacuuuuacuuagauguaguuacuaaaauaagaaaacuacuuuuaguuuacauacauauuauuuuucuuaaaagagucugguaacuaacuaaauuuccccccauuauucaaccacccuuuaaaagaaaguguuugguuuuaaguaaauugcaccucuccacagaaguaaccaagacacuuaaaauacaaaacaggcuggguacagugguucacaccaguaaucccagcauuucaggaggcugaggaaggcagaucaccugaggucaggaguucaugaucagcuagccaacauggugaaaccccgucucuacaaaaaauacaaaaauuagccaggcaugauggcgggugccuguaaucccagcuacuugggaggcugaagcagaagaaucgcuugaacccaggaggcagagguugcagggagccaagaucgugccacugcacuccagccugggcaacagagcgagacuccaucucaaaacaaaaacaaaacaaaacaaaaauacaaaacagcuuuuucaaaggauaguugggugagcucaauuuaauccagaaaaccaacaguuucaaaaauaaucugugaaucucuagaaguaacuauuuucuuaaguuuuaagaaauucaucaauaaugauacuaacaaaaauagauccuacuaaucugaacguuuuuuagaguucaaguuuuugcugaauaaugugcaauggcaauggauacucaucuuuuauacuuaaaacaaaagaaauacuuuucaauccagaggaugauacaggcaauagcacuacucuacagcccaaggacacaacacguaacucagguauauucaccuggaaggccagccucagaaucuagauacucaaucucacaaaggaggcugcuccuagguaagcaaagcagaaacaaagaggaacccgcauugcuacuaaacugcuuuguuguucuuauucuuguaauuuuggaagguaugggagacagggugucucaaguggaagagcagccuuaacuauauuaaaaaggacaaauuuaaaagggcuuucucaacaauaguuauuuagauaagcguuucccuuuaguauuuuguuacaaucuauuuccauuuuaaauuuuacgcauucaaccaguauuggcuggaugccuagaugccagucaguuccuaaguaagugauacagacacggacagaguccaguuucagccuuauauucugguggaagucaaaugacaaaagcagauuuuuuaaacaugcuaaaauaauuuuuaauauguauuauauauaaaacacacacacacacacacacacacacacacacacacacacacauuuuugagacggaguuucacucuugucccccaggcugaagggcaguggcacaaucucgacucacugcaaccuccagcucccagauucaagcaauucuccugccucagccucuggagcagcugagacuacaggugugcgccacuaggcccagcuaauuuuguauuuuuaguagagacaggguuucaccauguuggccaggcugaucuugaacuccugaccucagaugauccgcccgccuucaccucccaaaguguugggauuacaggcgggagccacagcgcccggccauaggcccuagaacacuuauuuuaaaaauuacugaccuuaaacucuaaucuugauacuuuguagauaugaaacuucgugugacuucuuucugaaaucaacauucugccaauuaaaaccacauauggauauuacucauguucauacuuuccuaaucaguuuccaucuucuaaaugagcuugccacacuauuaagaaaaagcacuuccuuuuaaaauuuuuuagauccuuaaaaaauaacugauuuccauuuuguugccucaaccaacagacuaacuugguauuuacaugacaaacccgccuuuuuucacuuaaauauguaaacaccuucagcugggcaacaaaucgaaagaagaggaucaugggacaaacaugcacaggaucuaugaaaagaugaacacccccugagcaggcagcuacucgguaccagcccugugccaagcacugugauaagaggaacacggacgucugagacagaguaaugucaagcagcccuaagaauaaagaggcaaguaaaaaaauuaauagaaagcuaaaagcaaaccaggacccacaaaugcauuuuggagaaucuuuuaacuaagaacuuauggcagggcuauuuuccauagaggucaaagaacauacggcaaguccauuuaaauaaaaauucuggacugggcacaguggcucacgccuguaauuccaacacuuugggaagccaaggugggcagaucacuugagaucaggaguucgagaccagccuggccaacacagcaaaaacucgucucuaguaaaaacagaaaaauuagcugggugugguggugcacaccuguaaucccagcuacuugggaggcugaggcaggagaaucacuucaacuuggaggugcaggcugcagcaggcagagauugagccacugcaacucgacucuggccuuggcaacaaagcaagacucugucuuagaaaauaauuaauuaauuaauuaauuaauucugucugccaagggagcuaacuuuaucauuagaggccugaguuuccugacagauugccuuaauaaguaaaggaauacuagugguguggcauuaaggguuuuccauggugagcuggcaaaacuaaagaccaaagccuggccuagaaagcugcuuaacuuaaacgagguaucaaugacccuuggacaacacgaguuugaacugcacaggcccauuuacacaugaacucuuuucaacugaaggcaaaucaaaaacacaguacucacagcacgcgaaagcgcagcgucuguggagggccggcugcgggaccucagaacgcacagaugugggugugcgcggacgguccagaaaccgauccccaugcucuccgagggaugaugcacacuguucauuauaucuguuuuauuugugccguaugccucaauggggagacagaacaucugaugaaacagguguauaaagaacuacagguucuuauuucacuuggaaacagccuugaaugacgguuucuccuaaaucauuucaggcacauguacaaauauauagaaaagugaccuguccauuguuaagguuuaucuagcucauuuauaauuuuuauacagguuuuauuucucuauuacauuaagcaccauauaauguauguagaaauacuugcagguuguaaggcauuauaaaaaugcuugucacugucacugucaucacugccaucaucaucaucaccauuauccuuacccgcugguccuccuuuaugagaauuugugaggacugacaacccuggaaccuccagaacagaggaucucaaaaccaggauuccaagaagacggucagugcaugaacacagguucggcacuucacugagccccuugguauugaaucaaaucacugucucucugaagaaagaauauacagcuuuccacagauucucaaaguuucugugacgccaaaaccaucaagaaccacaguuuuggagccuacaaauaggcguccaggguggcagaaaagaagcuucgcucaaccuucacaacugcaauuacuguguguuacaaucuauuugcucacaaaacaaaugagggcuacuuacugcucuaucagccacugugcuuagaagaggguagacagaugauuacgcuggacuguguccuugaguucauggagacggacugaagucacagacaggccgcgcacugagucauacacuacaacagaggaacacacaggaagugcccccgcagcgaagagaagcaaaggcuaccuggcuugaaggaaagguuuccccggagaccccacgauggcuuaccaggccagccuaaccauuaugcauugagugccuguuauauacaccaagcauucaaagacuuacgugcgcccacaaagagcugacaaucuagaggaaaggcgcguguaaauaaacaauuacacuagagugauacugcagucauauguuuaaguacauaaaagauaagaaacagcuccacguaacgaagagggcugucaagaaagcuuuauuaaguagaguuaugagauaauacgagcugaccacuguaugcccaaaggcagggagacagaaaacggcgaggcacagagggguagagggcugcacagggcaggggcugagggaccagggcugcacaggagccagugagggaagcacgggugauguuaaaugggagagcagggaggccuguuagggcaaugcggcuccgccacggagagacuggaccccgugcgaugggagacagugaaacggguuaaggaggauuccgugacagaugaacaccucagcucaagaaucacgucuguauugucagaaugccuccuaacgcaucacaccauaaacuacaucaacuggcacgcgcuacuuuccuuuaaaaaaugcaacagaauauuucaaaauucaauggcacuaagucgacgugcaucauauuuccaucauuugucguguuuuuauaauuuggcacagacaugaacuccaugagcagaguauaacaccacguaauuuuacucacuaauugugacaaucuagugagacagucuauggaaagaccauaaaauagggccuguacacggcaaguacucacuaaacguuaacuauaauuacaugcugaugaugauuaagaagaaaaagcuuaccugugauaagaauaugguuaaauuaucacaaaccagaaagcagucuucagaaacuacauaaauagcugaguaacuuuuauuaaaaaaaaacaaaaaaccaauugauuuaaaacuaaaaagacuguauuaguagacucuccccaacaugaaaugaguaagacauucuaaagaaucccauucaacagguugagccacucggaggccuagcaauggaccgaguucaacaugguaucagauauucgaggagauaugguacuguugaacuggcaaggcaaguuaauugauaagacuggcccuugaaguauauaugugaauaguuuccuagacuuacugucacugcugugaaacuggagaacugccaauucaacaaguacaggcaugugcccuugaacggcaaucuuuccaaguccauuuauuccuaguaacaaagacagaaaagauugcgcuuuguggcacuaugucuuguauggagcaugcacuauuuauaagcagcauggucugcuguuugaaaaaaaaaaaaaaaugccagaaaggcaacugcaaaauaacaguacacaaaacacacacuaauaaauaaaaacgugacaaauccagcccuacgaacuaaaauaauccaaaaaguaaaaacaaugggaacuaaaugguaagaaaaucuccaacauuuaaacuaacaccuaaagcuuaaaaucuuuucaauuuucauaguuguacacgguagguaauacggaaagaacagaccagguauuaagugaacauuaaaccucuacacacacaggucacucaacaaauuacgaacacccaauccuuaaacauccuuaggacaaaaaacaguucccuggcaagggggacggugaguaagcuuacucuggcuuucuugccccguacuagauggccaagaggacagcugcugaugccaaggcaccaaggaggacaaggcaagagaacgauggccucauguaacucgaugcagagggagguacaaaucacguuagcuuuggcgugcaggccugaaagcugggaccuaaccaccaucuuaaacaugguuuccacaagaaaagccuuccaacaauuaacguccuguccaguucagaugggcagcauuuuuaccgauuaaaucacacuuuuacaacugcaaacacaaauaugacaccuguccaucucuucaauggccaaugagacaagggaagcuacaggcacucaccuggauucacccacgccuucgcuggccugaucuugacuugcugacugccaccgcgacggaauucaaacuccuguccuccuaauugugcuagauagcaauaugucauucagaguaaaaaugcuggaagauucuuacauucaagacuccuucaggaccaagcaucgaaucuaggauucaaggcugcaaccuggccuaacccagcuuagcacagaaacccacuucacuagucguuuuugaacaggcucccucgcagcauccguagaucauucuucaaagaguaagaggaguaaaaugcgguucuggcacuuagcacccaagaagucuugggcaaguuacuuaaccucucauugacguuucauccuguaauguagggauaacagaguccacccggugguugugagaauuaaauggacuggcacacacagaaugccgggcccagugcccggcugugacacucagugucgugguuauuacuagacuggugcucaccaccagugucauuaccacugacagcaugaggacaaagccggccugucugacguaagcuguuuccaccccacaccuccaggucccggccccugcacacucugagaauuacaucacagcacgguaagcgucacugcgugcugcuccacaacgugggacggcccugagucacggucccccgaguucccauccacagccuuuccaggcuagacuuguucagucaguaacgcaucaacgugguaaacaucauacaaauaacuaaagaaaagcugaaucucuguuguuuuuaguaagaaaauggaacuuccuuaggauuucgacuagauccuauuuucaccuuaacaucuuccugcuucaaagaaggacccuuccccugguagaaauuguuaccacgcccugcuugacucagaaucacacacacacaagauuuuuaucccagaacacagcaacaacacacugugguaacaucauuucugccaagacacaacuuccagucucccuguggcugggaaacgagcuucuuuucucuuaagcuuuccuaggaggagaacauaaagagccaagaggacagcagcugcugccacuucagggaggagccagcaacacaaaagcccuuucaccagcacauuuuuuaacucucugccgggccucccacccgucucuaaucaaguuccugcugccaggaauucuagccccagcucccacagggcaucaggucccaccacagcaggccaggcuuccagcagccacccagcucucagccacuugcagacccuuuagucaggauccggggcccgucagccuccuccacauuccuucuccugucacaggaggacgugcagcaggagcagggaucccaggauguaaguaaaauauccuacuuuauaugaggaaaaggguuucuaacuugaaugaauaauaaauagcugaaacauucagaguucugcagaaccagacagaagcuccagaaacauuuucccugacugaggucaacaaucagguuagccugggccggaauuccguuccguucccacuguagaaacgcacucaccugugugcaccuaagccgggcggccaggagccgaccccacacaggugacacagggaugaggccaggagccgacccccacacaggugacacagacaugaggccaggagccgacccccacacaggugacacagggaugaggccaggagccgaccuccacacaggugacacagacaugaggccaggagccggccuccacacaggugacacagggauggugcuccaacacucuccaucgugugaaugcagccauuuucucuuaagaaaaauguccucauuucccuuccuguauuucaugaaugcugacuuaaguugugacaacggcuguacuuccauauuaauucauucccagucuuuucaucaaaacguaaauuucaauccugaaaccaggauugggaugcuaaaaguaacacagcaguaauauguuuagagaucugcucuuaucuuaaugaaaaacacgggcuccccaaauaaguagagucagaaggggaaacacucguccugggcugcuuuguauacuaacauuaacagccaaaaagagaaccaaacuacucuagacugaaggucaaacacauuccagggcguccuguacgcaauacacacaucagggaacagaccucaacccaacacugcuucaacaccaacuucuauucacaauuucuacaaaaucuucuggccaggcauuuuucuagacauucccuuaguuuuaaaaaugaacaaaaagcugcagcauuucauuggugcucaaguaauaauuaacuugcuaaguacacaucagcuaagaacacuacaccaaauuuauuccacacacccacaagagggaugcuccagauuuuauucugcuuaaauuacaggaaaaccuguugaagcuuacaacaaagcaacagagaauggaucugaaguagaagaggggguuggaugcugagacgcauggcaggcagaccgaacccugaaugugggauuacacaugcuucaaagaucuuuacuccgcuaaacaucuuuguuaaaucuacuuuauaauccucacuguagaccuuacagauagcaaucugaggaggagaaucuuaauuagagcucuggaaacuggcucucuaacgagaccgacuuuccaaauaauuguucacauggcccucuccccuuccagaccucacauggaagggcagucacguggcauggaucugucagaacaguucaccaacauccagaggccucuccaggaagggcagaugauaccgugagaccugcagaguccacgcccgccauccccacucugccacuacgcuuucucucgcugcaaagccauuugcagaacauguacaaaccacggagcuaagaacacagagcuaacaggacuguccguuuggugacagauuuuuagguaguccauagaauuucuacuucuacaaaaacagaaaacuacguuucagaggauguuuccaauuuaagcagauuuaaagagaagaaaaggaaagaucuuaaaauagaacuucauucagcuugcuggauagguucucuguucugugaaaaguauauaaaugauacacauauuugacuagguugaaauagguaaaauaugacaaaaauuugguuauaauacucaaccaacacuaguagcuuuaagucaaagacaagaagcaaacaguuacguggacagguuguugguccccagagccacagcacuccugcacaggcucauauuaauuagcgcaauauuaaaugcccccgaguuaggcaaagaagacccugguggacaugggcaaugggcaaggagcgaaguuccagcaagcaccagccuggccugggccgggugcacgccaaggcacaccaagcuguagugcagucucuggcagcccccacggguguuccucaacugccccuccaucucuucaccugacacgcaucuuuccacacuuccuucaugcccuagaaauuaguuaagacacacuccaagugaauaauuagcaugccuaauuuuagccaacaaaauauacugauuuuuccuaaaggaguuucuacacugugauaccaauuguccugccaggaaucucugaagaaauaacuugggcugauaauucuucugccaaaaaauguaucuuguaaugaauacgagguccaauguguaaauauuauucuaucacuuuuguucauuuccaaaagcauauaaacguaagucuacuguacacuacuuacuuucucuguaaagcaaggaccacagaauaaaugaccuacaaauuuccagcuucucucucaccuuuaaaucucaauauuuacacacaguuucuuauauacuuaccaaccacacugcccacaaucccaacaccuccccgccucccacuaaauuacuacuggaaaagucuggcacugcccuuucuggaaaauaccauaaaucuauuuugggacaccaccucguuuggcugguuguuuccuuauuuuuuuuuucuugguaguaaaaauaucccaaucucuuaaauguguaggugaaaaauacuaguuucgaaaugauuccuuaaaaagcaacaauaaaaauacucuucuucacuugaaagaaaaaacccaaaaggcaguguucauacaaagucaugaagagaauuuaaauuaagguuuugguuccauuuugucucaacuuuaacuuuuaacaguucuuuauaggcuuuugaaaccuacuuuggagaaggaaaaaaaguaggaauaacuguucuucaaaaauuuuacaaaaacaguuugacucagcuucaguuguuaaauuugggguauuuuucuauguugaaacaguauuugaaaauucuaacuuauacuggacagauaaaaugauaaaaaagacauucuacucuucagaggauuaucaaaugcuguugauuaugcuaguuucucuugaaauaaacuaauuauggguauuuuagauagugauauauagucuguagacuuaauacauaggccauaugcuaguggcacauaaccaacagagaaagaauuccuugcauuaauagaagcacaaaaaauauauuacaacuuccaaaauaacuuuuuuuuuuuuuuuuuuuuugagauagucuggcucuguugcccaggcuggagugcaacggcacaaucacagcucacuccagccucgaccuccuggacucaagccauccucccaccucagccucccaaguagcugggacuacagguguaccaccaccccagcauuuuuuuuuuuuuuuuuuugguaggaacgagguuuugcuguuacccaggcuggucuugaacuccuggccucaagcaauccucccaccugcgccucccaaagugcugcgauuacaggcgugagccaucgcacccagcccaaaauaauguuuuucuaaacagcaguuacauuuuucaugugcuacacaccuaucagauggcauggaucccaggguggguguugacugaagacucucuuguuuuuuugugugugugguauuacugaauauauaaaguuuaaagguaauuuuaaaaaggucccuuuuaaaaugcacagauuuauaaaguacacaugggugagauuaguaaacaaauugagccccaccuauugcugaugagugcuaugaucaccccuuuucuauuuccacuaucauucucagagggcaggacaugaaaagccaacacauucgcucauuuacuccugcagucuuuuaacacugauugaccagcuucuaugugccaggcacuuuuugcuaggugcuaaacacagaagaugcaggggcuaaaagccugccccgaaaggcucacacuccaccaggacauauugacauauaacuacaauaucugcgcagcaagacugagguauguacaaagugcaacacacgcacuuucuagcuuggacugcugccuuggaggucccgguuucagaaccuucaguauuacaacaaagcacugcuaccaugaauaaaccuaccacacgucaggaguuuucccguguuauuucacuuuacucucacuuaaaccuuccgguauuucuaaguguccccauguagaagaggaaaaaguuaguucuaagaagucauuugcuuguccaggaucaccaauuaccaacuagaagagccaggauuccaagccaggucuucucaguucagcaugccacuaccccgccucugccucucgaccaaaaccuagacgagguacuaagugaagaccacauuagagaaguuuuggcacaucaucucugcacuggguaacuuugccggugugcaacaaccucugaauggcacgccagaugguagcaguaguuguucuaaguaugagccugcaaauacacugacugaaaaaaguuggaaagacuucucaaagucagaacaaaaccauaaugaugcuuuugauaauagaguucaaaauagaguuuggagaucaguaucagugauaacaauuucaauguaucccuggucuuuuacucacuuuacgccacuuaaaucacucaggcccuuuuguuuccaucuucauggcuuacuacgaauaaacacaucuacaauacagcagccgggccaaaaaaaauauucacacgcacuucuauaccgagcccaaagagcaacagggaauuuugaagaagcugccacagggcagaugguuaaaaaaaaaaaaaaaauggaaaagggcaucaaaugagagcaauaaaaacauauuuaccugucucuucaccuauuuugaaaacaccaacgccagagccaucucuaauggaguaucggaucuccccaucucuucuggcguccucaucaugagccgacaccgucauuaccaaugaaccaacaggugcaucuucuuucacuguccccuuuuccacaaagcuggaaaacacgggugggugcagguucucauucacaucaaccaccucaacuucaacauagcaaguagaagacagagaaacuggcuuucccuugucuuuggcccucacagugagauuauacacuugcuucuucucaaaguccaacugcuggacgauccuaacugcuccacugaguuuauccacaucgaaguuuccuucuccgugguccagaaggcuguaucucaccugaccagacugaccuaaaucaggaucgugggcuucuaaccacaugaugacgguuccuucuggaagauccucucggacuuucacacgauaauuagguggaauaaauguagguggguugucauuaacaucuucuagugauacuuucacaacgacaguggagaacagcugaggcucuucucuggcuuggucccuggccucaaucuuuaaggagugcucaugcugcagcucucgauccagagggcgugcgauguuaacaacacccgucacgcugucaauugaaaaugugucugugucuguaacaauugaguacgucacguguccguugggccccaggucuuuaucuguggcuucaaccuggaugauuucacuauguaccuccuugucuucacucacuuccacaaaauagcucuccuguaaaaacucggguggauuaucauuggcaucgacaaccacgacauguagaagacgccacgcagccuucugggguaucccaaggucauagacgguaauauucaggguguauuugucuguuguuucacggucaagaggagauaaaauuuucagcauuccuguuuccauaucaaucaugaagcaacuauccucauuuccuccagaaacagcauagaccaguuuuccauugaagccagugucaaggucaguggaguucaugaaaauuacacuggaacccacaggcugguuuuccuuuaccugaauaccagucggaagagugcuucuaaacugcgguaugugagcauugacagagugagaaucgaagaaaauauccuccaccucucccugguuguguaauuuauuugccugcaggagcuucucugccagcauuuuggcaacaccagucucuucacacugcaaguuuaccagcuugugacuggcagccacuguuauguugauauauaaugguguggcaaaauuuucuccaucuguagcugugauucucagacuguggaaagacaccuuugcaccuaagccauccauuagcgaucgcuuuaaugacaauacccccgaguugggguuuaaacuaaagaaauccaguucauuuccagcuucaaucugauacuguaccaacugaaguucaucugcaucaauagcagaaacagugguuauuugcucucccacgccuagaucucugggaauugucccuucacaauuuauuuucucaaacaaagguguguugucauucaaguuauugagaguaauuguagcaaggacuucgacuucccggcgguacggcaagccccagucugaugcacgaauccucagaguauaaacccgaggcaucaguucguaguccagguuuucugacguacucacggcaccagugaaauggucaaucgcaaacggcacaugauuuaaauuugcgauacuguaugucacguacccguucucacccucaucagggucuacggcacucaggcucaugacaguaguaccaaugggcacguucucaucaaaagcagcuuuguacgcugucuggguaaauucagggggauugcuauuugcaccuaagacuuucaccaagaccuugguggacgcuuuucugucacuuguuguuacuucaaguucaaaaugggcugccugcugucuuuuaacugguucuaaaauagaaaugagaccaguguuguaauuuaaacugaauuuagcuuuuccagguguacuuuuaaaaacauaccucaaaugggaauaagcaggaauggccuuuaccaugaccacagguguguugggaggagcaaauucacuuauuucugcucuguaaacauccuuuucaaacuugacuggcccggcuuugaacuguggagaagucacgugaaugacuuuaacagaagagaacuggggcggaguuccuuuaucuuuagccuguagugugagauuguagccgaaaggaugacugucccaaucaaugccaccgauggcuuugacuuuauacuccuuacucccuggaaaggaccucacuguucuaaacugcuggagaaggucaccugccacgaugcuuaaagaugcuaugucaccauuggcacccugaucgcagucauccacugucacaauugcauaugcugggucccuguccaguucugauggugacaaugucacugcuguuaucaccggagcacauucauuggccuguucgaugugcaccguuagcuuggccaugcugcugaugccacugcucccauacaacuucaugccacgguccgcagcgaggauuuccaucucauagagcuuggucucuagguaaucaagucuaccaguuaacacuaucacaccacugguugggugaauagcaaacauaucuguucgaucuuuaaaacuguaguaaaauuccccguugguuccuaugucugcauccguggcgcugacucuugcgauacugguccuuauagcuguguuuucagguaaagaaacgcuguaugaggugggugagaauaacggucucaagucauuuguauccagcaccugcacccugaccuuuguucgcgccuccacauuaguauuuuuuucaagugcuuucacuaucaauguguagugauccuucacuucucuauuaagaauagcuguauuuccuccuuugguccuuauucuuagaaagcaaaagucuccgagaauguacucuucagcuuugaacagguuuucacugucuccggaaacaauuuuguaccuuacuucccacgcuggauguguaauguaaacacccaucuugacaggaugccccacauaagucuuagcugcagaguucuccugcacggugacguuguacucgagguguguaaacugcagaggagucuguucaagucguuggcugccaucacugucuccaaaauguuggaagagaaggagcagaagcaggagcaaagccaaaugucuccccauugcuuaa

SEQ ID NO: 15603 - RNA, 6714 nt, Homo sapiens
uguaugauucuagguuuuuguugccuuucucguauuuuauuuugccacaguaucguuucaauauacaugacuuucguucaugguucuuuaaguauuaaaacauucauaauuggaaauauuguaugagucauuuugucauccauuacagguauucaucaaaguaauagacacaaaugaccaucguccucaguuuucuacaucaaaguaugaaguuguuauuccugaagauacagcgccagaaacagaaauuuugcaaaucagugcuguggaucaggaugagaaaaacaaacuaaucuacacucugcagagcaguagagauccacugagucucaagaaauuucgucuugauccugcaaccggcucucucuauacuucugagaaacuggaucaugaagcuguucaccagcacacccucacggucaugguaggcgcucuacccgcucuccucccaccauuugguccugaggccuuuguguguucgagcgugauuuuuaauuaguuauaaggaaagcaccaaugggauugauaaugugucaauucuuuuuagguacgagaucaagaugugccuguaaaacgcaacuuugcaaggauuguggucaaugucagcgacacgaaugaccacgccccgugguucaccgcuuccuccuacaaagggcggguuuaugaaucggcagccguuggcucaguuguguugcaggugacggcucuggacaaggacaaagggaaaaaugcugaagugcuguacucgaucgagucagguacuuuuggagccuucaguggcauuuuaaauuugcaguuguuaaaagucuguuucuacuuuuccaaaaucaguucuggguauugaagcauuucuauguaucugcaaaaauggcuuaaauugaucucuagauacaauuuuacauguuaggagaaaggaauuuuuuuuuuuuuaacuuuuagcccaucagagaguuugggggaaguucugggggauucacaauauuagcccaguucaaggcucugagaagccacguaguagaggaaacuuuauuugaccaauucaguauuucugaaauuauuuuaaccacaguuucuucuguaacauugguuaaauuaaacacacuuaggaagcugcuugccuaguaauuuaacguuucacuuuuuugucagagaguauuuucucuugagcagagcaggaagcuccauaacaguguugacucaucucauuguaauuggcugaaaccucagaaagaggugucgugccccucccaccccuuccacauuuaccuggauuuuugccacucgccuuuaacagguggauuucccucauggaauuggguugaggacuagaccccagagcuggggccugcugggguggggcuugaggcagcaagggcagcaaaaaaaacagcuggagcugcgguccuggacgguuccgggacccagaggccaagagauccagagucgggauaacaagggggaccaccaggaagcaguccuggcauagcaggauguuuuuggucuguuuuccacugccauucccucauucauucauucauucugugggcugaugaagcucguuuuaugugucaggugccauguuggucacucauucauucauucugucggcugaugaagcucgcuuuaugugccaggugccauguuggucccucauucauucauucauucauucauucugugggcuggugaagcucacuuuaugugccaggugccauguuggucccucauucauucauucauucauucauucugugggcuggugaagcucacuuuaugugccaggugccauguuggucccucauucauucauucauucauucauucauucugugggcuggugaagcucacuuuaugugucaggugccauguuggucccucauucauucauucauucauucauucugugggcugaugaagcucgcuuuaugugccaggugccauguuggucccucauucauucauucauucauucauucugugggcuggugaagcucacuuuaugugccaggugccauguuggucccucauucauucauucauucauucauucugugggcuggugaagcucacuuuaugugccaggugccauguuggucccucauucauucauucauucauucauucugugggcuggugaagcucacuuuaugugucaggugccauguuggucccucauucauucauucauucauucugugggcugaugaagcucacuuuaugugcgaggugccauguuggucccucauucauucauucauucauucugugggcuggugaagcucacuuuaugugccaggugccauguuggucccucauucauucauucaugcauucauucugugggcuggugaagcucacuuuaugugccaggugccauguuggucccucauucauucauucauucauucuguaggcugaugaagcucaguuuaugugcgaggugccauguuggucccucauucauucauucauucauucuguaggcugaugaagcucgcuuuaugugccaggugccauguuggucccucauucauucauucauucauucuguaggcugaugaagcucacuuuaugugccaggugccauguuggucccucauucauucauucauucauucuguaggcugaugaagcucacuuuaugugccaggugccauguuggucccucauucauucauucauucauucuguaggcugaugaagcucaguuuaugugcgaggugccauguuggucccucauucauucauucauucauucuguaggcugaugaagcucgcuuuaugugccaggugccauguuggucccucauucauucauucauucauucuguaggcugaugaagcucgcuuuaugugccaggugccauguuggucccucauucauucauucauucauucuguaggcugaugaagcucacuuuaugugccaggugccauguuggucccucauucauucauucauucugugggcuggugaagcucacuuuaugugccaggugccauguugggaguguuccuccugggcaugguacguaggcguugccauuggguccacaaugcgugucuuguaaaaguuccaccccgauagaaacagggcucugcuuuagagcauacagucuguacaaucagaagucacguugcuuuaggauguuccugcucaugccagauccucugaaagugaugaaauguugggaagacaguuuacaguuuucuguuuucuucagugccauuguuaguacaaggaauauagucccuuucagucuucuucauaaugaguuuagagaauuaaaauauuccauuuaacuuguuuucuuuuuuaagucuguagcucuacauauuuagaaauugucucuccuaggcauuagaauugguacagguauagauuaauuauagaucauguaauaaaaauuugaggaaauggagaguaauuuuaaaaaacuuacugauguguucuaggugguuaaacuauguuuauuuaacauauuugaaauuucauuuguuucccuuaaaacaaccaaaucgaguucauuagucacaaauaagaucucauacacugccugugauugcaguguuaaaauguaguguaguuagugccuugaguaaagaugaaguuuuuuuccacugguugagaaauuugcaguuagaaaaacagugcauuccauuugugcaugccugcguacuucaauaaaguaauucugucauagacaaacugacuggguuuauguaggagaaaauguuaaacuuccccuuagcuuucacauaauugucaacaacugggugguuaaaauaugauuguuggugucugaguagaagcaugugcauucuuugaaugcuucuaaugacugacaggauuaggaaucugguauucagagaauggaacucccuccuccaugaauagauaauaccaauggccuauucuggcauagaauuaggacuuuuaagaugcuauuuuuauaguuuugguaauauaaaaauuaugcucagcaguuacuuuguaggagaccacuaccauuaaaaugcaguagaauuuuguggaaggggugugugcauguguuggagauggagguggacaucuguuggaauaguacgaacuauaaaauguucauacaaaugccuuucauuuaaguuuauucauaauuaucugcuucuaauuugugucagauuacauuuaaaguucaaaaagacuaguuacaaauucaguacguaacacugcauguuuaauuagcagcaauuaauugaguaaaagguuuggucugauuaggaguauucagggaaaaaggaguuaauuaagagauauuuucaguaaccauugaguuauaugcuggagacaugucagugccauacucuggucuguguguuuucuucuuacaucuuuuuaaaaaaguagauuauuagagcacuacuucuaaaccauuuuaauaccuggaaauagaagauacuccauaaauaaauauacuuauugauuagaauugguuuuccuccccaaacuuaaguaauugccuugagagucaacggagggugccacucugccagucaguggggccccagcugaacauccagugugugucuacaggggaagaaacagacuccccuucacaguucuguguaauauacuuaauagcuuaagaguaaaaauuagccuguuugucuagauaauugcccuguucccauacagggaacaauuuaaaguuguuuaaaaaucacucauauuguagcuaaagucagugaauaagcccccagccucguacagaccuuuucugccaccuuaggaagucguucaacagcaccagugcaucucagugucugugaaugaaccuguuguuaggccaggcaggggcacuuucuaccacucagcagcccucauuguuucuucacauaaacacgaugcugcuuucccaccugcaaaucugaugauuucugccuuaaucuauauggaugugggauucauguaucccaucacgagcuggguuccuguuuaaccuuguuaucagugacaugcuccaagcuguguucaccagagucaugaugccccagauaauagaggauguuucugaaucuugcauggccgauaaagagcaagguuguaauccaugcuguaaagaaaacacagggcgaugagacagaaacaguaagaauagcgggaggagacucuuccaggagaggaugcaucagacacuggggcucugagaugagugugcucuccugauugaggacaaagagaaugcccacuuggcuggagggcagggagcaaguuuugcagaaagcaguguguucuagcagcaccagccuccuccacagcagauagucucuucguuccuccacaugaggccuugcauauuugaagcuucaucggcaagauaagauuauccuguacaauaagagagaaguggauauagaagaaugaauauaaaauaugguaggucagcuggugaguacagacauagggaagucugaggggcagggaugaagagagucaccauggcugccccagucuccugugucaggccaggcagucagucacaauuuuagacagugagggugauguacaggugggaugagaaaaggaucuuggcguucugacgacggccaaaaaugcaaucaggaaggaccugggaucacugacucauaaguacagacaggccggaaauuagugucucaaaagccuggcagaggcagcaggacccaguucucggccaggguucagcucagagcgucagggccuagagaaacccugggccuccacccuguugcagacugaggcacugccuuggggcucggaugcagagccaguaagacuuaaugaaaagcaggcuggaucuggucucuaaaaaauggccguggauuuuuggaaaauguaugaaaggaaggaagugaagacuguagaggaaguguuuccuguuaaugauguggagaacaaagugcuuggugaaucccuggugugcagcucacacugagcaguucuggucugugaaaugccacacucguggcaaaccuagagcaagaaucugagaaagcaguuaaguggcaagugagcuuuguuuuggguaaguauaauaguucauuuggggaaaauaaauucugugcuaugacagggauggugaauucugggugcuuguucaugaaacagaaaaaggaugggcucguggauggauuaaaccugagaaccugcaacgccacccugauuuauccaaaagggcuguagagaacugcuuguuucuuugaagauucagucgaugauacaaaauuauacaauauucuggaguugugguugcagcuaaagauacauacaguauagccugaaaagguccaaagaaaaggagguaaaacacucuaucuuugagcagccucucagcuucagcacugcugacauuuggaaccagauauuuuugguuguguagggcuguccugugcguuguaggaugcuuagcaacaccccuggucuccacccacgagacgccaggagcacccucuuccgacaaguagugacaaccaaaaaugucugcaggcauuaccagaugucuccuagggagcagaauugcccccaggggaaaaccacugaccuagaggauaaguugaccugaaaaagauaagaagggaauguuguugcaaucuucaaaaccuguaaagugggguggguuacacacauuuauccauggacaauugucucuugaagcuugaugucaauuucuuacugaaucgaaaucuuucguaaug

SEQ ID NO: 15604 - RNA, 13398 nt, Homo sapiens
ugaaacauugauuuuagcaguuuauuuauauaucuuggauggaagcaaaugauacaguuuacuuggaauuccuagggaaaaaaaaaagaauucuuuuaaggugggagugcuacuuauacuuuaaaauaauaauuaacucccucuugcucacugccaaacuugguuuguacacauacaaugcacauaauauaaacaaaauaauauauauuuuaucuagaaaaaauuccuaaauaauuucacuguauaauaaauuggauacaaauuuuacaaaacaaaauuguauucauuuuaaaguuuccuccuuauuucuguacucuguagugcccaauaggcuaaaagaaucuuaaacacaucucuacuaaucuaccaggacuugcguaccuuucaaauccgaagccaaaggccuacucugaggacuagaaguaucuucgugaguauaguugucaaaauggaauuucucucuucuugaaauguaaguuguuuuugaagggucauuaugcugauuacaaauuuuaucacuuaaacuuaaauauucucguugaagaugccgcaucucaaauuccaagguaucccuuucauuuucuaugcuucuuacguaauuuucuaaaaguauuuugucuucaguaagucuacugaugcuguuuucaaauuuuauauuuucuugacuauguuucuuuaguucuucuuuuagaaucugauuaucuguuuugguuuccauuaccauuuuugauaacauuucacauuccuugccaauuucugacaagcuauucuuauaaauacuugcuucugauuuugcauuuuuuauuucuugcagaaaauucucuucggcaguagauugguagguuugaauauucucaauuucucuuuccauaauuugucuggcagcaguagauucuuguaauguuguuucaagguugaguuuuucaucuuuaacuguuucuauuauuugaagaagugucucuuguuccguuuuugccaaucuuucuuucucuuuuagcuggauuaucucuagcuggcuuucuuuuaguucauuuccaagugagcuuuuuucuuuuagaagcugguguguuuuuuucucuaacauuucuuuuucaucuuguaucaacagaauauugguuuucauugcuuccauuucuauacucauucgauuauuuucauuauuuacaauggccauaucacuuugaguuuuguguuccuuacuuuuuaguugaucuaaugcuuccaucauuuguugcuucucuaaagaaaguuguauauuuuuuuccucuagaguuuuauuuuggccuugcagaacauuauauuuacuaauuauuuuuuuaaauucuuuaagacacucuuugcuguauucuucuguuuuacuuaacuuagacugaauaguacucuuuucuucaaccagauucuuaaguugcuuuucauauguuucaacuuucuguaugagagauugugugguaaagauaagagguuucauuuuggacuuaagguuuagauuuucacucuccaguuccauuacuuuuuucuguaucugcacagauucuuuuagguaauucuguaaguacugaauuuuugcaacacacugcucaguaacggaauuaacuuuggaaguuuucucauuuucagauauuauugauccuuguuuuacuagaaaugguugucuuucuuugucuuucauuucauguuuuguuuggucgaggaaggacaguguguaucuuggaacucuggaauggaauuuuaaaucuguaauauuuuugccagugaugggaauuucuuuauuguuuuucucauuuuucuuuccccugugcauuucacucuuagauaacuuuuuacauuuucuacaaaaaugcacauggaauuuugacacaguuucccugaaggggaguaauuucuucacuaaugccucuaauucugaaauucucuuugauuuuauaucuucauuuaaguuaccguccaaguuuucuuccuuaauaaaguucauuuuauccuggugaauaggggacaugucauauuuaccauuccugugaacaucuggaucaguuuguaaagucugaaguucauuuguaagugccacuuccccaucaugugacuuuugaagcucuucuuucauuuguuugauagaauggcaaaugucaucuaaauuuucacaaaauccaugcuugagaaaaggcacaguaauuuuggauuuauccagaauuacuguaucagcuugagacaucacauuuggaggugcaguagguagaaaacgauaaaaguuauuauaauucuucaagaugucagaauuuucugaaggguguauaauuauguuugaagauaaauugucuguugaaguucucagaguuaauguguccucggaauguaucugggauggaacauuuacacuuugagggagacuguucacacuaucaccacuuaauuuuucuuccacugaaugaagugucuuggaauccucaaaaugaugacuuuucuccauagaaagguuuucuucuugauucucuguaggcuguaacaauaagaaguacacuauaaauguauugucauuugccacaugauaaagcaguacagauaauauuuuguggaggguuuauuuauguacccuaaacaagcauuuuauccauuucuacagcaaaggagcauaacaaguaugauuuauuuucuccaacaguuauuuugagaucuguaacucugguccucacaauuugcuuagaacuugcucuuauuuccuuuggggugagauacaugggccaaccccucaauuucagaaauauagaaauuuagcguccuucaagaggcugucauagguaggugggaaagauggaaccgauaggucaaaugggaguuucaggcaaaugaauguuuccaauucugggcuauuuguuaaccuuagcuugcacucauuucagaugauuuuaggacugugacuauccuggaagugugaguucgagucaguguggacacagugaugguaacuuugguuuggagcuuuucuagggaauuuaccccagaccuaggucaauccuaagugaauagauuggcuauaaaaacugccuugcauuugaauuuacucgggaaucuuucacgaucuggacuaagucaaaugucccucacagacucuuaagagaaaugggaaaacugcaaaaguacagagguaaauacacaucuuuuaagguuuucaggaccggaguuuccuuauuuucaucucugaugguccauuuuuccuguaacaaagaggaccauguaaagugaaaugaacugaugguagucacguuuugaaguaccuacauauagaaaugauuucuguagaauaacauaccaaauccuuuucaaugcgcgugccaaacaccagauuuuuuucugagcuaaauuguggguuuucuacuucaauaauacuuuuguucaauauuucacugauuuccgacuguaccuuuaaaagauaaauugagaaaaauuugauuucagauuuguaaacuuaugaauguacaggaauaauagacauuauaauuaaaagguguguuuaaauuuccugcccauaaacagucuuucccaucuuauagaauauaaaugaaagcuacuuaauuuauuguaaucucuaucguuaaucuuuaagaaaauuaugccuuguuauaaucagaagcaauuuaguaaaacaaaguuuuaugaacuauauucaaaugauuuuaggugucugauuuuuacauuguugaauaagagaccuuuggaaucuauucugucccccuuaggaggaguuaucuucccuuccuauuucccugcaggugcuuuuaguauaagaauauugggaugaaguuuacacugggucuuuagugaauauguguguguuacauacccccaauaucuauacucuagacuucuguuuauacuucuccuuauuucuucuggaugaagcgugguuaugguaguauugauucugccucuaacucccaggggcaccugacugagugcuaacuagucagggaacagcggccaccugacagugauugguucaagcauugcaugugacccagucgggauccaucugaaucaggccaagagccucagucuaaacuauugugagcaaaguguagccgggugcgguggcucacgccuguaaucccagcauuuugggagacugaggugggcagaucaccuaaggucgggaguuuaagaccagccuggcuaauguggcgaaaccuggucucuacuaaaaauacaaaaauuaaccaggcaugguggugggcaccuguaaucccagcuacucaggaggcugaggcaggagaauugcuugaacccaggaggcagaagucgcagggagccaagaucaugccaccacacuccagccugggugacaaaaaugaaacuccuucucaaagcaaaguguacucucuucucugacuugaauuuggaaggagaaagaacuggaccuucuagcagaucuucugccaccacagggagucugagaauccccuacuguggaaagcagaaucaggauacagagugagaccuauuuugacgacacaagaccugaucauguggacucagccauccugaagugagcucucuccaggacuuucauuuacuugagcuauuaaaguguauuuuuucccuaagccaguuugaauuagacuucaugucaccuauaaugagggucccuauuuguagucuauauauagacuuuaaacguguauugaaaaaaucagcgagugcuaucucuuugggcuuguuuccaaauacaaguauaacagagagaagaauguaguuucuuuaaaauaaauuuugagccuagaauaugcuguggccucuauuauauuaaauucugugucagcuaauccauuggcuagugaccaucagcuuagaagaugggaugauacuucaaggugagauauuucauauauagaucaaaagaaacauaccaugcugacauucugcaaagucugcauucgcaaagccugaaaugauuccaacugcugcugaaggaccuaugacaaaaguaaaguaugaaauugaguauuuuuagguagguaaacguauucuugaauuguuaugauuuuaugucucccaaaguugccuauuacuugaaaagaucccgugagggucaggugguucacauucuuaggcauuuugcuaacuccccaaugugcuuucauggagauccuugugaggauaaagugagagaacccguuugcauuuagggaguauuuauucugaaaaagaucagccuuuacccagaauuuuggagaugauaaaauggaauauagacucacuuucaaugcugauugugguuggauuugauuuucugauucugcuaugcagccauauucuaagaagcaaaauugaaaaaccaugugacuuaauucuuaaauuuuauuuuuuaaaaccuguaauagaaagcagucuccuaacuugcuuggauagugaggcagagauaaugagaacuucugauauucacacuaugcuagucacauaagcuuaagugauaauucucgcuugacuuaauauauccacuugagguuguaauagugucuucacuuuuagaguacaccguuaauuugcaacaccacacuuagaacucucaaaaacucaaauaucaaauaucuuuguuucugggauauaaacugcauucaaaaaaaaccuaauaaugcucauauuaugggagacccuuggcaaaguaguauacaggccucaauuucugugaaauuuccaugugacauuuuuccccuuauggaaaccaaguuggaucaacagcauaauuuuuguccuggcuuaagcacaguacgcacuuguggcuucccuugggaagggcaguuucacauucacagucuuuagauccccucuuggccauguaugaaugggccugggccuggaacacuucuuuaccaaggggacucuuuuuaaaguccucguucacagccugugcuggacuugcuaccauguguggggauagcacuccccgcuucagacucaguguguacuccuuuguucugcuuaagugugugugucauaugauaccuggccaacccugcuacucuguccccugcuagauuauagaugggccagaaggggcccucuggccauggggaaccaacacccacuacugaggcugaucuugcuccgucucuucauucugugaguaaaggguuguugcauccggugcuugacuguuguguuuugcuuggcgacuccgauacuaagauacaguagacagaaguacuccagcuucuuuugauaauaggcagaaugucacuugcuugauaccguccuggauagauuauagaucugcaacagggggagacucuaucauguuugcaaaugcccuuauaucccucuuugucugcauguuaggcugcuugcuuuguaaacuuuuuauuaaagaguguauucauaaaagcuuucaguguccuaaguaaaaugagagcuaugauggaacguuccccuaggcugauaauuucugcccuaaguuuuaaaagaggucagcgaaucuccuuuggauuggcaggcugucagauguuagagaagccgcuugcaaaguacaggcaccccuucugcucucugacccucaccaccaaaggggcaacgcugguuuggagccuggagcugccuggcuauugaagaaucccaccuucagucagaggguggggagggagagcgagucugucuggaucuugcuuagcuuugccuccaccuucagucagagggcggaucuugcugucuggaucuugcuuagcuuugccucuucuugggaauaaaauggcagcuaaacuccugguauccugaacuguucaucuaaaaaauaaggaacugaaggaaggcccagaccagcauaggaaggaaacacaacguuuuucagacucuaaaguaaccucuucuaaugaacuuaacuagaccaaagugcaaaucgggaagaauauaccaccuagaauccugccacccacaacgaacuguuguuaauuuuaggugccaucuuucggucagcucucuaugcacauaaguggaugaaguggaaucauuuuauacauaaaugguauuuuacauaaauauugccuauauuuacuugaauuuaagagaauuuuuaaaacugcaaguaguggaaauuauuucuaguauuuggauuuuuuuuuacuacaugagagauauuauuuccuaagagaucccuguaaacuaaugaaaauuaacaugaaaagaauuaaagauugaaaccuuuauuguuucaauaacauacaguucuauuguauucauuguugacuuacucccugccaagagagaugagaaaauuagcauucuauuuccuuccaugccuacuucccucuuuucaugguauuugcuaguuaugugauuuauacacugugaagguuuauguuuacauucuguucuguaacuguaauuuccacacagcucuuuauuuaaacacgaagauaggauaucauucucauaaauguauucagccuucaacucuauucugagugauguaacuguucaaaauucuaucuccuucccauaccuacaggaauagcuuccuuuuucuguacagauuuccuuucauuaggaggauuugcaaguucaaagcuaaauauaagauuccuuuagcuaaaaccaaauaagaaauaugagaccaaaagaaauguacagacuuaauaaagggauacaguaaaucaaagauuucaaagaaagcaaugggauuuauacauguugucuacauauauuuuccaucuuccaucucuucuuccuuuuuuggccucaccgugauugcacuguuacuaagcagcuuaguggacccaugggagcacaagaugaggacacgucggagcaggagacaggggcuagguuaugcagagccuccaggccaagcugagcggguuggcuuuuccuucaagugaaacggggaacuuuggaagguuuccaucaugagaaugauuugaucugacugaaaaguuuacaggucacucugcuacaugauaauagaguaugggguggggugagaaggcaauugcagggcuaccgcaauaaucuaaguggagaugaagauaucuuggacuagaaugguggugggggagguggggaaagcagguagauucagaauauacuuuggagaugaagccagcagcauugcuggaggauucguuggggccaggagagaugaaugaaugauggcuccuuguuuuuuggugagagcagauggaugagggaugaugucauuuacugggggaaaacaguagaguaggaacauacuuuaggagaaaaacauuuuuagauauguuaaggcuagguugucuguuaaacaucaaagaagagauauccaauagucaggugggucuaccaguguaugauucaugggagcagcaaugaacacaucauucaacauggaugggccgggugcaguggcucgcaccuguaaucccagcacuuugggaggccuaggcgggcagaucacgaggucaggagaucgagaccauccuggcuaacauggugaaacccugucucuacuaaaaauacaaaaaauuugcugggugugguggcaugugccuguaaucccagcuacucgggaggcugaggcaggagaaucguuugaacgugggagguggagguugcagugagccgagauugugccacugcacuccagccugggagacaagagcgaaacuccaucuaaaauaaauaaauaaacaaacaaacauagaugucacugcuggccaugcagaaggacaugcauagaagcccgaacgaagugcuugaggagagaauggaauguggagauuggugggcauggaggauaggucacuguuucuaguuucacuguggaagggaagacagugcauccuggaagagaugugaaagucaagagggauuuuuuuucuuuuuuugagauggagucucacucuguugcccaggcuggagugcaguggcaugaucuuggcucacugcagccuccaccuccaaggcucaagcgauccucccaugucagccuccggaguagcugggaccacaggugugugccaccacaucuggcuaagagaaggaauuuuuuuuuuuuuaaaccacaggacauucuaacaugcuuguuugcugcuggaaucacauaguagaaagggagaaaagcaauaauuccggacaaugagggaggcuaauugcagaagcugggacuugagaauuccacaagagaugagauccagaggaaaucacuuuugauugaucaaggacaauucuuccguugaaaugggagaagaccuagaauauggguuucacaaaugugaagggugagaaugaaggaguuugggucugagugcuucuacuuuuuucauauagagugggaccauguuaugaguggagcggccagggagaaacguguucaagauuugagaacaggaggagugaaauagcuuuuuugcagaggauuugaagaagaauuuucuguggaaauaaaguaaguuuucccaauagcauugagagugcauuuuagauucaugguaugacucaaaagugaguguuuuucuccagcaaaguucagaugauucugcacaggcagagaguaggcagggagucggauucaucuauuuuuaaaagcuauuaacauaacuuucuguuuuucuuaugaguuucagagacaucggcugcuacuuauucccaaaggaaagguaauuuaaaaacuaggcaauacuuagucacacagaauuacgugauucuagaauuggaagggaaauuaucaaagaacccaggagauaaaacacaaucacacuucaccauuuaccaagucccugcuaaacauacaauaucgggaggcacauaaacaaagcggaaggcauggucccacccaccaagaugagaguuuauugggaauguaagaauauuacucaucucauauucaacuuaaauuuuccagcugcuucauauuucugucaaaagugaaaaacaagguaguuaucaaugggaugacuuuugagguaauuuuuauucugagccugcaaaaaauauuguauucaauguauacaaaaaguaccaacugcauaccuguagcaaacagaccaagaggaaccaauacauucugaaaaugcaacaggguaacgauucuauauaagaugucaggcucucugcaagcuuuguaauucuuaguuucuucucauugcaaccucugccucccggguucaagugauucuccugccucagcuuccugaguagcugggacuacaggcaugugccagcacacccggcuaauuuuuguauuuuuaguagagacgggguuucaccauguuggccaggcuggucucaaacuccugaccucaggugauccuccugccucggucucccaaaaugcugggauuacaggcgugagccaccaugccuggccgcagguucuaauacugaguucugcugugacaauucaaguucauuccuagaugucccugucuuacaaagcuuugugagguguggcacccucugcaugaggcuuugucacagucauuaugcaaggagcuaugcaacagguugccugccgcccagauuugaauucuagcuuugccacacacucgcagugaggggauaacucuaggcgaguguccaguuuguagauaaagcccuuacugagguguacgagguguacggcacauagugaaugcucaagagacacuaacucauuacugcagaggcaauaugaugauaauuugguaaauucaaaauuucuagucaagacggaggggagagaagccuucucaaaauucuccagugcuucucaauuuucucagaauaaaucccaaauucauccauggaacuacaaagcccuguccugguuccucccgccuacccuucccuacuuguucugcuccauuuacaagagcaaccguuccucaaucacaccagccacgcucccaccacagggucuuugcaguugccauucucucugccugcggugcucuuucccuagaaaucugcacagauugcuucuuuacuuccuucuggucuuggcucagacgugaccugcugagugagcccuucuccuaccacccuguuuaaaaugacacacuucccacccaccucugccacuccaaauauuccucccccccuucucagccuuauguucuccauagaauuuauuccccgcuuacacacaauagccuuugucugucuguucccucacuagaagguaagcuccaugugggcagggaaucuugcaagucuuguucacuguuggauccccagcaccuagaacagcacuugaaacuuagcaggugcucaaaagaauaugcuccacaaacgaaugaaugaaugaaagcucggguacaacagggugcugggaacaacacccuggacacccucaaauucaaaagucucucacaaacccauuccaauaaggguuaauuagguuaaccacuaguucugaaaucagagacaccuugggaacauucuauaacucuuuguaaccuggcaguaguuaugcaaaucaggucauuauuuucucaguacacggggaauggaucacuuggugacaaugaaagcaucaguaggagaguagagagaagggcgccagccauaccuccuaguuuugccuauaguugcaggcaggaaauuccuggguggccccugacucaagauaacugguguuuauuaagaaccuguccugugucaaccccagaccuguaaacacuguguucuggcaagaaagacuguaacucuuaaacauguacaugugcuauuuugcauguaacuauuuucuauaaauguuggcaucuuucuccagaacccuaagccucauucaugucaaaaaacaugugaucuugccaaauuaagguacuucuauuucuucugaccuuacaugcucucuuugagguaaauacggagcuaccucaaugucucaacucucugugaggacucuuucuccuucguucagggggccccuuugccccuccugguugcccagggaaaccugcauaucucaaggguggaggcaggagggcggagaggggacuggccagugccuguccugcuggccuccacugggguguugcucauccugguagugccugggcacccgggugucuucugucuacugagguguggcugcucuagucucuucuuuccgggcccugacaaggcuuuuugugaagaucuugcaugguggaggugcagaaauccugucccaaccucaguccucuugugguucagcacuuuggcaucaggauugcccauauccuacagaggggcaacuggggguccgggcauggcacaucagucuagacccuucuccugccccgugcucugcuccuuccccggcauguccccucacagcaggcuccucugagaggcguguagucagucgccugggacuccaccuucaauguccucagauuccccuagcuggguacccccaucuuauucauaauuuauguggugcuugaaagcuuuagcuauguggcuauuucaaacauccuccccauauaauauccuguaguccguaaauauuuacuauaaaaaguaguuuucuuuagaaaagguauacaccccucccuggauauccacaggggauugguuccagagccucugcggauagcaaaaucugcagaugcccaagucccuaauacaaaaugggguaguauuugcauagcuucuauguguauccugcuguauacuuuaaaucaucucucgauuacuuguaauaccuuauacaauguaaaugcuauguaaauggcuguuauacuguucaaaauuugcauuuaaaaauugugguacuguuauuuuuaaaaauuuuccccccugaauauuuuccaucugugguugguugaauccaaggaugcggaacucccagauaccgagggcugacugcauaucguuuuaguguguguccaaaaaacucaacaauucuuacuuagcauucagagaagcaacggagcguagcgugguggugaagacaggcaguccggagccgcccugcugaaugcccgcuccauuccucgcugccugugugaccuuagggaguuaaccucucugugcccguuuccuuaucugcaaaauggggaucgugguagcacccaccucguaaaaguguugugagaauuaaacaguugauccauuacgugcuuagaacagcacuggcacaaagcgcgagugccgugguggcugcuguccgugucaucacggccgugggaagcacgccaggugagcagguggcacaggccagaugcugccgccuguguauaguuaaaggagccuuuuacggucuggcgauuuuaccugugucacugcagccacuuuccuucacccccuccgaagaauuuaggaucuuggacgcugaaaggagaacggagucaacuucauccucuucccggugcugcuuuucuguaacagaaccguccggggcuguucugucgcgggucguggcguggcggggcugaaggugggggcggggcagagggauggggcggggcaggg

SEQ ID NO: 15605 - RNA, 25997 nt, Homo sapiens
cacuucagggccggcccccggaacuuuugggcaggcgucagcgcccgugucaccgccacgucgcggacauggugaguaucucugcucgucaccgaccccuguguuuuuccccggacuuuggcagccgccacgagcgggcuucacagcgccugaaaggagcugguccugccgggguccaagauggcagcugcgagcugcgugggcagggcggcucuccaguucgccugucuccgcgcugggccggggggaaagugcccuacacaagugugcaccccgccucggccaccuuggacacgcacccccugcuacuucucugugugaaaguauuuugagagacuucggcguuuuugaagccuugcaagaagggcuuaaccugggacaggcgcaacuuucuucggauauuauauuccccuaguucccgugguauuucccuccccugguuucucuccugucucauugcucagcaagguucuccaaucccuauccuaaaugguggugcucuucagggacgcuuuacacccuaugcguucuccuaaaauuuuaucucuaaguuagaccuuucuucugagcuccagacccacaaaucugcuaaccgugccuccacuuggauagcucauauguauuucaagcucagcaaguuccaaacugagcauuuccacuuccccacagcccacaccugcucuuccuccaggaacccccaacucuguagauggcaccaccauacauccuguugugccugcccaaaaccuggaaaucauccuugacaucucccucuucucaacuccccgacaugcagucaauaaucaaguccuauagaugcuacuucuaaaugucugucuguugucacugucgccacucuuaccauccuuggccuugagaucuauccaucugggguagucaccuaaguggucuuuuaagcagaucuucacucaucgauggcccugccuggaaugggcuauugcaccuucacucacccuucagaucucagccucaguauuauuucuucagagaguaucucagcuaauucggaagucuaggaagacuagugcuuuuaugaaugaugucuuguggaaucuucauaacaacccugggaaguuguguauuuuuccaguuuuacagaagagaaacagacuuaagugauaaguuaaauuguguaaaauuguacaguaaguagcagaguuaaaauuuguucuuuccugucuaacuuuuaucuucaguaucuuuaaauauuuuuuauuuaaauggguacauacuaguuuguuugguaguauucuuuauuuaacugauuucuuauuaauagcuauuuaagugguuuccauuuauuuuucugugaugaacaacgguagaauaaauggacaacaugaagcuaaauuuguccugaacuuucuugauuguuuccuuagaauaaauucucagaaguagaauugggacaaaggguauaugaucuuucaaaagauuacaauuuuagaauaaauaaaaacagugacccuuauagaaaugugacaaaggauuuguaaaaugagaaaaacuguauugguaccuauuuaauacuguucugaggauuggaguaaguauguauguuuagcauagugccuuuuacauguuuuuguuuuauuuuauuuuguuuuuuggagacaagaucuugcucuguugcuuaggcuggagugcaguggugugaucauggcucacuguagcauugaccuccccggcccaagcaguccucccaccuuaaccucccgaguagcuggacuacaggugcagaccaccacacucagcuaauuuuuuuuuuuuuuuuugguagagaugggggucuuccuauguugcccagucuggucucuaacuccugggcucaaagugauccuccugccucugccucccaaaguguugggauuacaggcgugagccacugcacccugccuguguuuuacauuugaagagcucaguaaauguuaguacuuauucauuuauuucaaaauaggggucuuaguguguacuaugguucuucagccuguuugagagauauguuuugagagucucaugaaauuuuugaaaccucuucccaaaagaaaucucccgcucucuuucucccuuccugucucuuucucucguguguguguguguguauauauguauguauauauguaugaauauguguaucuguguguguauauauguguacacaaacaaugauacaugucauuugugauauaucaucaacuaccugaaacaguauauggauccaaguaaagaacugauuaguuccauuuugcaagugcucuuuucccuuuauaaguuguaagcauuguccugugccuuuuaauuuucagcaaaaacaugauuuuuuuauggcuauaugauauuccuauuuuuuuuaaccaaucuauuguuggcaguuagguuaauauccauguacccgaaucuuuguguguuuuucagauuuuucuuagacuaagucugagauucuaaaugcauaucacuagaucaagccuaugaauauaaaccuuugauucuuacugccauauucucugaaggauuccaccaguugauaucccacccucaguaugaguuuccucucauugucuugacucccugguauuauauuagguucagugccuugucacauucuuaaacuaguucuuuacuguugauguuuuauugucauuguuaaaccugucaagauuauaauuuggaaagauugucuuaaagcaguaguucucaaccauucacauuagaaucacuggcaugggggcauaggauacuuuuaaauaucccugugccagcugggcgcgguggcucacgccugcaaucccagcacuuugggaggccgagacaggcggaucacuugaggccaggaguucaagaccagccuggccaauauucugagaucccguccuuacuaaaaauacaaaaauuagccaggcguggugguguaugccuguaaucucagcuacaugggaggcugaggcaggagaaucucuuacacccaggaggcggagguugcagugagcugagauugugccacugcacuccagcugugugacagagugagacccugucuccaaacaaaaaaccaaaaucccugugccuaggccuuagaccaguuaaucagaaucucuggggguacagcccaggccucaguauuucaagcuccccaggugauuucaguauagaacaaagguugagaaccccugauuuaaaauuuugggguugcuuuuguuuuuguuuuuucuauaaaacaaggaauuaacucaugaaauaauuugaagaaucaagguuaauuaaugucuuaacacuaaacuuagauucuaauuuauaugaauaugaguuuguuuuguuuuacaagggaguuugucuuuaucuuuauuuguucuaggugauuucagaaaguauggauauacucuucagaauaagaggaggccuugauuuggcuuuucagcuagcuacuccuaaugguaggucuucugaaaaauucuuuuuuauuagaaaauugauagugaaauauacugagauuauuuccacuuugcaaaugaaacugagagagagauaggaugaacuaagauuauauuguuaguaaguacauuaaaugggacuuacacuuagacacuguguuccagcacacccaccagcccauggcgcaccucugugcaaauuagaaaaagauguucccuuucuuaagagacuuuacuccccucuucauuaauuguuacaauaaauguaaauauccacaaugagcacguuguaaaugugcgucgagaauuguacaugacagacuugcaaguguauguacaauccugagucuccagaaccuacucucuuaaauacuacauuauauggggaugaguacaagaacucuauggaagaaaaaucaacaggguuuauaugaagcagauucuaggaugucuuccuguugcugacuugaacuacagccacaaacugagauaaagaacaucagaggaggaaugggaugagcuguguuugagauuuguuucauuugaugccaguggaaggucaaguacaaauucccaacaggcauuuggcugagucagaaauuuagaagaguguggucagaguuggagcuagagaauguaaugucucugaagggugauaguuaacacccucauuauaaaugaaaucacucaugaaaaguacgaguaguggugccagaagccacagagccguucagaaagaucaggaauuaaaaguacuguauuagucuguuuugcaucuuucuaaaggaauaccugagacugggucauuuauaaagaagagguugauuuggcucacaguucugcagacuguacaaaaagcauggugccagcaucugcugcuggugaggcucaggaaacuuucaaucaugguggaaggcaaaggagggggcaguguaucacauggcaaaagaaggagcaaaagagaggaggaggugccaggcucuuuuaaagaaucagcucuuuugugaacugauaggagugagaacucacucuuauuacugugaggauggcaccaagccauucaugagggaucaugauucaaacaccucccaccaggccccacuucaaacauuggagaucacauuucaacaugaaauuuggaggggacagacaucaaaacuauaucagauaccagcauuccuugaaggagauugcagcuggccauccuuuacuagccccguggaagggagggagagggugcagaauauucuuuuccacccaucccuucaacuaauaaauuguucucaguuuugguccacauuugaaucccugccaccagacuacauuaaacuacauuucugggacagagacccaggcaucagucagcuuucuagguaauucuaaugugccauuaagaugagaaccauuuuacuaggacuaaaucacucauuuucaggccuauguuauuaguagaguguagcuguuccuaaaauguuacuuuauggauaaaaccuuacauuucacaacuugauauaaacugaaaacauacuuuacuauaaucuuauuccaaaguagaauuaauccauuaaucaguagauaauccaauaaucaaauguaaacaaggacuacagauacuuuuuaccuaguaauuaauauauuugaacuugucuucugacuugauuguauuccuucuccuuuaucaaacucugucaacacucaacaaagggcuucucauuaaucagaaaauauagagaauggacaugcuuaacuuuaaaggcuucacaguuuuuuuuagguaacuuuaccaaauaguccuuuagggauaaacagaagcuaauuuaagaauuauguuugucuuuuguagugcaacugaaaaucuuuaaauucugcuuucugaaacauaucaaaauauuuuaauaucugauuuguuaugaguaaucucuacaauagcuccaaaguauuuauuuaucaagauaccaguauggucguuguuuauuuauuuauuuuuuaaauacucuuucagcagaaucaggucauugaauaaauauuuacaagguuaaauaggcuuaggauuuaggaauguaaggcuaagaugaguauugaaagauugucuucuuugacuauaucuucuuauauuguuuugacuuuggaaacguaaaaauguuuccaaauugaaugugucaaauauucaaaaauauuaaaauacucuaauuuuuugaauauucaaacauauuuuuuaaaaagucuauuaaaaggaaauccuugaaaacaaaaacaaacuaaagcaaauauguuggugacauaaccauacagaggaaaaaaaaaccaaccgugacuuuagaacacagagcuuugauuauauaggccuagugggauauaguccaaagagaaaaagaacuaagagguuuaaauuucacucaauaguuuuauugcuauaaguaauacauuauuuuaauaguaauuggaauccuuauagauuacugaugggaauauaaaauggugcggcugcugaaaacagcuuggcaguuccugaaagugugaaauagagaguugccaugugauucagaaauucuauucuaggugaucacccaagagaauugaaaacacauccacacagaaacugaacuuaugcacagauguucauggcagcauauauaugauagccaaaaaguggaaacaaaugugcaucaauuuaugaaugaauaacaaaauugguguauccacacaauggaauauuauccugccauaaaaaggaaugaaguacugauucaugcuacaauacagaagaaacauuaagcuaagugaaagaagccagacacaaaaagccauguaaugugugauuccacuuaugugaaauguccacagcaggcaaauccauaaagaaaaaaguagguuaauaauugccauggguaguaugcugaaauucuuuucauuuugcaaaggaagcuggaugagagauaaaaacugugagaucauauaguuaguaaguggauugaaugggauuuaaacuuggauauuguguuccagcacccccaccaggccaugggguaccaugugcaaauuagaaaagauguaggagggccaggcgcgguggcucaugccuguaaucccagcacuuugggaggccgaggcggguggaucacgaggucaggagaucgagaccauccuggcuaacguggugaaaccccgucucuacuaaaaauacaaaaauuagccaggugugguggcgggcaccuguagucccagcuacucgggaggcugaggcaggagaauggcgugaacccgggaggcggagcuugcagugagcccagaucgcgccacugcacuccagccugggcgacagagcgagacuccaucucaaaaaaaaaagaaaagauguaggagguaaaucagaaaauuuucaauuagagaaaaguagggggaaugagaaacgacugcugguagguacaggguuucuuuuuggagugaugaaaauguucuagaauuagugaucauuaugaaaccuuaugaauauacuaaaagcccuaaauuguuugcuuuaaaagaaugaauuugauggucugugaauuuugucucacagacuuuuuuaaaaagauaggcaaaaaauuuugaaauuauuauugaauauggggaauagguauugagaguuuuacuaugcucuacuuuuguguauguuuggaaccauucauguugaaaaauuuguuuuucuuaacuucuauuuauauucuuuuaauuuagaaauuuuucucaagaaggcacugaaacauguguugagugaccugucaacuaagcugucuucaaacgcccuuguguucagaauuugccacaguucaguguauauauggccuagcagugacauaaacaccauuccuggagaacugacugaugcuucugcuuguaagaacauacugcgcuuuauucagugaguauguuugaagauuucuagaaauguuuucaaaacaucauuucauauuauaaaugucuguguauuaaaaauuuagauuugagccagaagaagauauaaaaagaaaauucaugagaaagaaggacaaaaaguuaucagacaugguaagcaaacuaucugucuucuguacugauaaaaauguuaaaucuuuggauuuggaacugagugcaaucuuagaaauaauuuaacccucuuaucauaggucagaauauugauguccaaaaagauuaaaugacuugccaaaaguuauauguuugucuuacuuaucuaaguuuuugucugauuauaauacauaaucucaaaaggguuuuuuuauaaugcuuucuuugcucccacaaaaauaaaacagccuaaauacauuuauaaauuacuuaaauuaaaucgcauucugaaucaugacaaagugacacauugugccacauaagacaaauaguaaaugauuuauuuuucuucacacuacucuugguucuguuguuuguguguguguguguguguguuuugagauggaguuucacucuuuuuacccaggcuggagugcaguggcacgaucucggcucacugcaacuuccgccucccggguucaagugauucuccugccucggccuccugaguagcugggauuacaggcaccugccaccaugcccagcuaauuuuuguauuuuuaguagagaugggauuuuaccagguuggccacgcuggucucaaacuccugaccucgggcgauccaccugccucaggcucccaaagugcugggauuacaggugugagccaccgcgcccggcugguucuguugauuuuugaacugauauuacugaguaccugccaugugccacaaacuuuaacagauauugaagauagaaaauggagaugcgucuucaaggcacgaaguuguaugaaguuaaugugacgacaguguuuccaggcugguagaggaagaauggguggacauaaggcuggagaggugggcgugggccucuuuagaagaggccuaacuaaaccacuagcuauggaaauagagaagagggauugcauacaagagauauuuagggauacaauggauucugcuuggaaacuaacuggcaagaucaguuucuuguguggguaaagauggaaggugaggaggacaugaaguugguuugggccauguuuaagaccucaguaagauguacagaugagcuguuagauuuacagauguagaaugcauaaaauaauugugggcuggauacaaugauuugaaaauuaccaguaauuggagcuugacauuuugagggguacaggugaguucuuuuuaagacugucccuccuuuuggauuuguuuuaugcuuccuuguuauuagaguuaggucaugcacuauuggcaggaauaccacagaagugauguuguguccucagcacaugguaugaaagagacaguuaucagucuguugcuauuauuggugagguuaacuucacuuacuuaagaugguauccaccaguuuucuccaugguaaagguacuauuuuuucccuuauaauuaguaucuugugggaagaaacuacauauguaucuuacuuuaguccucaucagauuuugacccaccacuuuuagcauccauugauaauuucugccagaauccaauauuaaucuggugauuacaaaguggugauuuuucuaaaucugucauuuccuuuuguauuaucugccauagaugcuuauuuuaugcagugguuuauaaucugguacuaucauuaguuauuuugaugcucacauuuuccaagauuuggccaauagaaguuucuucaagcuggcuccagugccuuucuaacauuguaauuuugggcacuuccuacccaucagauguuccaggugcaacaugugcuuucucuguucuagcuggagaaucagucauuuuuccaugggcacacacuuuuauacuuuuauacuauccacacacacacauaacacguucauuuuuaucuguguaaaucacauugauaccuccaguuccacuucaacccuagagugcuugaccuuuucccagugagaagucugacucccaggauccucaguauuuugcgaaauaaguuuaguguaaauuucacaauuguucauaccccuguaaaaaucaaaccuacaaaguagaguucaguauuugauuauaguuauuuauguauuagaccagggguauauaguuauauguuuaaaaguuccuuuggugugugguuauuuuauguuaauuugauuuucuaaacauuuuaaaucaguacaaaaguggagagaaucauguaacgaaccccagugaaccuaugcguggcuuuaacguuuauucauggccagucugauuucaucuuuacuucuuaaucccucuccccauguuauuuugaagcagaaaauaauuucuuuuuaaaauaauauuugugcuuuuaaucuuuuuacuguaguacagcuuuauauucuguccuuuaaaaguccuucuacuggcuggucugaggguagugaguuaucucaguugaucauucacagccaguuacagauugaacuccuuguucucuacucuuucccccuuuucacuacuguacuuggcuagucuuaaauuuuuuucuuaauaauaaauacauuuuugaaaagucuuuuuacuuacucuuuauauuuaguguuuaaugcacuacaaguugacuauuacuguuuaucuauauagcaucaaauaguaaauauagaucuuaugcuggaaaugucaaccucccuggcagcuguaacgcccaucauugaaagggaaagcggaggacaccauuauguuaauaugacuuuaccugucgaugcaguuauaucuguugcuccagaagaaacauggggaaaguaaguauuuuuauaguaccacugccacauuugaaugagggcccuuccccaaacccauguuuguauauccuguagguauaccuaaggugugauuuucuccuuguuuauuauuaaccuaagagccaucuauuaauuaaaugguuauuuggaggaaguaggguagcaugcuaaaaccuggaggauuucccuuuauccacaaagagcaaauacacaguuucuuuuauaauguauaauucagacuuccuuuagcaaaccugguccaaucaaguuuuuuacuauacuaaggauauauuagcucuguacuuuucuuuauuguagucacuauaacuuuuguuaauacacuuauauauuuccccccacagaguucguaaacuccugguugaugcaauucauaaucaacuaacugacauggaaaaauguauuuugaaauauaugaaaggaacaucuauuguggucccugaaccacugcacuuuuuauuaccagggaaaaaaaaucuuguaacaauuucauauccuucaggaauaccagauggccagcugcaggccuauaggaagguaaaaccaguucaucuauucuuagaaaaaacaauaaugacuaucauucauuuuguauuuaauuauauauuuccacuaaauggaagguauuuugugauuuaacuuaaaaguguggaauuuagacuauucauuuuacacauuauuuaauuucuguucucaugaaacuuuaaguaguauuaaugacaaaauguuauguugaaccuauauguaacauuuuaauuuuaaaugcucggugugguucauauauucugugaaauuuuaauauuuuuccauaaugaaauauagaaauggugcuuacaugccuaaaguugcugguauuaacagauuucuauaacuuuccgauuugugaaagagacaagauuacaguuagggaaggaaaaugauaacuuaugcuaauucugaauaggauuuaugguaauacuccacaaguaagguuauuugggcuuuauuagaggaauuuuggagaaaacaugaccagcauucaaaguaaugagauuuacucaugacugguuuuggagugcaucuuuuugauauguggacucgcuuagaaccuaucaaauuagaccguggagcaucuuccuaauuucuguccuuagggagagcgagaauacccugacccucuguauguggaggugacuugguuuguagaagcaauagcuacaggagcugaucuuuuaaaaccacuggaguacaagauaugauaaagaacaugucaaacuuuuuaaaauaccuauuacauguuuuuauauaguugggaaaauaacacauuuuaaacauauauguguauuuguuuuccugccauauugguuggcuuuagaccacuaacuucuacucuguaguuuaaucacuaccacuuacaauauaaaauauuuguaaggcacucgacacaauuuugcaaaauacuuugauauaauuauuguuaauuauaauuuacucauuuacaaggcuauuucaaaaccagucuuuagccuggauguauuuuaacagacuauguuguaauaaauaauuauuuaaaaauuaguucucuuacucuaacaauuuauauucauuuuucucuguucccuuccaguuucuacccagauacagacguaaacgaaaauaaaucuuacuugguuuuaguucaguuuucaccaucuuugauguuagugaauuaaaccauaaguguuuggaaacuuuuauaaccuauauauaauuuuccauguuuaauaacaucuuuauuuauugacuaggaaucuaaaucaccaacauuuuuucuuuuucuguugauucugauuuauuuuaggaguuacaugaucuuuucaaucugccucacgacagacccuauuucaaaaggucuaaugcuuaucacuuuccagaugagccauacaaagaugguuacauuagaaauccacauacuuaccuuaauccaccuaacauggagacugguauggugaguuuaacuaauuauuuaugggagucacuggaucaguaauguuauuaguuguuuuuuguugguacccaguaggagacuugauucauuauguauucauuccuaaaacaugauuuaucacccaucucuguuaacagacauugcuuaagauagcaguaauuaaaaauggucuagaaaaguuaguaauagguagauauaccacauuuaucuuacuaaaauucucuuauuucuuuaaaggcuugucccauuuuuuuucauucugaaccugagaaaucaugcuaauuaagggcauagucuacccaaaccacacuguaggauaaaucuuuuuuuguuuuuuugagacagagucucgcucugucacucaggcuguagugcaauggugugaucucagcucacugcaaccuccgccuccuggguucaagcaauucuccugccucagucuccugagcagcugggguuacaggcaccugccaccacaccuggcuaauuuuuguauuuuuaguagagacaggguuucaccauguuggccaguagcuaggguuacaggcaccugccaccacaccuggcuaguuuuuguauuuuuaguagagacaggauuucaccauguuggccaggcuggucgugaacuccugaccucaagugauccgccauguaggccucccaaagugcugggauuacaggcaugauucaccaugcccagccacuguaggauaagucuaaugaggaacuagacuuauuuuccauguaacauauacccgguugccagggauagauccucccuaaagguagcucaaauaagagugaauuggcggagggugguggaaggguuacuuuaaggauacauggaggccagugagaaaggaccuuauaaggcauccaagauuaggaauaccaauagagcugggccucuuagaaacagcagcccugugacuagcaggugucuucagucucucucaaggacuccguggauaccuugguggcauugcuauugcuuucuguguaugcuugugauccuaacuggccuguucuuaacuuuuacucugucugcuccaccucauacccucuguauccucacuguuucagcuugugugucacuuuuuccuguucuuccucagcugcccaguguaugccucauuccaacugcauuuccugcuccuggcugccuggcuaacucugcaccucucaguucagauucccaagagaaagaaaacuuggcuaucguaugguggcauuuauuaauaccuucugagcguccaggacuuuugaggaaaucuuaagaauuaaaaaaaugcauauacgauacaguacguacccuagaugaguuaggggcccacuuguggucuuggucauuagaguguacucagggcagcagaucaucugcaaaagcugugggccaaccagcuuccauagaaaguuccucacaaaaagaauaguuccuuagaagaaccuggacacacagaagguauugaaugaguacugauugcuuuuugacaauaaaauagguucauuauaucuguauuacaaggucguaagaaaaauauauacuuuacauauuuaucauguaauauuugauauguacauauaacauaugcaaauuguaaagcacaguggggaaaugaauaccagggagcuccucccuaauuuaagaagcaaaacuuuaccagucugugcucuuucccuacccacuccucugccuccucgacacaguuccaggaggaacuauuauggguuuuguguucaucauuuccuuccuuuuuaaaaaguaguuucagcguauauguuacauaucaaucucagcaaugucgcuuuuaguauugcauaguucugaguuuuauaaauaugguaucauucuguacguagucucugcagcuugcuuuuucacucaauauuacauaucaaacaucucugguauuuugucuaaccauaguuaauuaucuuuaugauuuuuuccaaguuuuuuugcuguuuagacaaugaacauuccuauaccucucgauacauaugugcaacaguuguuaacauuuugcuauaucugcuucauuucucccucuuuuuucccccucugaaccauuucaaggaaaauuauagauauauuauuuacccuuaaauacuuuggcacaaaucucucaacaauauagaugugcauucaugaaauaaacucgguuugguuaugacucauuauuuuuuauuccccucuggauuccauuugcuaauauuuuacgauuuuugcaucuauguucgugaaugauacuggcuuauaauuuucuucucucauacuguucuuauuuuguuuuuuuauuagugauauacugguuuacuaaauuaguuagguuaauguuccuuuuuuaguuuuuuagagaaguuuauauaagagugguaugaucuuuccuuggucauuugguaaaacuugccuguaaaacaauuuuggcguagcauuuucuuugugagaagauuuuuaguaaccaauuuaguuuugguaacagcuuuaggacuuuuugauuuuuauaaguuauuuaccuagguuuuaauauaucuuguagucauaauauuuucuuuuucauucuucauaucauuuuuaugccuugugucuuuuaaaaaaaaaaaaacuuuuggcuuuguuggcccccucuauuauaacuucuguauuugauuuuauuaauuuuugcucuuuacuuucuuuuuuuuugcucuuucuuugauuuauugucuuucuucuaacuucuuaaguuggacauguuagcuuauugcuaauauuucuuucuuucuuuuuuuuuuuuuuugagauggagucuugcucuguugcccaggcuggagugcaguggcacaaucuuggcucacugcaaccuccgccuccuggguuccagcgauuauccucccucagccucccaaguagcugggauuacaggagggugcuaccacgccuagcucauuuuuguauuuuuuaguagagaugggguuucaccguauuggccaggcuggucucaaacuccugaccucgugaucugccugccucagccucccaaagugcugggauuacaggcgugagccacugcgcccggccuaaucuuucuuuuuuuugagauggagucuugcucgguugcccaggcuagagugcaguggcaugaucucagcucacugcaaccucugccucccugguucaggcaauucuccugccucagccuccccaguagcuaggauuacuggcaauagccauacgccuggcuaauuuuuguauuuuuaguagagacaggguuucaucaugcuggccaggcuggucucgaacuccugacuuuaggugaucuacccacucggccucccaaagugcugggauuacaggcaugagccaccgugccuggacagcuuucuuauuuucuaauguaagcuuuuaaauuucaagcaaagcacugcuuuuaguguaucuuauagguuuaauuugaaggauuuuaguuuuguucacuucuaaguauuuuuauauuuuucuauuaugguuuuucuuuuguccauguauuauuuagaaguguuuguuaauguccaaauaugucagaauuuauuuuucuuuuuugcuuuuuuuuucuucuuguuuuaacugguuucugacucuugccuccuggucagaaagaauucuaagugaaacuaacucugaaauuuauugaaacuuguauuuguucccuaaaaaauaauaacauauuugauggcuuaaaacuacaaaaauguauugucucaguucuggaguucugaaaguaguaucacugggcugacaucacaaugucagcaggaccaccuucccuccauaggcucuuggggagaauccauuccuuaaucugauggcugccagcauccuuugguuuguggccccaucauuccgaucucugccuccucagucacauuaccuucuccuccuaugccccucucuuuuaagaauauaugugauugcauuuagggcacacuaggauccaggauaaccuccccaucuuaagauccuuaaucacgucuaugaauaccuuugcuuuccuuuuuucuuuuacuuuuuggcacagagggugcauucacaaguuccagggauuaggacauacauaccuuuugggagccacuuuucagccugucacaauggucaaguuauaaauuuuucuaucugugcuugggcagaauauauauucucuaauuguugggugaggguugguucuaucuugucccuaucuccucucacuuaauuuuuuaaaaauaucaucaguuuggagccaggcaugguggugugcaacuguaaucccagcuacucaggaggcugaggcaggaggaucacuugagccuagaaguucaagaccaaccugagcaacauagugugacccaaucucaaaaaaauaaaaacaaaaacccaguucuuuaauaaaaaaagacauauacauucuuagcacuauaaguaagaauuuauaugauauuaguaauuuauuuaucuuuauuuuuugacccuuaacuuagcgucaucaaauaacauacuugggcuguaaucauagcagguuuauaaauuuagacacauucuuccugugucccaugauauggacccuucauuuguuuguucauuccuuuauuccuuccuucauucauucagcauuuauucagcagcauuuauauuaaccgugugccaggcguguuguagaagcuugggcccaaaaauggauaagacacaguguauguacucacugagcucacauauuaguguaaguaggcagauauuuuuuaaaugauaaguaauguaucauuuaaaguauaucaagucaugauauacuuugaaaaauaaaaacauaaagaggacagagaugacaggugaggcagggggugggguagugagagaaugagugggccguuuguagacuggauggucaaggaagaccuuugacaucuaaauggaaaccugagugaaguaagagugcaagcuguacaauuaauuugggaaaagagaguuccaggccaagagaaccaugaggcuccaaggucauauugccccugguauaugggaaccgaaaguagagggagcaauagggaaaaguuuaggagaugaaauuggagaggaggccagaagguagguccugcugggcccugugguaaggacuuugaaccucaaauaaaaagccaagaagguauaauguuaaaccauagaucugugaaggcauuuuuauaaggaacuaaaguaacagucuaacucuaagaacauuaaacauaauucgggagcauauauagaauauguacuucuauccuaaguuaauauuuuacuguguuucuucucuguauauagauuuaugugguccagggcauauauggcuaucaucauuauaugcaggaucgcauagaugacaauggcuggggcugugcuuaucgaucucugcagacuaucugcucuugguucaaacaucagggauacacagagagguccauuccaacacacagagaaauucagcagguacagaacauaccguuuuaaauuauaaucaacuguauguuucauuagcccuuaauauaccauugauaauuuuuguuaccucauggugcagacuuauuucuguuuugaagaaaaaaaaauucuuguacugguaaucagggaaaaugcccuaaacaucguuuuuaauagcugucuuguguauggauguuuuauauuuuuaaauacaucaaggcucuagucgaugccggggacaaaccagcaacauuugucggaucgcggcaauggauuggaucuauugaggugcagcugguacuaaaccaauugaucgguauaacgucaaaaauccuguuugucagguaagcacacuuuaagaaauuagauaaaucauuucaaagugacagucugucauuuuaauuaaaauaauagaaaaaaugguaucuucccuuauuucuuuuuauuccuuuuccuucuuccuuauuacucauugcuuuauaaaucucauuuuuuaaucuuaauuuuuuuucauuuuuuuuuggaaggcucugauuuuaugaauaaacuuugugauguaauguauacuuguauuauuuaggccuaauuuuagccuagaagaggaaaacuuaaaaauauauuaacguugaguaaagucauaaaaauuauauuaacaguuucuuuaugcuccaaucuuuuaaaaagucuuaaaaggcaaaacucaaauguugaacuaugacugaccuuuuuguuuaccuccugcucuuuuucuuucuaaaacguuaauaaucuaguaauguguucaaauaauguauucauuuugucuuuuccaaugaucuuaaccauaauucuaauauuaaaaugagaaaauauaaauuaauuauuuucuaugaccauaacuagcugacuccugauuguaugagcuuauguuuuaaaauacauuuucuagccaggugcaguggcucacgccuguaaucguagcacuuugggaggccgagguggguggauccccugaggucaggaguuugagaccagccuggccagcagagcaaaacccugucucuacuaaaaauacaaaaaaaauuagcuggguaugguggcgcaugccuguaaucccagcuacuugggaggcugaggcaggagaaucgcuugaacccaggagguggagguugcagugagccaagaucaugccacugcacuccagcacaggcaacaaagcgagacucccuuucaaaaaaaaaaaacagaaaaauacauuuucuaaaaaaaaaaaaaaaaaaaaagaaaagccaaaaaacaaauaaaauacauuuucuauuguuaauuacaguaacaucguccucauuguaucuuuuauguguuaaagauguaauuuuauccuuuccucagugguuauggaaaucagugguaaaaaaaugacagacuggcugggcacaguggcucacgccuguaaucccagcacuuugggaggccaagguggguggaucaccugagguuggcaguuugacaccagccuggccaacauggugaaacccugucucuacuaaaaauauaaaaaugagccgggcaugguggcacacgucuguaaucccagcuacucaggaggcugaggaaggagaaucgcuugaaccugagaggcggagguugcagugagcugagaucgcgccacuccacuccagccugggcaacagagcgagccuccaucucaaaaaauaauaauaauauaaaacaaugacagacuuaaguagugaagaacuuuuuuuaaaaguuacaguuuugguacauuaaaacauacguuccucauuaagcaagagcuaagguuuagcaccaccgggcaccuucccccaaaaaauaccucccuucauuaucccaucuaucuuucucuuuucaaaaguaaaaauucugagauucccuaaaaauaguauguugcacuugaaaacauuuugcaguuuucacauugauuucacagacauguauuuuaggccuagacucuccucuguuauguagacaggucagcguuuugggucccaauuuaaagaugaggaaauacagacuaagaagucuaccagcaagaaggcaagaacccaggacuuaacacucauucuucugauuaauccauccauaagaacucccugagcaccaaggugauguuuuaacuucauguuaaaaacccaggccuccuuuauacaguucaagaagcagaaaaucaaggucuuuuagcgucuuaucuagcacacuugguggccuuaaguauuuugaguuuauguugcuuuaaauugcacaguuuaauugcucucaguucccuaacacuuaauuuuuuuacauuuauauauuuuuucaguaacacccgaaaaaacaagaaaguaggaaacauugucuccuagcucauuauuugaccguaguguuggaaguaguucaucugauagaaaaugguuucuuucuagccaagguucagaaauugccucucaaggacgggaacuggcuaaucauuuccaaagugaaggaacuccaguuaugaucgguaagcuguuucagacacuguuuuugguagagugaguaauaugcaaaacuuaucauugauauaaauauuuaauguugcauaaaaucagucauuuaaaaaauuuugaaauuaacuuuuacaccauauguauggaucucuggauauugaaaaaaauuucuaagguggcuuaaagguuacaaaaaagauuauaauaaccagaagaaguaaaggcugagaaaugguagcuauguucaaacauuuaaagagcugagaacaguauuaaaaagaggaaacggucacucagcugagcuucguaagucaugacucugucauaacugggcuggcuuugugagauuuugcaauuacuuaccucuguggauuuuauuuguaaaauaagaagauuggauuagcugaucuaaagaugcuuaauucuuugaagaacaagaccuguccugugaugacagaaggcaaggugagacuaguguguaagaaauggagguagaagcugggcauaguggcucacaccuguaauccuagcacuucgggaggcugaggcaggaggauagcuugcauccaggaauucaagaccagcaugggccagaccgcgucucuaccaaaaaaaaaaaaacacacaaauuagcuggcaugguagugugagccuauagugccagcuauucaggagacugaggugggaggauugcuugagcccaggaggcugcagugagccaagagauccacugcucuccagccuggguuacaaaagugagacacugucucaaaagaaaaaaaaaaaaaaaagaaauggagguaggcugaugucagcaaaauaucagaaagaacuuaaugaguaggccgggcccaguagcucacgccugacuccugauuguaugagcuuauguuuuaaaauacauuuucuagccaggcacaguggcucaugccuguaauccagcacuuugggaggcugaggcgggcggaucacuugaggccaagaguucgagaccagccuggccaacauggcaaaacacugucucuacuaaaaauacaaaauuuagcugggugugguggcacacaccuguaaucccaacuacuugggaugcugaaacaggagaaucgcuugagcugugagguggagguugcagugagccgggauugcccacuguacuccagccuggguagcagagcaagacucugucucaaaaaaaaagacugggcacaguggcucacgccuguaaucccagcacuuugggaggccaaggugggucgaucacgaggucaggagaucgagaccauccuggcuaacagugaaaccccgucucuacuaaaaaaaaauacaaaaaauucgcugggugugcuggugugcgccuguagucucagcuacucaggaggcugaggcaggagaauugcuugaaccuggaaggcagagguugcagugagccgaggucacgcuaucgcacuccagccugggugacgugagacucuagcucaaaaaaaaaaaaaaaaaaaaaaacuuaaugaauggagugcuauaucacuggagguacucagaggcagcaggaccaucugcugagagaggcacuacagcagauuguuacucuguugggaggaguuuauggcccuuucuaaauccauuuuagguaauuauauggaugugaauguagaauauaaauuguaugugauuauagauaugauuguaucuuuuguguuaaagauguaauuuuauccuuucagaguauaucugacauugugucuuuuauaguguaggguaguccauuuuaaugcuauuuuagaucaguuaauaagcaaaguaauguuguuuuuuuuuguuuuuuuuuuugagagucuugcugugucgcccaggcuggagugcgguggcaugaucucggcucagugcaagcuccgucucccagguucaugccauucuccugccucagcaggagcugggacuacaggcgccugccaccaagcccagcuauuuuuuuuguauuuuuuuaguagagacaggguuucacugcauuagccaggauggucuccaucuccugaccucgugauccacccaccucccaaagugcugggauuacaggugugagccaccacgcccggccguaaucugucuauuuaaauugaauaggcauuugacauuuguuuaugccuucauucguauuuccuauuuuuucuucuauagggggaggaguuuuggcccacacaauacuaggaguugcauggaaugagauuacagggcagauaaaguuucugauucuagauccacauuauaccggugcugaagaccugcaaguuauuuuggaaaagguaaguauccauuuaacacaaauugagacaaaaggcaaagaagcuagaaaugaaggaucacaaacuggcugguaacagaaagacaauaagcugagggcagagaucucccuguguggaggccuucugaggcuguuguaaguagccgucucuguauagggaaugugcaagaacaaagcacauugcaaaagacaaaauuuagguuuauagaaacuuucucagcuauuaaaauuaauaauaggacacacacucauaaauauauuccuuuggagauuuuagagcuuucauaaacaaauguaucaaaguuuaucaaugucuuaaaauagaugagcagaauauauaaacuuuuaaaauuuuagaauuaaccaaaagauagcuaagcaguaugcuagacauuauggaggcuugacuaauuuuaauucauuuacauauaaccuaaucucauucuauaaaggguuugaaguugauacauauuuaagaguauucuuacuuacaauagcagauaaaggagguaaaaauuuguuaauucauaggcaacuaauucucacauaugaaaacucaguaccaagucuuuaggagaaaguauuguaaaacauaauuaacuugaauuuuaaguaacauuuauauucgcugccaaauacauugaaauugcagagaauacauaaccaccuuuuaaacuauaaacuaaagauaaaauguuuuaauauguuaaagaguuuuaagccaggcgugguggcucacaccuguaaucccagcacuuugggaggcugaggugggcagaucaccugagaucaggaauucgagaccagccuggccaacauggugaaaccccaucucuacuaaaaaugcaaaaauaagccaggugugguggugggcgccuauaaucuuggcuauuugggaggcugaggcaggggaaucacuugaacccgggaggcagagguugcagugagcugagauggcgccauugcaccccagccugggcaacaggagugaaauuccagcucaaaaaaaaguuuuuaauguguguaguccaacucuguuauauccucaguuuacugaagucuuuuguuuaugauaaggguauaaacacuaauaggauagaaauguguuguuacaguuuuaaguguuuuuuuuuccuuuucucuuucacagcauuuggaauuugaagucuauaaaagguuuuuugacuggugcauguaucuuacugaauauaguagcaauauucuuguucuguagcaagguguucauuccauucaguauuuauuaaaguaccuaacaagugccaggcacuguccuaagcacuaguauuacacgagguuuuucgggagcuaaaaccuuuaggguaggacagagaaggagagugcaaaaaggacucucgagaaaaaaaaaaugguaucucaggugcuucuacgaggcuggugcugugguggccccugccuuguagaaacagugaaagccgcacugcagguagaucagugcguccagagcuaggcgaagaggugaggcuggaaggacacaccaagcucagucagaaaggguggucuuugugaaccaggcauuucgauuuuuucuuaaaggcagggagaagccuuaauuauuuucaucaucaaauuucucuuuucugguugacucaaggggcucugcacuacauggcauuaucuagguaagguuucugaacaauuagaguaagggauugucccugauuucuuucucugagaauugcaaucuccaucuuugcuaguucuauuucuauagaacuuuucaacagcagaaaccuccuugcucuauuuguauacacaagaaacugugcagccaagguccugccauuaaaacuauugauucacuugacuccaggaacccaggaggccagaggagaguuccaucucugccugaccucuuugccuucuuguggugcuuuccuguuugaaguucccaugcuggucaucucacaggaaagaagcauguccuaugcacuaugucccuaugcaaucccauucugacacccucucuaccaauuucuccuuuaaaaaaucuggaucugguuaccuggacaaggccuucauguguaaaaggaucaaaaaaagguuaaaacagaaugagccuuuuuucucugucuguuaagagaacagauuuuaggacauuaaauuaauagagaaaguuuugcugaaaaaaugagaugauuaauagaaugcugguuaccuagggagagugggggauuaccuaggacugguagaggauuuuuuacuuuuaucuuguuuuuugacaacguguaucuuauuaggagggagucagaccgcugcuugucacucacuucaugguauuuucagagucucagccuccuugcaaggauuucucaaagcauuuaagaaucauauaauacagaccaguuauuggcuuuuaaguuuucuucuuuaauaaaauaacucaguggcccuaggagaaaucugagaaauuuucauacucuaaaugagauuuugcuugaaaguaauuuucucugcuggcaaaaaggauuaauacugacaugaaacaugggaaguagaauugaguaacaccuggaauuugaaaaugaaagggcacagagugccaggcagggggcaagcugagguuucucacuacaguacuucaauccuaagaugccacugaauggucucuuacaguccuuuauggacuauuaagaaaaacagauugcuaguucaauugucacaugcuaucaguugcaagugguaaaacuauacaucucagaaucaguaaagugugguaucuggaauaacaguuacagguaaauuuuuuuuaaugauuuuuaugaugaauuacauacauagaauuaaaaguucaaaaaccuaccuuaaaggguaagauacguuacuuuucuaugcuaguaggaauucaaauccuugaaugauaaagccauuuagagucuuauuccaagguccugcugacagagccugaugucacgauuuccaugacauaaucuuguaacuuuguaaaaggcuuuccuuucccgucuucucuauccagggcuggugcggauggaagggcccagauuuuuggaacaaggaugcauacuauaacuuaugucuuccucagcgaccaaauaugauuuaaaauaucuuggagucaaagacugcaguagagugguauuauaaauuugugaauaaagaaucaguuuaauuuuucacauuaaauccugguucuaguuugacgauuuaaauuaugaccuuuuucaaagguuguaaauacugcacggagaauguauuuuuuagacguuccuuuaauaacuuaaaagacaaagcauacacaaccagcauauuauaggcauguaaauacauguguucuuaaauggaucuucacuuggaagaaaguuuuucguccuucucagaaggagauuagacacaacauaugguaaagccaaaagcaggagcuuauagauuugcaugaaaugaaggcguucuucagacuucuucauaacccacgugacaucuguuuuuaaaaacacguuaacauuaaaaacuuuuuuuuaaaaagaguuuuauccccaaacuuccaccaugcagucc

SEQ ID NO: 15606 - RNA, 2371 nt, Homo sapiens
uucauugguuacggcagcacuuuuauuuuuccuuacacaaugacguguugcuggggccuaauguucucacauaacaguagaaaaccaaaauuuguugucaucucuucaaagaaucgagaauugcguacaaaaaaaaccuuacauaaauuaagaaugaauacauuuacaggcguaaaugcaaaccgcuuccaacucaaagcaaguaacagcccacgguguucuggccaaagacaucagcuaagaaaggaaacuggguccuacggcuuggacuuuccaacccugacagacccgcaagacaaaacaacugguucuugccagccucuagagaaaucccagaacacucagcccugacacguuaauacccugcacagaucagaggcugcuggccacacagacucaccaagccacagacuugucuuccacaagcacguucuuaccuuagccacgaagugaccaagccacacguacuaaagguugaacucaaagauauguacaggguauuaaacaaauaccaaggggaacaguuaacuucaauacaaggucaaaaucagcaacaaguucuacaauccagugcugauaucagauacaagcuucaaggacaauuucuuuucgaaggcuuauuccaguuucgugaggcuagcaugaggugugugcauuugccaggggcaaauuucuauucucaauuaacccaugcagcaaaugcuacgcaucugcugaguccguuuagaagcauuugcgguggacgauggaggggcccgacucgucguacuccugcuugcuaauccacaucugcuggaagguggacagugaggccaggauggagccaccgauccacaccgaguacuugcgcucugggggugcgaugaucugcaaagacagccaggcacggcuucagcucacagagcgccccccagucagcucucccgagccaggcagagggccaccaaccccucgacucaccuugaucuucauggugcugggcgccagggcggugaucuccuucugcauccugucggcaaugcccggguacaugguggugccgcccgacagcaccguguuggcguacaggucuuugcggauguccacgucacacuucaugauggaguugaagguggucucguggaugccgcaagauuccauaccuaggggacagagcccucccuuagugaugcugugucaccgaggauguaagaguagaaaccuuuagcucacaacaccuacccaggaaggaaggcuggaacagcgccuccggacaccggaaccgcucauugccaauggugaugaccuggccaucgggcagcucguagcucuucuccagagaagaggaggaugcggcgguggccaucuccugcucgaaguccagggcgacguagcacagcuucuccuugaugucgcgcacgauuucccgcucggccgugguggugaagcuguagccucgcucagugaggaucuucaugagguagucggucaggucccggccagccagguccagacgcaggauggcgugggggagggcguagcccucguagaugggcaccgugugggugaccccgucuccagaguccaugacaaugccaguggugcgcccagaggcguagagggacagcacggccuggauggccacguacauggccgggguguugaaggucucaaacauaaucugagaagggacaaggggcggcuuagucagggacagagacccacggccaccccaugcucacacgccacaacaugcugcaugccagugugauguguggagaaaagaaaagaacgcaggcagaaaccaaaugagaaaccuggaggcuucagggaggaaaugccgggagaggaacagagccuggaacagcgaaagaaacacuuaaaugucagaaaucaagccgggcagaaaaugacuggggaaaggacgggaggagcacgggcgucggccgagccucaccugagucaucuucucucuguuggccuugggguucaggggggccucggucagcagcacugggugcuccuccggggccacgcgcagcucguuguagaagguguggugccagaucuucuccaugucgucccaguuggugacgaugccaugcucaaugggguacuucagggucaggaugccacgcuugcucugggccucgucgcccacguaggaguccuucuggcccaugcccaccaugacgcccugcaggggacgacccgucagccucgccggcgacaccgaacccaccccgcaacgcagaacccaggagccccgcggcgccauccacucaccuggugucuggggcgcccgacgauggaaggaaacacggcucggggagcgucguccccagcaaaaccagcuuugcacaugccggagccauugucaaugaccagcgcg

SEQ ID NO: 15607 - RNA, 86867 nt, Homo sapiens
gauuuccagccgcggcucuucgcaguuuccucuccuuguuuugcuuucgaucuggacuguucucaggcaagccggggaguaacuuuuaguuuugcuccugcgauuauucaacugacgggcuuucauuuccauuucacauacccuagcaacacuuauaccuugcggaauuguauugguagcgugaaaaaagcacacugagagguaacauuuuucaaauaauaguugugacuguguguguuucucucgagggcauguuucuggggacuguggggggccguguguguaugcguguccugaugccuugacacgauguuuugcagacggaaaaugccgggguucauaaauauuaauacugauuuuuggaggaacagucggcgcaauuauggaucaucugauuuuaggggaagcagguucugcugcuguugcugcugcuacuggggcugcugaggcugcgaggaggaggaggaggaggagguagagagggaggaggaggaggagguugguggagguuuaauuucacuuuuggauuugcagaugcggagagguggcuccauggacacagaccugcugugugugcuucugcgccccagguguugugugugggggugcaggucagcuggagucgggccucauuuaaaacaaaauuguguguaugugcguguuugugugugcgcgcgugugugugugugcagccaccgccgccaccggauccgaaggaggggagcggguccuucucggugcccgcggcggcgccucuccaggcugccuccagcguaaauaagcaggcaccgcuccccggccgggaggagcgccuccagccacggccagaggaaacuugcuggggcgccccgcggcgguccaggggcucgccugccugccgggcucggggucgggucgcgggcgucgggugccagcggccggggcgggagggcgggcucggagccgggccgggcgccgggccuggccgacgcgcccugcuuccugggggcugggccgccgccgccgccgcucagaagggacgccgcguccuccuucccgccggccagcgcccggucgggcccuggggcuuugucauugcacuugucccagcgcgccaggggcucgggcggcgcgucccaggaaggcaccgugccgaggggucagccgcccgggccgcggccuagcgccgugcgcccccggguccccgcaggcgcccccggccggccucgcgcgcugggccugacccgccucggcuacggagcgggcgaggugggggcggggagccuccggggaccgagcggcgcagugggggccggcguccccucggggucccggggcgcgggccgcggcgggguggggacgcgagugcccgccccgugcccuccgacccggcuccgggcgccgggugacauucgcccgcuggccgaacaugguuggugcaaagccgcggcggccgccacuuccuuuccgccucgccgguagggcucgcccaccgagugaagccggccgcggccaaucgcggcgcccgccugcucccaguggcacggccugggggccggcguccgccggggcuggggaagccguuccaaguuccaagggucgcggguguaacucaugccccucccagcacgcgccggcgucuccccuuggcccccggucugggugcguuugccacccucuccuccuuguucccuaagaagcgggggaggggaaggaggcgggcagccugggcagggcgccagagccguggucgggcaccaggugaaacgcccgggucagucuguguaggccggacccuuggcgcucggcugcggaugugaucccggggacuggcggccgagguagcucagaagagcgagguggcuuucgcucguuucugacccgcuacugucugaaacuuggggacauauugcccgcccccucccucuucaaccuccucccuccgguugcuccuuguccuugguuauggaaggaaaaaacucaguuguucuaaaugaggaaaaguggugcuggcauucgucuucagccaccggccuccuuauggcugugacucggucugcuuuugaugaauggccaggagguauggaggauaguuagauuuccuguuguggauuuucaggcaucaccgagacugcugucaagccugcagucauuuacuaguuuucauaucgacugcagguucucuuugagcaguucaguuuuuggugcuuaagggcaggugcacaacggggucugggguuagaccaggcgguggauagucuugaugcuaggcagaugcaguuaucccuaccaggcccagagggugacucuguuuaacuucaccacgcacgcagauucaggauucucugauuuccccaacuuuccuuuauucuucuuuuagugggagaaggggcaaaaguagaaaccuaaaaaauccugggaaaaggagccuuuucugaggaaacuucagcagaugaaauauuuaagacuugaacugggaucucuagggggaacguuggaacaucuauugauugaugugucaaaguccggaauuucacuguaauuagugaacgauuauaacuuguaacuuugucuguuauguaagaaauuacauuuuggucucuuagauccaagaguucuugucuguuacgauuuguaacugcuuguuaaaauuaaacauuuacauauuucauucucagugaguugucauuuuuuuguuagagaaaguuccaguuauuucagauuuacuuaccuguaaaaaugucagcauaaucaaaaguaaggaucuguagucaaacuggaagcaaauuauggcaaacacaugcgugccaugaaguucugacagccuuaugaacaauggucccacuuuuaucccacuuucugaaacacuuuauuaggcaaauagugcaccagagcaaaagauguuuaaacuuacuggaaaaauagacacuuuggaugcuccacauuugaugugcaucaauuuucucauguuaccaacgauguuauauuuuuauucuuaacaucaucucguacaaaacuguuguuuuuagagcauuuucacauaauauccuuuugauagugaaaaaccacuguacucuaucuaaauggaguaucuggguuauaguucccuuaucugccuuauaccaaaaagggcuuaacgcagacaagagaauuuauguacacacucaauaaauauccuuagaacaucuauuauaagccagacacagugcuagccucuguauacucaacugacagcgagaaagacagcaucuuuacacuagguuguguucuggugagugagcugaccauuaacaacaaaaaauauaguuauuaccuuuugggguuagcuguaaggaggauaauaauaauuuuuaacuauaucucguaaguguugcuuucaugaacaauugagauacuguauaugaaagaacauugcauaaauuauggcagucuacaaauguguaaggcauuaacuuucaaaauuauaucagauuauucuuaguguaaaaaggccagauaaucaugacuggauuagacacuaucuuucucauagaauuuccagcaaggagggauuuuacuucugagcauauauaaauaaugauaaaagauuaaacauggaauaacuuuuauauaaaguaucaaaaaaauuucacaguggaauccgauauugucagugaauuuuuuccugucagaaggaaaguuaggugguauccauggagaccaaaugauauggaaauaacagugauuggaccaauguauuuucccucuuuaugucagauaagaaaaucuucccaagccucucugugcuuuagucugaaucuucuucacucucgugucaacuucuucauuaucugucauugcaggugugcacugggcugauuguaguauuuugcuuuuaccaccuuuuuuuucuuuucuuuuuuuuuuuuuuugaggcagagucuugcucuguugcccagacugguguacaguggcacacuuucagcucaccgcaaccucugcuuccagguucaagcaauuccugugcuucagcuucccgaguaguugggacuacaggugugcgcaggcgugcgcuaccaugccuggcuaauuuuuguauuuuuaguagagacgggguuucagcaugcuggccaggcuugucucgaacuccugaccucaggugaucugcccaccucagccuucugaaguucugggauuacaggcaugagccacugcgccggccugcuuuaccaucuuggcucaugugcauuuauugaaugcuuacugugugcccaacacuguauaugugacaacauacaugaaaguaaauauuaacugauagcauauauuuauaacauauauuacaauacguaauauaugcaaauaaacgaaacugcggugaaaugucaguuauuauuaguaaaaauuaguucuucuuuucaucuguaugagacaugauguuccuuccugcacagggguaggaggucaggaccuucggucucugccugccccgucggcccccuguguuuggccugaguguaaucaguggucggugcacgaugccagcuucaugcacagugugcugaauugaggaguggcucugguggcgggagugacugauggaaaagugggugaggaaguuccaucaaacuuuaauuuaucaacaaagaacaaagaaugaugaauaacauauaggguccagauuugaacaugaagacaguauuuuuuauagaguaccaaggaaaacacacaagcaggaaacacagcucacagguccccuuugucccugggacuccgucugaggcucguuggauucagagcaagcagcaggccugaagucuuggcauugaccuucaaagauccccuaaaaauaauuuucccccucagaagcuccaucuuaugacaaacugucucugaaacaaauuguguuuauuuaaguagacuucauguauccuuuuucuuuuauuagagucaaagucucacucuguccaccaggcuggagugcgguggcucgaucauagcucacuacaggcucaaacuccugggcacaagugauccuccugccucagucuccugaguagcugggacaacaggcaugugccaccccaaagcccgacauacauuuuuguguagagacggggucucgcuauguugcccagacuggucucaaacccuuggccucaaaugauccucccuccucagcaucccaaagugcugggauuauaggcgugagccacugcacccggcccuagugcccauuuuuauuccucagaaacacauaugacuuccagucagaacuccugauugccuugagaaaacugguaucaucaaaucucacugaacucauuauagccaaagguagagacccgugguguguuggacaggcuggccggcuccgugugagagaaacucaccaucccguuaggcuuucugaggcacugaaacuagccgggacccuccaucaauaacuuggucugcuuggggauccagggaccccaugcaauuauuuuaaaugaauaauugauuuuguuaaauguaguaacacaugcaaugguuuucuuaaaugcacacauuguguuauuauuucauuuguuuauuaaauauuucuugacagccagcuguguacaaggcucugcgguggaaggugcaugaacucagaugccuagaguggccuuuuaguucuccaaucacuuccuccuuuggaaguuuucacuguaaaauguggcuggauaauucugucauccucaggagacagaaccuguguguguugugaaaaucaccuggggaggggacuuuuagaaauuacacgggaccuuuuagauuugagacuaucuguagcccccuuucccuuccuuccccuuccugccuugauagcgagccucuuauucaccauuggaucccugcuccccagccucccucagguguguggccagaguagaaauggaaagccacugaaucgaggaucucuucccagggccaaauaguugaucuuuuccuuggcucagaugaaaccucuuuccacauuuuaaaaagcacuucggacaggggccuguggucacucuguuggcucugcccacuugcccuugcuugccauacagaaaugggacucauguuaaguuugugauacauugaauuuuccuuuuuuuuucuuuuuugagaaagagucucgaucuugucuccugggcuggagggcaguggugugaucucggcucacugcaaccuccgccuccuggguuaaagugauucuucugccucagccucccgaguagcugggauuacaggcauaugccaccacgccgggcuaauuuuuguauuuuuaguagagaugagguuucgccauguuggccggcuggucucgaacuccugaccucaggugaucugcccgccucagccucccaaaguauucggauuacaggugugagccaccgcgcccagcccaguuuuccauuuugaagaggcaagaaggacuuuauuuuauuuuauguauuugucucuuuguccaggaaggccauggagaauuaggcguuugguuuuguuuuguuucuauuuugguuuauaacuccuuuaucaguuuaguauucccuucugauaagcaagaaagagcggaguugacaaagaauggcugcagaugagaagcaggugugugagguuccuucugaugauggauucuaaguauuuuuaucccaaaggcaagacuaauuuaguucagcaaaauaccuuaauuuaggauuuugugugauaaaagccuguccuguuuucauuaaaugacgauuuuugagaauuaacuacuugcugugugauuuucauaaauaauuucauuugggcauacuuaacacuguugcuaucugcugaaggcauuugauacucgcacaccuaaugccaucaaaggagagaugaguauacacuuuaauuuguucuuauugaguguacauuuuaauuguucuuaugaaugucagauuuugggaagauccaaagaaguacucuguagacagaauacgcuguccuggcccccuaagcuuagaauccuaccaauuuucccauuucaugagauugaccuuucagaugaggagggacugcauacaaauugcuuuauuucaaguaauaucuaccauguuauuuuugaaagaauucuuuuguccuuuuuacccuagaucuauuggaaaagaugagaaaaauuacaguggugauaagagugucuuaacaccuagauaugaugggugugucgggugaaaggauagcaaugggaggcugguggaaagugagaguugggggauggggugaugagaaggaaaauaggugacuagugacuccuggauucuugaaugggagagagugaagagacaaucaggcagggagauuuucugucuuugcauaaaugucacugaaagaguuuuagagaucggaggggugaggugaaguugguuaggcaauuagugauaacucaaggaccaguugaaagacuggaggacccuccacugcugacugugggaucagauccuuuuauccuggggaugagaaaggcugaugggaaaacugcuaggcagcugcugacauuauaccaccaggaaacaugaaguugugaguaguugucacuuggacauggcugaagucaccuuaggguacagugauguugcugcaucacaacguuuaggucaucaaugggccauacacaugacuguggccccauaagaugauaauaucauacuuuuaccuuuugcuauguuuagauacacagauacuugccauugugcuacaguggccuacgguccucaguacaguaaccugcaguacauguuugcagccuggaagccauaggccauaccauaaaccuggguguguaggagguuauaccauguagguuuguguaaguacacucugugauguucacacaaugacaaaauugcuuaauggugcauuucucagaauguauaagugugcugauguugaugcauuguuuggggauggggaaacugauacucacuaugugaggccccaaacucaaucuaaaauugccuuuggaggcaaccacggaaauacgguaauagcucucuuaggccuucuccccccguacugaucuuccuugguacuguuuuauuuuauuuuuaaacucuugaaauaauacauaauagauguauguauuuucagggcacauguaauaauuuaaugcauucauauuuguaauuuguaaugauaaaucaauguaauugugcuauugagauugugggagguaaauauggaaucagggaaauagaaugggcugauaauguguuuuccuaaagaacagaugggauuggccgugcgcgguggcucacgccuguaaucccagcacuuugggaggccgaggcgggcggauuuccugaggucaggaguucaagaucagccuggccaacauggugaaaccccgucucuacuaaaaauacaaaaauuagcugggcaugguggcgggcaccuguagucccagcuacucgggaggcugaggcaggagaaucgcuugaacccaggcggcggagguugcagugagccgagaucgcaccagcuugggugacaagcgugagacuucaucucaaaaaaaaaacaaaaaacaaaaaacaaccagaugggacaaguuaaaacugaacuaugaauuccauaaguggguagugugggucacugaguggggcacugaguacuccacagugacuguagucaggauucuacauugaaauaaacuuucuggaauuuaccuuggugcuauauacuuaaagucuuaaaaauguuaagcucucuguuccagaaauucugcuucuuggaaccuacuuacgugaaguaaccagagaugggaacaaagauguauguacacggauguuuauugaauuagcuuuuguuauguaaaaacuuggaaacaagcuaaauauccaacaauagagacacauuugaacgaauuacggcacauccagacagacuauagguagcuuauaaagcucguguuuucgagcagcguuuagugaugggaaaauauuuaugaucuaugcugauuggguggggaaaaaaggauaugaaauugugcuucuaguuuuauuuuuaaaacauauguguauauugggguauuuuuaaaaaccuggaagaaaacauaucuuuuugauggugaaauuguggguguuuggcuuuuuuuuuccuucuugaaacauuuuuguauuuuccaaauuuaaaacagcaagcacaauuaccaauuacccuuuuaaccagaaaaauauucucaagagagugcuaauaugucaucucugcccucaccucugguccacguaagguuaggaaaaacacacugggugcugccgaggaggaggcugugcauggacggggccauucucgagccuuucugccuccauguguggagcaggcucuagagccagggcuuuccuggccaggcucuuggaagccuuuguccucagacagcuguggcuacuuggagacacuuagauugguggcuuuuuggugagguugggacauaauguuuugucaguaacugugaagggcuugagauaugauuucacuucacaguuaacauucuuuauacauaugaauacugcagaaacacaaaaccccuggguaggagaaaagaguuccuuguugauauuuacaacuggggcaacagccugagugacacuauugugucaggccccuaaaccuugacccuuaggugacacugaaaacuaauggaauguacaugugggcuacacuuuguugacagggacagagcagcugucccucucccgucccaaaaggagagagagagaaaaaaaaaagaagaagaaaaaggaaaaccaaacagacaaacaccuuagcuccccugacaugggaugaaaagguuccaggggucuuauccuaaccuuucagaaugugagacacuuguaaccuggggaugucuccaaggucuguuuuucaugcuuuuugaaauacacaugccuagggagauacgucuucccagcaccuugggaaccaaggugaaauuauuugguccucuugaggagauuagagguuuuauuauccuuuuggaaaagagcauuuaauguacacaaauggcuacagaucuaauucucaugguaagugaaguauaaaauguuuguaggggaagugagagugaacauucccugucuucauguccuguauagucccuaucuucauguccuguacauucccuaucuucauaugcuauacagucgcuauuuucauauccuauauggcuccuauauucauaucccauacauucccuauccuauacauucccuaccuucaugucauauaugguccuaucuucagaccuuuuaugguccccaucuucauacccuauacauuccuuaucuucauguccugaacagucuccaucuucauauccuauacauucccuaucuucauuucuuaacaguccccaucuucauauccuauauaguccccaucuucauguccuguacauucccuaucuucauaucuuccuauccuauacauucccuaucaucauguccuaaauggucgcugucuucauaugcuguacauugucuaucuucauguccaauacauucccuaucuucauguccuauacggucccuaucuucaugucauaaacggucccuaucuucgcaucauaugcauucccuaucuucguguccuauacauuuuuucccuuuauauucuauucauuucuguguguuaggaggugaaggcauuuuauaggagucuggaaagaagccugagaaguuguauuuuccccucacaccugccuuuaccagaccccuguuggagaaugacaguagagcuuaaucagagugugaccucugacuuuucaaacugaagaccucaaaucuccaauuuuuaucugaaaaaauauuagaauaguuucacucucuuuaugaacauggagacguuuuuggauugcuacggaaguaggauugggcaugaccauuaugaguucagaggcugaaugccguaccacagcccaucaaaaaaaaaauauauauauaugcacgauauuguccaauacaaauauaaugugagccacauguauaguuuuaauuuucuaguagccacuuagaaaaguaaaaagaaguagguaaaauuaauuguaauaauauaucucauuuaacuaauuuuaucuaaaauauuucaguaugucguuaauguaaaaauacuaaugagauauuuuguauccauuuuucauacugaguauuuaaaauccaauguguccuuugcaccuauagcacgucuuaauucagcccagccacauuccaagggcaugguagacccauguggcugguggcuaccaucuugguuggugcagcauaaggaaaucaaucaaggugugaagacaauacaggggaaaguuguaguacaguccugaaaggacugaaggaaaguagaguuggagugguuauuuuggucauaacuguaugaaucucccuguggcucuccccacaaaccauaccugaucucuucagccuaaaacaaugaaaugcucugaauuucuauagaagcagcauacucuacaucccauuccuaggguaguuagcuaucugcaucuugaugagaugaauguuucauucuagacucuugaacuguuaugaaaaucuuagauuauuugaauuuuuccauuuguaucaccuaugugguaaguuauuugagagccaggauccaguccgauuuauuugcauuccucaccgguguuugacaccuuuaagaccuagauaaauauuaguuuauuugauuuucagcuguaaagcaaagguuagcuugaaaggcugaauuccagcucaggaaggguggcacagaucuaguuuguacuagaaaccuaaugguauaugaauugaacacauaaacauuaggauuugucacuuugcauuaggauuuguuacuuuguauuagggguuccacacccagaaggugaaaaauuguucgguuuuucuccuuuguauccagaccuuuaaaaaauauuaucaguuucuucuuuugauguuuaaguuccaaugaugauccuaauacuuucuuguagggauaaauaagcuauauuuggugaugaccugaagauaaacauuuggaagcugcuacuuuuuccauggguucuuuguuaacaauaacuuuguuauuaacaaacacagcccacaacaucuaggcgaugaaauucuuuugaaaucaaguauaguauuuuacaguugccuucauuuguucucuuugacuguaauuguuggguugaagcaacagacuuauccagagagccaaggcaauuuauuuuuacugaagacuaccuaagaacugcuuagguagcuuuucucugcaagauuaaaugcgaccuucauggaaucauguuagcagggccagcagcuagaaaaauaaagacuaaaccaaaccuucagcagcgaaauucccagcugcucaguggcucagagcuuuccugauugcuuucuuccaaugaaaacacuguagauuaguuuuaagugaauucuaguagguuuggggauuugcaacugacagaagaacagcaaaguguaaucucacuuuaaaauaauaguccugaagguaaaucucuauuggcucuuucuuaggaugcugggauuuuuguucauaugggaaaacuuaacucauacacacuguuuagcugaccuuugaagguaaggcccuagaaggcagacggaggcuggacaccuggggauguggggcaggacugcugcuccucuuucuucucuccauuguaggcggguggaaacuugggaagccugcgaggaaggucccuguagggaauguagcugacccauuuuuuccacuuuuggguguggucauccugacuauuggugaagucagggugaauugaaaauguuacaggagaggauuuacuuaacuuacaggugcuuuuaaugcauugcgauuuuuguuuuucuugaaaguccucgcaguuugggagauggggguuggggguuggggggcggugggggggcggguagaggagagugcucagcugaaaccguugacuauuuugaucauucauccauucagucauuuauuuagcagguguuuauucagugcuaacgauauguagagggagguauaaaacgaaagaaaauuaucuucgauuugagguagccagguagguagauggucugcauuccuuacaguuaggagccuaauucuuccagauagagaaaacacaauuaggcaaguaagaugacaguuccagaaacgauuuuacuuaucugugaaucccuuuuauaguucuuccaugggcccugugggguuguuucagauuguaggggaagccgcagugcuaaugugacagauuuuuuugccaaguguauacauuuuauuuuuuuuaaaacagacucuuaauagauuguaaaauaggcauagaacaacauauuguuuuguuguucuuucuguuuuuccacaauucucccacauuuaguuuggaacauggaacuauggucuggugucauuaaggaaaacugaugggguuaaauccugauaauuaucuccccucucuacuuacccuucccuuguggggagacacuguaaccagcagagcugcagaaucaguacuccugccccccgcgguaaagugaaggaagcugaugaaagauauccaggaacucuuggcacuauuuuugaaauuuuuauguggauuggaaauaauuucaaaauaaaaagguuuuuuuaaggcuucccauuagugcucuagaguuacuguugcuuauuuaaaauaacagccuaauagaguguauuuguaaguuccuuuguuugcuuccccacgucgaucuaaaagggauuuuauguagcucuuuuucuacguagguccuacuuuagauaucauuuaguacccucuccucacagggcuugagaagacauugccuugaaggggaaacugguccuuacuucauuuugaaaaugcuuccuuuucucucuucgcgugugugugugugcgugugcaugugugugugugcgugcaugugugugugugugcgcgugcaugugugugugugugugcgugcaugcguguguguguguuuggcuauagugaauacuuuaaguugccugaaauuaaggaauaauuaucauccauaaaagcacugaaggaaacaguggcagcaaguagggaauucauaaaugcauguugaagcauucuuuuuaaaacugugguaaaauuuacaaaacaaaauuuaccauuacaaucaucuuaaaguguauaauuuggugacguuaauuacauucacaagguugccuaagcaucaccaccauccaucuccagaacuuuuucaguaucuggaucagaaucucuauacccauuaaacaauaacugcuucccgcagccccuggcagccagcauucuacuuucugucugugaaucugaccacucgagaugucucauguaaguggaaucauacagucuuugucuuuuugugucuggcuuauuuugcuuagcagaauguuuuccagguccacccauguuguagcaugcaucagagcuucauuccucuguaagacugaguaauauuccuagauuguguucguccauucaucuguugguagauacugggauucuuauuaauuuggcuauugugaauaaggcugcugugaucauugguauaaaaguaucuguuugagucccugcuuucaguuauuucaauucuguagaauggcugggucauacgguaauccuauguuuaacauuugaagaaccaccaaauuguuuuccauagcuguaccauuuugcauccccaucagcaaugcacaccgguuccagcuucuccacaccuuuuaccaacauuuguuauuauuaucuuuuuguuuugauagggccacccuaauagguaugaagugguagcucacgaugguuuugauuugcauuucccugguaauuaaugaugcugagcaucacuucaugugcuccuagccauuuguauaucuucuuaggaggaaugucuauucaagggcuuucuucauuuuugauuuuguuguuguugagcuguagguuugagucauucauuuugugguuuugaaaaugacacacuaguaagucugaaaaacuaagcuucuccccauuacaguauauguagcauguggcaaaaaguucuguuuuagaauuuugagaugcugugaagcugaugaagcacacuuugaggaauuaacuuaggcuggagugaaguaaaucagagcgcauggguaagugagaaucagauagaaucucgcaccaugcuggaauugggaguuucuguagcaacgauugccugccccuucccuucauuuuuucagcuggagaaaucaaguaaccugcucaguguauuguagccagguuaaguacuuaguauguuuuguugaacugugcaguaaauaauuauuuuuuuucuguuguauuuugaauccagaaaugucuugugagaggagaaauagcagugcuugaauaugguaguggauuuauccucgcggcugcccuugugguagccucucugcuugggacucggauaugguagugaauuuaucauugcggcugcucugucugcuugggacucaugaaaaaagccuuagaguucuucacuucugugguauuucaggauaaagauuaguaaaaacagccucagaguaacauuuggggacuuaagaauuuaaauauaauccauucaaucaugguucaauaguauuacugaguggaugaaaaaaaaauauugccguaauaacagaucuguuaaguaaaauggauaaaagcauuuguguauuuauugugaauuguugacagcaggagaagccauucauuuguucuuacaagagccauaguagauaaagaaauucagugaaauaucacaacuguauggaagcaaauucauuguugguuuaguuuuauguccugcggaaauuuuucguuuugcugaauccuuuugaagaguugaacuuuauugaaaacuauagccuggcaaggucauguguggauuauaacugaguuguaaauaauuggaagaagaugcauaauauaugugagaaacagagaaauaauauauguguugugaagcagagugguaagaggaguugcaaaaauuuuuauucucuucaggcuuggggcaacgauuuuaaaaauccuuaaaauuaguuuuaaguacugugaaaacaaacaugauaaugaugaaauuaaauugaagacucucuucuacaaacaaauaucuuaaauaaaacccucagaggaagucauuccuucagcagacaauuuugaacagcugugugugaagcccuaugcugcgaagauguaagguugaaaauuucagauccaugcucucaaagagcuuaucauuugguuagagagacaagcagguaaauaaccauuccuggucaugaaaagaacgaaagaugggcuucauggaagcacagcaagccaaaggcuaagggagagaagaggaagaagcaguaucuucuuuuuauucuuuuuaauuuacuggagcuacccaucaugaacuaagaauuacgucuuugaccagagaaacuggggcgugccucaccacugacuucugacuggccggaaggagggaggcaaugucaucugguggccagugggugagcagggcauuuuugguugaaagaacagcaagagcaaagacaugaaggguugacaguuucuuccguuccuggugcauggaccacucuccaggguggcuggaacaaacagaugaaggagggagugucagagccaguuccugguggccacaaauaucucacucagugcauguguuccuguuucccaguaaggaaggguuuuguuccgaggauacagccagcuuuuuucuuuuuuuuuuggaagguuuuugaggauuuggaacauuuuccccugugcauuucagaaaaugauagcuaaugacuguuagcagcagggcgugucgcagcugugcaccugcagcguuggagaggagcucugaggcgugugcauuuguagucugcgguccauugcgggaaggacuggguugugccuuugauaauagccaggccugucuuugaggugcuuuuauauaaguuucuaagaggaaaugaugaauagguacaaaaauauuuuuuguacucucuuuuguuuguuuugaauugguuuguaaagagagugauuauaguaaguuuauaauccucaagugaggaggaauuaaagacaguuggcucaaauucagguaagaaacccaaguuagagaaucaaggauaauggcaagacccccagaaacaaugccuucauagggcagaaguuaggacagggcuuccuauccgcccagaguguccccaggucuuccgagugacgucacgccgggccacagaagggcugggcgaacaccucaggugcaaaccuuagccagugggacucaggaacuggagggagccccagagcugcccgugccauauugaggcuucuucccugcauugggaccacauggaugauccaggaaaauuccccucugucaaggucaacagacaaccuuuaaaucaccugccuccuuaauucccauuugucacauaacacagucuauucacaggucgcagaggcuagcgugugggauacuugggaggcauuauuccaccuguaucauguguuaaccaaaccaccucacacucuucauccgacgcagcuacagaguguuuggggagauguggccaucaggugccgaggcccucacagcuggggugaccggcugccuugauggcauugacuggauguuugccggacucuucacuucccuggggcgauaaauuggaagauguuauucaaaggccuagauauuccugugguuuauuucaguauuucaccgucuccacuguauuaucacuaacugccguguuugaaccgguuguauguuguggagggccgagccacaggacucgcguagacucgguacccucaguacguguuggcugaauucaguugcagugacugacuugguccuccaauuguuauuugcuguccagacacagaggcgccugcaggacauuggugccccugggcucaggcacccgguuucccgguagggagggcggaccgggccgcaggaaagcgcgucagccgggugugugcccuggcuggaccgagggguuuccuccgcucagucggcagggacccucgcugaggugcgaggacacauggcugacucugaacucgcagcuucagggaaaccuuccagcaguuucuccaccgcggcucucacguuccccguggcgcagcuucuucguaucaccaauggcucggacacgcgggcgccaccccucucuugcccuugucguuguucuuccuuuuguugggaauguucuuucuucccuuccaccugaggaucccuuggcuuccaggcccaguucagaugcccccucuucuaggaagccuuccagaguccucucuucuggguuuuuacauaaaauauuaaaacuuccccauaggccuuugaaaaaaauucaucuauuugaagugcagagucacauuuuugugaggcgaaugaacuaaugggggugagucugaugcagagagggaacucgaacccagugugucagacgcccgugaucagugugaucagugauggugggugugcggccgcagggcaggcacccacuccggugugcucuuccuggcaggcuucgagucucaccuccgggacaccacgucuugcuugaaagcuugcuuuaacacugacgugcccaccuucgucuuugcaggguaaguccuuugaggccagagaucaugucuucaucaucuuuguauacuccacagagcuuuagauaaugcuuggcacacagcgauuuucaugcgguuggcucgggguaagguuuuuggaaugaaaaguugaaccaacguaauucaaaaguguauuaacauccuuagccggauucacccggaaaauggcauguaaauaguaaaauuuuuuuuuagguugcaugcuuuuuguagucauuuuauuuccuuugcuuaucauuuguucauaaguuuauccaucacaacguauaguuaauaucauccgccuuauccuccucagcccuugcccucagugaguuuuccaggagggauucauccacuuucuuaucaaugagugauuacuacaugucauuaugugcaagcuacugugcucgguauuuugggaugagugagaugggacuccuccucacaggacuuuauacagagauaagcccguugccaaguaccugaagcuguaagcuuugguugcaucagaagguggaaggaggcugagugcgguggcucaugccuguaaucccagcgcuuugggaggcugagaugggaggaucacuugaggccaggagguugagaccagccugggcaacauggggagacgccuuucucuacaaaaaaaaaaaaaaaaaaaaaaagaagaagaaggaagggagggggaggggagggagagggagggaagggggaggggaggggaggaagaagaaaggaaucagugggauaagagguuagaagaagaagguggagggaaucagugggaacaagagguuagaaaggugggauggggaugaauuaugguggccaggaguccagauuuuauucaaugggcguuguggaaccauggaaggauuuucugcaaggucaggagccauuuggggagauuaaucuggccaagaaugugcaggguggagaauaugcuucuauuacagaagguggacccuggacaucgucuugcuccuuguggaacacugacuuagucacugcaguuagguggagcacgggcccuacuguuuggaauuucuuuggggaagucuuaggggagaccaaggaaaucucaccucauacuuuuccuccuaacauaaacuagccuuuaucuguuucuucucacgguagcucugcuaaguugcuauuaagaucucuguuuagugaugaggaaacuauggcuuggcgaaguugaagguugugaguggugagguuccaguucaggugugcuugacgccaaaucugagcucccacuaccauauuaugcuuuaacaaggagagggaaagaaaagaaaucauugugguccugggagggguuggcagagaggggaaauagugaccauccaauggaugccagauccgacccucccaccucuggcuaccauucggaaacuggugagaggcaguagguaucuuccaaaaauauuugaagacaguucugcagcuugcagaggagacauggauucuugcuucggagguauuccuguacuuagagugguagcaauuuuggcucuuuuuccaguuggaauucauugguaauugggaugguuuaucccaggaauagaaucaaacuagcggaaacuguagugcguaaguuuauaguuugugugcuggagcuugaccagauuugaacauaaagaguuaaauuggaugucuccauaauaauuaauaauaauaacaccaagaauagcugguaaccuuuauggagagcucccuggcagaggggacagcuuaaaggaaauccucaaaggaaaaguggcagcaagaagcagauccugagggccagccuguggauguggagugugggaggaaaucauuuacucucauccaggggaaaagauagugcccuucaaaucaaccuuucagaacagguuauuuucaggcaacugguuuuugggaaggcguugguuuucaagguagucugcuagugaugugauugaagucagaaagcagcaauuuuguugcucuaugcaaauagguuuucuuagguuccaguuccaguaugcuggcucuuugaguuucuguuauuugacuuuucacaaauacugaccacauugacaucuccucucucuuguccccuugucuuuucuguguuccugaaggggcaaaacacaccuuuugaggucuguggagcucaaaaaugaagucaaaggugacugggugacacaaacagcucagguaauucagguccugccguuucugccacgcuccuccuccucaagccagcauggcucaguuauccacucugaugucuacccuuuucccacgugccuccucuuauugaacuuguucucuauacuguuacgucuccagugucugcaucagaggacugagaggucuuuuccggcuugcauacugcaggcugacacagucuuaaaggaacuuccuacugcacucugaggaggaggagcugugccuucucgaggucauguuacuucuccuguacugcaaaggcagugcucagaggacgugcugauuaagggaaauauaggaucacuucuuuucccguuuuccauauggaaagaagcuuugaaaaugcaguaugugcucgaguccauaugcuuugaaaucugugcaugauucuugcuuugcugaauugcagaggcugaugccaucuagaugcugcgacccagggccaaacacaccuaagggucccagcaugaguuucaauuuauaaaauacuuuuaaaagucagucuacccuuuuaggucuuaauggccuugcauaaauuuuucuagaaaaugcucuuuaaaaaaaugauggaguaaaaaauacucuuagauuuucauaauuuaaauguaucuggaagguaauuuaucugcaauucacaguuuucucauguugucuguuuuuuacagaaaagaauauuacauguguaucugcaucagauuucaagaucauuguaguuuuuucuuuuuuuaauuuuaagacagcauguuucacacaugauuagauuacuugggaagcauuccuagaagugacauggcuggguccaaggguguaguuuuaaaauuuuuaauaccuuggccaagcugcuguuuggaaauuuuguaccuauuuuauacucccauagugcauguaagaugcaaaacacuauucuagauauuuuacauguuuauuugcuuuuuucuucucucucuauuucuucuuucuuucuuucccuuuuuuuuuuuuuuuuuuuuuuuuugagacaggguccugcucuguugcucaugcugggguguaguggcaugaucauagcucacugcagccucuaccuccugggcucaaaugaaccuccugcuucggccucccaaagugcugggauuacaggugugagccaccgcauugccuuauuuuacaugcuucuucauuuaauccucacaaagccugaugagaacagagaaggucaguaaccugcccaaagucacagcuaaaugauagagcugggggcgaaagcaggcagugccgcagagcuccacgguccauguuguugcugcgcccggucugcacuuccauggcagccggcaugagaacaugagcaaagagaggcugugaugagacuccuuccuucugggagccucuggauauggcuauggccucgucuuucacucugcuucuugauucaucagguaggacaggugcagaaugcuuuuccugggccgaagccuauggucuucgcauucuuugugcagcgguauaauuuggaaagaagcaauggucacuuuggagagccagccccuuugcucagcucuccugugccccugugcugcugucguugccccugucaccucugccagcaucauuucccaugacugcagugcuggggggacuugggccuggccugggucccuacaucaccugaggagggucuccaaauagaggugugaagguuuuacagagauuguguagggauuucaggcuuuaaacccuugcuugucuuugcugcugcauuuggugugagagauugcaaaaaauguguauguuuuuauuggugcaacccuagggucauacagggucaaaaggcuuccucuuuuaggaagagucccagacagcugcuaacuuaucuucuuguuccaucccuguuuaugggggauuuguauuuuuaauugccuuucacucugaacaaagacugagcaagcagaaaguguugggaagggccccagggaacauucuggcuuguguuuucuuucugaucugugggccugggggacuucaauguucacuuuccugacaggaggagacaaccauaggaacuagugugguguccagugccagcuggggaaggaaaccaguuuccuagcauuuauguuucaggaucaauggcacauguagaaaaauacuauaucccagggguucuauauuaccaagaauaccccugaagaugaagcccauuuuuggauccucaguucucaugauaauggaguuugaugaccuagagucagcuuuggcaugggcuaagccagagcacccuuuuaaaaugaggauaguaaugagaacgaccccaugggguuacugugaggguuaaaugagauaauguauagaguuuaaugcugagugcaucaugggugcccagugaauagucauugcucucacaauccccaccaccacuauuaucucccuagacaucaggagaacaauuuugugaagcaacuuuggacuuuugcauguauauauuuauaaacaauucagugccugcaaauguagaagcugauuuaaguaccuuggcccuuaugguaggaaggucucuggggccccuucaccuugacccucuuuaccuuuagaguuucuucuuucuucacacuuucaugaggaaguaugugccucuuugaacugaauuucuacccaaguaccauggaaucuaaacaguucagugcuuuucaacuucucacguugcauaauauuugccauuugauucaaaauuacgugauaaaagaaauggaggagguaaacuugccagacaauuccugugucuguuuuugcauuugugcuucuggguauuuagucuuuucgguuugcaccagggcuuccguggaggaggagggcaugugaaauggagcaguugcuuacguacuggucucaguggacgguguggaugucauucauagggcaugcacagcaacaaacaaacaaacaaacaaaugccauuuaacgugauccuuggaaagguauuuuuauaauaacuuuaguuuuuaaaucaaauauuuagaaugucauggagaaagaacaaugauauuacaaaugccaucauaaaggaaccuuagggagacuauuuuaaagaaauuuugaaucuaaauauuuaaagcuuuucuuauuuuauaaguauuuuauguauuugauugguaagguaaagcacauacguauuguuagguaaacucgacuuaaaggaaauaauacuuuuaaauggcuacuuaagauuucaaauuuuauaaaaauauuuaggaaaaguauuuuuccacuuucuaauaagcagaaauaguuugcauuacauuuuuucauuucagaacuaaacagugcuauuauucacuacauuaagccuagugugugccagauuaauguguaauauaaauacaguuuaaggaaaaugaugcugauuuuucguguagcgugauaacaauaauauauuccaaagauugaaauaacuugaaaucuacugcaagccccaaaucccuuauuugcaauccaaaaugcucugaaacugaaaguuauuaucaugacucauuuggcaggauagucugcccugaauugacaugaagcuauucauagcuuuuauuuaucccaaucagugugaauguucguguuucacugcagaaauauuaacuguguuggauuaagggguucugcccuaauuacuuuccgggguguuuuguuccuugugguauaugguauguguaccgcauuaucuugcuaacauccacacacuuuugaauucugaagacuuuaucuggccccaagauuuugaauagaagacggugagccugcgucaguauaccuagccccuacaaccagaggcuucucacauccugguguuuccaggaacagucgcucuuuauaucuguuucaggugucaguauuaaugagaccccauucacauucagaagugcuccauuuuggcuuggucaccauacuaaccacauaccauaguucuugguaacggccagcgcaguguuggugaacaucaguacauuucuagugaauucccauguauaaaauaaacaagaucuacauaaacaacauuccagauuguaucuugaaaaccuaaagucauuuaaagcauuauugguaagguauccccgacugccugucuagauggcauuucccacgcauuggugcacgcuucuuuugauggcaguucauccuucuccucacugugauugccugugucccugucuucucuuucuaggcugcaagcuccuuccgucauugcguaucacugugcugggcguauauagcaaguucauuauuuagucaacuaauauuuauugagcguuggccucugccguacucugggcccugggaauagcauggugaacaaaacagaauugacuuugguccucauggagauucuugucuacagauuugggggccuggccuggugaaauggagaagguuugcugucaagugacuuugaagccaaaucugaaaaaugaguaagaguuagcuugggagaggggaugcucuugaggcugaggggugacagacgcagagacuugggacggaccccucgcuggaggcuugugggguaaggacaggcuuuaggcaguggaaugaugagagucuguuugugcuuuuggaaggguguucuggcuguagggcagagcuggguugggguugggggccgaggagagcagucugaauggcugccugguccaggcuuuguggaaggaaggaucgguucuucaccccugguuucgguuucuguucucagugugggagcuguucuuggacagugcugugugcucuucuccggaguccgaggccaggggaguaacugcaguguucagccaaguacgagcaaguggaacugacaguuguucaggcuuccgucuugcacacgucgaggaaacguuguaaacaagaaacaaaaagcaaagcccuuacuccuagugggucuucccugagccaagugcuugaaaagcugugggagugggaacuguugucaugaucgaaaaugaaacuauucugggaaugccagauuuggggcgcugggaacccugaaguguccugcagagaacuggugguggaggggccucuggaggacaaacaucuacaauuugcaaaucuaucagugacccagcgauggcacuucuggcgguuuuucuuccaccuuaacuuugaggugaggcagagugacuuggaaaccaauucugugcuuuaaaauauaaaacauaaauaacuucuauugaauuagcacagaaguuuggcuggagguaaaucuuuggcgccuaaaucugagcgcuuuucucucaaauacgcacgagagcucuuuggccgucuuauuucuccucuucuacacaacugaacaauuuaaaugaauuauggaccaucacuccucaucucccccaggaaaugaagcuuagagccuccuuguucagcuaauuguugcuugauuaagcugccccuuauggauggauagauaaagugauugaugcaugugcuuauuaauaccauccuggugcacggaggacgaauaaaccgccagcagcuucauuuaagcaccacaaaggggguuuccuagaguuuguuguauuugcagaaaggcugucgucgucuuucccucuguacuggaaauuacuuaccuacuugguauugucuuucuggccaagucguuuucuuuugagcuaauuucagacuuccaccacaguuuaacaauaguacaaagaauuauuuuucuacaucuuuggagaguaacuugccaauacugauaucccaucacuccugaguacuugaaugugucuuugcuguaacgaagauagucuccauugagacccuggcacggccaucagaaucaggaaacuagcaccgcugugugagucgccucccacccgcagacccuguuccuguuggaaugucucagucaugucccuugcagcaggagaaucugaugcagggcuagguguugaauuucggugcccugccuccuucauuauuccuugacuuccaugaacuugacacuuuugacaaugacaaggcaauuuucuuagagaauguguauccguuugggcuuguugacguuucugguuaugcauuucuuacaagaauaucacggcggugagacuuucuucuucuugcauccuuacaggugauacaugcuuuugauuugccccuuaauucguaacguucauuugaucuuuuaauuaaggagccaucagucagccuucuccaugauaaaguuagucuuuuucccuuugucauaaaaaauauuuugugggagguauuuuugaggcuauguaaguaucccauuuuucaccagccuuuuacucacugguuagcauccauugguauuucuuggcugaguacuacuuugauagcuaccaaauguugaucuucuaaguccaucauucuuccuacauuuauuuguuugcauucuacauuaugggaaagcuuuuucauuccccuauuuauuuauucguagauuccaauuuuguucaaugacagaaauacauuucagucauguauuugggugcucagauugucuuagauguggccagugggagcuccaucagguuggguucugugacuuuuuuuugacauguugcuauuaucuuuugagcccuuccuuauuuccuuucccaggcuuaucuuuugcuuucccugccccagcucuggagucagccauuucuccaaggagcccugauuccuuuugguggaggaugguguuuggaaaccaagauuugugcacugccugugcucauugcuguuggggucuugcuguucccaggcccuuuuagugucaagguuagagaauauguguauuaguugcauauauacuuacacauaugcaugcuuuuuuuguuuuuuuugagacggagucuugcucugucgcccaggcuggagugcaauggcgcgaucuuggcucacugcaagcuccacuuccuggguucaagcaauucucccugccucagccucccgaguagcugggacuacaggugcccgucaccacgccuggcuaauuuuuuuuuuauuuuuaguagagacgggguuucaccguguuagccgggguggucucgaucuccugaccucgugauccguccgccuccuaugcaugcuuuuuuaccucuguauuuauuucuguguuuauugagauauaugaaaaagcacaaauucaaaucaaguccuccuauucuagugccacagccuggguuauuguaguuuucuuucuuucuguaucuguaacuuccuucuccaguagucaaaagccucacuuccauuacccugguauauaauauaauuuacucaguugccuguguguauguggucuuauguccccacgguugccccaccacaaugacgaugcccuccucaccucccuguucuggcucccagccccugcacagggcuguggucucccuccugugucuauccucacugcccacaugggcuuuuguauucugugugccagguggcugcugccccagccacccuaacaggugcucucuuucugccaauaccuacccuggcugcaccugccccucuaccccuagugucuacucuauuaguuuccuguggcugccauaacaaauuaccgcaaacugggaagcaugaaacaacagaaauuuauucccucacaguuuugaaggccaaaaguuggcaauuaagguaugggcaggguugguuccuauuggggacccugagcgggaaucugcaccaugccucucuccuaccuucugguggcugcuagcaauccuuggcuuucuuuggcuuauggaggagucacucuaaugccugccucugucuucauacaacauucuccuuucuucuaugugugucuguguccaaguuucccucuucuuaaaaggacaccagucauauuggauuuagggcccauucuaaucugguaugaccucguuuaacuugauuauaucugcacagacuccauaugcagaaaaggucacauucacaggcuccagguggacacgaauguuggggggccacuguucaacccaguacaucuucuuugcugcguugcaucaaaugggcuuuuggaguaaaucauucauaaaggaaggguggaggaaggaagggaagaaggaaacucaguuguuuugagaagaauguucucuauuacuguauuguucuucuucuucuucuuuuuuuuuuuuuugugauggagucucacucugucgcccagguuggagugcaguggcaugaucucaauucacuguaaccucugccuccaggguucaagcgauucuccugacucagccucuugaguagcugagauuacaggcacacaccaccaugcccagcuaauuuauauaaauuuuaguagagaugggcuuucaccauguugaccaggcugguguugaucucuugagcucacguaauccgccugccuuggccucccaaagugcugggauuacaggugugagccacugugccuggccuauuguucuuauuuucucaucuaaaauuagggcacccugcugacaucaggacagucuuggaaaacucaggacuuaagagugagcacaggauggcacuuagugugaugacacugggcuguucaggaaacacguucaccuucuguucugugccaacccgggguuggggcacacccccgccccccagaggcccaguuccaggucaaacaacugucucuuggugcauguugucagcccggcgcaugcucugaguucuguaagggugagugaacggggaacucugacugucauuggugcugugggggaagagagcagcgugucagcacguggacucagcuggggacucauggggaagccaccaugguacggcagggccuggaaguuugcgcgugguccuugauugcccugaugguuaaaaccaccugcuccccgacuuuuuucacauuaugcucugugcauuccugcacaaauuaaauauucuagacaguaguucucccuuaucugugguuuugcuuuuagugguuacaguuacccauggucaacugaggucugaaaauauuaaaugggaaauuccagaaauaaacaauucauaaguuuuaaauugugcacuguugcaaguagcaugauggaauguaacaucccaccucuuccugcccaggacauaaaucaucccuuuguugagaugagggaaucugcuguagucccaauacucuauuauuugacucuauuacauuuucuuuaaacaucuucccacugucugguauuuggguuaguuuugcuauauaaauaaugcucuuugaacaauguugaccauaaauuugugucugcagaaacuauuauuuguuaaauaucaacuauugauggaucagguacuaggcuaggcauguuacacaucuuauuuaauccuuaccgcaaaccaugcggaaguuaucccauuuuacagaggagaaaacugaggcauagggucuuggguucuguuaccuucugcguuugguuccugaagcagugcccugggaaguggcuauaguugccggauggagaccugaauggcuucuacaguuguggagauggugaccagcaccaggggauuucugaauuuuuggggcaauggcuuguugauuucucauuuaaggucucauuuuuaucacuauacuguauaugagauaagguuccucuccucaucucauauacaguauagugauaaaaaagcgucacuagccaaggcuggcuccugcccacuugucauggauaugggagccgccgaggucuucccuggucucugcccugcccuuagggggcugugcuguccuggagucauguggcugucagaccucgggugucauccugaguccugcauugcagcugccauccuacuccaugaugaauaaggguaggccuaugaagggccuaaucacuuauuaggaauuugcauguugccaaauuaauaagcuaagggucagacaugauugaucaccauuaauacccaaaccauuuccuagggcugucaucucagcaggaguuguggucauagaugagcuuacacuggcuagggaaagcuuucugggauggguggauuuaaaacugucuccuggauuucucaaagaacuaaaaauagaacugccauucaacccagcaauuccauuacuggguauauacugaaaggaaaagaaaucauucuagcaaaagauaccuguacuuuuauguuuauugcaacacuauucacaauagcaaagauauggacuuaaccuagguccucaucagcaguggaccggauaaagaaaauaugguauauauacacuauggaauacuaugcagccauaaaaacaaugaaaucauucacaauaagaagcauggagcuggaggucauuaucuuaaaugaauuaacacagaaucagaaaaccaaauacuaccacauguucucacuuauaagacggagcuaaacacugaguacacauggacaugaggaugggaacaagaaacagugaggauuccagaaggggagagagaggaaguagggcaaggguugaaaaacuaccuauuggguacuauguucacuacuuggacagcaggaucauuaggagcccaaaccccaguaucauugcaauauacccauguaacaaaccugcacagguaccccugaauuuaaaacugaaagcaaaaacaaaaacaaccuguaaucccagcacuuugagaagcugagguggguggaucagcugaggucaggaguuugagaccagccuggccaacauggugaaaccccaucucuacuaaaaaugcaaaaauucaccgggcaagguggcacgugccuguaaucccagcuacacaggaggcugaggcaggagaaucgcuugaaccugggaggcggagggugcagugagcagagaucgugccauugcacuccagccugggugacaagagugagacucugucucaaacaaaacaaaacaaccccucccaccccgcugcccccaccacccccacccccacccccacaaaguuaucuucugaagaccaagagagaaguacuugguaucaagugguaaaaaacaaacagggcugagagauuuaaguagguuggagaaaggaguuuuggggcacaggguuuuuguacuucuuggagguccugauacuaaaaaugaggucauuuuuagagugggaagcaaaacggccccauaacgaaguguuugcucuucauaugcacugaaacggcaggagguggaaauugacaaauauugaggaugcuuacuaguucacugguuuucagcaccuuaaauaaauguuaaugugaaauuaacauuaagauaguggcgcguuugucuucuaugggacuuacuugugcuucugaaauaguucuucagguuaaucgguuaugggcugggcagggcacacuuuccuccccuucugccuucaaaagacccuggaagcacccagguggcccugcuuuauggcagaagcagcaacuaaaaugaaacaacugauucaucugcauccaggugaugcaaagccaggaaaaagccccucugguucucucuuguuuccuuaaagagagcauggaggugaagggguggagagagggcgaguaucuuuauuuuggaguaugggaguguuuuccuaguccggacuacaaaaggaaagcucggguuggccaggaaacgcagcauguuuuguugaugcccacucgcugggaaaguauuaaauggggcaggaagugugacuuuggaaggggcugcauaaaggaggcugggaaacugcuuccugugcacccgggccagcucaggagcuggaacgauguuuggcaggcuguggggaucuugcugcccuggcuguguccccuuccacacaggcucccagugcagaugccaggucagacggagguguggggcccucucuaccucuugaugugaaccccaguuuggccugccugugcgagccucauauccaaaugcuaagucagggccuaagacuccaguucaaauaugaguucuaccacucaguagcucugugaccuugggaaguuacuuaaccuuacgugccucaguuucuucaucuauaaaauggggaccacaguaguacccacguucuugggaugcugugaaucaggugagcuuauccucuuaacgugcuuagaacuugccuaacacugcuaagcgcuuaauacuccuuagcuauuguuaauacccucaugguggaggauauugacaacauccugguaagugggacacucccugcuggccagcugguaucauuuucaaggguuugcaggucuagaucuggaugaggcaguuacucacagaaaagcucccuugcuuaccaacagguuguguuccaaaggugauuaaguuugcagagugugcaucaggcuuuuuaaaacuaagcuuuucccaaaacaaagcuguuucaguagcaggaacauuacaggggugucacgagcagguauuuucuuuccaccagacaccugaccacucacugugauuuggaaagauuagaaccggccgggaaacgauguuuccaucuuugaugacaaagcuuuccucauucaugguagccacauuucagguauucaggagccaccuuguugacugcccugauaaauaacaaguuaauaguugcaaaaugucuacuggauagugcuggucuacauucauuggguguuugcugggugcagaguacaaggccuauuuaggccuaaggagcguuggucucaguggauuaaagcacaucacaaugaaccagugacuuuaggacaguguaagaugcgugcuaacucacuguuagaggcagugaguuuuaugacuucaagggaagggggcauguaugugucuuguguuggccaggccaaguauuguggaaaagagacauuugaacaaucuuucaagguauggcgagacguuuccaggcuaggccuuucuccugagcuccagccucgcacagcuaguagcccagccaucaccucuuuuuggguaucccagagaucuccaacccuguaggccccaaaccacucucaguaucucuccucaaacaucccacaucuucuguugcagaguggcacucccacccaucuagucuaagaaagggaaaaaggucacacccaagugaguaugaagagggaggcgagguagacauucagaaagaagagccucgcagaucucuuuucucugugaagcuggaggcagggagggaucugaaauugcaccuguggaaaaugggaacaggaccuggggagaagaaagcaaaaaagaucugcagaggcagagacucugagagcucagaugaggcgaucagccgcccaucugcugcgagguucuccagccucucacaaauguuugcagugugagcaaacaagacggaggcaugaaggcccguuuguagugggaaaguggccaggccacugugugggaaggagaauggggccggggaggccccuggagcuggaaucccauguuaacguugcugcccacguuaauauauaagccuacguagucuuguacucucacccagcagacacgcaguaaguauaggccuccgcuguguggaauguggaaguggauugaagggaggguggccgggacagggacgcugcagcagcucggggcagagcggagagccccugaacaggcugccgcgggagcauggaaggaggccguggguaauggggauggucugacagauggagacugcaccccuugguggcugacauggcaaugggugggagggccagggaaguggcuacugagccagggaaagucaagaaaaugucagcagagaggucuagcugcuuucccauucguguucuugcacuguguuucuuacaucugccuagggaacugcccuuugagaguuuguggggaccuuucucagaaaaguacacaucugggugaacguuaacacacugcauguauuuuuaaggcuugaucucuggacgaagagcugcuguucuuguuaggcugcauugagaacuguuuucuagagugaccacugggucaucugcagaaccaagaaccagugauagacaggugacuuuugugcacacacacauaggggccccaagucaguuugcucgauuaugguucggaugcagcacacauuucagguaccagaggagucuguggucagagacaagguaaauuuuauaaagcagcuaugggaauagcuuccgaaaggauauagaaaacgugccuaauaggaaaauugugcauagaauggcaaauauguaaaacuguaaucuggaugauuuucagccuggaaaacuaguuuugugguauuugaaagcauuuuagacuuuugauuucauauacguuucuauuccauuaaugaugaaaucuauucaccacuggccuccuguuuucccaugacucaacuggagauguuuauuaaacaucuggaaucuggaaguccauuggguuaauggauacuaaauaacagugauuuucauacuuaauugcuuaucaaaauuauucuaggauaauaaaaaaaauucccgguucuuauuagaguggggccagggaccuuuuuuuuuuuuuuaaguacccccgcuccgccccgcuuuuuuuuuuuuuuuuuuaaaguuuuaagguaauagcauugcaaggcaguuuugggauaguggcaugaacagaacagaaaagaauaaagguggguuaugauguauuuggaguagcaguccugccucaucauucauccugaaaaaucuacguaguaggagaauuggugguugaauugcuugaaaccuuaugaggaagacuggcuggagacucccauucuuaaaugaaccuaugacuuucuaaaguucaacaaaacauaaaaaucaguuuugcauuggugcagauaauauguacacugagaggcaugguuuuuuccguaucuagcccuccauccaaacguuaaacgucuuucugauuucaggacuggcaauggcugacuucagccgucagggucccaugagagucuggagagugauuugaaugucgcaggcagagcaggaggaagcguggccgcauaggaaggucucaggccaugcuuccucucucauauaggggguccuguuaucuuugcuccgaacauacuauuuucaugccaugaaguucuuguacauuuuauuucuaccucuuagcagucaguacagcucuuaggguaugcuucuccuuguuucccuguuucuacaaaaauguuaaaaauauuaggccaggcgcggggcucacgccugugaucccaggacuuugggaggccaaggcaggcgaaucacauauccucuucugcauucuacuucccacagugcccccucccucucucugccguccacaugcucgcacacaccugcacacacacugucgggaggcaguccagccuagugcaauguuuuuauaccccuucaaccccaggaccaguauaauauaaugugacauuaaauggaagcaaacguuucauaaaacaaugcuuaccucacuuuguucggggugcucccucauuuuccauucuaucauauuguaaauuaaaauuaaguuaaaagugcugaucuuaaugcaacaaaugaucccacgacccucugguggguuguuagcagagacuugcaaaacacaggucuagagguuucuggcauauucuuuggagucagacggauguagauuugaauguuugcuuuaccacuuaauggcuguaaguggagcuuuguaaguagcuucauuuccucaucuguagaauggagaguagcuacucugccucauguggcuuguuggaagauuaagugaaauaacgcaugaaaggcauuugggcugagggucaggcucuaguuagggcuggaaugguauuaaugauggggaugaugaugaugauguucaacuucuaacuccagcuuucaauuuacauaacuuucauggaaauucuuacuuuugcugaaaaagcacacagaagucguugugaggaacuugcaggaggaacuugcauuugggaaaagacuauugugugcccaggaaaaauuacuacuaaacacugcuguuagauuccuauacgcgugucaucguguguguggguuuuuuuuuuuuuuuuuguacguuccaauagccacuguccugacccagagcaguaguucuagcucaccuccuucccuccauuuggcucuguauagagugcugcaugacucgugaaacugaagcauggcuuuucccaagucgugcacucagaagucauuauagcagccugcguaaacaagcucagacucuagcugggcaucugagacccuccugagguucaaguccugccuccucaucuagaggcgugggugacuuagacauuuucuuuucuuucuuauuucuucuucuuauuuuuugugggggcugccuuuuuggcuaugcuuuuccuaaucucuaaaaugaugauaauaggcugggcacggugacuuaugccucuaaccuuagcaguuugggagguugaaguaggaggaucacuugaggccaggaguucaaaccaacccgggcaacauagguagugaaaccccuguuucuacaaaaauauuuuaaaaaauuaggccaggcgcgguggcucaugccuguaaucccaggacuuugggaggccaaagcagguggaucaucaggucaagaguucaagaccagccugaccaacauggugaaaccccgucucgacuaaaaauacaaaaaaauuagcugggcgugguggcgcaugccuguaaucucagcuacucaggagacugaggcaggagaauugcuugaacccgggaggcagagguugcagugagccaagauugcacgacuauacucuagccugggugacagagcgagacuccaucucaaaaaacccgaaaaacaaaaaauuagcuggguguaguggaugcaccuguaguccuggguacuugagaggcugaggugagaggcucucuugaacccaggaagucaggacuguagugagcuaggauugcaccacugcacucuagucugggugacagagugagaccugucucaaaaauaaaaugaaaaaauaaaauggggauacuaguauuuaacugguuagagcuguuaugagaguuaaagaugauugaugugaaauacccagugcuugcuucucacacaccagugacucuuaugaagacaccccuguuggugcauaagacaguugcucugcucacaucagcaaacacaucuucaguccugcuuuggccgccgauaccaaccuuuuaccuccccuggcuugccugccaccuucucccugccuagacagcaccuccccauccauuaaggucuuccuuuaccauaaagcuuuccuuugccauaaagcuuucucuuauaugcccauuuaacaaugauuuauguauuccuuaugaacuaccuaacuuaguuggcaauuaauaauacacuaccuucugaucuuuauugcauagucuuuuauuauuauaauuauaggauuauuaguuagcuuuaugugauuuaucucucacauccucaguuaacuuauuuguuccuugaggguagugaucaugucuuaccgucuuugaaucccccacagcacucagcacaguuccuuguaacaauguguguuuaaugaauuuuugcugauccauugggugacuggguaauaagaaaaggcguuccauggccgggcgcaguggcucacgccuguaaucccagcacuuugggaggccaaagugggcggaucacgaggucaagagauugagaucauccuggccaacaugaugaaacccugucucuacugagaauacaaaaauuagcugggcaugguggugggcaccuguagucccagcuacuccggaggcugaggcaggagaauugcuugaaccugggaggcagagguugcagugagucgaguucgagccacugcacuccagcccaacgacagagcgagacucugucucaaaaaaaaaaagaaaaaagaaaaagaaaaagaaaaaagaaaagcuccagagauaauaugaauccuaggguaauguuauguuccucaagaucugauuucuauuuacuuuugguaguuccaggucauuuucauuagaucagggauugagaugauucaaagcugggcuucagccuuugauauuaguuuauuucuacuuaguuguauuacuuacaaagcuugugaggguguuuccaggaaccccuuuuccuagcugcauccugauguucaauuuuugucuccucagucaccugagugugucaaaagcucugcuuucaaagccccacagccuccucuucagaaaggagcagcugucccugcgcuaggacgacagcagcccuaaaugucagguucaccuuccuggguuucuuuuucuccuagaucuugccccccuaauuuuuaacuaccuuguuagcucucugaugcauuuaaauggauuuuaaaaauauauuuuguccauguuucuuaguuauucagccugggagucaggucugaauuaccuacuguaccauuaccagaagcaccaccccccucucagcuaaggaauuuauuaccuuaaauccagcaggcacauuuagaagucucuggaacagagaauuaacaugauuaaaugguauuuuaggaagaugacugucagugguuugcaagacggagaggaguuuggaaagucucaguaaguagaacaauuaagaggucuucauaacucagugcuuucuaaaguacgaugaaggcagagguuagaguggauaagccuggguguuucacguuagauaggccugaauuuaaaugagagucuuggcucuccacuuacuagcagguaauaaaggauaauaaagucccuauguccuaggguuguaaggguuaaauggcaaaacuuguagaaaacccuagguuuuuuauuuucuauuuuuagagaggggcugucuuucugccacccaggcuggaaugcaguggugugaucauggcucacugcagccucgaacuccuggcuucaagugauugucccaccucagccucccaaggagcugaaaagacaggugugucccaccacaccuagcaagaaaacccuaguuuuaaugcccagcacauaguaggugcucuguaaaugguaaccguugcucuuacuauuccaagaaccaaaauucaguuauuugggugaaaauucaaccucacuguuaauagcacuaaucauggauaguacugucaacuucaugggggaucauucgugacuuacgaaucacaaugaauagcuugcaugccuuauauagcaggcuuggcaccagugauauucucaguacccaccaugggcugaauugacuuauggccagaugccacaguuuugaagccagucccagccucaaaucucaaagguguaaagguagaugauuuuacaacgugccuuucgucaggcuccaggguagaugcuucaacucuuuuacuuacuuugaaguacagguugcucauauauuagguuugcagaaccauaaaauuuuagcauuuuacuucuaaaaacaaccugaugugcaagaagagaagcuuacagaaaaaaaaacaucagauuaugauucaucguaucauggauaaccccaggaaucaucuguuuaaaacgucccauuuuucuagaugaucaaagugugggccgggaagauggagggauuagcccaaggacacacaccagcaauggcagagucaaggucgcgacacaauguccugauuucugugcauuuugguucuuagacaaacauagccgcucugugucaucuccacugagcuaccugccuucucuaacucuguucgagguucacguggccugacuguuagcgccugugggaggcuugccuuacagaaagaccagcgugucaccuugacuuucgauaauggaagcuagacgauacauaccgaguaagcaucuuucuuuccaguccucaguccucugacccucugugccugucaucucagucuuuuaaucuccggaaacauaauuaaucuguuuauaguguccaacuaaaugauccguuucuggugcuaggcuugagguagauucugccuuugcuguuuuucacagaaguaaagauguacgcucacccucggcuagucgugagaaaccugugucaaauggcaaacuuuguaccgugucgcgaggcaagcgcacugguaaugcacuaccugcccagggcgugggagaugggucaggggagaaaaaucaagucacaaaggagaagggccuucaugugacuggguuagcuuuucauugagucucauuggagauguccuagcuacaaacaaaccaaccaaccaaccaacccaagcaaacaaaaccugaaauaaguguagcccuuuuuaaguuuauuuuuuacucugaugaaauacuuguucgauuuuuugcuuuuucuaaaaguuaccuauaauuaguaacaguccugauugaagauugugaacuuuucuaauaaguuugcgguuuggcugagcugcauccuuacuagacaggcauguugcguaagugaggaaugcacccagccgguggaugacaagcccggcacgccgaccaguggaggagucuaucagaauggccaaaaugaccacacggcaggagcaugggagagccaggccauugagcaugaacaauaaggggacucuagagcuuugcuucucagagugugacccaaggaccuaggggcuugucagagaugcagaccacagcggucgccuggaauccacugacuugggauuccugugcacguucaaguuggcgaagcgcuggauuucaggauuucacacucagcucuucccuuuacguuggccaaacugacccuaucauucuuuugcuaaaauccuucgguuuccucuucagucuuagaucguggucaugaccaaaauccuaggcauggucuucugggugagccgggucucugggcccucccugucacugacugcuguccacaggggccaccuugccucagggccuuugcagcucucccuucucuguugguugcucagggcugccguaacagauggcucucacacaacagaaauguauuccaucacaauucuggaggucagaagucucagaucaaggcaucaguagggcccugcucugccucaagggucuuggggagaauccuuccuugccucuuccagcuucugguggcuccaggcaugguuagcugcagcagccucacugcagucucugccuuuggcuucacgugcccauccucccucugugucugugucuucacgcggcauucuucucugugucuguguccacacuucccucuucuuauaaggacaucggguuccugcgagcuacuggucacaauauuuugucagcugaucauuguauaaccuugucuuauguguuucuguuugaagacacccucuguaauauuuauuguugauugaugagcauugaacucacagcacuauaaugcaugccugagcaaagcuuaucuaauauacguauuuucccuguaaggcgcaucauagccuucugguucuuaggaacccgggaaggcacuucagcacaaugccugggggccauuuuaaacagcaaagucaccaaaaaaagcacaacgaugugacaaaugucgcacucuguagccugugaaaagaacacuugucugccauaggagagcaagagcgggaaggcagaguguggccuuguccagccucagcugggaacacgugcaucagaugacuugaauucagcacauguccccgagugaccaccaacgcaucugaguauugauuuggggguuguggauauauuucagugaguaggcaaauucacagauacagaaucugcgaacaguguggaucgaaugugucuucacacacaggcuuuaguuuuaaagacagaaaguuggguuuuuugucuuggugcuuugcuuuaccugacaauugacuuuuucaacuacuguuuccguuuaaaacugaucuucgcugucuuucagagagaugccugucugugagaacuuuaaaagccaucacuaauauaagaacgggaaccacugugggcuggagggggucaccugaauaggaaccauaccauauggcuuuuugaacuauuucagaugugaccauuguuuuuuuuuuuuuuucccccaacugguuauuugugagaaacauaauggaggaaauauuauauucugaguacuagcuggaggcagggccacuuccacacgccucucguguuuccauauugccaggcucaggcucagcugcagcgccagggaccacgcacagcacuucugcacgucaggcugucaggagaacuggcgucuguugcucucuacucgugaccacuauaccuaccccuauccuguaacuacucuucccucgcucuucccucuauuuucuugaccgcucuggauuuaguggucuccaaucugugucuugaggucuuuuccagagggaagaucaggcugggcugguggucaccacccuggcgggcagagcucuugcagggugagccuuugaggggucaccagugcacuccucugugcacagcuuuucccagcacucccuagucuuuucugaaacucuuuaucaucuucauggggcaugguaccucccuucuuuccaguguccuguuagguugggaguuccuagauggcagggaaugucaucuuucccuguuccuggagcaucauucucaauacaugaccuuugaauggguggaugaacaaaugaaugaauggaacaaaugaaugaaugagaccaagagcagcaguaucugcaacuccuuguggccauuccguguucuugugaaauaucucuaagguucccguuugugucucaaagaaugguggcuggagccuccauaugaguggaggaggccaaccucugacggcaccccaccuaggcccucagagccgucuucagagcuggccugggccuggcagugaguguuuccuauguggaaggcaacauuugcgcuuuguaggacuagcaaaagaccuagaagagggcggagcaugggagcucaugucuguaaucucagcacuuugggaggucaaggugggaggacugcuugagcccaggaauuugagaccagccuggguagcauagggagaccccagcucuacaaaaaauaaaaaaaaauagcugggcgugguggcucacaccuguggucccagcuacugggaggcugaggugggaaaaucgcuugagcccaggagguugaggcugcagugagcugugaucaugucacugcacucccgucugggugacagagugagacccugccuccagaaaaaaaaggugaugcucuuccugcgguagaacuuaaauuugguuaggaaaagagaguggacuauacacagcugagagguguauagguaaggcaagggauaagaugaaagacuuuacuuaaaacaacugcccuaaagcaauguuugguuuuucaaaggagcaguguaagaucagugaguaacauaggagcuggaggcagagggacuacuuuaggcgggaguggucugggaagcccuuguggaggaggaggcuaggucuuagagggcggauaaggaccugcaaggccagggaaugaagagcagagggcacgggaugagcacggagcaggaggugucugcagcagucagugggccagacugcaggaggcauacaaggaaaaggcugggccagacugcaggaggcauacaaggaaaaggcugggccagacagcaggaggcauacaggcccagggugaggcccaggggcugggggucacggaaggaugcuuguaacucuggcauguucugggcgcagggaauagaggagagaggaaguccauggcaagcugggaaggagaguuauugagacaucagcccaaaugccaaggaauagaauuuucagagcucaauuuuggaggaaaugaacaaaagaaggaagggaccaaucaggauugagaagaggauuacagugucacacugucugugagguccuauagaauggaggcuugcaccugacccaucuuugcuuuuggagcccagauuagaugugaaugcaggcauagauagggugaagaugagugggggacaguguggaagguacuuuguuagugauuccccucuggaucuauuccgauggaccaggagaagucuaucuuagaaaggaaucuggaagcagcagggaggcauuguguggacuggcggaggaaggguggucagacuaugaaaaugauuuucaaagggaaaguaaguuaaaggaaaagggggugaugucaggucagcggggaggcuggcauugaagaaagacacuugggugagagacugcauucggguaaaagcaaaagcaaaggagauaccugugcaggcuuccaggggcucuggaaguaaagucaggagggacggguaguugguggaaaacuuugggaaagccaaauuaacugauuccuuucgagcuuuaaauguuaauauuggggguugaaagcguuuguauaacccagauucucaaaaggaauggcuuggcuaucauaauuuuuucccacaacugcuuugcucugcccaccccuuggcucuuggaaggaucauccccaaaggcguuggggccucugagcaacggaagccucaaaacacggccagugcaguggggauaaagccucccucuaggcaaauuccuggggaggaguguggguccuggucuccaauguccauaggacccucccagcggagggcaggccuggaccauccugugucuccagauagcccccuggccggugcgagggcugggcuugcacagguggcacagccccugaguacaccgaccccccagcccccugguccccagccccaggaaaggagagaaggaaagagucaggcgggguguagaacucugcagugcagacaccacacugaguggcaccaacgccugacgcuguguuucucucccucaagggcaccaugccgguggaaaggaugcgcaugcgcccguggcuggaggagcagauaaacuccaacacgaucccggggcucaaguggcuuaacaaggugagugggucaggguggguguaugugugagagagguccuggcugaaacacgcccaugcggacugcugaaaguaaaaucguguguauucaaaaucuuaggcuuauucaugacaaaaaccagccaacccaaaaugaucauaaaacaucaaguuaucaucucaaaggcuuuuuuucuuuuagagacagggucucacuauauggcccacgcuggagugcaguggugcagucauaacucacugcagccucgaccucuuggguucaagugauccucccaccucagccuccagaguagcuggaacuacagguaaacgucaccacaccuggccaauuuuuguauuuuuuuguagagcugggaucucgccauguugcccaggcuggucuugaacuccugggcugaagugauccucccaccucagccucccaaaguguggggauuacaggcaugagccacugaacccggucacaaaaggauuuguauccuguacgacuguagccucagccuggagucuccaaugucugcucaccuuugguguuuuggcugacugccucucgaaagcuccuugcuuuuuuuggaaagcuccuugcuucuuugaggauucuuacccucuuccuucuccaaauuccuuuuuuuugcuucuccuggccuuuuaggacuagaggacauggaaacuccaggguuuuauauuaggaauggagcauuuccuuuuccauguucucuguuuaaagaaagcuuguuuuugucuuuaaaaaaagccuucuuuuuaccucuguaaugaagcccuaucuguguguccaccuuuccuaagaaagcagccagucauuuacaaccugccccuuccaggcacaaacacucccuuacuuuguuaaccuaaaaacucuuaauuuaauugauccuagcuguuaggggugaaucagaaagagauaaugucggcaaaaaugaaaaacuucuagaacuauauaaucuagaaaagcaacuaaauauauaucaugccuucuuuaaggaggcccaggagagaaguuccucuccuaccagaacaguucugagucaaugccuuuuuccucuucuccacucccuccccuuuucuuuuuuaaucuuaaggacacaaugaauaauuuagcuggccaggcuuuaucuuuguaucagguacaagagcuuagagccagauugcagauuguagccugcuuccaacaagggaacaggauauugcaguauaauuuuuuuuaacuaauaucauuccuggccuuauugggucuuuucagauaucuuucaaaucuuauuucuuuuuacuauuuuccuuuuauccacuuauuuugauuuuuuuuuuguuuucuuuagacaaggucucccucugucacccaggcuggagugcaguggcacgaucucagcucacuguaaccucugccucugugcugaagcgauccucccaccuuugucucccaaguagcugggaccacaggugcgcuccuggauaauuuuuauauuuuuuguagagaugggguuucacuauguugcccagacuggucuggaacuucaggacucaagugcugcccgccuuggccuuccaaagugcugggauuacaggcaugagccgcagugcccagccugauuuugaauuuaauguuacuguguugaauaugucugucugagccuuucugaaacaaggugaggcacuaaguaaauagaaaugaagaaaccaucugcuuauuuccugugaccugucccauaucucaaggucuuaccacaauguauuuuucuaggguugcucuaucuauaguguuuuagauuuacauauguaaucagcuucuuccaaagaaacaaacaagaaauggaguugcuccuuggucagcucaguuagcaggggugccguggagguauaaggaaggggggaccagaguaaaggggagcuggagagccaggguagcaaaugacacugaaugaaagcugacuuguacucagcacuuacugugugccaggcacccuucuaagcaagguacaugcauuagcucacguuccgccaccaugggguagguacaguuaauauuuuccauuuuacagacaaggaaaccaaggcacagagagguuaaguaagauucuguuuugaggaacaagguagcauuacuguuugauguggagugggagaggaaagcaaaugcuccuguguucuaaagagaagcaaguggucugcuucugcuuuuccuuuuucaaaaauaccuccacuaguuuugguuggcaggaugcaguggagaagagacagugucucacaccucuccuguugagcaggugccugauauguugaccgcugugguugguuuagacuaaccauuagucccuucuuggugcuguaguagauggaacuguggcucccggagaagauauguccacauccuaaccuccagaaccuguggaugucaccucauuuggaaaaaggguuuuugcagauauagugaaggaccuugagaugaaaucauccuggauuuucugggugggcccugaugccaaugaggagugucuuuauaagagacagaagaggagaaggcacacacagaggagaggggcaugugaggacugaggcagagacuggaaauaggcagccgcagccgagggacuccaagaagaggcgaggaaggauccuucccagagccuuggaaaggagugagcccuggcugggcgcaguggcucacgccuguaauccccgcacuuugggaggcugaguugggcagaucaccugaggucaggaguuugagaccagccuggccaacauggugaaacuccaucuccacuaaaaacacaaaaauuagcugggugugguggcaggugccuguaaucccagcuacuugggaggcugaggcaagagaaucacuugaaccugggagguugagguugcagugguggagguugcgugagcugagauugcaccacugcacuccagccugggugacagagcaagacuccaucucaaaaacaaacaaacaaacaaacaaacaaacaaacaaacaaaaaccggagugagcccugcagagaccuugauuuuggacuucuggccuucaggacugugauggaauacauuucuguugcugugagccacccaguuuguguaauuuuucaugacagucuuaggagauugaugcacccucuaagggucacuuccuuucugggacucucaguugagaugccuuuucuuccaucuauuuuguccauguuuuucugauacaggaccagaaggcaaauggauuucccuuugugcaaaugaacacuuggccccuuucaggcaguccuuaccugcugagcgucacucaucuggcucuuggcucgagaguucucuucccgaggcauggaaggaaaggagaccucugugucaucucacagggcuccuccgcuacagcuggaccugagccaggcugaugaaggagagcgugcccguggcugccggcccgugccgccucucagcaccgcccuggaacagaggccgaggccugcacuguggccccgaggcccugucaagcugcauccugcugaggccuagccagagugggcacguggcauugcucgugcacaugggcacugccaucacugucacugcaggccucggcuggggucaggaucucuucucuccauaccuacacucccacagggcauuuuuuuauagguuuccguuaacuuaggcuuguuggcauucaucuguccauauaaauacuuaacugagagccuaauguucuucccucccauucacaagcauucugccugggaauccuuguuuauauuuugagugguuugaggucauuccaagaucucuuuugccacugaagauuguuguaacucuuagaauacacuguccauggggcugugggacucacuucugcuucagucggcauucaggauguguucauguuuauugugaagugcuccaggcugggagccccaugcaccagugccuuggcuaucuucuucaugucugcaugcucagggccaggccuagugccugguaagugggaggcccucugucaaaauuguucugggaauacacagaugaaugucauggauuugaaggggagcaacauuggugguguuuuuguucuguuaagauaaucagauuuauggacacuggcuuggcaguugucacauggcucucagaaaguccauucaaccuacuccauucuuaguaagagagaaagaguugguuaauuaaugccuuaaauuuguuuccauccucuauugucuuagucuguucccuguugcuucuaacagaauaccugacucuggauaauuuguaaagaagaggaauuuauuucuuacaguuauggaggcugagaaguccaagguugaggggcugcaucuggugagggccuucuugcugguggggacccucugcaaaguccugaggcagugcaggauaucacccggugcggggaaagagcaugcucacgugcuagcacaggucucucuuccucuuaaaaagccacaauccuaccccucaugacaacucauuaauccauuaaucccugaauggauuaauccauucaugagggcagggcccucaugacucaaucaccucuuaaaggccucaccucucaguacugccacauuggggauuaaaugucaauauaagugucauagggggcaaauauucaaaccauagcaccuacuuuuaauaaguuugaaggagggugggaauggaaugggucccuuggauuccucugaaggaacagcgaggaaguuuggaaaagugcauuauaaccagcucaugaaugagaccuuggcuggggcaauuuaccuuugguuauggguauuugcaaaugugcauagcauguuugaguagcccaaugacaaaaagaaauaggauagcaaauuuucauaugccuguaucuagauguaugaauauuuugccuuaucuuuguguguguguguguguguguaucuguguguaucugguauauuaaagcagcucccugacagcauacauuguaagacauaagggcauuuucuuauauauccacaauauaccauuguuaauuggacaaaauuaguacuguuuaauaucaucacugcuccauucauauuaagaaugccuugaguauucccaaauaaucuuuuuacaguugauuuguucaaaucagaauucaaagacuguccacagguuguguuugguguuuaugacucuaagucucugcugacugugggccucuguuuuuuuccuucucgccauugacuuguugagaccagguuaguuuuggguuuguccacaugcuugcuugugguucccugggccauuucuugaggaaggaaggaggcagucacauccgggguccugguuucucucguggcuccaugugacccccaacucuggugggguuauugauguucuuaguucuuccuggauccaugcacuaaggcaggggaaucaucagaucuuucccuuuuuuucacuuugagaguagacuuguguuuguguaaacaucaggcuaucucugaccacgguaaggaguccagacaaaaauagcacacuaauuggaacgucuugcaaauguuggggggaagaagaggcagaggagauaacagaacuaguuuccauguggggccaaggaacauuguucuacauugcucaaaauaaugucagaugcuuuucugaagucaagcagcgcucaucucuccugccuuccuucagaugggcagaguugugcacacacguacaaauggugggcccuggcauggcgcgucugucuauacacagcauguaccaccaccacgugugcaggacuggucacucggggaugagacaccuggcacauacugacgucacggggucuacacacacauagcaacaccgucaugucccauggaacacacaacuugugaccagaauguuuacuggucagaaucucuuucaguuuuaaaaugaaucuugcuuucucuuaccuuuucauauggucuucuucaaaaaaagaaucugugauacaauuuuaaagauauuucugauaaguuuauuagucuuuucuuuuuuuuccugaaguaugaaaaacuagguaaaggugacauguaguuuaaaaaauauuuaccauuuuaaagugacauucacgaugucaugcagccaucaccacuguccaguuccagaacuuuuuaucccuccaaaaggaaaugcuguacccauuaaucagucacuucccauuucccuccccccuagcuuguggcaaccaguaaucugcucucugucucuauggaucucugcucucugucugcucucugcucucugucuuuucuggaauauuucauguaaauggaaucauucaauuuuuggccuuuugugucuggcuucuuucauccagcauaauguuuucaagguucguccacaugguagcaugugucaauacucuauuccuuuuuguggcugaauaauauuccauuguauggauauaccacauuuuguuuacccauucaucagcugauggacacucggguuguuuccaucuuuuggcuuuugaaaguagugcugcuaugaacguuuauguuuugguuugaauguuggcuuagaauucuuuggguauauauccagguguaaaauuccuggaucaucagguaauucuguguuucacuuucuugaggaauggccaaacuuuuucuccagaguggcuguaccauuuugcauuuccacagcgaugugugaggauuccaguuucuccacauccucaccaacguuuguuauuuguguaucuuuuuuuggagacaugucuguggguuagucuguuucauguugcuacaaaggacuaccuggggcuggguaauuuauaaaaaaacgaggcuucuuugggucaggguucuaggcuguacaagaagcaugaccuuggcaucugccucuguuaaggccucaggaugggaggcaaagggcauuacauggcaagagagggaggaagagagaauggugcaggcgacaggcuguuuugaauaaucagcucucaccggagcuaauggagugagagcuuacucauuaccacgagaacgacaccaagccauucuugagggauccugccccaugacccaaacaccguccaccagaccccaccugcaacacuagcgaucaaauuuuaacacgagauuuugaggggacaaacaccugaacuauuccagucuacucaggccuguugcacauuucaagaggguccauaguguauguugcuggguuuggucagcgcuuuuguaguugcauggcuuuugcgguuucugugggacuagguuugguuguguguguguguauguguaugcaugcaugcgugcagaugcuuaaaaagaucuacuuuaucuguaucaauuuugugucuugcaaguuagauuucagauugugucacccuagaacuccuuugaucuagaaaaaagugcaacagcaaauucuuaagaaucucgguguuuaagcauaaagcuuuagauucugggcaugcacuucaggaaaagcucuuucacgaaaugaauuuucacuuguauucauuuucaugugaacaucaauaaauggcauuaagugauuuugcugucgauuuucaucuacauuaaagcauaaaaugucacucagccccuuucugaucacuguccuuuugaaauuggcuaacccgaagcccucucuguggaugauacagaaugaacaccgaggaauuuaugaaaaagucucucacuuucaguucuccuuuaauaacugacuuuuuagaagaugguagaauuuuccuuuuaacagguuuugggaaacucuccaauguucugaaauagucuuuguucuggcuuugugauugguucuguggagaggcgcugaaucucuuuggggacagcugggacccuuucuguguuucacuaugugagacugaagugguggaaacucccugcugacauuuccucuccuuccucagcaucuagugcagggauccgcauaccuagcaauuaccagaacugccuugagagcuuugaaagaguacaaccuccugggcuuuaaucuccacagaauccaggucucaacuggucugucauaggacagggacucuuccaaaucuaaaagcugggagacaaugagugggugauuaaguaauagcauauggagucgcaugaccuggguuuugaacuuagacacuuauuauccugcaaguuccuugacuaaauaguuaaaaucugcuucuugguuuccucagcuauaaaauggaaaucguaacauauaccucacucaguaggcugugggaggaagacaaaacugaggucccuguggauguggguagucagaugcacagugccaaugggaccuuaguaccugccgguaccgccacaagagcugcuugggccagguuccucaucuguagcuuuacuaagaguacggcuuuguuacuaaaccauggguuuccaaucauguguuuuucaggguugcuugaggcgguuuugaguuacagaccucaacacugagagagauguagagauagucugauauaaggauuguauugagggauguuucuccagaaaaaugugucauuucauaaccucuaccucuuuguuugcacuucuugcuauuucuugcaggcaguagacccacagggauucgaacauuacuuucuauuucuguuggaugcacaagcaaauggagauauuugguuucugugacaguggccucagauguacccgacuuuucuuuaguagcaucaaggguuuuggaaacuugucuaauuuuuaauuuaccuaagauagcuggaguuacuauuuaccaaacgacgagaauaaauuauaagaguaagcauuagaaguuucgguagguggccauuuuucugugguuuuauaaaaaaaagaggcacagggccgggugugguggcucacaccuguaaucucagcaguuuggaagccugaggugggcagaucacuugaggucaggaguucgagaccagccuggccagcauggcaaaaccccaucucuaccaaaaauacaaaacuuggccaggcgugguggcacaugccaguaauccuagcuacucaggaggcugaggugggagaaucucuugaacccaggagguggagguuguagugagccgauaucgcgccacuacacugcagccugggcaacagagcgagacucugucuccaaaaaaauauauugaaaacuagaaaagaggcacaaauaauggaacacacaaggucaaaucaucaccuuugaccuuggaaaacauuccugcucugcaagacuucacgagacugacugucacucgggguagucuaucaagauuugggauccagcgggggaaguggguuugguuuacaguagauuuucuugucagcagucaacacauucagcgaugcuugcuggggaaucuugcuggcuagaccuucacaaccuuuugcaauggugggccaaaacccaugacuccaguucuuuaccuuuuuuuuuuuuuuuuuuuucaggaaaagaagauuuuucagauccccuggaugcaugcggcuagacaugggugggauguggaaaaagaugcaccacucuuuagaaacugggcaauccauacagguacuaaaacucccugcggcguuuauagaggaaggcacucuugcuuaguuuuguuuuuauuacacauaaaauagccuggcuuaugaccucaugaagauggcucugaaaaaccugugacuugucccuaggcacauccaggacacaugggguacaaacugcagcccucagaaguaaugcuccccucaucccauacacucuuaguccuucaauuuccuauaaaugugguauucuaagaaguucccuagguguuaccggggaauagaaacucaguuguucugaugcuauaaacuuuggucaaauuuaucucccccccaaaaagguagucagaaauaccuguauuuauuacaaccuuuacguagggagcuguuuacaggaauggacuuuguuggagcgucagaugaaaaagaggcacucagcuucccucugccuguugacuuugcagccucucagucuucuauauuuuucuuacgcugaugcuccauucuuccagcauuuauaguuuccucaagcuguucaguagaaccagggugaccaacuugucccaguuugacuggaacuguucagguuuuaaaaacaaaauucccacaucccaagaacuuucucacccccagguacaccaggacgauuggucacuggagguauagcauggagugaaaagguuuccuuauacugccugaccagcaauacuguguuuccagaaauuccuuccucuguaucuaauguuuucucucuuuuucuuaaucuuugucucuuuuguuaggaaagcaucaaccaggaguagauaaaccugaucccaaaacauggaaggcgaauuucagaugcgccaugaauuccuugccugauauugaagaagucaaggauaaaagcauaaagaaaggaaauaaugccuucagggucuaccgaaugcugccccuaucagaacggccuucuaagaaagguaaaggcauuuacagacuaaaauaagguaaaucaauuugugucaucgugccuucgugaucucuucauuucuacaucugcagucaguuugcagguagaauagccuguucaugcuguaggggaucauuccgccccuaccuggcuuggaaacaagacuuucgauucaccagaggcagugaaagauacauguggaauuuugaccauguacagauuaaagcaacagguucauugagaguuucagaaagaauuuaauuugagggaaauguuucucuggaggcccuucgugaauuaauccaaaacuacauuuuuguugccacaggaaagaaaccaaagacagaaaaagaagacaaaguuaagcacaucaagguaaucuugggugauucagagagaaagccaaaguugggauccuauuaaugacucauauucugccuuguaaagaugagucacaggaccucaguguguccucuuucuuccuuugcuugugucuucugugcuuuacauguuugcucuucagcauguauccacuugcagacauggagguacacagggcccugccucaucccguuucucugggaaauuuaugaaugaagucacagauucucacugugcucggcaggcugaggccuccaucuggccaccacagccguugccaguggucauuuugugccagcuaaacuccacaacagcuuauucucauacuauuaaguauauuuucaggcuauuaaguauacuuuaauauguauuaaauguuauagaccucuauacaauguaugaacucuauguuacagacauuccgucacaggcccuuuggugggggacagaguggucaaugucagcacucuaucagaacagcucucaauggcugccuucuguccacuguagaaucaucucucacaccccacaaggguuuuccaugggaugugcaugugugugucagcuucucacuaggcugugucgucugaacuccccuacagucugaggaucuuuaugcauagauuagguggcccuuguuaaauaguaagagaagagccgaauaugcccugcaaaacuggggacgagcuucaguggcugagcagagagcauacacugcggucacagacccagggaucucagagagauugucgagcucccuggccucccuuugcagaugaagaaauuuaggcggaggguguuuuugcagugaugcuuucaguuucacuuuuacuaguuuuuauuuuuaacuaaauuuaaauauuguacuguauuaaaggccuaauuuuguuuuaacuuuucauuguggaaagauuuuaugcacauaggaaggagacaguugaguaaaauuuaccccauaggccaucauucagauuaauuuuaaccuuaaucagcuccuggccaguuuugcuucaucaauagccccucccauuuccugacuucuaacaugaaauugcagcccuucaaccauuuuugacuuacagaaguaauuuauuuauuuaauuuuuuuuaaacugagauggaguuuugcucuauuggcacaggcuggagugcaauggcgcgaucuuggcucauugcaaccuccgccuccuggguucaagcgauucuccugccucaaccucccgaguagcugagacuacaaacacgugccaccaugcccagcuaauuuuuguauuuuuaguagagaugggguuucaccauguuggacaggcuggucuugaacuccugaccuuaagugauucgcccaccucagucucccaaagugcugggaauacaggcgugagccacggcacucggccccaaaacaauuuuuuauaguucagcuuuuuuuugaacuauuuuuuggaauuugaagcaaauuccaaaccucauagcauuucuuccauaauaguucaguauauauauuuaaaagauaagugcucuguaaaaauaccaugaugucauuacuguaccugaaaaaguucacaguaauuucucaauaucagugaauauccagccaguggucagaguuucaguuguuucauacauguuauaacauucguguaguuuguuacuuaaauuaagacccauauaaaauccacaugugauuuuugaaugucuuuuaaguauuuuuuaaggauauauguuucuccuauauuaccucuuaaaacauuuuuuuuuuuuuacaauugaacaaaccuaguuguuagccauaucguuucucacaguuuuuuuuuucguuuuuuuuuuuuuuuguuuuuuuuuugagacaaggucuuacucugucacccaggcuggagugaagugacgcgaucauagcucacugcagccccaaccucccgggcucaggugauccucccgccucagccucccucuaguaguugggucuacaggugugugccaccaagcauggauaauuuaaaaaaauuuucuuuuauagaggugagguuucauucuguugcccaggcuggucucaaacuccuggccucaaguaauccucuugccucggcuucccaaaauguuggaauuacaagugugagccuggcugaguuuguauuuuuaaggccuacguuuugauucauguuauuuagucagaaaagcacagcuuucucacacaugugugagaauuugcuacaauuucaagugugacugaaucguauuuacuacucuuuucccauuaucuagcucagugccuggcccagaacagaucacuaauacguauuugauaacugaauagaugcauccgcauuuguugacuaaauagauguauaaauaaguaggauauguggggugggagugagggguuuuccauuaggaugcagauuuaauuucauaaucgcaguuaauggagaaauaagaacggaguaacagauguugccuuuucaacacacuuugcucacauguacccacuguauuccaucgaacgccagaugccaaugaugcuaagaugcacuguuauuuuauguaucucuuagaaaaacugcuugcaaugaaaccaugacacguaauggauugaaaggcauguccucuuucagggauguggcaaugcgaggaaauguacaucuuaguaguucaugccaugugguggucccguuugucugggaucucuacagccacaugggcacugguggugucuucacauggcccugaaaugagcaaguuguggaaggcacgguccugggugggcuugaccauccuggcccagggaaguaagugagagaucccguuaggugcagccgugugggucaagagccaccucagccaaguguguuuuaugaaauccuugugccgugaagauaugauucauaccugaaacuuuuuucuugaaaggaccugauuccuucagcggaaggcaggugauucauuaggccuaaacacagccuuacuuuugaauuuagaucuacuugcauugugcuuuccaguguagcagggaagcucagaagaggccagugggcuucccgaguucugugcuuccuggcuguucaagcuauuguguggacucagugucucuguagaguguuugaaaagugaacucccuagggcgucuggaauuggaaagucagaggacaauuacuagcuauuaauauauuacuuuuuaauuguguaucaaaacacccaagcacugaguuaauauauccugugcaaauauacuaaaccuacuuagucuauccaaauauguaacuggauacacuacguagguuucuucuacugaggaaauuugucuuucauaugguaacuagguaugaauauuugcuguugaagcaagcuuuucccaaucuucaaguugaaguuuuaauuagcaaacaauguuuacaacauguaggccaaguauuagaauuuucuuggggucacucaugauuuaucuccaugcuauaugucccccaacaaauagucuccccaagacuggaacacccaaggcccauuggccauguggcaggugcagaaacggccucagcauccucugacauuucgcuuugugagcauaucccuacaaacucagucagccauguuuuccuugagcuaagccccaccugugcggcgguaacugguuaucuaaggaaauaagaacaagaaaaacagcuggguacagugguacaugccugucccagcuacucaggaggcugagguguaggaggauggcuugagcccaggaguuugaggcugcagugagccgugauugcaccacugcgcuccagccugggcaacagagcaggaccccuuccccaccucaaaaaagaaagaaaaacaauaaugagaaauccuggauucuacaucaucagugcauguauauguuucagaaaauaucauggaacgguuugcucugagacuucagacaaggccaagaacaguaagaauagaaguaguuaaaacagaggggugcuaguugauauuuuugagcugauuccaaguucccagcuaugauuuuugucucacugaguucucccugugaugggcaggucauuucccuuuuauacauuuaggaaaugggugcacagagaagcugauucauuuucccaaggcugcauugcuuuacagagcugagauuugaauccaaguuuguccaccgggugccucguagccuuuggggccuaagccaggccuugagggguggacagggucaaacugguccuuccgcagcacuaggggcaucaggaaugaaggccuggagauuacaguugguuugucuuuccuggaugagacaggaaacuggcuuaauuagagcaggaguuugugugagagggcaaugggaaauacaggcauguagguggggcgaauagaaauggguacuuccugcuucggaggguuguuugcagcugaaacauacaugcuugaaacuguaaagugcuuccggaucaaaguguuaguguuaugaaggagacagaauugggaagggcugccaaagucgcuuggaaaagauuaggccuggucuguauucguucugagcacagaccuauggguagaaguuacagaaaagcagauagggguucggcugcucuuucucauagagcuguuggcucuaacagugaccugagcuggauuaaaacacagcacacucccuggcagggcugcuacuggagugaucccuucacuaguuggaagaggucuucaguuuuuaaacuuuaaucaaaugaaagcacacaccagcaacucacuugaaaaacagauaagaugagagaugcccugggugaagcagguuaucaggcuuauucugccugcccgggauccucccuucccaugugguagcucagaacgggagcuccgaacccaguuggaagagcuugagggacaguuuuacggaaugagacacaguugaacuccuuguagcacacuuagagcaggcgggaauugauauguaagggaggccuuucucaccgggaugggaaggagugggaggcaggagagacugcuguggaaaggcaguagcuggugccacuggcauggagggaggagacauuucuccagaaaguggaagaggguacggaggaugcagauaagagcggccuaaagaggaggccccggcguuuugcaccuucagaagcgaguguugggaaugcaggucguuuuguggagaggguguuucgcuuuggacaugcugccuuugaagugacagagagcccugaagguaaaugccagcuagaaaguuggaggguacagcacuugagugagugcccaacgggcagauguguggucauuuacuugagaauggcguugguagcuuuggaaacugaugccuucucuaagagaugcagacaaaggcccgcagagaagaugcagagaaaagugagcuaagggaaaaagucaagagggaagcugcagugagagaagggaggaagagaaugacgauggccucauuccaagcaaggagcagaaggaaggugguucugggaccgggcaggaggccccagccugucuuacgagagcuucuguugucaguggcauugcgccucugugcugggugugugcacucgccaagguccaguucccugaccugcuugugaaguccagcugucagccuacacguucuguuagcagagacuuagagauguccuuaaauuugauguccuuaaaucuggcuucaaagagacuggcuuugcacagaugaguuagagcauuuuggaaggugggaggugggcuggaggcccauuaaaugggacuucagggacaaggggcauuagcacaggguugagacagcaugggcucggagcagaggggagucccucugcuguccucuaacucuggucuguccccaagcccauucagcaaguguagcuucaagaccagcuaaagguguauuauuuuacaggucuaaagaagugugcuccugccccugaacucucucuugugccaguuugcuuuugcuuaaaaucccuuaaaccagagaccaaaccuuggauucuguaauuauagcaaagguucuugagcgucaauguuuggcggaguucaugcacccacguagaucaauccuuggauucuacaauuagagcaaagauuuuugaacauaaauguuugcuggaguucaugcaccguggagaagucuggacccaagcagagucuuuuuuuuuuuuuuuuuuuuuuuuaaucuuuggagcaaggggagaaaauuaaaagccaagaaagcuauggguuacuugauuuacagaagagucucuaucuaaagugagaaagggagcagacagaggggaugugaauccugaccaggauuaaccgggccagguuauggugcagcaaagcaggaguugagccagggcaggaguggggcaucggggguccaggagaggcuucgggcgaagaguguucagggccugcaggaucucuguguuuauuuuacauagagaacuccacaccccuuuucuucauuugagauccuuggauuuuuaauauaccuuagauuuagauauuccuacuucuaaucauuucaaaaauugugacccaguuuagugaagauccuucucuccugggccuguucugcacccuggauggagguguuucgggaggugcuggcuccguuuuacugugccauugacuguacugucuguccagagugacggugucagugagaugauuggcacugauggcucugaaaugacaggguuucuuuugaaguggggugaggggaguaacacaguguuuggaauagucucuccuagccuccaucgguggaauauaugaugccauuauagaaguggucagugcaggauacaggguaagaauggagagaguagaaggcugggcaugguggcucaugccuguaaucccagcacuuugggaggccgaggugggcagaucaccugaggucagggguucgagaccagccuggccaacauggugaaaccccaucucuacuaaaaauacaaaaaauuagcccggcaugguggcaggcaccuguaaucccagcuacuugggaggcugaggcaggagaaucucuugaacccgggagguggagguugcagugagccaagaucacgccauugcacucuagccugggugauagugugacaccccaugucaaaaaaaaaaaaaaaaguguggagagagaguagaacaguguucaaaagagugucucagucuccgcuggaauuagggcaggauacaagggcuucuuaagacagaaagcuccuggaauugaaccauauuucgugaccaaagacagaguucaguuccggugucucugcaggcuaaaaguagcgugaucuuggaaaauuaauuuagucucugagucaucguuuucucaagugauaaaaguaucacuugucacuaauuaaacuguagaucauguguaacacuuagaggucuucaauggagaaaucagaauuaauuuagcuuuuuaaauauaugcaagccugacugccucauuacuuuuauaagaaaccuagaaacagaaugacuaaaaaaauaaggucagacagcaaaggaagcccauacaaaugagcaguucucuuguaacuucuucagaggccugugcuuaguucuuuuugagggaguugaagagauggagguggacuagugaaagguggggcaugacucgggguggggaaacugaccaggggucauugaggacgccauugagaaaggaggcugcuguuggagagauggagaauugcagcagugucagacaguucaggccgccauggagggauagcaugguccaucagaggucagcauauggggcugggggaagggauuugagaaaaggccauuggauuugggagagcacaguuuuguuggugaccuuugguaauggugagugcuuauuuacuaguaagugccauguacguaguuagcucauuuaaucuucaccuuaucccuaugacguggguccuauuauuguccucaguuuacaacuguccgcagugcccuaggguggcuuacagagguuaaauaaggagcugcaaccagugaggaguggaggugccaggcuuugcuccaggcccuucugauuccaaagcccgagcucucaagacccuucugggagcuugauucugcagguggagaggaagcgagaccacaggaacuaaugggggcccagguggagaggcgaaguccggaaaggcagacagcgggucggaaguuugguugugaaggaagggaaaaccugcugacucacccaggucacaggcaaguggguuuuuuuuguuuuuuguuuuuuguuuucagaaggggcagacuuuuuuuuuuuuugucuuuaagaaucaggcucucgcucugucacccaggcuggagugcagugacaugaucauagcucauugcauccuugaacucccgggcucaggagagccucccaacaccgcagccucccaaguauccaggacaagaggcgugcaccaccacacccggcuaaugcuuucauuuuuuguagagacagggucuugcuauguugcccaggcuggucucgaacuccugggcugaaacgauccugcagccucagccucccaaagugcugagauuccagggugagccaccgugcuuggcccaagaaaaggcagacuucuuauuuagaacuuguaagagagaagagugcaagaugcugggggagaaaggaguaaaaaucgugccugguagggauggauauucugggccugcccuuacgcuggaccuucgggacaucugguaaaccaggcaguguaugguuuguuuaaaaaccgagcuauacaguggagugaugccuuugaagucauguuauuaaggugggaguuugccaggugggauuaugaaggaggagguuauuuccccuccuuccguuagugacuuuuugaggauuuuggggggauugauuccaaguaguguauaaauaagcugaugagaacacccaccauguuucagagccgaccacuguugacuuuuccaagcacagucacgucuacuugcaugauccucugcuuccaguccuguguuccuucugcucucuacccucuuccgcuuuggauuccuuggguguuguccuguguggcuuuugucugacuugauugcuaucguagcagcagaugcaaacuuaccuugagagcugaacguccacaggcaccucagggcuggcuuuugcagagcuguuuaguacaagggaguggaggguucuggugcacuugaaaaaaaagcacacauuuagagcuccaauaagggaaaggaauuuguucucauuauuucauuagugugcacgugcagaauucuugggcuggaugagauauucagccaccugaagggcauuuauguaaagcccauggugugggguugcccggcuggacucaggccagggugaucagccagccauccaaugcagggccucagguggccagaggccauggcaaaacuuaucugcagagaauucaucuacaauguccucugggcuccuguucuugggccagucacugaggcagagcuuuuccuaagaaauaauuaugaaagagguagcaugauuccucccuggugaaagccaggcauugauucuuuugagcacccccucagaggaggagaguguagaauccacgcagugcagcauuuuacagagacaaugaugcagcucugcguagccccaaagcuauugucugcagguggaagcauuuccuaaaggcaagccagaugggccgguaccguuuccuugaaggaaaauggaaggagcugaauacccagcagugcacccugggcagaaaugugcuuuaaaacaggccaguuuaaagaagcaggggaugaauguauucggcagcugaacaugaaugacccuagcauuaaagaaaguaggcagaggguagaauuucagcuaagagaagggaggggaaaggaaguguucucaauucuuuuuucuuuucuucuuccuagcaagaaccaguugagucaucucuggggcuuaguaauggaguaagugaucuuucuccugaguaugcgguccugacuucaacuauaaaaaaugaaguggauaguacggugaacaucauagguaaacuguuuugacgucucauuuuuuauacauaccagcagcccccuggggccuaaaauuuguaaaacagagaacuucaaauaacauagucagugggaggaggucuuggaaucaucucagaaugcaaguuccagcccccagauuucaaggcugagaaacgaaggcuuuugaggaucagauaaaggaacuuagacgggucagccuccguggaagaaggcuggggugaccucccaggaaaaauguuuguuucccggcggcucguggcuagcgaucccagucuuucacuauuugguucacgugggcaaaagaguauuuauuuaacucgggaaccaaggagagggaagaugguccucgcgaguccucucagcaacugcuuccuggcagacagagaaacugaggcacagagacauguugccaaagggcccacucugauucagcagauauuuuugagcaccuucuguauaucagacucaguacuaggagcaggaaauagauggaggaggcccaauuucuuuucucauggagggacagagauaguaaacaaagacacccccagauaacugcaguguuaccaugugugguaaauacugcaaaagaaaagaaaggcgagagaaaaaucaaggcaccaaauuuagauuggaggucucagaggagcaguguuuucccuccuucguaacaguugaacaacuuccagauguagcuagcugcacccccuguaaagaugcaggcucuuuacaaugaagacacaucuucugauguuccuucucuccuguauggccagaugcacaggaauagugcccaaaagaccucagccugcuuucccuuuaaggggaaggagaagaaaaaacuccuuuuuauuuuuacuuucuuucagcauugaauuuuuguuguguguauggugacuucuguuuuugggaaacggaagaagccagcagcaugcugaauuguccugacaggccuccgcuggccucuugccgagguuagcagugcuuuuuuuguauuuaaaccaucucccgggcaguguaaaaaguuugcaggugcggacauucugucugacuggucucggcagugcucuauaacccuguuguguuucuugauaaaacacagccccacccuuuaauaaagcaaagauugcuaugaaaccagagagucuauucauuacuguggaguaacuagagcagucuguagugacuagacauacggcaauuaggaagucauggaguugggauuuuugucuuaauuuuggcugcucaaagugcccccuguaggauauucuuuuuucgggaauuguuuccaaacuugccugucuuuaucuauggugaaacucaagccgcuuuuuaaggcaagccugcaaacccaaguaucaacaugggcuccugaaggcacaggagagcagauucacagcuuacugaccaguguuaggguccccacgagggccacccauuugaacucaagguuggcagacucuggccccagcacuugccgugguuucaggauggccagcggugacacagggcuauggaacccugggucuucaucucuucccauauccuuuguuucaccuucuuuuugccauauuuuauugugcuucagauagaaauuuuauuuauaagauaaaaaguagcucugaggcugggcgcgguggcucaugccuguaaucccagcacuuugggaggccgaggugggugguucacgagcucagcagaucaagaccauccuggccaauauggugaaacccugucucuacuaaaaauacaaaaauuagcugggcgugguggcaggugccuguagucccagcuacucaggaggcugaggcaggagaaucgauugaacccaggaggcggagguugcagugagccaagauggcaccacugcgcuccagccugggugacagagggagacugccucaaaaaaaaaaaaaaaaagauaaaaaguagcucugggugagucuuuagauggaaggcaccaccucuuaggagaucacccaugcugucagcugugcccaugccuucuuccuggaagcugaguuguucaccccuuaggagaaggggccugagacaaggcauucgauuuuauccacaccccuagaaugcucuuagcaagaugaaacuccauaugagaugugaacccuuacaucgcaauaugcccagacacagaacccacaacaacauacuuuauucuuggcuguauuggaccuggagcaccugggcacugaggugagacuguggggccacuccucagucaccaggugccaaccgagagaccugggcaguggaguugggcugcuguguuuucagccuuaagaaguuuuuauuuacucaagaaagcugucaucuuugugugaggcuauauauuauuuucuccuucccucucucccuggcugccgcugccucguuuauaauuagcugucagcuccuccuaucuucccucaccguacuucucaaguccauccccuuguuucugacacugugugugggccugccuuggcugucaccugggcucugcuuccauucugcuccccauuucuucuucucacaaaauaaagaaugccagugucaucaugucaccacugccccuaagagaaggagcugaguucccccagguccccggggucuggcaugaucuaggcccugcccacugcuuucauaccugucuuugaacuugaauuacucugaacgaguuaagcucccuguggcugcucauagagacagugagguugguggugggucuccuuaugguggagcagcugcaaaggcuuuguccacagggcacagugagggguggacacguggcaguuccagcaggagguauagcuccagcccaacacgucucauccacacuuccgcucccagaucauugacccuugagacacugguuaccucuacugaguuuuguuuuguuuuguuuuguuuuugagaccgaguuucacucuguugcccaggcuggagugcaguggcacaaucucggcucacugcaaccuccgccuccuggguucaagcgauucuccugccucagccucccaaguagcugggauuacagggaugcgccaccaugccuggguaauuuuuuuuguauuuaguagagauggaguuucaccauguuggucaggcuggucuugaacugcugaccucaaaugauccaccuaccucggucucccaaagugcugggauuacaggugugagccaccgcgccuggccucuacugaguuuuuacugggauacauccugugcuucccuucguguaguagccugagaugcuguuuucucacggggugcaaggugcacgcugcccugucccacucuugccuccuccugcacucugucacccuggugagguguaugcagccuguagucagggacagccuggcccaggcaccuacagaucccugucucggagucaccggccccgcggugaucuucucucccaccauggcucucgagugccuaaaccaaaucauggcuguauuuuauaccgaaagagcacgagauuagaagucaaaaggcguggguucuagaccugcuucugaaguuuuuuauuuaccaugugauuuugggcaaacuccuuaaucuuuugaaauucaauuucuauauagauuggaaacaauauauaauuauuuauaaaauggaaauauuuaaaauuauauagaaaauggaaauaaucguacugauccugcccaucucgcagaguuauugugaggaugaagugaaauguacagauaaaucacucuggggcuagaaggggguaaaaugauaugauuaucauauuaccaaaaucauauuaaaauauauuugauuaagaaaaguagccuccaucugugccaugucaucaaggcuggugugaaguuuaacuccugaaacuuucagaggggucaggggaaauuucccugcaugaugcucugcugauggccugauuuuuuaugccugcuaguaaguuucauucuugacucugcagcuaccugggugaccuuagcaauuuaccugagcucuggguuucagcuuuuuucaacuguaaaaugguaggaccaaaccaccuccaaggaccccucuguuucuaauaaucugcuuuuaagcacuuucucugaggcaugggagcaaguugcuuucucagguggagaccuacauuaagucaacaauugcuaauaaagugagaaugaccuuuuaaagaagcaaaccgguucaucaguaaccagccauaaauaauauuguuauaauucucagcaacuagauucagauaaaauugcauuccugugggugacucuuuucagaugugcugacuuuaauaaacuggagaaacuuaguggauuucuaguucuucuguuugagaauuucccuggcacacaauagauaacuguugaaaagaaaugucacuauuaguucugagccuggagacucacuaaggugagauucaaaaguuuuuauccugagaggggcuaagaaagcccucaguaacucaguuuggacuucauuaacucucucuguuagggagagcauauuauaaagaguugaaauuuggaguuggguaaggcuaacauugaaucccgguucugcugcugauugucugucugaccuugaauuagucauguaguucugucuuguaugguuguuucagcaugucuagaauggggaucacuauugugccuuccucauggguugugaggucuugggaggugguagggagaggcaaagaucagugcucagaaagacagguuuugucauuauucagucaggacacucuuugguacccagaggagugccacuucugacuguuuacuguagcagguaaguuuguuauuccugucuuuucaccugucaggagucaguguugcugucuguuuugccgcuuggugguccagggaaaucaguucacaugucgagagagagagagagaaacagauagagacugguuagugagaguguugaugcucaucugagagcauuucgauauugggauuucccugcuucucucaugggcuuucacucgagagcuggaaaguuucuaaaguacccacgaugucuggauggagagaagccauugucccuuaccagggcauaaagcaacacacuccuaugggggaauuuggccugagagauaacguaauuauauuaacuugguauccagaucauagcccagaaaacagacugacuuuucucuccuggucagccgcauucaggauacaccuaaaaucugcauggacgugcuuaucuacuuuuuuccccaagucauguauauuaagugaaauacgguaaaauucaccccuuuuaaggcacacgguccuauaaauguugacagacgcacucagugauguaacuaccaccauagucaagacagaacauuuucaucaccccaacacguuuccucccuggccccagcccucgcacccacagccggcugucuuuaucacuucccaaagguuucaagaguccacuugucagaagucuugacauuuuucuagaaaacauuaauugucacgucccguauuugcagauugucacaauccccugcaggacuccacucuggcuccagucagugagccucggccccaucacauguccauuuauucaggggagagucccugagcgccucuccggugggaguugugagcaugugucaugacuggacacaaaaaguucauacuuugguugaggagagaugccauugaccaacucaaagcuccauacggguauauagcguuaaccagcaacuugaggucagaagugucacaaggucgcggcccaucguaguuucggccgagugacggggacagugagugagaggcacccaggggagagaggccagucugugcuggcgggucaggaaggggcuccagaagucaggggcauggugaaugcugccuguugcucaacccccacuccugugccacuaccucauugaagccuuugauuccucaaacuggaaaaaacaccccacuucucuagcuuccauuguauggcccccuucuuuuucuuuucuuucuuuucagugcucacggccuuaaacugacucucuagaugguuagucgcuggccuauagccauguauaugaacuucuuacaaaccggauccuugacugcaucgaucuuccgcugcuccuucuagcccugggaggcugggaggugcaagcagguguuccauaaaucucuguuaguugaauaaccgacuaggacgucauggggagaagcagugagagaaagaauuccugguuggaacaaagggaucugacuagggggauacuugagcugcugccauuguuuguagucccagcuggcuugcccucuuucuguuaggagcaacgugcaaaggagagaugaguuuugaaauauuggaaguuaaaauggcuuugacuuaagucacauuuaucuaagaccuucacugccuuaguaugcaagguaucgcugcgcccucccuccucaaacucucacaccccauuugguuucuaccuccacccaccagcugcuucuuaggacuuaggauagggcaggccauuaucuuguuuuccugccauuuuauuuuacuuggcuggaagaggcagaggaaacuagagagagguugguguaggucagcgucagucugugucuagugaccugcauaauugauguccucacccucacguaggauaauccaaaggaugaaauaaaugggcuugggagucugccugccauauauagccugccugccuuuucuuuaauuuuauccccaccaggaaaaccuaaacaggauccgguuucccuuccauucuguaugcuguggcuuuuggacucuuguaucacagccccaaauccccuuucugagccucuuuugugccuuuccuuucuuuauuaaagaaccuaugaauugccacugcccucuaaaaccuucccugcguagaaaucagauaaugugcuugucacuccacagacagcaauuaaaacaggaaccuguuuauaaacaaaaauacuucagaaaauaaaauacuuggagugauuaaaacgagccucuccaugacgccuggcgucucaaggagacuggaaugcguucuaaccugaauacuuugccgauuggugagaaaaugacugcaacauagagcaccacauauacuccaagcugugcgagucuggacaagucacucucccucucugugccugaguuucuucaucuauaacaggauaacgaugcuuucucugucauccuuauggguuaaaauguuaaaauaacagauacagguaugaguaaaacguugaugaugguggcaaagugcuuugaggaccuugggaauuauuucuucaccuuuauuuauugaagcuaauuuucagggacauuucauccaacuaacagugguaugaggucaguuucauucaaaaugagggcaggaccuuagggaccuucaaauuaaaauggccaugaaacaucaugacuuaccuaugagaauggccaaaauaaauaaacagugaugacacgaaaugcugccgaggcuguggagaaauuugaucacucagacacugcuggugggaauguaaaauggcacggucacuccgggaagcaguuuggcaauuuucuuguaaaauuaaacaugaaauuaccauaugacucagcaauugcauucuugggcauuuaucccagagaaauggaaacuuauauucauacaaaaccugaacacaaacauccauagcagcauuauuuguaauagucaaaggcuuguagcaacucagacauccuucagaggggagaauaaacacacugguacaccuauaccguggaauacuacucggcaauugaaaaggaaccgaugacugauacacacaacaacuugggugacucugcggugaauuaugcugaguaaaaaaaaagccagccccaaaagucuacuguaugaguccauuaauauaacauccuugaaaugaacaaauuaaugaaauggggaacagauuaauaguugcccaggggucauggacaaagagauggauggggagguacugaaggaagguggcuaugguuacaaagaguaacgugagagagauuggucgugauggaacuguuugguguuuugacaguggugguagguacaugaaccuuuaugugugauaaaauugcacuuaguccuggugcagguacacacucacacaaaagagugcaaguaaaacugaggaaaucggaacaagauggguggauuguuauuuaugucaauacucugguugcgauauuguauucuagcuuuguagccuauaaccauuggaagaaguugaguaaaaggcacacaggaucucucuguauuauuucuuacaacuguaugugaguuuacaaugaucucaaaauaaacaauauaagaaaaauauuugaggcaguuuucagagccaggguggucagaauccaucuuaucaguguuccggggagcugaugcuacuaauguuugccagaauuggagaucugacucuauuccauugugcugauauuucagccaguuggacauguugccuguagagcaggaagagagcugggagcguaagcagagcgccacccagcuagauggggaccuugggcauuuaucccagagaaauggaaacuuauguucauacaaaaccugaacacaaacauucacacagcuagaugugacacaauuggguagauuuucauggcccuuccucuuuaguaagguuugauaaugucucccuggauuguagaacccagaaaauaagcacagcgccuucuuuuggagcaagagcagggagcagaaaucggucagguucaaaguacugucaugucuggcccuggggcuggggcuggaugccgccucugguccuguggccucggcugugacgggguugacuguggaauucugcugagcuggaaaggacauggccaccgugcgugccauuggcaggcaugcuggagauagaccuggggagccaagugcuggccggcugcucccugggagacaucacaccagagcuacagagcucaggcguguucuucagccccauggcaggggacagauggugaugggagccuggcgaccuggcucuuuuggggaagacucuuucuugagaaagugugcuagaauugugaggucagcagacuuugcaugauggcugucuuuucuuugaaguuguaggacagucccaucuggacagcaacauugagaaucaagagauugucaccaauccgccagacauuugccaaguuguagaggugaccacugagagcgacgagcagccggucagcaugagcgagcucuacccucugcagaucucccccgugucuuccuaugcagguaagcgucagcgggaggcuccgggaggcgugggaaccggccgcgcaguccuuuggucuagggucacccaucucaccaccccacggagcaucccuccucuguccuaggaguuauucucccuggaguuuuucauacuuuaauuaucuugaucaacaucuucuuggacacuuuuguucucagguagaggacaggaucacagcauuucuuuacucaguuggccaugacauuuuuuauuuauuuauuuauuuuuuuuuuuuuugagacagagucucgcucugucucccaggcuggagugcagugggaugaucucggcucacuguaaccuccgccucccagguucaagagauucuucugccucagccuccugaguagcugggauuacaggcgcacaccaccaugccagcuaauuuuuguauuuuuaguagagacggggauucaccauguuggccaggcuggucucgagcuccugacgucaggugauccgcccaccuuggccucccaaagugcuggaauuacaggugugacccacagugccuggccucccauaacauuuuuauauaugguuacagauaagauuucuuuagggcaguaguucaucagagucuaauuuauuagcccaaguuauuagaaauuuggcagaguguuuuaauggauucucaguuugagcaggcuggauaggaccuuagagaugaucucuuccuguuccuucauuucugaaagggaaggggcuugcgcagggucguacagucagcaaguguuugggccaggacuugaccucagccuucagaccccaagcucauugcuagauccauuccauccaccaagcguacuuguccuuuccacauauuuucucuuucuuuuuauaucuaguacagguucuaauuaggccagaugacugagccauuuccaauucuccagggacuuggcuacauaaugacaggaguuggcccaggcagagucacagggggaggaacagauccaguugguucuuccauucuuccagaguaaaaggauggcuccucucguucgccaacauuacuucaucuucuccucucuuccugaugaucuccauugaauuuuguggaaaucaauuguaauuaggaaauauaaauucugagucaguguuacugcuugcagauauuaaaaauaaaaagcagaguccccauccugggaaacugcaguucagcucuagcaaauaguucagggauucuucccugugcucuuuacacgcugccaaaugggauguccuccaguaggugccacccccaacacuggcuccgaccagcguuggaauuagaguugacucaaaggacuguuguuugugaauuaucagccacuaagucuaaucucauuuucccugaaugccaacuuucuuuuuuuuuucacuuuuaaaaauugugguaaaauacauuaacauaaaauuuaccauuuuagccauuuuuagguacacaguuuaguagcauucagugcauuaauguugucgcagccaucaccagcauccaccuccagaacguuuuucaucuugcgaaacugaaacucugucugcauuaaacacuaaguccucuuuucccuccuccaccccagccccuggcaaccuccugccuauuuucuaucucagugaauuuggcuauucuagguaccuccuaugaguggaaucauagugcuuguuguuuugugacuggcuuauuucacuuagcauagguccuagugugcauuuaugcuaggagcguaaguggaaugugagaauagaccuuggccacaggaagauuauaaucugucaaacaggauaagcuugucuucggugcuuuauucagcaaaugcguuuuggacucuuacacgugccagucccuguuugguccuugccagagugcagucacaagaacuacuauguuuugcaaauuuauugugcccugggaaccaugcucagugcuuggguacaguugacuguuguuguuguuguuuguuguuguuguuaauagaaauaggguucugccuugcugcccagguuggucuagaacuccugggcucaagugaucugcucgccucagccucccaaagugcugggauuacgggcaugagcugccaugccugguaugauacaguugacuuguuuaauuauaauuagaguaacccugucagccuggguaucgucaucaucccguuuuuaaaagugaggaaucuggcugggugugguggcucacgucuguaaucccugcacuggaaggcugaagugggaggaucacuugagcccggaaauuggagaccagccugggcaacauagugagaccacacuucuacaaaaaauaaaaaaaguuaaccgggugugguggcaugugcccguagucccagccacuuggaaggcugaggcaggagcauccccuugagcccaggaguucaaggcuucauugagcccugguugcaccauugcacuccagccugggugacagagcgagauccugucuuaaaaaaaaaaaaaaagaaaaaaaaauauauauauauggaucugcggcuggcguggguagagcagcgugucugagggaggaacgauugggagcacagcuagaacccaugagccguugaugccaaaggccgguccuuaacgcccgcccugugucgcugcccuggacagcgcacgggcucugccguucagaacacagccacaucccgugaucucauuugauuuucacaaggacccaccaaaggaggcagagcagaauguuuaugccuaaauuuuacaguagagcuaaccgaagcgugaaacacucagccacuuugcuuauauuuacauaguuauggcuaaaaacccaugacuuucuucuauagccugcugcugcaggcaucguuacacuccaugugguuuucuuucucucuucuuuuuuuaggggguuggagcuuuagaauagacuucuauguuuaucuguugaguaagacuuuucugaggucuucuuggggauucuggaaagaccucuucuugcuguucugccagcaguggcauuugcucaagcaaaagauuccggagaacagcagauccaugcagagagaaaugaacauuucauuacucucuucaggacauuugcauagguuugaaaggaaggauuucagugccaggauggcagucaacaggagguuuugcuggagccuggcuuuucagccuggccuuugguucuuuccguuguuuucauugucuggauucuccagaaccucguggagggaggcuuacugguuggaggcaaaauguuccaucgcugcugauguucuagagcucacagugguguaaaacauuucccugcuacugacuguagcuaauuuuaguuccuccgucagaaauuguauaacaugcugucaggaaaggcagcuuucugcguguauucaccuuucuugcuuuauguucuccaguagagucggccauuugccuguuuuucaugauggaguuccuuuguuugggcuguucaucugaauuucaaucuccucugaccaccuuuuuuuuuuuuuuuuuuuuuuugagacggagucucgcucugucgcccaggcuggagugcaguggugcgaucucggcucacugcaagcuccaccucccggguucacgccauucuccugccucagccucccgaguagcugggacuacaggcacccacaaccaagcccggcuaauuuuuuuuguauuuuuaguagagacgggguuucaccguguuagccaggauggucucgaucuccugaccucgugauccacccgcuucggccucccaaagugcugggauuccaggcgugagccaccgcgcccggcaugcucugaccaccuuuauucaucuguuugggaaacugguauuuggaggcugcuguuugcuaguuuuucccccuacugaucguugaaucauaaucccaguaguauauuacaaaaccacauucaguuuugcaagucugucuucuccucuguggucuaaauauuaugaugagaaagagaagagauaguacuugcguuggauguuuuaagacaacauaaaauucuagugugauuugugaaacuuucauacuagggagggacauuucaaagugccacuuugggaagcucuggcggagagacaugucauguuuaaaggugcauuacaaagugaccccuugccugaucuguggcaucagaauuuuauuaggugguugaugguuuaguagaagaaaaccacaguagaauaauggggugggggaggauggguaagaggggcuggagaguagacucgagaagaaaacaucaucugaaggacucacuggcuauaaugagagaguggagaucgccugcugaccagcagccaucaguaaaggcuuugaauccuucgggaaaccacaccaggcuugcauuuuguugggcagagcaaagacacaaucgcuuugagauuaagaggauuccgauuugaaaauaauuuacuccuggugaaaguaauugagaauaugaucaauagaaagaaauucaaaucaaacuugcugaacaagagccuuccagaaaguguagcagaaugucagagugcaaaaagccuuucaggugaaaaugcauccucucccuucccgcaguguuccugcuuagacaauauguauauccucagcgaggcguuaaaaacuggacuggauagagagugaaccuacaaccagugucacccuagaacuggaagagcuuuugagaucaucuaauccaaauccuccccuucccucccacccuagaugcuuucaggaaaacugagaccagaaagguuaagugaauuacucaugugccuguugguacuguacgaacaccuucagcuucuucauuuguuuggaguugcuggagaagcaacuccagacuucuuuauuccauuguauucgaaguaaguaauaaacaaaaagcaaaaacaaauucaaacuaaucaaaagggaaaaugaaaugacaacguauguugauaguucgauaguaacacugaucuggaggcccagcugcagucagcucccuuguguaagaagucagcguggaaguggcaaugguggucaaaccaaggaaacagaggacacggggcgcagugcauccaacaaagcacuuggagccaccgauucuggggucacagagagaacugcuccccucagggggagguucaggguucucugcuccuaagcuaagguacugaaggccccuuuuugaaacugucaguguccuaauagggcgcaucuuccugacgacuucagaugcuguggaacuuaaucuagacacgacgcucuuuaacucgcauuugugucagcugaaaacauaaguucggagcauguguaucuuuucuuaucugcagcuauuuccccgaagcugaaaacuggguacuuaaaggaaguuagcaucccggucacauucaugggcggugcaaggucuuacccgggagccuuaccccaggaucugacuuccagccccuccugcaccugcgacuggggcugugcuggaaucccagcccccaaagcaugcuugguugcguaucuuuguuuguauuuggaggggaaaggaaaagaagacagugauauuuauggagagucauuaggagugaagagcaucugaacccguaugaaaggaagagaaagcuuggcuuuggagcacaaagaaagcuaagcauaaaauggaaagcggaucuugaaauguugucagagaccagaacaccagggaagcagggcugcugugugcagugcacaggcccuggaaucagaaguacaguuuuguuuucucuccucugugcugucucaguuggcaacuuuggcaaguuucucaacaucucuguuccucauuuuucuucuugggaguggcuguuccgauuccugccuccucaggauacugagccagcacgaggguucucugaggaggggaauuuucuuuuucuguugguuuucauguguuucugcguggaaacaauucuugugcucggcaacgucagcucaucuucauagcugggaucgucgucagcugaggcugagggcuucucugggucucuguggcucccagcacgggguguuuuggggaaacaugcccaguccgaggaguggagagaucugucuucugcaugcucauggccagcccaccgcgaucacucagguuugugugaaguuacuggagaacaguggcugagaaacaggcccagagacuccaggcugggaccaguggaguccacauucuuacuuuccuuguuuaaggaaugcaccuguggcacaguuuguccauuuguucuuuugccuuuaauugauagagagccuggucuggggcuaaugcucucaguggaagaaagggcucugucugggcuggagccaucucaucccagcucugccaccaggaagaugugagacagaggccagccccucagcagggaccggguggaaagcuggaaggcacuggagcauaagagcucuucugcguaacgggggaugagagcagcugcuugcugacgugggaccccugugagaccugcaugcaaagccucugacauggcacugacccauagggcucccuaaauguuugcuucuuuuagaacacgagcuucacuuuuggauuuucuuguguugugaaauauacgucaccuaaaauuuaccauacuuuuggguaugggguuauuaaauucagcauuggaacuaaauaggaggaaaggcaguuaaagguugccaucaggaagagaagcuauugcaguuacucuuuaggccuugucuguaaaacgaauggcucaggcuaagugaucucuaaaugccuaaauauugcacaggcucugcccucugugauugcauuucucaaugguuauggacacuggaauaaucgcacaccauugauauuuuauuuuacaaaaucaaaauguuuuuacguuuaaaaagcuuuuuauaagcauaggucauguguaaucacuagacuucgauuccauuaauccagccuguugugcaaacccaguguuaagcagugcugauguauggagugugugcugugugccaggcccuugcuaggccuuucccauguacccucucacucacucuccauguaauccucuuagaugguggcagugcccucauuuuacagaggagaaaacugcagcucaguaaaggugagaaacuugcccagugucucacagcuggcaggccaaauggggauggcaacugauuggcugccauagccaugcagccacaaacuuaguggcuugaagcgacacacauuuggaucuuacaguuucuuugagucacgaauccaggcguggcuuagcuggguccucugcugcagagucuugcaaaccugccauggagguguuggcuacagcugcugucucaucugaggcucaacuggggaaggguccauuuccaagcucaugugguuuuggcaaaauuaaguuucuugcagguuguuggacuaagggccucagucucuugcuggcuguuggcuggaagcaguccuuaguucuuugccauaggagccuucccaacaugguugcuugcuuuaucaaggccagcaaggcagaguguuuccucucccagcagguuucugaguuauguaacaugaucauggacacaggaucacauccauuucauccccuuugcuguaucuuauuuguuagaagcagacacauuccauccacacucaagggaggcaaucccaaagaaagugaauccaaggaggugaggaucauggggagcaccccagaucuguccaccuacaguaacccacauggcagaugcaacucuagaaauccaggaucuaaguccuaaaggggugagagguaaaggaaggaucugagugggauggggauaauguaggaagaccuuuuggaaacggucaacucugcacugggaauuaaaugaauugguuggcauggauugaaagacaggacccaugugggcauuguggacagagcugcagugaggagggccccagggaccagcgccccuuccugggagguagugcccaguguauacacagcccggcccuggccaagggagccuccucacagcucucaagccugguuucuccgaagauuacagaguugaaauucacucuagcuucucccauguagaauguuucgcuuuacaaagggagggaggugaugcguuuaguuacucagucuccuuuuuauaaacacugccugagccuggggacagcuugagggacaggaaugauggcccuguguuuuucucucugugaacagaaagcgaaacgacugauagugugcccagcgaugaagagagugccgagguaagccacugcccagccugcccacgaugcugccaaggaaaagccucccgaccagcuccgggcuuuccuugcugcugguuaugcaccuuuccuuuagaucacaagcuucacuuugggauuuucuuguguggugaaauaugcaucaccagaauuuaccauacuuuuggguuugggguuauaaaauucggcguuggaacugaaaggaggaaagggaguuaaauguuaccaucagguagagaagcugugauagcaggaaaagggaauugaaguggaggcugggaaaugccgaugcucuuaccacuuaaacauccuacuucaccggcaaaaauagagcagccuucccagccaaaagcagugaccaguacacgucacaaaaugcuaagcaaaagccucuuccacgugugcguggguucccucccgcugugacccgugcccagagcugguugugugccccaucucgauuccgagugggucccguccccucucccucccauagauggggcgugcacaauggcagaaaguggcuggaauggagauggaaagcauuccugcuggccaccugcugggggucugcgcuugagugaaugagagagagagagggagggagcaagagagagggaagcucaugguuguuugaauuagugguuucccauguacuaaacacuuugagaaaaagugcagggauucugaaaagacagauguacacgcucccauacacccuggccugauuucuucaagguugcagcucuagccacuucucugaaugaagccagcccugaggccgcugcuugcuguacaccguggagcucuaagccgcccccauuugaaagcaaucaaggggcauucauugccugucacuaaguuccucgcugccuuuucucugaaaaugcagguuggcucagguugacugggccagcauugagggaccgagucgcugugccacacuggccauggugaccugaaaccuaucgaauaaucgggccgagccgcagagcacaagggaaccagaaaccaagcugcugccuucuuuuccugccuucacagaguagucuggaaaguauuucugggagguagcaaaugggaauugauuuuuuaaaaaaaaagaaaagggaagaaaaaccauuacuuggcauaugaauagcugggugcaauagauuucaguugagggauguagaggugcuaagccuuuguucauucugcaguucuuaagaaacucagcuaaagcaccaacacaugggaacgacacauuuuucauuuuaaaauuuuuuuuguggguuguuguuuugagacaaggucucauucuguugcccuggcuggagugcaguggcgcaaucauagcugacugaggccuugacuuacugcgcuccagugauccucccgccucagccucccgaguugcuggggcuaaaggugugcaccaccaugccuagcuaauucuuacguuuuguagagaugaggacucgcuacauugcccaggcuggucucaaacuccugagguuaagugauccuccagccucagccucccaaagugcugggauuacaggcaugagccaccacaccuggccagugaugcauuuuuaaaaagccauccaauagaaggagaaggaaauacauaucuuaauuacuuucuugaaaggggcggccacacuggcggaagaggaauauugaaggcaaacaguaccucagcaacauggggacucgaggcuccuaccugcugcccggcauggcguccuucgucacuuccaacaaaccggaccuccaggucaccaucaaagaggagagcaauccggugccuuacaacagcuccuggcccccuuuucaagaccucccccuuucuuccuccaugaccccagcauccagcagcagucggccagaccgggagacccgggccagcgucaucaagaaaacaucggauaucacccaggcccgcgucaagagcuguuaagccucugacucuccgcggugguuguuggggcuucuuggcuuuguuuuguuguuuguuuguauuuuauuuuuuucucucugacaccuauuuuagacaaaucuaagggaaaaagccuugacaauagaacauugauugcuguguccaacuccaguacuggagcuucucuuuaacucaggacuccagcccauugguagacguguguuucuagagccugcuggaucucccagggcuacucacucaaguucaaggaccaacaagggcaguggaggugcugcauugccugcggucaaggccagcaagguggaguggaugccucagaacggacgagauaaugugaacuagcuggaauuuuuuauucuugugaauauguacauaggcagcacuagcgacauugcagucugcuucugcaccuuaucuuaaagcacuuacagauaggccuucuugugaucuugcucuaucucacagcacacucagcacccccuucucugcccauuccccagccucucuuccuaucccaucccaucccaucccaucccaucccaucccaucccgcucuuuuccuacuuuuccuucccucaaagcuuccauuccacauccggaggagaagaaggaaaugaauuucucuacagaugucccauuuucagacugcuuuaaaaaaaauccuucuaaucugcuaugcuugaaugccacgcgguacaaaggaaaaaguaucauggaaauauuaugcaaauucccagauuugaagacaaaaauacucuaauucuaaccagagcaagcuuuuuuauuuuuuauacaggggaauauuuuauucaagguaaaauucuaaauaaaauauaauuguuuuuuaucuuuucuacagcaaauuuauaauuuuaagauuccuuuucuuguuuaucagcaguuguuauuacauccuuguggcacauuuuuuuuuuuaauuuuguaaaggugaaaaaagcuuuuaugagcucauguagcaaucagauuuuccuguggauugauaauaaaugaauaugauauauaguuaaauuuuuaaggggcauca

SEQ ID NO: 15608 - RNA, 4605 nt, Homo sapiens
cgucuugggagcgccggcucgcgccggaagaacgcgagggcgcgcggcggcggcgagguuauaaaagggaagaagccggcggugggcggaagugggcgguucggcggcucugggcgcuguuguuuggucuuuaggccugcggaggggcguuaucuggagggccgcgggugcaggccgcagugacagggccgcucgccccgcuaguccugccugucucccggugcagcuguguucgcggccugcaggcccaacauggcgcaggaggugucggaguaccugagccagaacccgcggguggcagccuggguggaggcgcugcgcugcgacggcgagacugacaaacacuggcgccaccgccgggauuuuuugcuucgcaacgccggggaccuggcccccgcuggcggcgcugccuccgcuagcacggaugaagcugccgacgccgagagcgggacccgaaaccggcagcugcagcagcucaucuccuuuuccauggccugggcgaaccacgucuuccucgggugccggugagugaggcagcgucccuaaccagcacgccucguuuugugugccaccugcagaccggggcccggcgcccuccgcgggaccggccucggcggggaggggaaguugugaagcgcgggaauccgccggcccggcugcccucuaagggggagaagggcgucccugcgaggagccgacaugauucccggacgucugugugcccgguggugugggcgcagcugcugguaggguugcuuguguuagggaacaacgcucuuggggacgggugcgagauuuaagauuagugaggaggugcccugccucccagacccuggggcacuuguuuaugggguuccaggaaacaguucuuggcgguugguucacuuucuugauugcagccaggaaaugcagucccuguggccuguuuuuugcacaaguaggaccuuagaaaaaacacuuuuuaaaaaugacuuuuccuucuuuuucagauacccucaaaaaguuauggauaaaauacuuaguauggcugaaggcaucaaagugacagaugcuccaaccuauacaacaagagaugaacugguugccaaggugaagaaaagagggauaucgaguagcaaugguuagcagaucauagaugugaacauacauaggaguuuagagcauaaguuugauauaauuaggaauuauuguuacuaauuuuuuuaacaagccagaauuuuuauguuauuaauaaguaauaaaguuggaauguuaaaccuaaaguauauaucugugucuuuaggcuuugaauuugauaguuugcuuugacugcuuuagauuuugaaguguccacuguugucugaugcuguuauuuuuuuaauauuagacauucaugauguuauucaacacuguuuuaagaaauuaaugacuccacacuuuuuaaagaaacgauuagucuugaaauguuuucacuuugugccuuuauuuuaauguguauuugucucaucacccguuuuguacgagguauucuuagucacauaucuauguuuuucuucuuuuuagaagggguagaagagccauccaaaaaacgaguuauagaaggaaaaaacaguucugcaguugagcaagaucacgcaaaaaccucugccaagacagaacgugcaucagcucagcaggaaaacaguucaacguguauagggucggccaucaaaucagagagugggaacucagcucggagcucuggcaucuccagucagaauagcucuacaagugauggagaucgaucuguuuccagccaaagcagcagcagcguuuccucucagguaacaacggcaggaucugggaaagcuucugaagcagaagcuccagauaaacacgguucugcaucauuuguuuccuugcugaaauccagugugaauagucacaugacccaauccacugauucuagacaacaaaguggaucaccuaaaaagagugcuuuggaaggcucuucagccucagcuucucaaagcagcucagagaucgaggugcccuuguugggcuccucaggaagcucagagguagaauugccacuauugucuuccaaaccuaguucagagacagcuucaaguggguuaacuuccaaaacuaguucagaggcaaguguuucaucaucaguugcuaaaaacaguuccucaucaggcacauccuuacugacucccaagagcagcucuucaacaaauacaucgcugcuaacuuccaagagcacuucccagguagcugcaucacuacuagcuuccaagagcagcucccagaccaguggaucucugguuuccaaaagcacuuccuuagcaagugugucccaguuggcuucuaagaguaguucucagacuagcaccucacaguugccuucuaaaaguacuucacagucaagugagaguucugucaaauucucuugcaaguuaaccaaugaagaugugaaacagaagcaaccuuuuuucaauagacuauauaaaacgguggcauggaaguugguagcuguugguggcuuuagucccaaugugaaucauggagagcuccuaaaugcagcuauugaggcucugaaagcaacacuggauguauuuuuugucccacuaaaagaauuggcagaucugccucaaaauaagagcucucaagaaaguauuguuugugaauugaggugcaagucuguguauuugggcacuggcuguggaaaaagcaaagaaaaugcaaaagcaguugcaucaagagaagcauugaaguuauuucucaagaaaaagguggugguaaaaauauguaaaaggaaauacagaggcagugaaauagaagaucuaguacuccuugaugaagaaucgaggccuguaaacuuaccuccagcacuaaaacauccucaagaauuacuauaauguguccaaaauaucacugcauacaauaucugguauuugaagagaaaaacugacuuuuguauaguauaaaacacaggcuuucacaaauuuuguauugcuuuuuuuccaguuuugcagaaaauuuacauucuaguucucuucacacaguagcaguuguaaauaauuuaugaaugacaguacacauuaaaagguaugcauuagcagcauauuaguaugcuguuuuauuugcugaagaaaauacugucuucuauuuuuaaugauacauuagguacgauguguaguucgguagaguccuaaaauuuuuguacuacuuucaauuuggugaaaauguauuaaguugucuaccauguuuucuuuucuagcugaauaaaccacaucaaaggaaagggaccacaguauuugaauguuugaaagucuguaaagcuuaagguuuuaaaaauguugcccguaauguugaacgugucuguuaaaaaauaaaagaaaaaauaguugcuucaaacuauuuuuaugagaaguuguaagcauuuuuuagauauaaagcaguauaaaguacuuguuauuuuacucugaaguuguuuaaaauucaccaugacuuugaccgcugaagauucuuuaagcggguuaauuuauguuuugagguggaauacaauuuacacuuuuuucuuaaaaacaugaauguggguuucuauauuaagcauauuuugugacuacuauuaacagauugauuuguuuagauauuaaaugcuuuaagcuauuuuaccuuuucaagaaguuguguuuuuuuucuccaagucagaaccaauuccugcaaauaggcuucccaugacuugucauuauaaauuagacaaccagguaauugugugauauacaucuuuauuuaauuuuuuuuuuuacagcaauccccugagccagaauagauuaaaagcgauucccuucaauuuucaaaucuagaacuggaugguuuuuguguuuaugcaucuuuuagaauaccggaaagaacagagagccguguucagcucuugauaaugagccuauucaauuuaacuacauucguuaaaaugaaguggaauuuuguuuucgucuuaggugauucugccuguuugucugucauuguauauucuguuuacuuugcuucaaacuggccccaagauguuauuuuugugguuucuggcuuucuagauucuauuuuuagauacugcccauugagcaauaauggugauaauauagagagaaaagaaagaccuuucaugggccaguuguguuggaauaggaaaaucaaacguaagcacaauuuaaguauguagcaguuauuccuauuuuguauucuaggaauaaaaagauacuuuaauuuuuuaugcuagaauuacauaauuacauaaucagauguuuuaauuuuaccauauaaccuuuaaaaaugauucauuuuugaggauauuuaauuggauaccaaagcuaaaauccauauacuguaaguggguugccuuuauagauugcgggacacaauaacaugaauguauugugaaagcacuuuuaguuaccucacuuuccucagucuuggaauguguauuuugugggauaaugauuaucagaaaagcaaaaaauuacaacgaacaaauaaauuuauauaauauauccaauuaggugguuugguaauuuccuaaauuggcuuguuucaaguuacuaugaagguuauugagaauguuuuauagugacuuuugaugug

SEQ ID NO: 15609 - RNA, 665 nt, Homo sapiens
aauggcuuuaaucuuuagaacagcaaugcaaucuguuggacuuuuacuaucucuccugggauggauuuuauccauuauuacaacuuauuugccacacuggaagaaccucaaccuggacuuaaaugaaauggaaaacuggaccaugggacucuggcaaaccugugucauccaagaggaaguggggaugcaaugcaaggacuuugacuccuuccuggcuuugccugcugaacucagggucuccaggaucuuaauguuucugucaaaugggcugggauuucugggccugcuggucucuggguuuggccuggacuguuugagaauuggagagagucagagagaucucaagaggcgacugcucauucugggaggaauucuguccugggccucgggaaucacagcccugguucccgucucuuggguugcccacaagacgguucaggaguucugggaugagaacgucccagacuuuguccccaggugggaguuuggggaggcccuguuucugggcugguuugcuggacuuucucuucugcuaggagggugucugcucaacugcgcagccugcuccagccacgcuccccuagcuuugggccacuaugcaguggcgcaaaugcaaacucagugucccuaccuggaagaugggacagcagauccucaaguguaag

SEQ ID NO: 15610 - RNA, 665 nt, Homo sapiens
cuuacacuugaggaucugcugucccaucuuccagguagggacacugaguuugcauuugcgccacugcauaguggcccaaagcuaggggagcguggcuggagcaggcugcgcaguugagcagacacccuccuagcagaagagaaaguccagcaaaccagcccagaaacagggccuccccaaacucccaccuggggacaaagucugggacguucucaucccagaacuccugaaccgucuugugggcaacccaagagacgggaaccagggcugugauucccgaggcccaggacagaauuccucccagaaugagcagucgccucuugagaucucucugacucucuccaauucucaaacaguccaggccaaacccagagaccagcaggcccagaaaucccagcccauuugacagaaacauuaagauccuggagacccugaguucagcaggcaaagccaggaaggagucaaaguccuugcauugcauccccacuuccucuuggaugacacagguuugccagagucccaugguccaguuuuccauuucauuuaaguccagguugagguucuuccaguguggcaaauaaguuguaauaauggauaaaauccaucccaggagagauaguaaaaguccaacagauugcauugcuguucuaaagauuaaagccauu

SEQ ID NO: 15611 - RNA, 7237 nt, Homo sapiens
cagacaucuuugggauuuuguucgcucauuuuacagacauuccuugggcagccccagaaaccuuacaccuugucaggcucugagauguggaggcuaagaacaugugcauucguucugcucuucuggggggcucuaggcuguggcagggauaggcggguaaccaggucauugcagugcauguggaaggagcuaacuaaagggauagguagggaccugugagagaugugggaggagccucagucaguauggggcaggugcuggggcugcgggcaccagcagaggagauuauaagagaacccaucauggaaggauggcugcaagcuccuuaggcaccuagggguggcaguuuugagugggacauugaggcgggaagaacagcauggacagaggcacagaccuuagaagucagugccaagcucuggcgcauggggaguugccagcuggugagccugcccaggagaacugggcucaaguugcacaggccuuggaagcugugcagaaggcuuccacccguggucucugacgggcggccagcagggcucuccgugcacaaaaccaaaugauggggauggguuuuauguagggcagauaucagaggcauuguggagagugggcuggggagaagcggguaaggguggccaguuagguucaugggagguuuguggggggcaguggcugcccuguggugccagcgcucgagauggagaaugcuggggagcagggguguggggaggaugcugaccucugccauggcacaccaggcaaugccagcaggcuagugagauaaccaugaccaguagacaaguggaaauaaaaaucuaaagccaggguuaggggucaggauggagauuaaaaaaugggagugcucaucuucaaugcauuggucucaucuguggaaaugggccagacaucccagaaaaugugaggugacugggaaaggaggcuggugggcaccaaucacugaagggcucgccccaaaagagaugcuagaaagaauggcuggagaggucagaggagaaccaggagccuggggcaagagggugggaagaggagauugauggagagaacugaaaaguacauccgggaucccuggugagcacacuagaugguuucagccccgacggagggagcucagcaaaaagguuuguuccuauugcguuuuuauuugguuuugguugagguuuuguauagacgagucuuuggaaaguguuuaggcauaaaggggagaagcccagaagaagcgaguguuuuugaaguguggggaagcuaggucacgugguggagcagggacagcuauggcaggcugaggucugguaccaagcgggagggcagggccacggaccguguggcagcagcagugugccuuagugggcucacagcucuuucauuuuucugcaacacccugcaguagagagguuuuuccacccucuuuucugcuaaagaaucacauuugugacuuucagggacuaccacuacuuggguuuuagaacugcaggugaggggagcccauccaugucccuggugcuguggucacuuagagaauaagcagcauugucuagcguggaaagucacacaacucgcaguuguugccgaaaccugaagcaaagaauccacgaacauucccagcuucccuuaagauacgaagcauauuauaucaccagggaagugacgagaaugaugagauggaccagggugagacagaacaugcuggaagcgugggauuugcacggcuaccguugccuggccugggguggugagaucaggcagcgguggggccugggccguucugcccggcaccaccccagcugcuuguuucaccuggaaucaggagcccgauggucccuggccuucuaauuuuucaagagaaguuagaaaucaacaguuuucugugaaauaucucaaaugcaggugccggcaacuacuucagguauuuuuaaacaccccaguuagcagcugcgccuuaaggccuccgcugacaucacaccuacacucguggcauuuuuuguucuuguuuuccucuuaugaauugaacaaauuuaaaggacacuguucacagcaguagcucguuccaguguccauaguguucucacuccuccuuuucuucucuauccuuucuuagucuucagaacauccccaccucagcucugguuucuaacccgcaccuccucccccaucuggacuguucuuucgcaagggagaaccagugcuugauucuucagcuaccagcaugccccuugcauguaauaugcccucaagaaauacgugcugacggcauaaaugccauguacagugugaaguucuguagggaaauagacgcacuguuugucuuuuuuuuaagcacucuccucaccugaaaaccgcucugcccugucucagccucuccgcugcuucgggaccagggcaguuacuaccuugcagauaguuccuccuucuccuuucauuugcgucguggugucgcucaucagguugucccugccccggcaugguaucgauguaaagacuuuuccuguuauugugugcuuuucugugagguuacugagaaguuuccagguaggauuuugggccuuuugagucuucugcuaccuaguucggaaacacccauccuagaccaaaccccuacuaguuuaaaaacugucuucuguuggaaguucccugaagggaacuuacgggcuuggucuguaggugacuuccgugauccagagcugcuguucuccuugauacccccccuuuaagcaggcagaggcucuccugauuuuaaauggaguucugcguaaggaaaagagcuucuaccugugcuugcagagacaucacugccacugcaggucuuggggacuguuuuaauggucccagaguauuuuuagcaucauauauaagucaauuuauuucucaccccaacucuagggagaagauugccuacuucaccagagcaaagauaagcaucccaucccugccagcugaugaugugugauuacaugacuuaagaaauuauuuuuucaucuguucacuuucuuagggaggguaaaagacugaagauuuguguuuuuguuuugguguuugguuuuuuuugguaacguaacugucaacucuugaagaacuuuuauuucacaucagauuuucaacacauuaauuuguaaaguaccuugaguguaauuuuuauaugcuuaaaaaagaaaaaaucauauaagaaagaugggauaaccugguacacaaauguugcccaguaugugcgcauugccaguggacuucauuuuguaaaaauggaauagaggcaguaccccacauguguacuguugagccggcuguugagaaacaacuugguucagccggugguuuugcuucuccuuuguguuccugugaguaggcugugccgauggcagcagcgccacgugguaucugugcgcuggcgaggagaggagcgcuuuccauuuggaggcagugugagcacacgcuggagugcagcguuccaaaguccgcccgaaauggaugcugcguccacggccaucaccugugcgggaacaccugguuuccuuaagacaauuuccuuuuuguccuuuuauauuuuucuaaagaaaacuaagauauaaacuaccaagugcucuuaagaauaaaaauaagaauaagaauacaaaggagcacuacucuuggcuacacgaaagaucuugggauucaugacacugagggcagggagaagaaagaacaccagccacgcagagauacaaauaagcucaucaaaugagcagcugguuugucucacucagccugaauuugcauuaaguguucaaaagugaguuucuggcuugcacuaguguuuugcccuaaaucuaaggauggugccuagugguggcccuguguucugaggacagagagagcuggagggguggagggaaaugcaucggcacucauuugguguaaccaagaagagggggaaagaugucuugauagaaucaaaguugccaaaaacaaagaagaguuuaucaagcagauuucuaacauuuaguagaaacuacuucauagcucucauuuuuaggggguucuaucuauaauuuaugguaaauaguugggaggcaaagggaagaauguguguggggggauuauuaauuugaaguauaagcuaaauuguuuauuaaaaagccuauuuuggaugaacaaguuuagagagauaaacugacuaauguguccuccaguuuagaauuucaccuuacccgacccaggcacuucuuaaaaacacagauccucagugcagcucugccagcaucaaggcuuuuaaaauauguaguauuuaggccauuuaaaccauacuuauuacucaauaacccaagaaacaauuuuggguuagccaucuaauauagcaaauaaaauagauuuuuuaaagaaauccaaaauugucuuaaaggaauggaccccuugaagaaaaaaaaaaaaaguuuuguuccucaguuagaaugcucacuagcucacuagcaagaauuuuuauuuucuugaaagcaauuauauauauuuuggaaaguucauguuauuggaauugaaguucaaauuaagcaacuucugagccuagaacuuuaauuacuuuuuccuaaaugucccaacacuuacauacaaauuucuuugaagacauaacuggacauggcagacacugcuuugaacaaaaaccagccuagugaauugacugaguacaguccuuuaaggcugcccaguucauucuauuagaugacuaaggaaaacuagaaaaagaauacaguucacccuugucaaggucaaaugugaaagacagaaguuuauuuaauguagagguaaaugaaggugagcuguuuucagcaucuuaguuugaccaugaaaaugucuauagaauuauguguaguuguuccguacgauuuuauuuucuucauuuauuuauuuacagucuuauuuauguucuguuuaauauauaguuugauucuggccauuuuaaauauuugacacagaagagacuauauuggaauauuuacagcuuuauaagucuuucaucagauuagcuguugacuuuuuguaauacaaaaaguuucagacaaguauuaaagaauaaaaucugucucaggcugguaguuagcaguugugaccaagaugcuuuugguuguuguauuucacaaaauuuccucauuucuaacaugagagaugaacuuauuuuaauauaauccuuuuucuacacuuuaaaagucagcaauaguguuauguauuuauaggcagcuuuuaauaaucuugucauauuuguacuaacccaaaugauucacagugacaaaacauuuuaauaacuugaucacaaaaccauauggacaaauaugaauuuuaauauuauaaauacuauuuuuaaaagguagaauuuauucgcacaggguaaaaagaauguaauauuuaguucucaaguuugaauuaucaguauauuauuacaauuuuguauaucagaaucuuaaguguuacagguacaaaaagaauauugcuagccaaaugaacaaaguuuagcuaaaucucuguagcaugcaaaucaaauaaauuaaaauuuuuugcuauugcuuuaucuauauugucuuaaauaucaaaagcucaggacugaacuuaauauuuaaucagguuaaauucugaacauguuucuguuuuaauuugucuuguuuguaaacguaugcaaauacaucacauagauuaacugguuucugcacuuuccauguguuuguggguggaaaaaaauucagugguuuuuuuuaaaaaaaaaagcaaaaacaaagcuacauauugccuaauacucuauuucagugucguuuauuguucaguuuauuucccugauuggcacaaacacaagaguuuccuugaaccauguaccaagcaaauacaaaauauuucaugaagaaauccccaggcuggcaguuugugaugaauaguucuuguuggaacuauauguauugcugauaaaaaaggacgaaguauuuucauugagcaaauaaaaugaagggcuccagaauaugugcucuguggucgcugcgccugggcuggcagugugcuccacagagaggcagccgucccaggagguuaucuacccacacaccccaguccugcccugccgugccccccacaggcugcucagugccugggaagccagaaacgcugcccgugaaauacagaacacaggaugcagaagcacguuuguguggcagagucuacuugaaucauccaaaacccaagaucgcccuccugccucugacaguauagaaggcgugacugaauguggcugccuuuugaaaaagguuccauagagacacugaggucucugauucagaaggagaugaugugucuacaccuuucaccucugaagcuucuaaagagcuaguaauuauuuuauauaauaagacgucaugcauuuuaaauaaauaugcaacaagaccucaggcuuauuauacuagguuaucuuaaacaccugaaauaaguaaaugauuugccaaaugauuccgcuccauaugaauaauaccuucaaagauacauagagauuaauguuuuauuuaccacuucugugcaaucgcuauuuuaaaauugagaaaacucauccacaguaaugggugucauuacuauucagucuugauugauuuuggucucagacuagaagauaaaaaugguuuaccagucuuggaaagaaacuauaguuuaauagccacaggaaaagaugcauuuucaaaaaucaaaagcacagugagaugacuagagcgggacauccuaccaaauccaguguugagcaagcgucuccugaacagcagacgcuuguccuuucuggcuuaguguuucagguugguguuucucgucuccaguucuugaugaugaucuuguguuugugccacugcguaguggcccgaagcuaggggagcguggcuggagcaggcugcacaguggagcagacacccuccuagcagaagagaaaguccagcaaaccagcccagaaacagggccuccccaaacucccaccuggggacaaagucugggacguucucaucccagaacuccugaaccgucuugugggcaacccaagagacgggaaccagggcugugacucccgaggcccaggacagaauuccucccaggaucagcagucgccucuugagaucucucugacucucuccaauucucaaacaguccaggccaaacccagagaccagcaggcccagaaaucccagcccauuugacagaaacauuaagauccuggagacccugaguucagcag

SEQ ID NO: 15612 - RNA, 11324 nt, Homo sapiens
ccgagagagcgggcgugggcgccaggcgggcggggcacuggggauuaauuguucggcgaucgcuggcugccgggacuuuucucgcgcuggucucuucgguggucagggauggcgcggaagucgaacuugccugugcuucucgugccguuucugcucugccaggcccuagugcgcugcuccagcccucugccccuggucgucaacacuuggcccuuuaagaaugcaaccgaagcaggugcggguuggcggccugggcgggcggcugcgccgcgagagcuugcggguggggaugacuagcccgccccgcugcagucacccggcagggcggacggaagagcgccgggcugggccgggccucgcggucccgcccucuaggucuucccgagucuccagcgccgcucagucucuugcaaguggccuuuacugcauccuccccaccuaccgcuguugcauuuuagguccucccuucaugcagcccccagcgcaauguauuuuccacccugcugcugaccauaguuauggccuuugugcuuuaaucaaguagcagcuacgcuuuucugccugacagucuuuucacgggcuguguacgucuccaccucucguuucuaauccuucacuucuuugcaauuuuguagacgacuaauagugucccagccauagccuacucuuuucccauuuacuuuuuuugccacguguugucauacuuuaccugccacuuagaauucaagguuccaaccuuugcuguacauucacacuaucuggggagcuucucaaaaaucauccugccggggcccaccuccugugacugugaucuaacugcuggaaucagggccacuguuuuucuuuaaaaagcucccuaggugauuucgauuugcagacaggguugagaaccacuaagcuaagguaucaccucuuccaggaagcguucccugacuuaacugcccucguguccagaaugaguuagguuccugccuucuacaccuuguuaauagccuuuacguaccauuaucuuggcauuuucgcauuguacuaugcuuguuucuuucauuugcuuaaugaccagaagagucauuuucagaccccuccuccuccaucugagguugcuaacguauuaacuuucuagggcagaauuggcuccagaauuugguggcagugcauacgauucagagaaaaugaagaagcaggcugugagaaagauauucccagccauaaugagacgaaaagaaauugcaucagccugggcgggggacaguucuguguuuaaguugccuguauugaaagagggaacuugcguaaauacacuuucaagccuguaggugcuguaguguuuaccaaccagagcacccacucuucaaggaauucuguuguuaccagaaaagaaauuguccaucaaagacccuuccccccacacccccaaauguaugggauccuggcucugcuacuuaccagcugugugaccuuaaacuaacugccugaccuguggcucuguuuacuuuucuuuaaaaugagggucgugauuguacaguaccuaccacagaagcuguuaugaagacucaaugaacuaauccauaugaaguccacguuguaauuguuugcuguucaguauuauuaagacuuccugggauagguguuaccucaauacacauaucaauuaugcauauuuuaaucuaaugaugcagaagaaaugugugaagaaggcugcgguuuaguggauuuuuuauuuaacugccuuuuagugguuucgauuguaccuuuuaaaauaaaggaggggauacugauuucguuucucgcacacagaagagauagauauuaguaagugaaaaaaaaaaaaaccuucagcuugcaccaauagccaguuuuuugaguucuucugauaacuaguuaaauaauuuugacucuucacugacuccuuuguaacacuugauaaacuaauguguuaaaaaaucagcuuaacucaguaaaugugaaaaaguuguuaaauuggaguugguuuguugcauuuggcauugaaaaaaaaauauauauauaaacaagcauuauugggauuugauuaacagcguggagggcauuagcaucuggaggcucugcccuggaugcaguggagagcggcugugccaugugugagagagagcagugugacggcucuguaggcuuuggaggaaguccugaugaacuuggagaaaccacacuagaugccaugaucauggauggguaagaacaccguucagguccuauuuauuauguugaguuacauuuagaguuguggucuucugagagcaagaugaaagaaugcaugaguuuugacacagaucaaaaccccuagcuuauuauacuugaccuuucuaaacacaguuucccucucaacugaaaaaaaaaaaucagaguaauagaaauaucacauggagagauagguagucccuuagaacugggagaaugccaagcuaaaaaacuaugucucugaccuuauaaacaaucauuuaucugcuguccacaaaugcugugguuugccugaccugaagccuucaggccccuuucaaaagccauauuuaaaauuagcuuggagaaacugagaauuuuagugcuguugugguacauggcaaguugauuuucuauuuuuuuuccuuaauuuugucugauugugggaaucuauaugaacuucguggaugugcugucacuucuguguuaagaugguggaguuuaaccgcaaaacacuauugauuggagaaaagcaauguuuuuaaucuaugaaccucugaaaacuccuuaauuccuaacugcauucuauuuucuugcagcacuacuauggauguaggagcaguaggagaucucagacgaauuaaaaaugcuauugguguggcacggaaaguacuggaacauacaacacacacacuuuuaguaggagagucagguauuuuuuuaacuacacugaaauuuuuucuagucuuuugacuauaguuuucacugaaaaauaguacaaaaucauggauaaaaccagaucuaaguucaaauuccagcuguuuuacuuaacaucuauugaacuggauaaguaacuuuuaaaucucuuuacuucuucaucucuaagaagaaggcaauggaaguuuugagacggaguuucgcucuugucacccaggcuggagugcaauggcgcgaucucagcucccgacaaccucugccuccuggguucaagugauucuccuaccucagccuuccaaguagcugggauuacaggcacgugccaccaugcccagcuaauuuuuauauuuuuaguagagacgggguuucaccauguuggccaggauggucucaaucucuugacuucgugauccacccgccucagccucccaaagugcugggauuacaggugugagccaccgcgccuggccgggacgagaacucuuauaaugcaugccccaaagguuuuaaguggaucuguuuuaggaaaggcauaaggaaaucgaaggucuaaaaauugagucucuuaaaacuguucaugugugaauauuccuuugaaagucuuuguguagcucacuuaagaugcugcugacccagaaugucucuaguacauauauuuuuguugaaaagacaauacuugaauaauuuauacuuuccuuuuuuccaaucuccagccaccacauuugcucaaaguaugggguuuaucaaugaagacuuaucuaccacugcuucucaagcucuucauucagauuggcuugcucggaauugccagccaaauuauuggaggguaugcacacauuuaauuuaaaaaaauaaguuaauugaaaauauucagugacauccuuucugcucaguguugccugccuguuguccaggguacugguuagcauccuggcuguacauuagaacuagugguuuuaguugacucuccagguauggauguuccugaaacaccucuagcugcauugggugcauauccagcauggagagcuacuggucucucacaauaguuuucaaacugaaguuucugccauguggagguggcugccucaaucagggcugcucugcuuguauuucuuucuaacuaagucuaaaaaaucaguuuggaaacuaugagucuaaaauauuucuuagauuuuacgugcaguguauccaguaucuuguucuugacuugaggacauguaauauuacaugucuaguauguuaccaguggaauaauuuuucuuuaaugagacuuuuggcauaaaucaguuugccuuugccguacaggguccuucugugggauaucuuagucucucaucuauuucuucccuaaguccuaauuacuuucgaguagccaucaagucagaagucccuuggguuagcacuugaaagaggcuaaucauaaaacgaaguuaggggaggcaccuagcgcacugauguguaagacaugaggaauaggaauagguuucuugcuuuaauaccagucuacauacacaaccuaaauuuaugaguuugcauuauauucuugagcccuuuagauuuauaaaggaaucuuaaagcacaacuuagaauauauucacauaaaccuagcuuugaagaaacaauaaaagcuuuuaaaacauauuuuacuuuaagucucagaauucuuuggccaaggaacaaauuucugaaauuuaaagguccaguguguaucuaauuucuuuaaggauuaauaucuaauuuuaaaaaauuuuacuauuguguugagaauuuuagauauauauaaagagagaaauuagggaccugugucaugcaauauagauaccucaccuguauuauuuaauucuuagacuagaauggauauucaguaaaauuauuuaucuuauuuguuuuuauauaagacuuagugauuucuuagcuuuuaauucuuaucuuuaaguuaccagaugucuuuuuuugguuucuugcuaguguuuagcgauuguacauaauuucuuggcaauuucuaaaaauacccuuuguaagaaauaaaacuuaaaucuuguuuacagaauguuauaccagaucccucaaaauacugcggacccuacaaaccaccugguaucuuaaagcaggauauuccuauccauaaagaaacagaagaugaucguggucaugacacuauugguaauuugccuuuugugcaguuuuuauggauaaaguuuaguuaauuaucuuccuguagcucuucccuauucuucuaccagaaguugauuuugauuguuuuaacugccaauuaagugugccucucuauagauagauccaucuugucuuaggaucuguauaaaauuuggcaaauuauuuauacaagacaccuaaaacccaaugacuauucacuugcggauuuuuaaaucuuuauuugacauuucauuuuuuggcaguuuuauguugcuguauuuuagugaccuuaaauaacuuuuuccaaguuacaauguugaaaauuuacauuagucuaugucuuaguuuguuuuucgcuguuauaacagacuaccacagacuggguaauuuauaaacaaaaguuuauuugccucacaguucuggagccugagaaguucaagaacagggcacuggcaucuggcaagggccaucccaagguggaagucaagagaaugagacaggaaaucggguagaacucauccuuuauaucaggaacccacucccugcgauaauggcauuaagcccuuuuagccuaaucgccucuuaaaggccccaccuguuaauaauaauuaauaauguuaauugccuguuauaguggcaguuaacaaaauacccagacuggauggcuuauaaacaacagaaauuuauuucucacaguuacggaggcugggaaguucaaggucaaggcgcuggcagguucagaguuuggagacagcuuguuuuccuggcucauggauggcgucuucuugcugugucgucacgugguggaaggggcgaggaagcucucuggggccucauuuauaagggaugaauuccauucaugggggcucuguccucaugaccuaaugagcucccaaaggccucaccucuugauaccaucaccuuguggaauaggauguugacaugaauuugggggaacacaaacauucagagcacagcaguuauuaccaguugcucaauuauuugguuauauuugagguaaacuuuauacaccuacagugauuuuuuuuuuuuaacuucuaggcaugguuguaauccauaagacaggacauauugcugcugguacaucuacaaaugguauaaaauucaaaauacauggguuaguguuuccaaaagaacagagcucucaaauauacacugaaugcagagcaauauaugccgggugcuauggggguugcaaagcacagcccuagucucacagcugcgaugaaugagugugaaagaaaaugcaguacucucugcugagugccacaggagagggagucacagccagugcuauaggguuuagggguggcagaggugaucucuuuaagcugggguaguuaggaacaccaguaaagugaugcuuggagcucagcccugagucaugguaguugagguucagcgcuccuacuggcuaggaaaguuguguguguauauguguguguguguucagggcucccacugggguguguguaugugugcauguguucagaacucccacuggcuuggaaagaaggggugugugugugugugugugugugcgugcacgcagaacuacuggcuuggaaagaagggguguguguguguaugugugcgugugcgugcacgcucagggcucccacugguguggguguguguguguguauucagggcucccacuggcuagggaagaagggguguggggguguguguguauuuugggguaggggaagugguauuggaagauaagacuacaagggaagacuggggccagauuuaaggagucuuaagucaguugaaggcauucuggauuuaauuuugaaauagaaaagcauuaaacauuucuuacuagaaaaaaaucugguaaaaguuuggcacauuacauaggaagcggaaauagauuauagaugagggaaaccaauuuugaacauguugcaaucaucuggaaauuagaugauaaaggaugguaauaauagaauagucacuguaaaucugugccauccugguauauaccuggcugauaacaaguucuuuuaaaaaauuaauuuuaaugacaaugaaaauuauguguauuugugguguacaacaugauacuuugauauauguauauguuguagaauggcuaaaucaagcuauuuaacuuauuaucucacagaccuauuuuauuauggugagaacacuuaaaaucuacuuagcaguuuucagcugggugcaguggcucacgccuguaaucccagcucuuugggaggccaaggcaggcagaucaccugaggucaggaguucgagaccagccuggccaacauggugaaacccagucucuacugaaaaaaaaaaaaauacaaaaaauuagcugagcuuggugguucgugucuguagucccagcuacucaggaggcugaggcagggagaaucgcuugaacccaggaggcggagguugcagugagccaagaucaaugccauugcacuccagcugggugacagagcaagacuccugucucaaaaaaaaaaaaucuacuucgcaguuuucaaaugugcacucuauuguuauuaaccuuagucagcaugauccgcaguaggccucuggaacuuacccuccugccuaacuggaauuguguguccuuugacccgcaucucgccaggucccccuccccccagccuccaguaaccaccauuuuagucucuguuucugugaguucagcuguuguacacuccacgucugauaacaaauucuuacauaauuaaugcagguuugugaaaaccuuaguuaaaaaacuaaugaagaccuguucugucuuuguuccgaugaagaauuuacuuaaaacgguaucagaggcuaaguggaacuaucccuuauuuggaacagcuuaugacuuaauguguuuuacacucgauuuccugccguaaauuguuaauacccucucaaagccguguaggagacucaccaauaccuggagcuggagccuaugcugacgauacugcaggggcagccgcagccacugggaauggugauauauugaugcgcuuccugccaagguaugacuucuuaguuugugaauuuuagagaccuuuggagaagauauuuuuuucuuuuaagauagaaaauaauuuuugaggcugggugcaguggcucacgacuguaauccuagcauuuugggagacugaggcagguggaucaccugaggucaggaguuugagaccagccuggccaacauggucucgaacuccugaccguuucuacuaaaaauacaaaaaauuuagcugggcaugguggcacaagucuauagucccagcuacucgggaggcugugguaggagaaucgcuugaaccugggagacagagguugcagugaaccaagaucgcgccacugcacuccagugugggcaacaagaaugagacugugucucaagaaaauaaaagaaagaaaacauaauuuuuguauuguguaaccugaauuucugugcacaagagcuucuuagaaacugcauacaaacuuguugccuaucauuuugauaaugauaaucauucaaguuaaguaaucauaguccugugaaauaaaguaguauuucucacccugcuucccagaugagaauacuuaugaucuauuuaguaauugauguaaagcuacugaguaaaggagcugugauaauugaugguaaaaguaggaagugcagucaucguguaccuuuaaccacccuagcuagauguugugcccaugcacacuacuuuccccuuugauuguagcuguuuuucucauugaaaaucuguauucuuuuugaguucuggccauuacauuugacugucgguaucauuacugacaguuauucagccaaagccaaaaauaauauuccacaucugaaauucauggguggauuaguugaaaagauagacucuguaucaaaguggacuugcuuuguggaugcuuuaacagaaguaaccgacucuuguucauuuauguguauucuaucacauguggcaauuuuggugguuuuaauuucuaacuucaaguaacccaauuuggaguuaguauuuauucugagacacuaagguuucaccucuguuucaaucagcuaccaagcuguagaauacaugagaagaggagaagauccaaccauagcuugccaaaaagugauuucaagaauccagaagcauuuuccagaauucuuuggggcuguuauaugugccaaugugacuggaaguuacgguaaguuguguuuggauuuuguauuugugugaacuuccaaauauuucuaaaacauacacuuuuuaaauauuguuuuguacaauacacuauauucaauagaaaaagagacuccuuaagugggcauugaguaaauguucauugaugaucucaagacccacagcguuaaaaauauaccuaaaagccucuuuggauugacugcugguaguuaugacccagucucugacuaguaguucuuaucuuucacaugugucuuaaaugaaguuuagcuucagcuccaguacacguugacauaggcuaaucuagucaaauguuuauacuaauuaaaaauagacaaggauaaauuaucuucccuauuucuuuucuauucauuauuuaaaugccucagccauuuagaucuucucggggcuccaaagaacaaaauguauuacuaauuaguaaaccgaagagguuagcagaauuauuuuugcacuguuugaggcuugucuuucacuucauuuacuuuccauaugagccuaucacaguuucaaagcauuuuaagaucagccacugcugauucucauuagugaauuuucagauggggaagauacacagcuuacugaucaauaugacuuauuagguuggacugcuuauuauuguucuuugaucuuuuacuucccacaguucuauauuugaaaaacuuguuugaggaaugcuuuauucuuuuuuaagcacuaagacacaaaagucaauaaaaauuaugaaggggaaaagcuuuauguaucaaauaaggcaguucuauugauucccucuuaagaaauaaaccuuauuagaaagcucaaaguuggauuuaacagaaugaaaaaaaugauaauuauauaauuguggaugaauuuacaggugacuaguuucuucuauuuaaugaccaaagaggacccucccccagguguuugagcaugagaagaugaacuugauuagacaaagcaucuugacaaauuacucuugacucuuccugugagaguagaagaauagggagcaauggugggguaugggguuaugaaugaaugaugagaauguucuaguggcuagagaaauaaaaugugggagaugugccugaauaguuuuuucuaagaaaaacacguaagaacaguuaaauaaucguagcagugacagcauguguauagaucaacaacaacaacaaaaaccagccaguuuucugaaguucaaagagauaguuuaccagcuaccucauuccuuucauggacuguucacugcucaguucugaggaggaugacacuaguguauuuccauguggcuuagacauaagguauacaguagccagugucuagucaaauaagcaguaucuguauugguuauaaauaugugcauccuauaguucaccaaacuucuuucucauuuuuggccccaggugcugcuugcaauaaacuuucaacauuuacucaguuuaguuucaugguuuauaauuccgaaaaaaaucagccaacugaggaaaaaguggacugcaucuaauccaucuuuacugucaacaucuguauuuaaagaagaaagaaacaaaggcugaaaaggcugcucacucucaucaucuaguguuccucauguguucuaaagucuuuuuguaaaauaaacacaaaaauaaauuuauguugaauuggcacuuucuauaucugaaauuguauuaucuauuuuuauuuaaccuuucuuauauuaucugaagaugaauauguauguggcuguauuuuguauauauuuaaguuuuaagugacacuuggauuucugaucaguguugcaaaaaauugcuacuuugagauuuauuuccacagugauauauuaaacccaaaaggaaucaucauauuuggaugcuuaaaauagaguauacaaguuuuuuagacccaaagaaaaaaacagcagagucucagcaugaucaguccugauugaauuucauuaugucacagugaugcaugucuuagcacugauuauugguuuuacuuaauauucccuaaaaacuugaggaaggaagaugauagaacaugagauacucuuuguuuuguacauacuag

SEQ ID NO: 15613 - RNA, 11994 nt, Homo sapiens
agucuuuuaaaaugcauacuuuuacugguaaacaaaauucauuuucauuagaaaaaaugcugaauauuuauugcaauuaagaaaaaucuucagccgggcacgguggcucacaccuguuauccuaacacuuugggaggccgaggcagguggaucacuugaggucaggaguuugagaccagccuggccaacauagcaaaaccccgucucuacugaaaauacaaaaauuagccggacgugguggcgggcgccuguaaucccagcuacuccggaggcugaggcaggagaaucgcuugaaccugggggguggagguugcaguaagccaagaucgcgccacuucacucuagccugggcguaagagcagaucuccgucucagaaaaaauaaaaaaauuuaaaaaggaaaagaaaaauccucaaacauauguucaguauuuucaugaauuuuuuuaugaaugacuacauugugaaguaaacaauuucccaaauugcaucaaaaacaugcaacaauuuuuugaaacaucucuuuaaacuacugaaagucacacauguaacauauacaggcuucucucugcuaaaagcaaggaaaguuuugaaaugaauauaugcuuguuugcuaccaauguucacagcucaugguuuucccccaugaacccacuucaugucaaugcaaaguauuauaaaauaauaccuccauugacauauacccgaaagauccaaagcucuagaucucuaagcuucagauagaaaaaaaaauagugaaaaauguucauuaucaauuaauagcugggcuuuaagauuaucaucuuagagaaaaagcccagcuuuucaucucuaagaugaaaucuuuaaaaagcccaucuaucaucucuaagaugauaaucuuaaagcccagcuaugaauuggcugacgagacccaccaaagaacuguaaaauaauuccaggaaaggaaacucaaaacccacuuucuuauuacacccuuaggaauuucugaaguuuuuguuauuuuccuuucagaauaaagaaaccaaauguaaucaaucaggggaauaaaaaaauacugauacagauguuugucuagguuaaacuguuagagaaagggauaugugaacacauuuuuaaauuaauucauuucuaaccauaauuacuuuuaaauaagugucuucaaauuauucucuuuucucagaaucauuucugggcucagguauuucuaaucauacucaguuuuguauaagccugaagcuuugugucuuuguagaacauuaugagacuucuuuaaaacacugagacuaaagcaaaugaacugguuaucaaacugaacacaagucaauuuuuuaaauguagaaacugcacccaaaaaugaguuccugagacugaagguccuuauucccauguuggagcauucuuuuucugagcaauuucccuuagucaagcaaacagaaaacuuucuccacauuguacuaguugggcauuuuuacuuaucuuccucaccaaacuccaaaaaaagugggcuugucaaauaacuguaauucaaguaaauuucaacauuaaucucuaccagacuaacagauccacucaucacagaaguaucaugaacuguuaaacugguaccaggucugguuaagacugcaggcuuaucgcacaugccuuuaaagaggacacaccugauuuuuaagcuuugacaccugcacauuuuaaguuuccaugucuaguauuuguacaaacuaaaugaggugaaauuuucagaguguaaaaucuaacagaaauaaaguaaaucaauaugaguuauguguuagacuuucauucguuuuccugucuucauauuacuaacgugcuuuuuuguucaaucucuuugcugaacagauaaauuuuaucaacuugugugguguaaaaggauggccauuaaaguuaacugguccaacucugucauuuuacagauaaagaaaccaagacccugaaaaguuuaaugaaaaagcugggagccaggcaguuuagcauucagguaccuuugaccuuucugcugguuugaaaaacccauacccacaggcuuuugcaugaacuauacaacuccacacaacagauguuaaaauuaauguaauuaaauagugauguauuucacauaagguaaauauaacaaaugucuguaauuuaaacuauucuuagaaaauauuagcccuuuuuggucacugcuaauaguguaacuacaguguuuggucuugcuuuucuaaggguaacugauuugcaguugcuacuuugaggauguuuauuuguccacugcagaaaaaaaaaacauguuaaauacgaucauguauucaaucauguauuauguacugaauuucuaaguuauuuuuacauacauguagauuuccuuaugcuuuuaauauaagugaaaugaauuuauucagagaauaaaauauuaccucgauauaaguuguuggcagcuugaaaauuagucacuuccauauaaaaugggaaaccuuuucuagaauagaaaggguguccaggguaacaaaaauaucaggaagguuuuaaguaaaauuugauuagucugcaaucugagguauaagagaaaggaugagcucagaaaauuagaagaucugaguucaaguuuuaauuccacuccuugcuggcuagguaacaaugaagcaauucaauaaacuucuggguuucaguuucuuaucugcaaagagcuaacacuuauacuacuuaccucauuagauuauugaggaugacauacacuaaaguauaugagugguuuguaaauggaaagcauaccacaauuauuauuaucccaauaauuauuaaaauauagaccuacaaaaaguaguaaauaauucacuuagugacagcaggcaugcucacuagaagaaacauaacucagaggguaaaccaugcaaacauuuuaacuuucaauggcaacgcuaaaaaaaaaaguacaaagcuauaaaggaacguuuuuagagaaagcacugaagacacacauuuugcugaccuaaaagauuuuaaaaugaauuagaauaauuuacaucauauaaagagguauuuagucuuuaaguggagaaaguugcuagucacauguaagaaaaacaaguauuaugggccuuccuaagacaaauggaauaaauuccaucacuuuuggcuuuuuuauaaaccagacuucuaacaaauaaccauauuaauuuuccaguaaucaaacauauccuaaaagaggaaaaagagaaugucuacuuuuaaaucacauccaaugugaauuugcgugaaugcaaggcauaaaauacaguuauuaugacucuacaggcaccugaaaguuuuaacuaccuuucaugcuuacuuuauauuccauaaagaauaauggaaauacagggaauacuucaaauauguauuuuuuacaaaucuguuuuauguaguucuuauucuuguaagauaauauuccacuguggcagccuuguuuuuuuguuuuguucauaauauuaaguagcccauuaaccuuucccuuuaaacaggccuuuugauguuaguucuuauaccaaaaaaaaaaaaaaaaaaacccaaaaccaaaaaacaaaccaacaauacaugaagauguaagggaagagauuaaugagauacaauucauuaaguauaaaaauauguuguuucaaauucagaauaauuuaauaacucuucguuauuucauauguaucuggaaaugggacagauacguguccugauccugucacaagagguagaauuccagcauuugguacgacguuccaagacagggucaaagugacauuccuguuuccccuauaaaaagauauaauaaacacaagucaucagagacacuaguaguucaaaaaaaauuuuaagacaaacacugagaugucaaauacuuuauuuauaaccaucuauuccuaacagaaauccuaauauguuaaucugcaaaaagaacuauuuucucaugucacuuaaaauccaaggacaaugcuagaagacaggggcacuacauuuacugauaucccaggaugacccaucuaaacucacagcugcaguuagaaccaucaaccgaaaaguuuaaaugauuaaaacaguaaauguaaaaagagacgagcuaagaaucagagcaaugauuugaagccuaacucugucaauuaucuagauggacaaaccuuaacaaaauucucauguucugaaauuuucauugcaaauacagacguuuggcuuggucgaaauagcuuucuucuaaaauuauuuccaauguuuaccacuagagucuaagagguaaaaauaaccugagagaucaaucacacugacuaaaaugagcuuuagagaagucacguuuggagaaccaauacuacuucuuuuaacuauuaucaacuccuagacccaacaugcugcuucuaagguuucccgacucacgcucagaaaggagcccuuugauuugaccaccacagcccuaccgcaucugaacaagcccguauuccuuguacacgcuuaggauagaagcuuuauuaguuugacuaugacauuucagaaacugcaagagaauugcuuaucuuagaucucacuuugcauuuccacccaaucuuucaguucagauaugcauaaauacuucuuucccaauuuuucuccuuuuacucucaaguauuuuucuuuaaaauaaaaauacaucuuucucucuuuuucaccucuuauuaaauguaaaaaaaugaccaagaauugcucacuugagaccauuuccaucgucaaagaaaaaauauuuuguuuucauaucuuucagcagcagcuucggauuaucaccucucaaaacaaucuugucccauaggacaacuugguucagagccuauauuaaaaugaaaauuaauuagauaacucaucagaaauaccaucuuaucacuucaaauuaaaaguauuaguaagcaaauaguuugacauguuaaugaauucaacuugaggagcuugcugaaaucuuaaugcauacaaaugauagcaaagagagagauacaaaaaaggggcaaacuuuucucagagagaagaaugacaauucccugaaggaguucauuccuucugcuaacucaacuguauuacuuagugccuucauaacuuaaugcaagguuuuugaucuauaagaucuccaaaaagugaggccuuuggaggaacagaugaauuaaaucccuagaagggaaguauucuuuuaaaucacuuuucccuauaaaauuucuaagacccuccagcucagcauggauccuaaauggugccaggaaaacagacaagagccaaucccuguuccaucacacugcuaauacagguuacugcugauuaauuaugucaugaaaauuuauaagaaaucuucuccaagauuucuuuacaaaagcuuuaagaaaucacuaaagaaaugaagccuuuuaaagaucuuuuuucccuuuaauuaagaaaauacaugcauuguugucucaucaaggcaaaauucuagaggucagacaauucuuuuaagcuacucuuucaacauauuacaaauaaguuccauuuagaaaauuaaaaguaugaaauggaaauaaaaaaaauuuguggccacuacuaaaucccaaggaauuugcucuuauuaaguuagcaucuauucgcuuuuaaggccaauuacucaguauaugaugacuacauuaacuaaaaagaaauguagagcaguuauuucuuccuuuuuuuuuuggagauagagucuugcucugucaaccaggguggaguacaauggcacaaucucagcucacugcaaccuccaccucccagguucaugcgauucuccugccucagccucccaaguagcuaggauuacaggcgcgcaccacuacgccuggcuaauuuuuuguauuuuuagcagagaugggguuucaccauguuggccaggcuggucuggaacuccugaccucaggugguccaccugccucagccucccaaagugcugggauuacaggugugagccacugugcccggccugaacuaguuuuuuaaaucacaaauuauaauucauaauaaguuuuauaauuaaaagcuauuaaaccauuauaucaaaaccuauuaaaacuauuaguuuaugauugaaaguuauuagcaugguggugggugccuguaaucccagcuacuuggggggcugaggcaggggaaucacuugaacccaggauguggagguugcagugagccgagaucauacuacuguacuccagccuggacaacaagaguaaaacuccguguuaaaaauaaauaaauaaaaacaacaacaacaacaaaaaaccaguucaaguacucagauacucagauuaaugaaucccaugcaacccuaaaacaaaggcaaauuguucucaauagguaaggauauuaauuaauuguagcuauauggcuuaauguagacuaccaaaaacaccuugcaccauguucuuuuuuuuuuuuuuuuuaaagaaagguaucugguacuaagauggauuuuaaaauaaucucagaagguuugaaaauuauuaacaaucuuuacagcuuuugauuauauauagucauaaugagaauuauaaucacaggucucaaauuuuguugauucaaguaggucaccaugcagcucucuaauugcagcuguggagagagaauauuuuagcuuaaagaguaaacaacggccgggcgcgguggcuuaugccuguaauccuagcacuuugggaggacgaggcaugcggaugaccugagguuaggaguucgagaccagccuagccaacauggugaaaccgucucuacuaaaaauacaaaaauuagcugggaaugguggcaggcgccuguaaucccagcuacucaggaggcugaggcaggagaacugcuugaaucuaggaggcaaagcuugcagugagcugagauugacggcgcuacuguacuccagcccgggcuacaagcacgagacucugucuuaaaaaaaaaaaaaaaaguaaaaaaaaaaaggaaacagcugagugguggcaauacuaccggcuacccacuccauuuccuaguugauaguucagcaauaucuuucugaucuuacuauuguuaauuaauaucauugacagugucucagccaaguuaucagaucuaucuagguugucuuuguguuuuuuuaauccuucagugugacacagcagcucagaagaggaauacaaguaugagcuccaccauuuuccuacuguuuacauaugcauggauuauuagcauuaucuucaaucugugauuucuuugcagaaaucuuuuuaagccacuuuuccauuuugaaaggauuggcuaaaauuuuauaauauaauccacuuauguauugcauauacugcaauauuuuacaacaugcugaaagcaaaugaauaaauacuagguagcauggugaacuucuugaccuacagaauuccuccuuuccuccagaauaucugcauauuguagaaggcaugugcccaucuaucugacuuaagggcugaauaugaacauuaacgucuguucauauagcaagucuccauucuggagaccccaaugcuagagagcuaaauagaacaaacagaaaacaaacaaacaaacaacaacaacaacaaaaaggcucccaaaagaucaaauguuuucauaacacagcuaccuccacuggcuugugauguuuugcuagguaacucaggucagauauuuuaaauauauaaaaauguguauucuuucguaaagaguaagacuuuaaauagcuauuaaaauacuucuaauuagauauacuuacauuauuuuuuguugaauauucugcugauaaauaaagaaacaacugcuuaacauuccaaucaaauauauucucuagauguaaguaaauuaaggaaaauauaaauuuaugagcaguauaucacuuuuaaauagaucuuaauuauucuuagguuauuuauccauaacaguaauacuaaaguagaaaagaggcggcccagaaacauaaugugccacuaauuuaauaaaaauaugcagaagauaaauacauugugaaauccagcuuauuccaaaacaaaaaaaugucaguaugagauuacuggcauccucccauacuccuccaaggauuacuagcugagauacuuugacuaguaagaaaagaacaaauccaaaauuugguuuucuguaacaucaacuaaguuaaaaaaaaaaaaaagaggacucgauauuucaagcaaauacaauuccacuggagcucuaaaguauaaacaaucaccaccauuuaaauuuaacaauaugcaaacauaaacaaggcucaauaauuaaccaaguauaauaaauuguacaugucacuuuuggucacaugcaaguagacauuaaaaugucucucaaagaugcaaaugacaccaauguggcucaauucagucucccaaagaggacaagaacuucaccagaauuaacaagacuggugccaauaccaagaaauaagcggaguuaauauuuggauuuuuaaguauuauguuaauuguuaaguuaacucauuuuacuauaugaguuuccacacugguaguaacacauuuguuacauuccauuauuaauuauguguaaccacuaagaaucacuccuuuagaacuaagucuaggacugcuguuuacaagaacagcaacaauuucaaguaguaguagcagcagcauuaagaaaaucugaagaaacuacaaauaaugagauugguaauauauaaauaccauagauaccaggaaauuucacuauaauucucuggauacacaaaauuacuacccucacaguagaccuaaauucccuuaagcagauuuuuaaaaauuacacaaagacuuaaaaauacacaugaaauucagcauaagacucuuccgaugguacacucuauuuccuaaaaagguaccuacagaacuaauucuuagccuauuucuaaauccaauaauuaccaaaacuuaagcuaaaaguaaauuucauggucauagaaaggcaaauuagauaaauuccccaaguauaugaucagcuuuaacuguucagacagguacuuucacacaaguucagaucguucaaucuccacaaccauuuaaaucacgggguauuaaaaaggcagaugaaaucaggcuagaaauggcagagaacauugccaagauauuaaccuaagaaagacccuaaaaaagacuagccuggccaaaaugaucagaguugucaaaagauagaaacucaaucucaagagaaaauauuuaaauaucaccaccaaagaaacucuuauaauuguuaauauuuucugacuuuuauaaaaguccuuauaaaaagaguuaugacggcaaaaagcaaccacagguuaccaauaauuuugauaugaccuuuucaaaucauaacacacguaauucacuuuuuaaacauauguuucucucugcuauaauaaaauauggauauauuauuugaaauuguacaugaaauauucacaggcaggcugagcauugguaauauuuuuccuucuuauccaaaugaucuaauuuuauuuuuucuuucuaaaauacagauucaaacuuucuuauguaguuuucaaucaauuuaauguuucgguuaagaauuuaaaguauguucacacaacuacucaugaaucuaugaaguuuucuccaagugucauggggagguauuaacauuauuuuacugaugaaaaaggcggaauuuccaagguuuggcugauucaaugagauagucacacuguaucccaaaucauuaaacaacacauaucucauuauaaaacuacagaaaacgcaacgaaauauuuucuuaaaggauaucagcaguuauaucaaaugugauaaaucccagaucacuucuuucucuagguccagugaaaucuucuacauuuuuucuaggaauaaagauaaaaguuuuaccauccuuccaacagaacauacacaauucacguaacuucuuaaagagaaagaauacaggugugugcauaggugaaacugcaauuccacaaagaaacgaguaaacaccagagaaaccuguaagugugaaaacaggagaaacauucuaauccaauauuaaaguaggucuucagcuaauugcauauaccucaagagaaucccuaacaaaacucagaaggggauaaaaacugcuaaaaagaauaguaaauacuugauguaaagcaauuuugcagaauggguagaagaaagcuacacaugacuacaaggugauacgaauacuaacagauggcauauuaaagggugauacaguaaucacccccuuauccgagguuucacuuuccgguuucaauuauccgcggucaaucuggugugaaaauaggugaguccaguaaaauaaguuauuuugagagaaggggaaagagaucauauucacauaacuuuuauuauaguauauuguuacaguucuauuauguuauuguuaaucucuuauugugcuuaacuuguaaguuuuaucauagguagguauguauguacgguauaggaaaaaaccaaguauauauaggguuuggugcuauccgugguuucagccauccacugggggucuuggaacguauaccuaccccauuaaggggauacuacuguaaccagcugcuauuuacuguuuacuacggcucagacccacugacaauauuuuucacauuucaaauaauucucacaaccuaaaaauuagguauuacuuccaucuuaaacaaaaagaaauuaaggcccagaaugguaagaaaacuugcucaagacaacaacagcuaacaucuguucaguguuuaauaugcaccaagcucuucuaacccucacagggcugacaauggcagugcugauguccaccccaggucuauucgaacaauaucuaacaaacaucaguacaguaauuuaaaaaaaaaaaaaaaagguggggggagaaggcucgcuauuugauaacuggcuucuuggcgauucugacaaagaaauaaacuaagguuaaagaacuuguguaagacggaaauagaguagaaggguaugagaacaagagauggaaaaauacgacgauuaaagacaaaagugccagagaauaaaaucaaggacaaaauaggcaauagcgaaauggcacugucauuucgaacugcauuuuuuggcguuuucgcagacuucuucaagugguuggcaaaagaaaaagaaauaaagaaacccaacaaaacaaaaaucucgcuguaucagaaggcuaagaugcuuaauucucucagugcccaacaucucuggccaacuucaaagcagcuccaacuguuuacugccuucugaaggugcaaaggcaacaacuguaaagggaaugucaaacagggcaaacucgggugaugaaugacacaaagacaaccccguccuguggccuccagagccgccaggaaaccccacggaagcccgacccagagcgcggcggcagcgccuggagggccucgcaugcggaccacgagcggcaccggacgcgcgggaggcgccagcccaggcgggcggcggcgccggcucugcuguuguguugcucccucauuggccaggcguggguggagggaagugaggaacaggaagcaagcggaggcaccgaccugaggaacgcucaaaauuaaaauuuaagagcaagcccgggaauuuacgguggaggggugcaaguuccgaggggacgccggaaaagccugcgacguccaccccugacgaccgcccucgggggcgaacugccgcucaggagggcgauccggacgcccugcccgcggccccggcacggcagccccggcgcggcggcccggcuucggcuuccgccccagcccggucccggcguccugcaccgccggcccggccucacucacagcaugauccgcgagacgugcagccgcaccgggacgcuccugucuuugaaggcgguggugaugaagcagccgaaggugagcgccgccaucacgcucagcgagaaggcgaacagugaguucgcccgcgacagcaccguguucaucgcgaucgucucccacgaguccggacuccacacgcacacccaggcucccguuccggcggcggaccggcucccugcgauccgcgccgucugc

SEQ ID NO: 15614 - RNA, 6654 nt, Homo sapiens
aacuauaauaguaauaaccuuuauuuaaaauagauuuaauuuaggaaagcucauuuuauaugaguuuccaacuaauuauuagagucagaaacaaagaaaauaaaaucagagaaaauccucuguagaaaaaauacacaaagaacauuucuacaugugaaaaaacaguaaacaguguuaacauccaaguuauuagucucaauuccacgucuccuagugaacaccacuaucaaccuugagaucugauuuguucuugucauucuucacugaguagaugaaauauguuaaggugucuuuuucauucacuggaauagaccuaaaguggcaaccaacuaucuacaaagaaaagaaaaauuaaggaaauuaaauuuuagauauaacagguuucauaaacuacguaaaaaauacgguuucaucaaaagaaaaagugcuaugugauaagggcuauuuccuuuaaaaauuauauuuaacaaaauaucaacaagacagaaagcauucaagaauaaaauguuacgaacaagagauagugugauuucaaaggacccuuugacccacucaauuuaauauacauugauuagaaaauauauuuuccuuuuauuuauuuuaaauuuuauaauugggccaggcgugguggcucaugccuguaaucccagcacuuugggaggcagagguggguggaucacuugagcccaggaguuugagaccagccugagcaacaugacgaaaccccaucucuaccaaaaaaaauacaaaaauuagauaggccuggugguguacaccuguaauccuagcuacucagaaggcuuagacaggaggauugcuugaacccagaagguggagguugcagugagcugagaucaugccacuggacuucagccugggcaacagagcaagacucugucucaaaaaaagauaaauaaauaaaauaaaaauaauaaauuuuauaauuagaaucuagaauagggaauaaaugauuuuacuuuuaaacuuuaaaugagauaaaacagacguaagagaucacaugcaucauuaaaccugcaaugguuuagacucuacugauagaaaaagaaguaugaaguugaaaacuuuugcuaguagagaaaccaacaauaacauauaaauuguuugcugcaaauuauauucauucauucacaccuugguagcauucuuugguuaagguuccuugaaaauuuuucugaauaaaaauuaugaauggaaaugagaggagaaagagggauguucaaugaaggauguuuaccugcuuccuugcuuuuucauugugcuaacauaacaugcauacuacaauuacuaauagaagaauaauagacuuaccuggggugcugacaugcauauuuagauuccagaaaauaaaauuucuuaagaaaaaaguucauccacacaauaauuaagagacuuaagacuuagucauacaacccuggauucccuuaaaacagugguccccaaccuuuuuggcaccagagauagauuucacggaaggcaauuuuugcacagauugaggguggcggaguugguuuugguaugaaauuguuccaccucagaucaucaggcauuagauucuuauaacaagcauacaaucuagaucccucacaugugcacuucacaagaggguuuggacuccucugagaaucuaauucuguggcugaucugacaggaggcggagcucaggcaguaaugcuugcuagcuggugcucaccuccugcucugcggacccguuccuaacaggccaccaaccaguaccaguccauggcccugggguuggggaccccucucuuaaaauauauguacuacaucugcacauuccuuaacuugcuaauaucugcauuucugauuaaguaaaauauaacacucauggcuaucucuuauguauaaaaaagaaaauagcucuggaaauaauauaacuguucuuagaaggucaguuuaucaaaaauuacagguuuaauuuauaccuaaauauaacauuuaaaauaaucaguucuuugguucucauuugucccaaaacaggggugccuucacuccauuaguaccuauugaaauauuucaucauggugggcaauaacuauauuuauguuacauuaauguauuguacaaccccaaaagaacuugaucuuuuaaaucaaaauuaaagaaaaauuaauuagaucuguguugcccaaccaaggauaaaaaauuuuagcuaaauaguuaauauauuagauuuuaacaauguuaaaaagcauucugccaaauaaauguaacuucuauucauauuucauuuuauucaauaggcacauuuuagaaaauguuggguaacuacuaaauccaugcaaagaauaugagaaaacugauuuauauuucuacacuucuauuuugucuaguaggccaaauuuucuuuuuuuagagauggaguguugcuauguugcccauggugacucaaacuccuaggcuuaaucaauccuccucaguagcugcaaguaaaaauuuuuauuuuaaauaugauuaaaauauauauauauaaaucuauaaacaucuuaauaagaugcacagauuucuugguucuauuauauccugaaaacauaugcaugcuccguuaacuuuucacaacucagugacugacuagaaguccucuaucaaagcaaacuacaaguaaaagcuuggguaaaagaaaagcuuuugccucuucuagaugugaaaaaaacauggaugucucuaauaaaacaaacaucaacaaggacaaauuuugaaauaguuaagucagcaaauuauaaaaauacuguuuagggucugauuuguaggccuauuccaccacuuuaaaauauaaauucuaauaaggacauuaaagcuuguuaauuaauuuuauuaugccucaauuaggugcucaaauguuuacugguuaaacggaguuuuaaaauuaauagauuucuaaagugaggauuaaaaaaacucucauucaacauuuugagggccaggcacgguggcucacacugguaaucccagcacucugguaggcugaggugggcagaucacuugaagucaggaguuugaaacaagucuggccaacauggugaaacccuaucucuacuaaaaauauuauacaaaaauuagccuggugugguggugcacaccugaagucccagguacuugggaggcugaggcuggagaauugcuugaaccugguagguagagguuucaaugagccaagaucaugccacugcacuccagccugggugacagagugagauucugucucaaaaaacaaucaacacauuuugaaagccaguaucagaaggugcuguacacaaucuacuaagcagucauuacaaaaaggaauuuccuaaguggcagacaaacauuucuacacaacuagauucuuccacaacagauuuuuuaacuuuguucuuucuaauuaaaauguacuguuacauacacuacauuaaaacuuccauuagcacuuaauaaccucucgguugugcagauaguucaaauaguuuaaaacucauauauaccucaacaaguugugcuuuauuaaguccuggucugguugguagcuugaagugucuuuuguaucuccuaaguguauuuacuuguaauugguauaaaucaaccuagaaaaaauuaacauguauaaaugaguucauacaauuuguugaaaauuuaucauugauauguauaauaacaaacauuuuaacuucagcacaauaaaauuuacuuccaaaaucaaaaaaaauuuaaaaaauuuauauaauccaacauaaauuauuaaagaauuuaaucuuuuggggauaaauaauauaaacugaggucaaaaaaagaguaaguuaugugacaacagagcugcaaaaauugucaaucuaaaauguaacaauucaaacuguguaaaugcaugucaacuggcuauauuuaauuuugcuuucauuuucagauuucucaaauguuuuaaacacuuaaaagauuguucauaucuuuuuauaaaggcuucagaaugcacuacuuaggauuuacauuaagcauaaaaaacuuccaucuaccucugggguaucaauaucuugaacaggugaaucaccuccaucaucaucacucccuuuucucuuucuucuguuucgaacacucugaauuaaguuuuuaugauaaucacauauguaaagaugccuugccugaaacagaaaaguuuuacacacugcuuaugauuacaguaaaaugugucuauguauuaguaaaacacauaugccacagugaguucuuaaaaauaaagacagccaagaugggccauuguuaagauaauggaauauuuauacguuuaaauccuauacgcuaaaacauaagaugucuggaauacuguuaaaaggaugguggauggggaaggagggguugguuccaucuggggaaggggguaagggagggagggagaggagaaugagaaauuccaacccucuggguuuugucaucaaauugcagugaggggcugggcgcggugguucacgccuguaaucccagcacuuugggaggccaaggcggguggaucacuugagcucaggaguuccacacaagccuggccaacauagugaaaucccgucucuacuaaaaauacaaaaaauuaggcgggcaugguggcaguagccuguaaucccagcuacucaggaggcuauggcaggagaaucacuugaaccuggugguuggagguugcagugagccgagaucgcgccacugcacuccagccugggcaacagagugagacuuugucuuaaauaaauaaacaaacagauagcaguaaggaugaccugaauuaguucauguugaauuuuuaacugaugaggggaaagaugauguugcucacaguuuugcuacuugacaguacuuucucuacuuaaaagaacagcauauuuuaguaauauaauguaugcuuuccagucuuucuaacugaauacccaaauuauaguccagauacaaaaccauucguuuucacaaaugagccaucgacuucaaaacuauauuuaaauuucaguuauacauuuuucugaauauuaaaucaauguauuuaucuauaacacauuuuuccaaaacaaucugaaauuaugcaaguucaccugaagaguuucucauggauaacacugaaaacuguuuaaacgggcaaaaagugucacaaauaaacuuuucaaaaacuuuaauuacauauacuccugcgagcuguagacuagcauuugaaacaaacacggacugagcuaacaggcuuuuacauuuacuucuaagccaagcgcaagauaaaaauaugcaggacuugugguagguucucgauaccauguuauucauuuaccgcuagccagaucucccaaaaguagcaacggcuguuucuaaaaaccucauagauggucaaacgaaaagacgugcaaaaaauccugauggcugccaaggggauggcaaaaccgcagaggcuacgugcuccccaccaucggaguagcugcccucggagcugacagcgcaaacgccguuuacaaccccggcucacugccaggcggcgggugagcucggcuucccucucacuccgcuccggaggagacggaacacagaaaagaacaggaucuuccuuguucgugaagguccuccgcuuucuccuagacgacgggauuuaguaccgccuggggccaaacaccagcuugggcagcaaaacaaaggcgccuccauuccagaagagcugccgggcugcaagaaaacuacucugggcccucagugcgccgguccccuuuguuucgugucccggucgcagaggagaaggaagagggaagacugcgcgggagagacgcaggcagcgggagguugggggccagggugggaaagaagaggggaacgacagccugugugugguguguguguugggguggcgguaggaguugcagcgacuuuguuauuugcuuccaaacacagacuccacgagaccgcacugcagccagugcgguugucugggggaccccgccgacaacccgugccuuugcccggcuccuggggccccaccgaggggcgggagggcagggcggucccgcgguuuacuuacgcucuuauccagcucgaucuucaccuucuucugggagaugcucuucuggauccucuugcugaagcuggcguugccugccgcccggccgcaccgcucaccauccucccgcaggcagcacaguugcccggggcccggcccggccgcccccgggggcccagccgcugagaccgcccccgcgcccggcaccucagccccggugcccgcgccggucccguuccccgccgaggcggcggcggccgcggcagcgaccacugcggccacugcggcggccgcauccccgccgcggcucaucucgucaggcgugaagccguucaugucuccgagcucccgaggccggcgcugacagaaauccccucucuccuggccgcuccgccucucuccgcuccggcagcggcaauucacucugcacaccaaguuagacagcggcacggccaaacaccaacugucccgggccugcuggucucugcuggcaccgaaacaguggacagugcugagggccgggacgcagacucgagcgucuccuggagcggggaccccgcucacugucacauggggacuucagcaguuggaccgcuacgccuccgccucccuccggccccgggaccugcgcaagc

SEQ ID NO: 15615 - RNA, 6319 nt, Homo sapiens
uuaaacauaaaaaaaaaaugaaacucauaauagaaaacauuuuaucuauaucagaauaacaaagacuaagaaguuugagaacuauuauguugcugagaugaggaaacaggcacuccaaaacauuucauugcuauggaguguccacuccauagcguaguacaacuucuauuguugagaagcaguuuuguuuagcaggcuccauuaacagcaccagagcaguuucuggcauauauuaagcacagguuuuagcuaguauaguuagcacauuuuuaaaugugcaugucuuuuggcccaccuacuucacuuguaggucuuuuuucacaugugacaucaaaugguuucguuuuuuucagaccaagucuuggucuguugcccaggcuggagugcgauggcaugaucacagcucauuauagccuagacaucccaggcucaagugauccaccucagccuccuaaauagccaggaccacaggcaugcaccaccaugcccggcuaauuuuuguauuuuugguagaaacaaggucuauguugacuagacuagucucaaacuccugggcucaagugagccucccaccucacacucccaaagugcugggauuauaggcgugagccaccauacccagcaaguguucucuaacuaaaaauagaaaaaauuagccaggcuugguggugggcgccuguagucccagauacuugggaggcuguagcaggagaauggcgugaacccgggaggcggagcuugcagugagccgagaugugccacugcacuccagccugggugacagagcgaaacuccgucugaaaaaaaaaagaaaauauguauauaaaacaaaaacaaaacaaaacccauaauuauccuauuauccuuagggaacugguuaaauuaugaucuauucaaugggauaccauacagauagcuauuuaaaggaaaauggcagcucuguugcucugggguacugaaaacaaucuccaaaauaaugagaugaauacacuuguauauaggaagcuucuauguaacacuguaacauauacacacauauauauuuuuuacaccuaugucuuucuuaaaggauagauuauugcauuguugguguugccuccugggacaggguagcagaaucaagaaagaguauaaacuauuacauauccuuuuacauucugaacuauuaagauaugaucuauuuuuaaaaagaaaacagguuucacaaacacacuuccaaguaguggcuggugugagaucuaauucuugcccucauuuuaguucuuuccaauauguucacuccuugaagucaccuggucuugauuauugagaauuuggggaauuuugauccacacuuacaagaauaucaaacaugagccaggaaggauccaucucaaauccugaguucauucuggaggaacucuugauuaaaagaauaguucuuagcuuagaaacuuaaaaguauauuuuauggaaaagauaaugaaagaagucacagacucccaaaaagaaaggugacaaggaacccaacaggucugccucuuggaucuaauuuauuuagaaauucuuaaauaaacaaacuuacuuacucuauuucaguuuuagaaacucuuauucgauauccuuuaugcaguaguuacuacuuuaaaauaacacuucgaccauuaaaacacugugaaguagguaaaguucauacugcuagcauuugguagagguagggaacugggucucagacauagguaguaucuaaaauagauuaccccaaauguuuuagcauauuaagucaucuaccaccaggaaacacugaaaauuaguuuucaucuuaugauaagugaaagccccaagucugaauguaagauuucuuauuuuuauguaggccaauuuaucaauucuuucauggcuuugggaggucucucccacucagaauauaauuaauagagggcaaucauaaagaugauugaagauuuuacuuaaguccauuuguucuaauaccccacuauuuaacagagaauuaucuuaccgaauaugagacaaccaaagcucccaugguuggguaacagaaauccugacuucuauuuuaaaguuugguagguaaccaagauugucaaauuuaacucuaaaauugucaacaaauagcuuacuucuauaauucuauaagcacauagccaaccagauggccaaccuucacuaauaaucucuaaugaaaguuaucuuaauucaaauacagcaacugcuuccuuaaacaagcauuuuuaaaauaacugccuuccccguaaauaauacaauucccagguaaguuuagucauggaauauaaccaucucaaacggcuucuuaguuacccauaauucuaaagcuuaagaccaaaaugaagauauacaguaauccucccuuaccauggcuucacuuucccacaguacaguauuuucagaccacauucacaaaacuuacuaguuauaaauguucucauuauugcuguuaaucuuacugugccuaauuuauaaauuaaacuuuaucacaguugcguauguauaggaaaaaacaaggcuucaauacucuuggcucuuucaggcauccacuguaggucuuacaccccacagauaaggagggacuacuguaacucaaaaccuaauccgguauucuaucuugaaacagcucaacuuaauagcagaaaacuuaaucuuguuauugaauuuuguuucaguuuguccuuuuagauaugaauucacauucuagccccucuucuucccauuaaagagaauuuuucacccaaaauaaacuuguuaaacaauauacugggacaggcgugguggcucacaccuguuaaucccaacacuuugggaggcugaggugggcagaucauuugaggucaguuccagaccagccucaccaacauggugaaacccugucucuacuaaaaauauaaauuagcugggcuugguggcacauggcuguagccccagcuaccagggaggcugaggcagaagaaucgcuugaacccgggaggcggagguugcagugagcugggaucgugccacugcacuccagccugggcaacagagugagacuccauauacauauauauguauauauacguauauauguguauauauauacauauauauauauauauauauguauauauauauacacacaccugaggaacaauuuagcuaauaaacagaaacgucaaguacaaaacuuaacguucuguaaaacugcauaaauucuuauaaaguucacugaguucaacauguaacuuuuaaagaacauuuugcaaauaugagcauguuugguuuuaauucucaaacauuuuacuaggucaacugugucuaagaacuacuaggcagaaauaccgaaaaaaaucaacauagcucuggucuucaaauggcuuuuuuaaagugaaaauuaacuuagcauauuaagacaaagacaauagaaauaauauacauaauuuuauuacaaaauuuuuuuuaaaaaaacgaaaugcaacauccuaaaaaacccaaaauuuacuauugauacuaauuccuacaaguuugcugugcuaccauacacaagaaauuaaaaaaaccauuaaauauuuaggaacauucaacaucagaagcuguaaaaucuaacuguaugaguagcccaucaaaaagcuacaaccugcauuuuuuaaaaguauuuucucuacagagaaucuuaucagcuauacaaaaaucuguacaguuuuuauacugaagcuaguauugagcugcacuugaauucacauucuuagcaaaauaauugccugagcacacacacacauuccacacgcaucauuaaaggauagccauuuauucuucaucuucauccucuuccuccucaucuucaucuucuucuuccuccuccuccuccucaucuucugguucguucuucuucuuugagccuguuggccugccagggcccuucuuuccugcuucacuuuugcccuuggcacgauaugcagcaauauccugaaauauugucaaaaaaauaaagcauccgguaucauuacucaacugugaaaaaccacuuaguuguaaacaaucuaagaugauugaccaauaacccuaauaacugucuaaaaagguaaccagucuaaguuuuuagagcacuuaucccacuaggcuuuaacaaguuaaugacguaaaaugacaaggguugcgauacagcaguaucaguacuuucacuaccaauacccuuuuacaucacacacagugccauagucccuccuguaccuucacauuuuauauauaucuacauaaaacaauuucuuugacucucugcuuaaaaaaaaaaauaacagacuauacagacuauacaauaacuacaaguaacuacaagucugucugcaggaauauacuagugcuacaaacacugguuucagucaaaaggaagguuucaauuaccuuguguugaaguguacaauuuucauuaggccuuuucaaaacauagcugacaaccauuaauacaagauuaacuaaauuucccagguuuucuacaguuauuaccuauaccuagucuuauccacggcuuuaaaaaagaugacacuguaccuuuucauauuucuccuuuagcuuagcugcuuucuguucauaugguuguuuaucuuuggcugacugcucagaccacauuucacccaauuucuuugcaguauccccaauggauaggccaggguguucacuuuugaucuuugggcgauguucagagcaaaacaggaagaaggcagaucugaaaggaagcaacagaguuuaauaaacugaaggaaaaauccaaggagcaauuuggguuauuuuaaacuuacgguggccuuuuaggagcauugggguccuuuuucuuccccuucuuaucaccuuugggaggaacguaauuuuucaucucccugucauagcgagcuuugucacuuuuugccauaucuucaaacuucgacuucuccuuugcagacauggucuguggacauaaaauaagagccaaaaauacagcaaaauuguuaccuauaaacauccaaagacgacaagaucaucuuuaaggaccacauuuuccuuaacagcauuuugcuuucgaagucuuauauaaguaaaaaccuaaaaucgucugccuggaacucuuaagauauucaggugagucacugggguggcaaaguugaagcucaugaguugccuacuaccugccuaaggcccuccuagccgaaaaccacaccugcacccccugagcuccgucccucuccugccucaccuuccaucucuccgaacacuucuuggagaauuccgcgaaauugacggaagaguccggguguuucuucuugugcucuucccggcaggucugcacgaagaaggcguacgaggacauuuugccccgcggcuuguuggggucuccuuuacccauguugacagauccgcguccaccugacggggccgaggggggagaggggaagccggagggucggcgcggagcccgcagcugccagggcgggcgcuggcggggcuccgcuucccgcccaaauccgcucccgcccugcccgcgccccccuccucccgagggcguccucccaagggcggccgcccgcgcccccgcccgcgccccggcgcacacccuccuccuccuccuccucccggcccgagcggccgcggcucagcccagcaaguggcucccggggcccgagacgccgccgcccgcccuucaccgaguccggugacuccgcaagcgcccucaaaacgccuuuccugacagaaaugucccccagcucccacgucgcgagccucacuuaaccgcuaagcaccucgugaccgacauugaaaacucccagaaccgggcccggucaggggcaguuuccgccuccuccgacugcccgccggcccuccacagacccagcccucgccggcccgcaccccaaaugccgcucgccgggucagaccccgagagccacugcgccgagaccgaguagaggcucugagggaauggggaaaggcagguccacgaacccgaggguauuggaggguauucuugccuggugcgagcuuuuccucagagucccgcagagcggccggacccaacggagacgcuucccucacggggcuccggcgugaacugguuuaucucuaacgcaauccucagccucuuguuuugcagaguucuccgcgccacggcaacuugacgagcuaggccacgggccacauccccacuaaucugauugguucugacgauuauucaaacccagauaguccccgcccccuugccacggaggcuaacgauuggucagugucuuaccagacccgcccuccacgccccagccuagcagguucggugggucgcccaggucguuaacucccagacccg

SEQ ID NO: 15616 - RNA, 1308 nt, Homo sapiens
uuuuucucucucuuuuuuuuuuuuuuggcugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucucagggaugugguuuggcugacgaugcaaaagaagaugcggcugacuguagaacaggaggagcagagagcc

SEQ ID NO: 15617 - RNA, 16356 nt, Homo sapiens
ugcgcgccgcccgcugccgggucagggaagccgcagugcccgcggucccuuccccgcgcggcgcggcuccggguaacuaauguuccgaggcgccugacuaaacccuccaaauccaaggaaugucagcgcuaacacucgcgcccugggcggcagacaaaugcgucccagcggagccgccgcgagcuccgcgccgccgcuccccucggcgucggccugagcuagccggcagccggcgcggggcggccgggcgccgacacaaguuaguuuuccggcccaagcagcccugccgcagccaaggaagaggaacugcuccucuucccccggauagcgcccgagcacugccacagcaggggcuuccccaggcgcugagggcugggggcggcgggcaggcggggcggggacgccccuccgccaucuccggccaaccgccccucccucgcccagggacgcgagggggaccggcgguccgggcgaggccucggccgcgcaucgcaccccggcuccccgccgccggaguugagggggaggcgcgcucuccguaagagccggaggcggggcgccaucgcccucccacuccccggcgggcgggccgggggagcccggggcugcgaacacccccagacgggcggcugcgggaggggaggcuggaccaaggggccugguccaccggaccagcgguggcggcaucggcaucucgccuccuucaggccugcacgcgccacaggccgcagccuggaccaaccccgcguccccgggccgugagcgcugcggucccggccccccagagcgggacgccgggcggccgcagccccccggacccggcucuccgcccgcuccgcccgcagucccggcgcggagagcggccgcccgagccgcugccgcggcagcgcgggugucggcgacggagcccggggcggggaagagcggaggaaggggcggcgagggggcgggccggcggcggccagggaggucggagugcgcggggcucggcacccccucggcccgcgcugcgccagcaccaccugcggagcugcggugcccacgccgugccgcgaccccgccgccccugcucccuccacacgcgggcaaacaaaacaaguugccggucgcugccgccggagggggccgggcgggucacucacccucauccugcucagcgggcuugggucguccggccgcggggucagggaagaccagaggaccacuagccccaggaagcuucccaccaccagcaaacugcguaagaugaacccaaucuucagccucaucuuccuccggcggcgagagacucacagcccggcgcagccgccgccaccgcucuccccucccuccuucccccuccuccggcucuccucccccucuuucccccaccccuaccgcuacggcugccgcccucuccgcugccugcccuuuccagcuccagauccggaacuccccucggcuacaccuuuccccgggcucuucccuccgcuccuccccguggcccccuccccucuggcggccaccgcagagcuccgacugacccgugugccucgcucugccaggcugccuuccucucuaccugcccccuuccagauccgcaguccccugcucuccacgcgagcccccuucacagucccugcuaccuuguaacuaacuugcacuuuucccgaguccgguucuuagccuuugcccugcagcucagcuccuuaaagcuuucagauccccaaacuuuuauuguaauuauggacaauaacuccguccuuaacgccugugcccuccgggaucccguggcccgccgcccccuccguuggaccuggagucgcucucgucugcaccucucccuuagacccacuucccugagccccuugucgagaggcuuucaggaagccaaccaggaagugggacuaccgcugcugcugcagcagcuccacguggcugauuuauagcugaaggguuuuuuuuuuuccuucuuauugauuguucuugcuuuuucacacggcuccuuaagguggugaauuuguaaccgaaaggcccaggugagaugugcaaauaucacuggauuggaggagcucacuuggaaagccaguauuccuccugagcuaaugaaaagaaaggcugucgucuuaugccaaaagcaauaccaaccuuguucacgggcugguaaguuucaaauccaaggaccacggauuucaacuccacccucauugcgucccucagaucugauauuugccacuugauuucugcuuuucaaacgccuuuucugccuguguuaccuaaauuacacaguaaaggauauuggcaaguguuuagccaaaugccccacccugaggaaauaauuuuucugcccauaucucccaauaaagaugucuaugccuuuauagcagaauguauguaauuacauuaucaguguacuauauccuaaacugcuaauuuaaauuuaagucgaacaaaacguuuuaagauuuuauccuaaguuuuuugggguuuuuuuucuuuucuuuuuuuuuuuuuuuuuuuuuuuuuuuuuuuuuuuuuuuugagacggagucucucacucugucacccaggcuggaguagagugcaguggugcgaucuuggcucaccucaaccuccaccucucggguucaagcaauucuccugccucagccucccccguagcugggacuacaagugcacaccgccacgcccagcuaauuuuuuuuuuuuuuguauuuuaguagagacgagguuucacgguguugcccaggcuggucucgaacuccugagcucaggcaaucugccucguacucccaaagugcuaggauuacagcugugagccaccacaccuaggcuauccuaaguuuuaagaugguaacagcugauucuuuuuucucguacugucucacaucugcaaguuuuuugcuuuaaaacaaagcucaguuauguaaaguuuuacagugaaacaauuucaauuaucaagauagauaaagaauuauaccaaacuaccuucaugugcuuuuuggcuuggcuuacaauagcuaguauaucagggaguucuguagaugccauaauuucaaaauuuccacaaaauaucugaagugauauccucaugaacagcaugguuccggaaauguagaauggauuguaguuagguguauuauugguuggcugaaggacuguacaucauauuguauaaaaguccacuauauagaguaccuggaagagggacugucaaguguuaaacacaaaucacugcuugacuuagcauuuauaucagccccuuagguuaaaaccaguuguuuuaaguagaagaugagagauuuugccuaagaccauuuuuuuugugugacagagaucuagaguguguaauucacgaaguaugaaucugcuggguaaugugauaugaaaagcgaaugcaccauuucuuggugaugauucaggucagcguugggacccaggaaucuccuguuaaucaguacccuggugauuuugauccagguaaucugggcaccaccuuuggagaaacacugaaaggaagcaagguugcggggggugguugggaaaagucuuauauggauaucuuuggaagacagaaauaggcucauuuauggacucaacuugaacuguucagaagugagguggacuccuuuucuuuuuuauuuauuuuuuuuuugaguugaggucuugcucugucacccaggcuggagugcaguggcacauccauagcucacugcagccuggaacuccugggcucaagugaucuucccaccucaaccucccgaguagcuaggaccacaugugugagucaucaugcccagcuaauuuuuuuuuuauuuuuuguagagacggggucuauuaucugguccuguugucaaggcuggucucaaacuccuggccuccagcgauccucccuuuuuggccucccaagaugcugguauuacaggcaugagccaccaugguccacccggacuccuuuucauaggagacaguucccuaggcagagacugggcuugaaacagguaacuuacaaggcauccugugaucauaagagaauaauuccauuugaaaucagcagcugaaguccaccugaauaauuaagucuuucacuuguguuauuuucacaggggagacaguuuuuuauucuuaagaagguaggaagcuuuauuuuuacuguuaugagcauagcugggcaaguaugcaaauggaaagugauaccuaucaucaaaguauugaggaugguccuuugaaggcccuaguauucugagaacauccugccaccacuaccaccccccaacuuuaguuuuacacagagaacuuaaaauaugugugaaagaguauauaguuauacaguuguauauugaugaauagguauauaguuguaaaaguuuauguuucucugagucuuaauaacuuuuaaaagaaacugcaaguaaacuaacacaggaacagaaaacgaaauauugcauguucucacuuauaagugggagcuaaaugaugagaacacauggacacauagaggggaacaacacacacuggggccuauuggaggguggagggugggaggagggagaggaucaggaaaaauaacuaauguggguacuaggcuuaauaccugggugaugaaauaaucuguacaaacccccauaacacaaguuuaccuauguaccaaaccugcacauguaccccugaacuuaaaaguuuaaaaaaagugcaaauauaccuuaaaacauaugcccauugcaguauuugcugggaggcagccuuuguaggguugacagaacucguuuagaaaaugaggagcuacauucaaagcuucagucaagauaaaucacguaccucucugaaccuagggcuuuuaucugccaaauagugauuacaauacucaaccuuaugauguucucaaaaggaauaauugagaucaaguacauauacaaauauaaaguacaauuaguguaauggaacaagucucaggugcguguggcuauaauucuuguuuuaugaaugcugcaguuccucuaaagaagaggguagagacuagaacugaaugagauggacauagagauggccaagaaaagcaucguccucugccaagucauggggucaugugugguggauggugacaugguguccucagcucagaguccagcugggggcucagaagcaagguaacugaagggagagaauuauuugagcaccuaguguguguaagaugcuucacauuuauuauuucaccuaaccucuacacaaccuguuguggguauuacuggucucaagcugggauucaaagcagguuuuuccaaccucagaauucuugccagacugauuagccuucugcaucuggaacauaaauguuuucaggcagcauaaugugcaagaggucagagccuaaagcuuuguuauuuuuuaauuucuccaccaugucaacucuguuacagggaagcccagcagagggaauuguauccauuuuggggcuacacuaccccaaugcuaugcugcagccaagcugaacuucuaaguuucuaaauguaacucacuuaccuucaggccuuuguacggggaguucuuuuugccugaaauaccuucugacaucuuaacauuacgcuuagaugucaguuacaaaaaagcuuuuucuagacucucucacaugucccacuccacaccccuauaucucuucccaccaauguacuaggguagguauccugcuagguacuuccacugcacccucuacuuuucuucccuaaugauuaccacuauauuguaauugcuuaauuucuuuuuccuauacccagauaaaaauguguaugaagguggagccuugucuaucuaguucguuauuguuauccgugucugguauguggaaagggcucagugaguauuucuugauggaaugcugaaugaauaaugggauugaaaauauaaaaggcagacaaaacuuagaagaggggccagguuuacuucaauugcuauuccuccucacugggagguuuuucuuccaaggacaaaacuuuggagguuuuauuaaauuagaaaagugauuauuuuacauauggucaucaucaucaauugauaggcuguuguuucccccuuacucagcauccuacuaaggcugcuuagaacuaagaagaaaggguaauuuuaauuuaaguucauauuuuuguauguacggagauuuaaaaaaaacagcuacauuaaaaugggaauauguagccauagggaauuauuugcaaacaaauuucaguauuaucuaugugugguugccaagaacucagguuaaauuagagucagugaccucuaaaugacuaaauauccuaucaccuauucuauaagccauuuaaucaccucuuuucaaagaagaagagcacaauugguaguaucuuuaaaggaagauacauuuuauuguuuagaaaauaacuacuauuuagauaucaagggaagcauaguguaaguuuguuaagaauuuauuaauuuuguguacuguucauuaguuaccucuuacugcuuaacaaaugacuccaaaguuuagcacuuucaaacaacaaacauuuacuucacacaguuccugaagucaggaaucuaagaguggcuuaacaagguggucuggcucagggucucucaugagguucuuaccaaacuaucagcugggaccacuaucauaaccaacugggccuggagaauuugcugucaaguucacccacauggccagcaggcaggccucaguuccucacuggcaggcggugggaggcuucaguuccuugucaccugggcuucuccacagggcuacucaugacaugccaagcugacuuccccccuucaugaaagaucugagggagagagagcccaaggcagaauccacagucuuguauaagaaauaaucuguauacugccuucaucuguaaaaugaagguguuggaccaaaugaucuuuaacauucuuuccaauacugaaauucugagauuuuccuaugaugccgaugugugauugagacuaauuugugcuuucauguggaauacuaugagguaaaauccugccuuuguacuuuuuuucugacaugggguacuauuucuaucauaagcuugagauggauaauuccugaguugugcucaucuggaauaaaggacuguugucaagggcuuccauuuaaugagguuaagggucuccuacaguguuuggaaagcaaaaauauuuauguaaaagcccucagauuucacaucguagaacacuaccucuucauaauuugguacuguuuuuggacucccauaauucagaagugcucuucugaucuaaccauuuauuuaagaggugauugaaacggauuuugucucuuaccacucuuguuuaaaaccucuucaacagcuucccauugcucuuauauuuaagcccaaauuccuccauuuauuacaaagccuuugugagcuugccucugcuuaccucugcagccccauggcuggucaguuauccccucuuuugcaacuuaaacuauagccauguugauuuucucuccauuucugaaauaggcuaacuucccucucacuucuagaccuuguguguguuauucucucgcuuagaacacucugugguucuuacaccaaccccucucccaugaacucccugauaauccuucagauuucaauuuauacaucaguucuuucagaaaccucuaauugucuucaguccccgaucccacugcuagguuagaagacccuccuucaugcucucaaagcacccuguaaguucucccucagagcauauagaccaaguuucuuuucuuuucuuuucuuuucuuuucuuuucuuuuuuuuuuuuagacguagucuugcucuguugccaggcuggagugcaguggccccaucucagcucacugcaaccucuaccucccggguucaagcgauucuccugccucagccucccgaguagcugggacuauaggcaugcgccaccacccaucuaauuuuuguauuuucaguggagaugguguuucaccguguuggccaggauggucucaaucucuugaacucaugauccgcccgccuuggccucccaaagugcugggauuacaggcaugagccaccgcgccuggccuagaccaaguuccuuaagggcaaggaccauguucgaauuuggcauugugucucuagauguugaccaugcuuggcacagaagagaugcucaguauuaagagacugaacaagugaaaauauauuuccuguguucacuguuaagcguggggaaaaaggaguugcauaaguaaaaauacuaauuuaaaagcccucagauuucacaguguggaacaccaccucuucauaauuugguacuguuuuuggacuucuauaauucgguagucuucuuauuuaagaagcauucuuuaauagcucuuaaaauaugauaauaucuaaaugauuugcagaagcauuuuauagguagaugguuuugccuuuauuuggguguuggggaagaaggguacaguauucuacauuuuaccugaccaaaaagaguacuguaauuccuagauaauaaacugauagcuauuugaaacugccuguuggcucacugaagggaaaaugcauugcccacaaccucauaucuuucaugugggaacccaguaccuauaagacaaacuggccucucucuguuacuauugauaaucucuuagagcauaacuucuaaauaauggguggaauggaaaggaacucugucagugaaagggcuagagaaccugcccugcuauaugcagauuaagagauuuggcuagacucaaauuucuaauuuccuuuaaaaugcucaaauuucuuaaaacuaggguaugaaaugcacugaagaaagacucagguucucagcagugugguuaguuaaaugaccugaaagucuucaaaacugguauuuaucaagguauuacuguaagucgucuuacagucugugcacauaaaccucuccaccagcaagcagacuaguuucagacaguuaucaaucuguuaucacauccuuccagagauccugauuaucuagcuaugccuagaaccugacauucuuuauugugggaaccuauaagacaaacuagccucucucuuguuaauacugauuaucucuuagagcauaacuuagacacaacagggguggaauagaaagaaacuaugucagugaaaaggccagauaacccaugcugccauauguaaaaugagagguuuggcuaaaccacauugggcauagcuggauaagcaggaucccuggaggugugugaagauguguggacaggagaaaaaagucggagaggaggggacauuccugugcuugacuaucuucugaacguuuuuugauuaauuuguauaaaauuggguuauuuuaguaauggaguaugucuucaagccuuuuuaggcauuugagacauaaacaguuacacacaaauaaaggaacugagguucagacuacagagagaugaugcgagagauucucccaaaugauccaggaauuaagaggcuggacagggacuagagaucuguuaauuccaaaccuuuuacuucccaacuaugccaucuugcuaauguccagaaauuucauccuuucuuuaguuuguaacaacugaacaaugacaaguacauuuucucuuuuauuugaacauguggcucuguauuaaaugacuauuuggagagccacaacagaguugugagcuaagagugcugaucuucaggggagcucaaaauacugccauuuagguaaauguaccuuuuaucauacugcaaagaguuaugaaauuugaauuuuaauuacauuucuuuuuuggagagugaucuuugaggacuugguuuugugggauaacuucuuuuuucaaaccauauaaaauuauuuuuaacaaauggcauccuuuuguauaaucuuuucuuguauauuuuuagauauuucuauucaacauuuuuugagcuugugucacgugcuauucauuguucuagaugcuggaaauacagcaguaaacuaaaagccaaaauccuuguccccauagagucagacaauaagccaaauauguauauuauuacauacuguuauugaauaaacugcuguaucaccaugugccaagccuuauucuaagaguauacaaagauuaacucauucauuuagauagcauguuagaagauaaaugcaauggagagaaauaagccagggaaauggaauguggaaugcuggagaggggugaggggaggauuccauuuuacacagucugagaagauaauaugugaacaagaccuggagaugagggcacagccaaauggguaucugaagggagauggcuccaagcacaaggagcagcaaaugugaggccuugaggcaagaauguuccugcuuguuugaggaaaagcaaggacauaaggacagcuguagcuaagaaagugaagggagagcauuagaucauaguaaagacuguggcacuuauuuagagugacaggggaagccaucggagaguuuggugcagagguggugucaucuaacuuacaucuaaauaggaucacagccucuggcuucuggguuugguuuggaaaagaaaaagauaaaagcaaguaucaguuaggaggccauugugauagcauagaguagguuuguaacaguagagguggguagaauaugucagaauggggauauauuuugauuauucuucagcuauuaugauuccaacuaauuaggcuuguuguuuugguuccuggcucucuauaaguaguuaaauuaauaacauguaaagcaaacucgaaaugcucuggcaucacacauuauuuaaauaaacugugcaagcgauuaguuggcauuuuguuaaacaucuuuguuuagauuuucauguaucaaauaauauaauauuuucuuuuccuuuuuuuuuuuuugagauggaauuucacuauugucacccaggcuggagugcaauggcgcgaucucagcucacugcaaccucugccuuccggguucaagugauucuccugccucagccucccaaguagcugggauuacaggcaugcuccaucaugcccggcuaauuuuguauuuuuaguagaggcgggguuucaccauuuuggccaggcuggucucgaacuccugaccucaugaucugcccaccucggccucccaaaaugcugggauuacaggcaugagccauugcacccggccuuaaaaagauuuaaaaauauuuuaccuggcauuuuuaguuguuuuugugagaucaguuguccuggccccuaaacugccaguguugcauaggagauuuaauuucuaaauacagguuguugccuuugaaaauauaggcugggcgcgguggcuuacaccuguaaucccaacacuuugggaggccgaggcagguggaucacaaggucaggaguucaagaccagccuggccaacauggugaaacccaucucuacuaaaaauacaaacauaagcugggcacgguggcgugcacuuguaaucccagcuacuugggaggcugaggcaggagaauugcuugaauccaggacgcagagguggcagugagccgagaucacgccccugcacuccagccuggguggcagagcagagcgagacucugucucaaaaaaaaaauuaaaugcauccauugguaacaagaaaauaaagaaugcuaaggucaaagacugauaaggcagggaagcugagcacugaagcuggcuuuuaguuuaagggcuuuggccagaacugaggaaccugaguaucauauauauucucaguuugugaguuugggaacaaaaaacaaauugagggcccuccccaaaauggaaaagcagauaggucugccaaaaccaggauuccaaaagggcuguauccccaaggugagagagaacuaaaauuaacucauucccucaacuuuugaagagaaaucucccucuacacguauucacuccaucaucuaagaaauucauaaucauaaauuggcccacaugucaggaauucaugcuaucuggauggcuagaagaacuuuaaagcaauaauuuuggggggagaugguuguuuguuucuuuuucuaucauuuuauuuuuuaauuuuuuuuuugagauggguucucacucuguuacccagccuggagugcgauggugcgauuacagcucacugcagccuggaucucccugucucaggugauccucccaccucagccucccaaguagcugggacuauaggcauucaccaccacaccuggcuaauuuuuguauauuuuggagagaugagguuuugccauguugcccaagcuggucuugaacucaugagcucagguguuucccugccucggccucccaaagugcugggauuacaggcaugagccacuguacccagccuauucuuuuauuuuuaauuuuuuauguauacagguacauaguagguaugugugugugugugugugcguguguguguguauacaccacauauauauacaccacauauauauacaccacauauauauauauauaccacauauauauauaccacacauauauauaugguacaugagauauuuugauacaugaguacaguguuguaauaaucauaucaggguaaaugggguauccaucaccucaaguauuuaucauuucuuuguguuauaaacauuucaauuauacucuuaguuauuuuaaaacguacaauaaguuuaaagugguuccaggccaauaauggcacaggcgucugaaaagcaaauacaaauccuuuuugcaagaaccccuucaccucaugcuuugaaaaauguuuuguucauguggucucuaaaacaaugaguuacucacgguugacaaucacugaacacucaagaugccauaagggagagccagcaaaauccauaaacugugaaauaugaugcauaaaaaauuagcaguugcaguuaucagacauagaacguaaaauaaguauguuuaauacauuucaagaagugaaaaaagaggccugaaaauaugaguaaaauugagaaaagaccuaauuuccagaaauaaaaaauaaaauuaaaaaaauuuuuaauuacuaaauggguuaaauugcauauuggaauuaucauugaaauugucucaucucuugauuucugggcuccagguucuuucucuuucuauccauucuuucugucucuuucccuaauucuacuaucucuaaaaacaaggcaucauuuagaauucaguccguucuaguucuuuuucuuuuccucaauuuuuaaucucuuccuggacuaacccauucacaaggcuucaacuuauguuaauaauccccacaccuaaacuuuuggcacggguuguuuucugagcauuaaaccuacaggacauuucucaguggauguuccauuagcacuucgaagucagcauuuccagaauggaauuuguuuauuuccccaccgagucaccuguucuuuguagguuccugauuuagccauugacacuugaacaagaaauuucugacaucuuccauaguuuccuccacuuuucccucccagauuuaguuguuaucaagucaagaccauucuaucauugguauuuacuuuugcaucuauucucacugcugugauucagggucccuugcuguuuccuucaucauuuucccaccuucuaggauccuguuucuuaaaaccauaauuucuagcacuaccagaauuauuuuucuaaaauauaaguucaaucauaucacucuuggagcaaaagccuuuagugguucacccguagagguagucauucauugcauccugaaaaguaucaucucaaauaaagcacuaaaguacagcgucaguguccugguuggagaacaucaagaagauuauagcuuuucauggacuuuuugauaccaaauguuagaaaacuagauagauggcagagaaagaggacauucuguaggaucauauuagauaaauguuucauuaaaaauugucuuaggugauguacauggcaaccuacucuccuaccuuggauuugagaagugguaguaagugaaaucaaguauauucacucagcggggagaccacuagauagacgucuucauuugagauuaaaagaaaaaaaaaaucaaaaucaggcccauagaaaaagugcugcaaaacaagggaacagaggauuggaaguuuuuaagacuuggaagaagaacauaaaugaauaguugcugugaugacuccaaaauuucaggggcuuaaugcaauaaaaauucaucacagcacagcccauuucucucuguggguuugcugagggguggggaagggacucucuccauuugguagaucugcuaucuccugggaugucaaaggccuucacugaugcuuugcaacuagcuggcaguggaaggugaaaaagagcacuugcaggaucacuaggaaguguuauuauuauuauuauuauuauuauuauuauuauuauuauuaucauuauuuugagacggaguuucgcucugucauccaggcuggagugcaguggcgcaaucucagcucacugcaaccuccaccccucggguucaagcaauucuccugccucagccuccaaaguagcugggacuacaggcgcccacugccaugcccggcuaauuuuuuguauuuuaguggagacggggcuucaccauguugcccaggcuguucuugaacuccugggcucaggcaauccgccccccuuggccucccaaagugcugggauuacaggcaugagccaccgcgcccggccuaggaaguguuuaaagagucaguccuagaggcaggaaaugugccuucugcccaaauuguaugcgccagaacucagccacaugccuauugguagaugaaucauuaaacaguauaucuguuccuuuauguuuuaaaaaauauuuaguaaaggaaacaauaggccauuaaguggagaagaaaacaugauacaaagcuaaacacacucugguucuaauucuguuaauaaaagaaaucuguauauuuucauuuuucaaacaacuuuaaaaaaauaacccauuaacauuuugaucuauaucugaauaguaggauugcugguaauauuccuaauguuuuucuguaccuacauuauuaacagugaaauuauuacuuuucaaaaugagcauuaccaaaaaaauuuuuaaagacaaugguguguuuuuaaaaauauuucucuauucccuaaaauuaccuauuagaggaccuuguccuccuaguagacgcuuaauaaauauucacugauugaaucauuguaccauugaauaggguaauuaaguguaaauagccuaagaacaaaguguuaggaaaguuauuucccuagugacaccauauaaaaugugauaaccgaugaaccaaauuaucauacuuucuucuucauaugauuaccuugauuucaguuuuguaacacuuaaauuauaccauaaguguggcauuaauacuagugaguuaccuguguuaaugauucccgaacuuuauucauauugguacuauguauacuauuuucaguccuaccuaaacuagcaauauccuauugcuuucauauuuuucauuaaaauuacuuacuuuuuauaaaccuaaauuuagcauuguauuaaacagcaauaccaauaacaucacagcaguguauuuuuucuacacauauuaaaauauaaauguguaauuaucaaaauuuuaaauguuuguguucuaucuacuuaaucaucuuuuuuuuuuuuuuuuugagauggagucucgcucugucacucaggcuggagugaguggugugaucuuggcucacugcaagcuccgucuccugaguucaagcgauacuccugcuuuagccucccaaguagcugggacuauaugcgcccaccaccaugcccagcuaaguuuuguauuuuuaguagagacgggguuucaccauguuggucaggcuggucucgaacuccugaccucaggugauccaccucccucagcccuccaaagugcugggauuauaggugugagccgccucacccagccuacuuaaucaucuuuuuacccccgguuuaccacacuuuaggauuaacugacuuauaauauauuguacuucccuacuuaauguuuuagguucaaacuuguauguguuuggggaccaugaacaucauauguuuugcccagcuggcaucuaguuuuuaugauuuaugaucuaguuuaaucguuuauguuuauaugugugcauuauauaugugcauauuuauguuuauauaugugcauauauaguguauauauacacgcauauguuuauaugugcgcauucauguuuauauaugugcauucauguuuauauaugcgcauauauaugugcauauucaccaaaaagugaaugcuuuaacaggugcuguaugggcugauuuuuucuuaagcaugccaguuugcuuuuuuuuuuuuuuuaacaauuaauacucuaucucucucccaccaccccauuuuuaguggaaguucacugaugugacauaaaauguuucua

SEQ ID NO: 15618 - RNA, 3059 nt, Homo sapiens
uccccuuaucguugagcuaaccaagcacauauugaagcucacuugggaaaggagggaaggaaaugugggagacauauaucuaauuaaaaaguauucguuccucuguucucaaacuaaugugcuacgccauuacuucacuacauaaugagugaaacauuggugcaaaauuaggcaucaccuuaggacagcaugagccauuaaucaaacaauaauuuuaaggguugucauggaaggaagguucagguuuauucuuggcuuuuuuuuuuuuaaaguagugcaagcugcuagguagugaagcucuggaaaaaagaaacaucaaaucuuaaaaauuagaaucuuuuccuuuaaacugaaauaacaugccuauucauucuuagagguugucacuucuauucagaauugccuucaagauuuucuuuugggcuucucaucacugaaaguaguuuagucuacccaaaagaagagauaagugaaguuaggaacuuuaaauuguugguuaaauuggguaaaaauuugggcagguaaacuuaccacuuuaugcuuuucucucccaugucauaaccuauacgaagacuaaauacacuacuguagcuuuuacacaguauuaaaaucacaguuugaagguuugagguauuaaaaugaccaguuaauucagucaaaaauuaaacaaauggaauuuggcugauuucauugccuugaaacuuguugauuugaaauuucuaaaacuacuauugccuugacauuuuuuccuggccgcuuagacuuuuaaaauguucucacugugucaguguggaugauggaaauaucuguuucauucauaacaguaaaaugccacucccauguaagauucagaaccuauuguuuuaauucucugucuccuuccccuuaagagcaaaauauuauuacucaauugaguuuugaaaucccucuguguuugaaagaggcccauuuggucuguuugcuauggcugcugacaccucugggcccugcaacuacaucagcucccugggcugugcauaucagagcuacaaugcugcucacacgagaggacagaugauuucuuucugcagcacaauuguauucccccaggacagcuaaugaucaauagucguaucuucaaagaauuugccauuugucaguaggaagacagguaagaggagacuugggaacacuaaauggagaaaaauaaguuuuauuuccaucagugaugugauugguaggcaguucagcagaugaaacaagaaaggcuaaaccaaaaggccguaaguuaaggaagucugccugcacuauguuauagcaacaggagagcagcgacagguaccaaccauagaaccuuaaaugcuacccagaaauugauugcagucuguuagucaaucauuaaaugaaaugguaaaaaugaccaguaagauacguuguaaugaaaguagaucuaugaaguaaaacuuucgaaggaguaaauaugaauuuacagccagguaagaaucuuagccaauuaauucauacuauuaaaauuuaagcuaaaaucaaacuaaaugaaaaauuaaaaggauaucauaucuggauuacagcugagaauaaaaugaaacaaguaugauauccagaucggugcauuuuuuucaaaaaaauuuuuagauaauuagcuuuacauaacccauauugauggguugacauguuacccuuuccugacacucucaggaacaccuggaaaaucaggccauuucuuuuaccauggagccuuauugaucaguuuaacagaaaauaccacaaaauacggauuuccaaaauucuacguagcugcaaauagaaagaauucaaaauauuuagaauucuugacugauuauuuuuccaaagguuuuuuaaucuuuggaaagauagaaaaaccuagcaacagugauugccuuuagagagggaaacugaggcauuaggaggcauaauugggaaacauuuuuacccuauauacuuugguaucuuuugaaauuugguuaaugggcauguauuauuuauuuauauguaucuuuuuaaauacauauuauauuuucaaauuuauacauugaaacauuuaaauuauauauuuaaaaauauauaaguauauaauuuaaaacuuucucaaaaauaguauuuccuaucuaaggcuugagucuuugggauaggcuugcuucucugaucccuaauaggucucagcaccuaauauaaaggugaaauaauaaaccacuaaaggcucacucaauugaccauaaccuucucuuaauucuucucucauuuguugacccaccuugccuuaaucaauagaaaauuuuaaaacucauuucuuuuacuuuuguaauauuucaugagagauaucaacauggggcaaacacacauaugcacaaauauaugcauaagcacugauagauuuauaggcguauguuaaauauuaaacuuuccuuugagaaaaggaagauuuggccucuuggagaaagucaauuaaggacugaaagugggacugugaauaagucagguaagaguuugagaggaagcaauuauauuugucuauugcuaccuuucaccucuagaacucuagugaacuuaugauguuaucaggaaauuaagaauucagaagccuccauuuuacugucuuuuucauuggacagguauuaucaauucaguaggugugcauaaaaugguagagaaaguuuuuacccuguaaacauaggcacuucagaucggggcuucaucgucuguugaaucuaucucccccaacccccaccaauuuccuuuuuccuuuuagcauccuaaaagaaaaggggaaaaguaaaaauugucuucacacggcuucuucgaaaucugggaguagguacacuuaucucaauuuuccuggguuaagauuagccuucacacuagugcauucauuaaauugucaccagaaagaguacagcacagaaggaagaaaaaagcaaucuuccaacuguggagauugaggaaaacugugugcuuaaugagaaagaagaguagcacuuaccauuacuaugauuucagaaaagaaguacagugaugaggcacagugacuuuucgaagagcuu

SEQ ID NO: 15619 - RNA, 2604 nt, Homo sapiens
auuguuuaaaaugugagagauuuuacuuuuuuaauuccaagugcacuuuugaguuauuuuacuuugaaaauuaauaacuguaucaguacuuaaaaauauauccaauauaauuaaaugauucuccaaauuuauuuccuugagcaccugacaauauucccaggaaaccucucccugcuauguugcuucccagaauucacauuucuguguuucaaaacugcacuuccuuagagagaaaaagguuagaaaauaacgcagacuacaaaaggcauaguguaugugugggggugggggugaggaauuaagucccuugcacucuagauuaaguugcauuuauauaaaaucuaaagguaauuggucuuuauauaaaggacacauucaacaacauuuauuaaauauauuuuuagacuauuuuaaaauucaagugauucacaaaaacaaauauuacagcauagcgcuuuauucaugccaucauacagucgaucuguauucuucaaguacauuuugaauuuauaaugagaacaguuuaaggcauaacucuucccacucaaaucuaggucuuucucaagugagacacuagagagaguagaaagggaggaagagauagggcgagaagaaaaggagggagggacagagaugaggacgagaaagaagaaaaaagggaaagagaaaauaccgucugaaguccacaggcuuaucuaucccaagcaugucuaccccacgcaugugggcaucauauccagguuguaacaaagaggugaccauggcguuuauuuuuggcuccagacaggcggauucagccugcauugcaugcaugcaugucugucaccucaucuaaguccccauuccuuccggaguugugagcuccagauccaagagugcccagugcacggugcugggcacgcugucccuuggcgaggcugccacagguuccugagugugcggucaggggcguuggugcauugauacguuaggcggagggaggaguaccaucugccagagucuuaucucgagucccacguuuucuggccaucgcggaggagugugcgaggacagguagcccucgcagugacaaggcgcgcggagugcggucgugcaaggcgggggaggagcgggguggcccugccgaaucuuaaccggggccccggguguuugcagacccaaauaaagccgccuugggucuccacgguguccuccagaagcugcugccugagaacucugagccucagcucugucuugcuucgggauccucuuccuccuccuuccccacccccuaccuggccugaacggcggaacgcgcggcucgggggauccccucucccugggaccggcccugucccgggucgccuccaccucccgcagccgccgcgccccggcucgccgcgcucccgccggcaccauggaggaauuccugggacaaccgccugcagccggcgacuuuuccccaggaaucucuggccuggcgcccuuugggugagaugacggggugcuggcaucccugucggucccagauuacccggaaaagcccuggcagguaaagagaggacccgcgcaggcugggagcucccacuccuccuccagcgucacgcucgcccuccgccgcugccucgcguccgggucuguuuauauagcgucuggaggccgggaggcauugcccacccccgccaggcggcccgcccuccccuccugggcuccgggcugccgcacguggcagacaccagcgacgucuccgcggaaggcaggcgccggggaguggggcgcgggcgaccgugugcagccgcggcgcaucuccgccuuccgcuccuccucgcagcgcccucguccgcuuccaagcccagcacagacuucgguuucuccgccuccauccccuuuacgagaagaggagaucaaaaaauauugcccuuuaggugcucgugaugguccuguggguucguucaguugccagaaaagaaugguaacaugaacagcggagcgugagagcgucaccgggggaagggacgagauugaugggcagagcgcucacuucucagaggaucgcauuccgaggaccgcgcgaggaagggacgucgcggcgccaccacuuccuggcuggacuccgcugacaucuguagccuccuuuccaccagguucccggggcucccagccgcugccugcagaggagcguguagacagcgcgcgaggguccggcacuucguggaccuccauccgaaccggaguucugcccggaucccgagucccuggaucccgguggagcccgccggcaagcuggcuccggagggaguugaacuugaguucagguggguuaucccaaggggagcacaggaaaagauguucagggaagacgaagaaggugacgcuguuccaaugucaaaagcggacacuuuucuuccugacacuugaagggguugagccaguuccucucaguucugucuccuaacccgcuccaccccgacccagcccucccacacuaaggagguggggggcgaacaacaacaacagcaacaaaaacucccaguuaccuaaguaucuagcaggcuguugacuuuuuuauaacuuaccuuuagucaaugaaacgaccauauuuacucuauugcuuuauauuaaugg

SEQ ID NO: 15620 - RNA, 31370 nt, Homo sapiens
gcugaaauucggcuuggaggcuuuugaacccggaagcgguuggcggcgcucggaagcggccgcggaucggggaauucugcuggcgcugcagcugcagaauggucggcgguggcgggaagcgcaggcccggcggagaggggccgcagguacugccggaaaggcugugcgggcuacgcggggcgcuuugggugacagccagggcaccaggaggcagcgcuuuucauucauccagugacuauuaagcuugcuguguguccaggggcugcgguuugcugcggggauccugcccagggccgcuguuucgcgcucugcaggggguuggaccaggaaaguagcuccucugcaucuucugcccagcuccucuuggagcauuuccuggggaaacggauuaagccaaccaaugguucauucgcccagccagauugauugggaaccgauuacauaccugacauucuguggggcgcugcggauuugggggucaaccugcuugcuccugcugcuuguugagcccucggccuggggaggaggggcacaagcaaauaugcauucuacugugacuuuuuuguuugggauuauaacgcugguguguagaaagugcuauggaaacacugaaggaggauuuaacaagucccaggggguguuaaagaagacuuuuaagacaacucuuugaaaauugguuuugaaggcagagaaguaagauucugagacauaaaacuguaggagauguuugggcguagcggagcguucggcuuggcuggagccagggaaaugggaaaauaagagggaccugaucauaaaagcacuacugagaggggaggaggagagagugugugcauucucauacuuuacuacgauuucggaaguucuguaaccacuacaguagcaauaaggggaaucaggaaagaagugccauugugauaacuaaaguuuuagaaaaguuacucugguagugucauaaaucggacagggugagacauucuuagagggcuuaacuaacuguuaaagggccaucgguauaggcauccuucauauugggucaugcauucuaggaagaccaggguaaagaagaaguguagccucugaaggggacagcuguucuaaauccuaguuguuagggcuauggagaugcugaacuagugugugaguaaaggcacagcugaaaaaauucucuuuuugaaggugcagugaagaacugcuuugguggagugaugugcuuaacuagaaauacaauaacagaaaugaagaugagucuguagagacuauaaccguaauggccagcauuuguauauuaugugcuaggaccguucuguguauuuuuacauauaauaacauuccuuguaacaaccccgauauaggcacuguaugcccuuuuugcagaugagaaaacaaagcacagagagguuaaguaacuugccuaagguuggaaaucaguagagucaggagucaacccaggcaaccuaacuauuaugcaaaacugccuuucagcaaggcagauuaagccuuuucuaacaucuuaaguuggagccagucuuugaacgucugaacaaagacaguuaugaaaacagaagauaggauagcucaggacuucauauguuccuacuguucuauauuugauguuggagaagcagcauagugaagugguugaggaucugcuguggacccagauuuaaaccugaguuuaaaucccuucucuuccacuuccuaguuagggacguagggagguuaaccucaguuuccucagcuguacgaugagguuaaugguaucuagugcaugagacaguugaggacuaaaugaguuaauccacagaaggugcuuagaacagugaaacagcacaaaauaaguucucaguaaguaucacuuaacuacuuguuuuuacuauuauauuaucuuuacuauuacuauuugcuauuauugauacucacuuuuggauucauuguucaacaggcuuuuuguugaacguaauuuuuuuuauaaaucagacacauuauaauccuuggcauaauaaacuguuaccauauucaugaucgucuuugaccuuauuuauguuaaguaauguaacaaacaccagugaacccauugcccaaucccaaagcugaaacagacaauagcucuacaucuacacguguuccucuccuauccguucagccuucuuccugucaauuauuuucaguguagcuauccugaauuuuguuuucccuugccuuuuaaaaauaggcuuaucucccaugaguguauaccuaaacaauauuuauucuuaguuuuugaacuucauaaaaaggcuaucaugcugcauauaaucaagagcuuuuuuccucauuaaaaauauugaauauagguugguccauauuguguagccauagaguaaccauucgguaaaugacggagauugguuccaggaccuuaggagagcauacacuaauuuuuaaagcaacaagaaaacaaaccaucucauuagccaaagauaacacaguuaauagucuaguauacaguaacaaauuuccauauauccccaaaucugagcauacccaaguuccaaaguugguccuguggaacccgaguauacgaaaaguuggcccucucuauaaguggauuucacaucccaagaauacuguauuuuuuuauuugcauuugguuggaaaaaaaauucauguauaaguggguccacaaaauucaaacccuuguugcucaagggucaacuguaauauuaaguguaauagucuauuguuugaaaaccuuacaacuguucuccuaacaauagguauuucauuuguucuguuuuugcucuuggaauuaaugccaccaugaccauucuuguaucaucugauuacauuuuguagacguugaaugauaccuaacguuaauaaacuucagacuacugagaaaauagaagaauauaaauaugagggggcggggggagggauagcauuaggagauauaccuaauaaugacgaguuaaugggugcaguacaccaacauggcacauguauacauauguaacaaaccugcacauugugcacauguacccuaaaacuuaaaguauaauaauaauaaaauaaaaaaauauauaaauaugagaaacaucuagcucagaauuucucaacuugagcacuguugacauuuggggccaguagucuuuguugaggaugccuauccugggcauuauaggauguugagcauaccuggccucugccccacuagcaccguuucuuccaauuggugacaacuaaauaggucuccaaauguccccuggggggcaaaaucaccaccgguugagaaccacugcucuagguaggaagaauaaaaaggaaagaacuuaauccaaaaagaaagaaucuagguucauagaaaaacagauugcugcuuagaaaacuaaacauacguaacuuccaauuaagcauauugucuuuacagaaauuuaucaaauaucuaguaggcauuauaaaaccuaguauacuuauauaaugaaccuguauuguggugguccuagagaugaguauuauaacuucauccuggcauuaaaaggccuuuucugaaauaauuggauuuuuggcccagaguuuagugcuauucugcuaacuuuauuaggaacuauagauguuuaacauugucacuaaccuucccucuuuaucuggaaaaucaaaagggagguaucuguuuuuaaggcuggguaaugauuguagugaauagcucagacacaacucuagaaguugcuaaagaaacagcuuuuuaacugaugaauugcuuauauccaguuacuucuauuuguuucucauuugaucaaugaaucuguuuaaaagacucacaccuuuaaccaaaagagggcaaaaucugcccuuucuuuauuccucucuuccugcucuuuauuauuucuuuuuuuuaccuuuuuguuuuuugugguuuccauuaucuuacaaaaauauauuuaaagacuugcuguguggauuccucuuaaccaccauauaaacuacucuuuuuuccugugcccaaaugaauucccagauuuuacucaaagaccauuuagagaguuuuaaggaaaacacauguauuucauagaguugggugaacaagagugauagauacuguuaugcaaggagaguuacugaaauuuggagaacuaaaguuugugugccaauuuucagugugaaaaaacaacugaugugaagaaaaguaaauucugugaagcugaugucuccagugaccuucgaaaagaaguagaaaaucauuauaagcuuucuuuaccugaagauuucuaucacuucuggaaguucugugaagaacuugauccugaaaagccaucuggugaguugcuccagaaucauucuuguauuaauggaaagaguaauguaauaggaaaccagcugggugugguggcucacacucuguaaucccagcugaggcaggaggauugccugaggccaggaguuugagaccaaccuggucaacauagugagaccuccacaaaaaaauuaaaaacaaaaacaaaaaacuagacgugguugcaugugccuauaguccuagcuacuuaggagacugagaugggaggaucccuccuugagcucagugguuugagguugcagugagcucugaucacuccagccucagugacagagcaagaccccgucucuaaaacauagaauaauuggccaggcaugguggcuuaugccuguaaucccagcacuuugggaggcugaggcaggcagaucacuugaggucaggaauucgagacccgucugggcaacacagugaaacccugucucuacuaaaaauacaaaauuuagcugggcaugguggugcacaccuguagucccagcuacucgggaagcugaggcacgaucauugcuugaaccugggaagcagaggcugcagugagucgagauugugccagugcacuccagccugggugacagagcaagacccugucucagaaaaaaaaaaaaaaaaaaaaaccuaaccaaggauauaaacuguucauagaaaacaaauauuuuccaagauguuucuucuaguaagagaaaauauagaaagaaauauagauuaaugcuauaguaaugccacugucaccuaguuuauuggcaaagguaauuucaucacauucugggggaaugugaaggaaagcaagcucuuucauguguugcaggaguuauaacaguucugcuuccaagaacuugucuuauggauuacauaaacuaagaauuauguuugaggauauuuacuuaaagaaaaaaugggaaauggcuuaaaugccuaccaauaccacaucuauucaguagaucuucauuguuuuaaaagaaugaagcagauuuuuaggaaauaauaaacuaucaugccugaaauauguuaagugaaaaagaagaguguauagaguaugcuaccauuaguauuuuuuuaaaaauagcaugggggagagagaguacacacauaucccuguauacuuuucugugugcuuauuuugucucugaaaggauaaagaaacuguuaaugggcuguguucauuacuuugcacuauacuauuuaaauuuuuuaacuaguaggcacugucauacacuauugauggaaauguguauugauacauauucugaauuuugccaguagaucagaacagaacuguguagcuguuucuuuaaaaauagucaugccuuuagcugggcgugguggcgggugccuguaaucucagcuacuugggaggcugaggcagagaauugcuugaacccaggaggcggagguugcagugagccaagaucacaccacugcacuccagucugggugacagagcgagacuccaucucaaaaaaaaaaaaaaaaaaaagucaugccuguauacaaacauuuauuagcaaagauguucacugaaacauuuuagaacagaaaaaagaaauaguaaauuucccucaguaagagaauagaugguuaccucuuuauaaugcaguauuaugcccuauuaaaaaaucaugucaaauaacauugaauagcauggaaaaauauucagaacauuuaaaugggacaggauggaggacaaaagcagauuacaauacaaaacaacccuucucaguuuguuacauguuuguaucuguucauggggguggagaguauggaaauuuguuacuguauaauagacuauuaacuguuaucuucggcuaaugagauggaugguuuuaguuuucuucaugcuuuaaaaauuaguguaugcucuccuaagcuucaguuaagcugaacuauuuuuccugucaaguuaucuccaugcuucuauucauguuauuaccucuuccaggaauuuuuuuguuuucuucauccuucccuccuuauaaaacuggguccugucuggggugcuucccuccaucuuagaaguaaggacccauuugaaguuaugcauuguacacuugcacagacuucaugucuuugugguuuaugaacacucccugucugugauccgugaauagagaaggaagauggagucauccaggguuaggguuggccaaauagauugucaaagagucaggggaaucuggugugauuagcugagguagaggaaaggggauagaaauguuuuuuaccuuuuuuuuuuuuuuuuuuuugagacagagccucacccugucacccaggcuggagugcaauggcgcaaucucguuucacugcaaccuccaccuccaggguucaagugauucuuguuccucagccucuccaauagcugggauuacaggcgugagccaccacacccggcuaauuuuuguauuuuuaguagagacgggguuuugccauguuggccaggcuugucuccuccugaccucaggugaucagcccgccucagccugccaaagugcugggauuacaggugugagcgaccacaccuggccuguuuuuuacuacucuuaauccacacauuuuugcuaucuuucucucccuuaaccuguguguacuacaaguauuugaggcuaacugcagugugguaaugggccuauaggaauacaaaccagucuugcuuuggccaaaauaagaaacaacaggaaugucugaaauguuaggcuaauucagugguaaauuuaagaggaaauccuaaauguaaauaccacuuuuccuguuacucugacuucuuuuccauugaauguuuauaacugacaucuucacacauaacucaagauuuuuuuaguuuagaaacuuuuuaaagacaauugcuuagaaauaguuuacuaaauaaaagcauuauuuccuaccugucuccagaaaguauugucuaaauuuauuuucuuuauagauucacuuucugcaagccuuggacuucaauuaguugguccuuaugauauccuugcuggaaaacauaaaacgaagaaaaaaucaacaggccugaauuuuaaccuucacuggagguuuuacuaugauccuccugaguuccagaccauuauuauuggagauaauaaaacucaguaccacaugggguauuucagguaaaggaucuuuucuucgccucuaaaauacagcugcuguccugcuaaugaggauaaauaguuauucacuagccucacccaaggugaaaggcauauuuuccccuguugguggauauaugagccaucuguuguucuugcuguuaccguuuuaaccuucccuaggauggguaaacucuuuagguuuaaucucacuuguuuuuccuuuccuuguaaacuuuuuuucccuuuuggguucagaagagcucuuuuggcccaagaaagauaauuuagagcagcugugcuuaauaagccgugugccagaguggcaacugguaguuaagaguggucucuggagucacacugguccucuuguuuauuaucugugugacccuguaucauuacugacugugacuuucugugacucgguuuccugucuuguaacaauagggauaacuguacauaccugauaggaauauuaugagaauuaaaugaaugcaugcagaauacuuagaaauagagaaacuccaggaggaaaauacuuguccgcuuguaccaguagaaaugcuauccuuuaaagugaagauuaaauguaagguaauagaaggaacgugcccaggaagaaguguuguaguacagcagaaugcacauguggcuaggaauugaauuauacuguagccaagguccuaacuuacuagguccuuggcugaguaauuuaaccucucgguauuuguuuccucaauuuuaaaauaaaagguuugguuauauacgugaauaggauccuuucaucucuaauguuuuacaauccuuuuucuuguuuuuccuuuuuuuuuuuuuuuguauuugaguauaaaagcaacuagguccuaagaaucuuaguuuuagguuccauuauauaagauuuaucauagauauuccuaagaaacuuggagcuuaaaacuggcaaauuuguuugaauuuuuuuaaaaaugcccuuauaaaaaaggcaucaaccuagauccuugggagggaccuggcuuuccuuuuuaaaagauauuuuacugaggagcugaugaaaaaugacuagugugggguuagcagaucgaauaauuugaaguagaccaugcaguauuccuaccacuacaauguaaucauccuauuugugacagagaaagggaaaaaaguguaauaauaggacgauguaccuauaauuuggauaauuuugagcuauugaaaugucuuuguaauuuucacaacuguuguccguuguuugaggaugcuaccuacuaaacugaaaacauucauuccauaucuacuacauauacaccagcaacaguauaaauuuaagccuaacuuugcaauauuuauaauacuuuagugauggaauuuuuuaacaugcaguauguaaaugugcagauuuuauguguguugacaaaauuuuucagcuugcaaaaugggacugcaauauuacauuuuucacuuaaacaauuuuuuacaucuacguuguugcuuucuaaaaugaaugugaaugccaucuuuuaugacugcaacuugccuuuuccauuacagaaauuuuuguuugauguaaucgauaaauucugguaugauuaaaaaaaaaaaaaggccuccaaaaaggaaaaaaaauagguguaaauuguugucuguagaccugaaaucccacuugccugauaauauaaauuaugggcagcuaaauuuuuaaugucuuuugcuuacacagggauucuccugaugaauuuccuguauauguugguauaaaugaagcaaagaaaaauuguauaauuguuccaaauggagauaauguauuugcugcagucaaguaagaauauuuuaauuuauauuuguuuacaauguuuauacuacauuaguccauuacaaaggggguuugaggggcugggcacaguggcuuacaccuguaauuccagcacuuugggaggccgaggugggcagaucgcuuaggucagggguucgagaccagccuggacaacauggguauaccccaucucuacuaaaaauacaaaaauuagcuggaggcaugguggcacacaccuguaaucccagcuacucaggaggcugagucaggagaauugcuugaacacaggaggcggagguugcagugagccgagauugcgccacugcauugcagccugagugacagagugagacucuaucuccaaaaaaaaaaacaaagcggauuugagacaagcccauaauuguagauuucuagagauaauuuccaugacuuuugcagguagucuuaucuauacuguuauuuugugccucuucaccaaaaaaauacaccucuuauguaacuauuuuacuuaacgaaaauaauacuugaccucagguguuccauggcaacaucaacaguuuuguuagacaucugauuuuaaacaccuguuaagaguuuauuucuuauguaugguucaaacagaaaggcuuaauaaaguaaaaagagguggucauuauauccuuggaaggguugagggagcaggcugagcuuccaggaaugacaguuguguggcucacaguggauuuugucucugccaccaucagggagcugggaauucgagaacugcugccacagugaguggcucuaggaccacauuaucuuugguauaaucugggccagguaaauggaugcccuacucuuugccucucagcccccgugaagcuaagaaccaggugcugggaucucagcuacagcugcugcagaaccaucagaugccucuacagcugugcucauugauggagaucguggaagcacagccuccaugugguaucucuucugccucugagauuucaaaguauugcagcugcuuggaagaagauaggucccauguggagccugagcuaaagaguaguaugggaaaugcagugaacuuucauggggaagggguuggaauagaggugagugagccagucugugcuauaucagccacagacaugacuugaagccauuuuauuugucagcagcuguguaguuugcauuguaaugaagaaagcaaacuuuaucacuucaaauacaaguagauuaucuuuucuuugaccucuuuuaguacugucucuuuaaagggcuguuguucccugugauuugaucauacaaauuugcaguaaagugaauucaaacuaaaucacccuacuacaaccacuagacuaugcuacguacauacugguguaucuacaaggcagcuacauuguagauguccaaaaauguucuuucuuuucuaauaccucucaguuuccuauaaaauguuacuugguauuuguaauuuauaacuucuuuuaaacucuuuggauuuaucauucaauuuaaauuggugccaucuuuauuagaaacucuuguuguuuucuugcuuauugucugucucuugcacuagcauguuaaguuccacgagggcagaguaucugccccauacuagaugcuccauaaauauuaauucuauaaauaccuuggcauguaaaaacaccuaauuuuuucaggcugggcaacauagugagacugucucuuuuucgaaaaacaagccuaacuuuucauuuguguuauuagucauguuuuuuuuuuuuuuuaaaaaaagauaacauaauaguggucauguaacauaacccaagacucuucugguaucuuuuuuuuuuuuuaagcuaauuggagaacauagacaaugaaaaagaaaaaaaaaaugcaugggugauauuuauaacuuaggugaagaucagcaagugaguauuugaggaacuaccuccaauaauuuaucucaaacagggguaaaaaauuacuugagauauaacuauuuuaguacuuuuaaaguauuauaacgguuuuaguuuuuuagguacuaccuccuuaaaucagcuaaccagaacacuuaauuucuuuauauauuuuaaaauuuauuuuuauggcagacugaauaaggucuuucaaggcauaccuuugaucaacacauuuuuaucuuuaguuauuauuaaaucuugugucugcaagauuuaauaguaacuaaagaaaugccaauuuaaccagcaaagauuuuuuuuaaagguuaaagaaugguaauaaccaaugaugguuaggguauaagaacccuuacugauguguuaauugguaaaacuuuuguagaaagcaguuugaaaaauguuuaauguuaacauuugaaaaauguuaacuuagaaagcauauucuaagauuucuuaauaggugacauugucagguacuaugugaaguacacauuuauacccuuaaguuagcaauuucacuucuagcuguuuauuaaagggauuuuggacagguacagaaauauguguauuacagauuguuuaucaaaugaaaaauuggcaacauauccagcaauagggaagauuagguaaauauaaacuauccauauacuauaauacuuugguauugauuuguugaauuuguuaugaagugggcaaauaacaauaguguagaaugauuccauuucauacugucuaaugcauauggaaguaaacauaauucuuaaauaacuuugaacaacaaaggaaugauuuuuuuuuuccuucugccuuauuuauuuuccuaaaauaacugggguaaacaguuuugaccuugggucagggacccuuaaggucaaaacuauuugugauaauaaaauguuauuuuugcaccaauggcacaaaguaaauaguggauaauacuguugucaccuuggcaggaaucaagauagugccaccaggguagcagcagucauugcauuauucacagcaguaacaugcaaauguauuuaaaaauguuugugauggagccaggcaugguggcuacucgggauguugaggugggagcauugcucgagcccaggaguucaaguucauccuaaacgacauagcaagacccugugccugaaaaaugucaguguuggaguauacauguauuagaugucuaccauugaguucaucucuuuaacauucugugaugaaauaggaaauacauagaaagcauuucucauacugaaguacugugguuugucucaagggaaaaaaaagcccuuguaugauugaauuuugagaugaacuuuuccccacuuuuagaaagagugacucauugacugugugccugucaagauucccucugguuuucuggcuagaaagcucacccauuuccaguuucuaagagucaguucaguggcagagccaccagggacaaguaagacucuugggggugcuuugacccugccuaccugggagcacacuuuucccuucccugaugaccugggaugguggccaggccgugcccuugcugucgcugggcaguguccuuuuggaaagggagcugccccaggguuuagugcagcugccaacccuguuaggcccggccucucgaggccucuuccgacuucaagggucacacacccccaaagauccucucacccaugguaguugcugugcaugguucugucuguccgugcaccuaugcacacacaccaccccaccacccuacucugaaauuggcgagugaguugagagccagcucuguggggucaucccgcagccaugguugugccuguccuucaugguggucuuucagguuaucuuggcaacauguacauugcuuuucuuuuuuuuucuuauuguacagucaguacuauaaaauuucucuuugaguuuuauaccuuuguagcauuuuagaugacauuguguuuguacuuuguuguguagaguggaagaauuguguugaauaaacccaagauuggaaugcaaaaaaaaaaaagagugacucauugacaaacugguuauuugggucuagcuacuggcaggaauucucucaaaugaaccaaagaaaacaacugacuauauuuuuugucagugauaaaauucaggguuucaaauaaaaauuagauugagaaacuuguaauaccacugugagcgcaauagcuuuuuuucauaauguuauguaaugaauuugauauauaaguuucaacacuuacaucuauauaacuuaguaaaccacuauuuccaaagggccauugcaugaugccauauaacaugcauggguacaaauucauuugcguugaagacauucuaauggauuuaaagucacagcacaaaauguucacguucaugguuauggcuucaguugcacaucgcaccuuaucuuuaagcaucacacaguaaaguguuagaguagguuucggcagagacaaaaacuuacagagauagucauaauaaugucauauguaugggaaggcagcuaccaagugccuucaauaguggcagagguaaaagaggauauuuuaugugggcuuugauggaugccuaagaacuuacuagaaagaaugggaagaaggauguuuuagguaagggagcaguaugugugugaaagugugaaaauacguggcacaggguacuugaauggcuauauugccgugccagaguguugaggaagacuguaaagaucgauugauucacauaggacugacaugaucaaaucuguauuuuaugguugauauaaaaauacccucuagacauacagcugguaauaauugaagguaagauuuaguguaaccgugugcuguaaucagaaguuagauuuugauggcuuggguuucuguggcauuuuaaucuaccaguucuacugguaacucuacggguuuaaucuauuagcucucucaacuuggguaaguugacuauccucugugccuuuuuuuuuuccugauaaguacaaugaagcuaagacuagcacccacuauaaauguucuaacucccuaacaguguugcagggaauacuacaaacucucagauguuggcagugaauagaagugaguuucuuccuaggaguuguuacucccucagccuucuuccuggaagucuggcacacucuugccgcucuucauuuuacuccugaccuuuuauauugauggcaaaaaucuuaaccuguuuaugacaaaauauaaaauuauuuccauaaguggcauuaacaugauauauauucacauacuuuugagaacuacuuuggauuaugcuuuuguauaagcuuacaaaguagcuuugcuuuccuuuuguguuuucuaaauuuuucuuaacacaaacuucaacauuaaaaaaaaaaucuaucgaccuuuaguguuauaauaguguccugucucuuuaaaaaugaaaaaaaaaaaaaaaaaaaaaaaaaggccaggggcaguggcucacgccuguaaucccagcacuuugggaggccaaggcagauggaucaccugaggucaggaguucgagaccacccugaccaacaugaggaaacccugucuccacuaaaaauacaaaaauuagcugggcgugguggcauguaccuguaaucccagcuacucgggaggcugagucaggagaaucauuugaaccugggagguggagguugcagugagcugagacccugccacugcacuccagccugggcaacaagaaugaaacaacaucucggaaaaaaagacaguuuuuuguuuuuuuuuuugaggcagucuuaggcugaagugcaguggcacgaucucggcugacuggauggcugcaaccucuaccucccggguucaagugguucucguaccccagccucccggguagcugugaauacaggugcaugccaccaugcccagcuaauuuuuguauuuuugguggagacaggguuucacuauguuggccagguuggucuccaacuccugaccuugagugauccgcccaccucggcuuccaaaaguacugggguuacaggcauggaccaccaugccuggucccugaaaauauauacauauauuuuuuugagacggagucuugcucuguggcccaggcuggagugcaguggcgcgaucucgguucacugcaagcucugccucccggguucacgccguucuccugccucagccucccaaguagcugggacuacaggcgcccgccaucacgcccggcuaauuuuuuguauuuuuaguagagacgggguuucaccuuguuagccaggauggucuugaucuccugaccucaugauccgcccgccuuggccucccaaagugcugggauuacaggcgugagccacugcgccuugccugaaaaauuuuuuugaugucuacuuuuuuuugaugucuacuuuuuuuucuguuaggucagacuucuccaaaguaguaugccauaucuuaguaucaagugauacaguuuaaaccuugacuaaucucagcuuugcaaauaccccuuauaccuuuauuguagacauuagagugcuaauauaaauuugaaucguauuugcucuuucucugacuggcaguuuuuuaugaauauugcuuuucucuuauuugaagaaaacuauuagggauuuugagagaaguguugguaauuauucuguggacuuauucuuguauggaauuugacauuuuuaccuuggcucaacuuugaaaggucuuuguacuuaguacaguggccugccacauaaugcggacuuuuacuucuuuuucagauuauuuuugacgaaaaaacuuagagaaauaacggauaaaaagaaaaucaaucucuugaaaaacauagaugaaaaacucacagaagcagccagagaauugggguacucgcuugaacagagaaccgugaagaugaaacagagagauaagaaaguaugauuucaaccuguuggucucuguuuugcuauagcauauuuuuuuccccucuugauuccuucccaucucuacuuuacccuucucuucccuaguccuaucuuaagaacuggaugcugucccuuagggauguuaggaggauggcacugaaagaggauggcacugaaacaggggucagauggcuccuuuggguugguacacugauugaauugcgcaacuggugauaucacugcugugguugaauaacucaugccaguauuuaccacucuuuuaaucuuguuuaccauuuaaucacuucauaaaguuaagugaaagcugcuuuguacauaaugaaauuuacauacauacauuuucuccaguaaacguguauauaagcagugcuccuuucuuuuuccuuauuaauccuaucauuuccuuuugcaucucuccuaaugucugcaauaugaggggaguauuuuguaaaggagcaaauacuuguuaauguuggauucuuuugguuuuucagcuauagauuucagaguaaguuaaugacaagcuggaagauuucugguuuggaguaaaugagaauucuauaggaguuuguucuuauggccucuggggaaaaaacaaaaacaaaaaaaaaauuugucacuggaaugagggcuccccagucuccuccagccucucaccauuugucugcccaugcugguucaucugaauguucuaagcuaaauggagaacuugcuauuccuuaauaaacuagcacugguaaugaaguaccuuaguguacuuaggcauuaaauccuacuucaguuccuucucugaucuugauucagcugcaggggugacauuuguaucaaguucuaggcacucuuuaguccuauagacuggaaaguuucuuaaaacauacauuuuaaugaaacccauuacaauauggcauuuuaaauauuaagauuuuauauugccauuuaccuuucugguuaucacaggaagcuucuuccacuuugugacuaggaggaaggguagcauuuguaaccuaguuaauguauuucuaauuuguuuugacuaaagucugagcauccguacacauaauagcuguuagcaaauuauuuaaucagucuuuuuuuauuuuucuaccacaagcuaugauuuauuucagaggagauuuucuuaauucuuccccauaaagaagauaugauugagguuuaaauuucauagauauuuuuguccuagaccccuccccuaugaaguuucauuuuaguauuuguuuuuuauacaaaaacagcugguaaaaacaaagacaaaaaagaacuuucaagacaaucauguuuuuaauccuccccuguuaaugacuauacuuucaaacccuuuucuguuaaaugcaagguuguucuuuuauuguuuuugugagaucuucauugaauucauauuuuucuacugaagaauucaauuccacuaguauaugugaguuaguggcuuuguccuugugugugagcguaagcauauuuccacucuaguaugauagagcacugugcagcacacuagaaaucaguguuuuuauacugauaguaacuuagcauacuuuggaaugcagagucuuuaugaguuauaucauuugacucccuacaacaaaucugcaaaguuggaauuauccuauuuuauagaugaguaaauugaggguuauagagguuuugugucuuguccaaaaucuuaaaugacacauguaaaacccaacuucauauuuuccauauuuagcauucuuuccaccccaucuucuuacuaauuggcucucugccacuucaccuuuuucauaccuggauuucuucauaaggaacguugguuaaaugaugcauaaaaugaugguguggcacuccauccaccugugaucccaugcuucaggaugucacccaccccuauacagcuuuccuaaauuuguaaucuuauucuucuuaauuucuuaauaaaauuacaauucugaugacuucuuaauugauuccucuucauggacaauuaguacagguaaucaucugugaaaaaucugaacauauuaccaucauucuuuauguuguucagccugagcuggcaacuauagcacugcugucuuuuucuuucauuaucagugcuuuauguccugcuuuuuacacuuaugaauaugguaucuuuaucauuucauauugccaauuuaagaucuaccucauaauuuugagcggcugcagaauacugugcuuauggucaaaguuuggguugcuuaagauuuuucacaaacacaauccugccauagauauccuuuuauaccuuuauucucauacuuaucugguuauuuuuuuagaagaaauuccuagacguaguauugccagguccaaaguaguuuguguguguguagguguguuuguaguuuuucuuugcuuguuucuaauuuugggggguuuucuuuagucuuuuuaguuuuuuccaugcugguagguauaaaauucugcaguuuuaauuagcauuucuuuaauuauaaaggacguuaaauacuuuucucuguuggccauuguauuuuuuuuuuaacugccugaacucugcccauuucucuaucaggguuagaauuagucuuuuucuuacauguguucuaauuuggauguuagucuuuuccuuuguuagacucccuuauaguuuaaagacauuaauuuuuauuuacuauuacauuuugcagauauauuuuaucaguuaauuugucuuguguacuugauuucacuggauagacuuuuuauuuuuauauagucaacucuucucuaucacaaaauuauuuuuuaaaauuuaccuucgaguaguuuuaugucuuuauuuuuuauuuauuaugcuuuaaauuuuaggguacaugugcacaacgugcagguuuguuacauauguauacaugugccauguuggugugcugcauccauuaacucgucauuuacauuagguauaucuccuaaugcuaucccucccuccuccccccaccccaccacaggccccagugugugauguuccccacucuguguccaaguguucucauuguucaauucccaccuaugagugagaacauguaguguuugguuuuuuguccuugugguaguuugcugagaaugauggguuccagcuucauccaugucccuacaaaggacaugaacucauccuuuuuuauggcugcauaguauuccaugguguauauguguaugguuuuauuuuuacauuuaauucugaaauccagcugcagauuaucuugauagaaagauuaagauagaagacaaugacuucauuuuuuucccaagugguaagcaguugucugauaacuuccuuugaauaaucugcccuuucuggcagcuuaauaaaggauaaugaaagaagcaagagacugggagaauagggagauuagagagaaaaaaaucuuuaagauauagagacuuaggugagaggccuuuaaaauuggaguuugguuuuuggguuguguccuuccucugccuuggaaacuuuucacugaauugcacaaagaaguggaauauuuguacagauguuucgcuaaggaaagaccuaaaaauaaugucacuaacaugagcuaaaggaagaauggaaacuggaaggguuauggugguaguuguaguugggccuguuuuugucuuugaagacuaccacuuaauaaaagcucacugguuaugugauuugccuccauaaaggacaccacaaaccuagaaacugcccuacuuuugggaaguuugcagagaagccuaaauauuccagguaaaaauaggggagucucaauuuggcaggauggaugagaggaguucuguccuaccauaucuucuugcugacaagaacuauuucuuacucuuuuucuuuuagaaccagguuccucugugcuuucuaccagaagguacuuugaccuuagaggaaaccaauauuuugacuugccuucuaggauguauuggguucuuccuuaacaaaucagggugcagacuuccaagugacuggcacaauuaagaaaagccaauuauuucacuguucugugauuacuucaacuguuuaacuuuuagcugauuuucaagaaaaaaauaguguuaaauuuuuacccuggaguccaaauuuacugaaauaaaaugugauuaaauguuacauuuuggcagaaauguugaggguuuauguauuuggggauuuuuuuuuuugaugucugcuuaccaugauuacauuuuauucuuuucuuuaauguagguugugacaaagaccuuucauggugcaggcuugguuguuccaguagauaaaaaugauguuggguaccgagagcucccugaaacagaugguaauguauuucauaguaaacaugugcauauauguuaaugcacaugaauaaagguuuugcuuauauugggaaguagguaugucuauauaccuuuucugacacagucgcuagaccuuaguaauaaagaguaagcugagguuuuagagucagucauuccugaauuaaaaccgaguucauagcuguguggccuugaacaaauuauuuaacccugugaaaucuugucuuuuucaucuguaaaauggagcuaaucauaugcacuucauaaaggaauuugugguguaaacaaguauuaaaauacuuaacaaaaugcuugccucaguguucaaaauucaguaguuucuuuuuuuguuuguuuuuuuuuuuuuuuuuugagacggaguguugcucugucgcccaggcuggagugcaguggcgcaaucucagcucacugcaaccuccgccucccagguucaagcgauucuccugccucagccucccaaguagcugggauuauaggcacccaccaccaugcccagcuaauuuuuguauuuucaguagagacgggguuucagaauuuuaacccauugccugcuucuugggaacuauuuccgaaccuuugacauuacagucaacuugcaaaguaguaauuauugaaauuguguuuuuaugguucuuugugaacauuuuuucaucugccuauaaaaugauuuagcuuucagaagcccaagauccugaacuacgucaucuguaaguauaaaaacacuuugaaaauggaccacugcgcauaaucuaguuauugcuacguuaaacaucgagaauuaaaaucgcuucucaauucuuuuccccuugucuccauucccuuaucgugaacagcccugcugguauuccuuuauugaucauccucuucuggggggauaaaacuuaaagggaaaucaaacuuagcaucuucucaaagaaccacauauuccugcccaaugcacguauuuggccgucugcuuuucagaacagaacuaacuagccuugguaguuaccagucucuggggguugugaccuggacaucugcauuuaaaccaauucucuaaagcaguucuucucaaauuuuacugugcagagucuccagccaguagguagagaugucuuagauggcagcuacucauacggaccuguuuuugcuguaccccugccacuuagaggagugccauagggaagacgaauguggcugagcuguccagugugauggccacugagugccucacagguggcuccugcaacaaaauuuguaacucguauuuauuuuuuacuucuuuuuuuuuuuuuuuuugugacagggucucacucugucacccaggacggagcgcaguggugcaauuaaccugucucggccucccgaguagcugggacuacaggugugcaccaccaugccuggcuaauugguggguuuuguuuuuguuuuuguuuuuguccuguagagacggggucucacucuguugccgaugcuggucucgaacuccugggcucacgugaucaacccaccucggcuucccaaaguuuugggauuauaggcaugagccaccgaaccuggccuguaauuuucuauaauuuuaauuaguuuaaguuuguaaauuaaaacaggauuaaauguuucuuacauugauuauauguugacauaauacuauuuuggaaauauggguuaaauaaaauaucuuaauuucaccuguuuuuuguuguugguuuuuuuuuuuuuuuuuagcuccuucuccugccccaccuguuucuuuuuucauguggauacuggaaaaaauguaacccacacuguauuucucuuagacaggcugaucuguccuauaucuccucuuugaagccagagucaauuagucucugaugggaccauugugggcccuagcuacuggucagucuucugcuucuacacuaagucaucuucucuucaugucucugcucacagagagagcuuuaaaaagcaugauuacuaucucguuugggaaagguugcgcacauuuguuguagagaugggcagucucuaaagcuuuuggggugauggauguuaaauuguagugcccuggaguaaagccuguuacccugcgguaguugugguucugggguuuuauauccaagucuacuauucuaggcauuagauccuucuguauuuaauuaguuuugaagugguagcaaaacauuaagacugaaggaccuaaucuucuugcucuugccagugucauuugccaagagguauaacugacuggcaguuuguuaaugugacaaugauuagcaaaucacaacuaaguuuguucuuaacccuuugaagcuucucacaauaacgcuuuaacuuagcaaauaagauacguuuuauugagcaauucuuaaaugucagugucaugauucacuuuaacaagugauguauuuaauucucacccaacucuuuauuguaggucuuauucccauguucacaaaggaaauagacucacggugcuuagcauuagucaguaagggcucugguuuucuuuuuuucuuucuuucuucuuuuuuuuuuuuuuugagauggaauuuugcucuugucacccaggccggagugcaaugguagggugucagcucacuguaaccuccgccucccagguucaagugauucuccugccucagccuccugaguagcugggauuacaggcacccaccaccaugcccagcuaauuuuuguauuuuuaguagagacaggguuucaaccauguugaucaggcuggucucgaacuccugaccucaaguuaucuaccugccuuggcuucccaaagccccggcugagggcacugguuuucauacuugguuuucugacuguagagugcauacuacuauccgaaguaagaagaguugccugccuaguugccugauuuuuaccuugacagaacuacuguagcuuaauuuaaguauucuaguugauaguaguggcagggauauaguaagaauucagcagugaaacuccuaacucauuaaauugaguauuuugaguagaaacauuuaagucaucauuuuugaauaguuaacuuaaggcuucacucauguucuuuaaguuuggguuucaguuaaaugaaauuucuguagaauguuuuauugcuggaagaacauauuuuuccuuguacugauggugagcugaauauuuucaucucuguucuucaguguuuuucuagcuuaguaauucgcauaaguugcuuauucuuuuuaguccauaugugacuugccagguguaaaaauagaaaauaagauacuggaaagcgauaaacuuuaaauucuucacuuccauacccacccugauuuguaguggcugacuggagcacagcgagagagauucuaagggucccagucaaucaguuacacccacgauaacagggaggaaccacuuauuuuccauccuuaaggagcuuuuuggagaaagcuucaucuguuuucuugaaaugaucagcacugauuuuucugaagaaaggaaugucaugaagcucauguaaaauaauuuaauuuguaaaagguuucaaaccaacaaauaugucacuacuguuuauagauaguuagaaacguagguggugcaguuugccauucguucaaugcgauacugguccaccaaaagugggaaagggaacaacacauuuugugacugggguaacagcauguauucuguacugucgucaagacugaaccaaauguuauucauagacugggguuaaaagcacuaguauauaguauauuuuuaauaccauccuugguaauuuuuuuuuuuuuuuuuuugagacagggucuuacucugucacccaggcuggagugcaguggcaugaccacggcucacugcagccugcaccuccugcacugggugauccucccaccucagccucccaaguagcugggacuacagguguccaccaccaaguccagcuaauuucucuauuuuuuguagagacagggucucaccacauugcccaggcuggucuccaauuccuggguucaagcaguccuccugccucagccucccaaauccucccacuaggauuacaggcgugagccacugcgcucagcccgucccugguaauaucauaccugauauuuuucguuagucucaucagaacguugugccucauacauagaauuuaacaucaccuaucauucuugaguauaauuguuaauguuuuaaccagucuuccucucccccaguauggcagccaccuguuuggaaauguuuuguugguuuguuugaauaauauccauucuuuucauucucaaagaaguacuguuuguuaaaaaggacauacaauuugucaaaaggaagucuaaauagauauuguucauacuuccaucucauuugcguccugaaaucggauguacauuaacauccagaaagaaugaaaaaaaucuugaaagccaaaauugaaauguuaauuuguaaaaauauauucuuuagguaaauauuagacauuuucucucuauucuuaccucaaacgcaugcuugccaugccuacucuucucccaauuuggugaagguuuuaguuaaagguuuaauucugcagugauuucuugucucuuacauuguugucuuuuucuggguuuaguucaccacaagucacaagucaguaauuuuuuuuagcaaacaagguaggacagggcaaaaagaauaaauuuugccuacuuggauuauuuuuuaauccaguugucuuaguaucaggaccucgaaggauacccagaaucugaugcucaagucccucaaauaaguugguguagaauuugcauaacuuacgcacauccuccuguauauuucaaaucauuucuagauuacuuagaauaccuaauauaaaguagacacuauguaaauaguuguuauacuguauuuuuaaaauccguauguuuuauuuuuuuccugaguauuucaauccgcacuugguuuaaucgaaggauguagaacccucagauacagaggcaacuauauagugcaugaaccaggcuggcagacuuuccauguacagccagauaguaaauguuuuacacuuugugggcuacauaaucuaucacauucuuguuugauuuuucaaccauuuaaaaaugaaaaaaacuuaguuugagggcaguuaaacacagggugagccagguuugcccaaaguuugccaacuccuggacuagucugcugaaucuuuaaagcuuauguaaaugcaugaugaccaccauggaauagacuuuuuaaaaaaaucaugacuguaucugggcccaguggcucacgccuguaaucccagcacuuugggaggccgaggcaggcagaucaugaggucaagagaucaagaccauccuggccaacauggugaaaucccgucucuacuaaaaauacaaauauuagcugggcgugguggcaugugccuguagugccagcuacuugggaggcuggggcaggagaauugcuugaaccugggaggcagagguugcagugagcugagaucgcaccacugcuuuccagccuggugacagagcaagacuccgucuaaaaaaaaaaaaaaaaaaaaaaaucgugacuguaacuaaauccugugaaauagucguuaauaaagaaauacuuguuaaccuguuuuuaagcuugaauccuaaguagaaaaguuaccaaauugccauucuaaauuagagugcugaagacuacuacccaagguggcacaaguuguauuaguacaaagucuuaggaggaaaaacccucuuuauaaucuucuuacuuuugaagacugauucauuuucuaacuauguagauaaucuuuuauauuauugauuucuuucagcugaccucaagagaauuugcaagacaauaguugaggcugcaagugaugaggagagacuaaaagcuuuugcucccauucaggaaaugaugacuuuugugcaguuugcuaaugaugaaugugauuauggcauggggcuugaauugggaauggaucucuuuugcuauggcucacaugugaguaaaaaaacccuccaccuucuacccacugccacaccucccuccucuccccgcgacauacauccacacaugaauacgugcacauuuauacccccaaauuccagcagagguaagacagggauucagcuuguauuucaaaaugaaguuuuugaagugauuuuuuuuaacguagauguccuaaaaauguuuuaaacucaucuuauauucuggcaaaggugaauauuugcauucacucaaaggugaagauuauuugcauucaggcuuacauuaaagugaauuuacucauuagacacauuauagggacaugccuucuugccguguguguacguuuggggcuagguaugggggugugugcacacaccuuaggcuccauuucguuuccauugugguggggguauuuguuauugugcuuaaauucuuagaugaaaaaugcacuuuaaauuauuuaagcuuuauaagagaugcuguuuuaccguuaacuaauugcucauuaaauaagaaaauuuuacuuaauagcuaaaccagugcuuacucgaccauaguugccugaagaucaaagaggcaauaagguguagcggauaugaccuguuucuggggccaaacugguuguaaaucacaucuucccaguguguaagaucgggcaagcuuuccaacaccuuugcaucuguuucuuuaccuguaagauaugugugcacaugugcacgagugcauacccacacgcagaucauuuaauucucauuuaaccuacuuuguaaccaagucacagagaggcaaagcaucuugcccagguucacacaagcagucuggcuccagaaucagugccuaaaucagugcaguaauucccaaacuaaaaugcauaugacucaccugcagacauuguuaaaaugcacucuaucgguagguccagcaugagaucugagacugcauaucugucaugcucccaggugacggucaugcugcugcucuacagaccacacugggaaaagcaagaccaaaccaguagcucuccagcuuuagcgugcaucagcgucaaugggaaggcuuguccaaacgcucacuggcagucuucccacccuccccaaguuugauugaguucuaggguggguccugagaauuugcauuuccaacaaguugccaagugaaguugaugcuccuggucggggguguacauuuugagaacccugcuauaaaccauauuauacuacuuuucuuugcccaccucauagauaguuaucaguaaaaauaaucaaaaugcuuaacagccagaaugacagucauugaccaauccaaauaguacuugaccugcuagagaggcccuagccauaaauaaguagagccauaagaugugaaccagugaauagcaaacuugcuuguugugagaaugaaauaacauguaugaguuauaaaaagguuuagcacagugcuuaccgcauguuaagggcuaaauguuuauuaugaucagcaaaacggugguauauguagauaauagcaguaaucucaaaucuuuugauaagccuaaggcagugacucuuaacagggauugggaggcgguacguguuggggaugggggagagaaggaauuugaggauaaaggcaauacgaucugaaaacuuucagcauagcuauucuuacagaauugaggaaaauaaagcuuaaacuuuugccugggaauacacuggagagaauaaaaaguauuugugggcauuguuuggggugagaaaaaguugauaaaaccuaagggaauaaggaagcucgauuuaauuugguuuucuuaauuuucaagauaugccauuagucaucuagagcaacaagacugccucuuagaaugccaggcgccuguccuuaaauuauguucacuaaccaccugaggguguagcuaaaaugauuuuggaaguagccuuuguuaaacaagugcuuuguugauauauuuucugcuacuuauuaggauaucugcuauauucucugcuuaauguuauauuuuuauuuuucaguauuuucauaaaguugcuggccagcuuuuaccucuugcauauaaucuguugaagaggaaucuguuugcagaaauuauugaggagcaucuggcaaacagaagucaagagaacauagaccaacuugcugcaugaguaagguggcuuugauugguguacaguauuucaaaggacuaguauuaaacuugugauuuuuguuuuguuuuuaaggaauacaaaaaauaaacauuuacuaaaaacguuuauaagguucuucugccugguuuuccuucuuuaaugugcaaaaaaauggcagucaaaucaccuaaauggugacccuaaucacauuuuggaggacaauuaaagucacccucugauaugucacaggaagccacugucuaaugccuguggcuauaacuagaccauccuuacagaguccuguuucaauauuuaucauaugggcaacuaagaauauuucuucugagucuugaguuaauagcuguagcuuuaaggaucggguuuauggcaggagaagaggggaacagaaggaaacuuagaaggagacucaugacacugcaauaagcacucuuccagggugccugaccccgaccuacccaaacugcauuuugaguaguagcuccaggugacucccaguaaguaguccaguuaucccauuagguauauuauuuuaaaucuucucuugacucagucauuuacuaauacagucuaguauauugauacauaguauauaguuuuaguauaagauaguaaucaguauaccauuacuuuagauuuuaaaguuuuucauugcaaaugauuucaauggauguuuaguacgaaucuguggauagcuguguuuuacuagauccagauuuuccuuaaaccugauuacauguccuucaccuuaaaaguagagggcagggccgggcgugguggcucacgccuguaaccccagcacuuugggaggcugaggugggcggaucaccugaggucuggaguucaugagcagccuggccaacguggugaaaccccaucucuacuaaauauacaaaauuagcugggugugauggcaggcgccuguaaucccagcuacuugggaggcugaggcaggagagucgcuugaacucagguggagguugcaguagauagccauugcacaccggccugggcaacaagagcgagacuccgucuccaaaaaaaaaaaaaaaaaaaauagguagagggcagaccaugaaaugcagaauagcaaacuuccuggauggggcugaggaguguauaagcuuuuuuccccuuucuaugaaguucaacauggaaaagcaccguccccccaucccaggucaucuaguuaaaccuccacauuguguaaaauugaugugauuuacucaaauaacuuauugacuagacaguaguucuccaaaguucugucagcuguccccuuaaaauauauuucagguacuuacucuuuuuuauauaaggguaugaguaaacuauuaaaagacaacacuuagaauuuuaaauauaaguagcauuccucaucuccccaauuaggcugcaagcuucuuaagggcauguauuuuauggauguauaucccccucaguaacacaaaccuuuggaauugcacuuugugaauaaaaugacccugucacauguucuucaaugcuagacagaaucaaacuggcaagagcugggaaacugauaagaugccugggaguuaaggauucuugacuucucagacaaaaagucuucuggggucaaaaaucucugccacaaacaaaaucuguuccuuucugccaauggcucauguugccuuuggaggcagguaagaugcuuucuucaagguagguauauuuuguauaauaucuuaaccaaaaugaaacugaaaagaucuucagcuucccuuucauaacugugcaggaacuuuuacagcucuuaauggggaggucuuagguuuuaaggaacugccauuuuaguuagguaaguagcuccaggcccuggaaccaucugaacuauuaacuuguuuuauauuaaaacauuacaguuacaguuagcucacacauauuuuauuagaaaaagugaccaaaucacauugaucuuaaaugauuuuaggcuauaaauuuuaaauaaaauguuagaaguucgagcuuuguuccucagauuucuuuaguuucuaacgggcucaaccauuucuaaauacugccccuaauguuaacacacuuaaaaaauauccaaauucauguaucucauuaaauauuuguuuagcuagaaacauuagauuccuuuaauuuugucacuuggugauccaacagucucaacuguauaguuuguaagauuuuuuuuuuauaugcuuuaucaguaauauggauuccagaaggauuuuuuaucaaggaacaaaugaaaggggacaaaaaaggugaaucggcuuuucauccauuccuuacagaaaccuaauaugaauguaucuucaggaagcugggcacaucagagccaagacagaaauuggacacaaacucuaagaauauggugguuauaauucagaugauacaguugugaauggaguuuccugaagacaguaauaagaaauguggauuuccagucucaaacuccaaccaguugugucagagugcuacuaaccuguuucaggagguacuaucuuccaacuacugaacauuuuucauuaaagagcaagcucccuacaggaagauaccaaauuuuaucuuuuuccuuaacuaaaggcauaguccacuuaaaccuaguucacuaaauauuaccuaggaucuggucacucaauugcuauaguagcuuccaaauggcaucuauauaccucuguucucugagaacacaguuuaagugccuaggcucuuucaugaaugaagaaccuugauccaaucaggacuuaacagaaaaucauuaccaguucacauuuagcuaagcucaccucuuggaguucaauaauggaguuucuguauaaccucucaaacauguauguagaauaacacccaaggaaaaaugaaagcugcaaaacagauugcuauaaacuaaucugcaguguccuaagaccuuugcauuaccucaaacacugaccuuaccagcuuaauggcauucuguccaaacuauuccuaucauaauu

SEQ ID NO: 15621 - RNA, 102758 nt, Homo sapiens
caggcauaucggccuacacugcguagggcagcagugaagagggaggacuguuacagauauaauuaaaggccaaaccacacauugucauauagauuuuaauagauuuucugauuaacucaucacaguagucguuuuuacuguaaugauaugcagcuuuacuacacuaguauaaauaaaaacagauaaauacagcucuaggcaacauuacagauuaacuaagcauucuucgugaaccaaaacugaaaacaauuaauuauuaagaagaagagaugcugacacccuugcccauucucaucauaccuucucaaaaaggguauucaaacaaggcgcuacacuuauuauauugguaaauuaauuugccaauuagccaggcacaacaauuucauggucuccacuauuucauuauuuugguugaaaaggagacacacuucaauguaugaaaaagaaaaauggaacagauaacaccaaagaaaaccacuaaaugcauuaaaaauacggcacuuuuccuguauuuuagcaguaagauagaaauacuagggauagaaauauaccaaaaaacaaaauuaaugcuuuaauuaauauccacccugaaaugucagucucugaagcaagaugggcaauuaaaggaggagcagaaauaaaaaagggaaauaugauaaaauaaacuccaugugaaguuuuacgaagcuaucugcaaagaaaccgauuuguccuuugaaggcuauuaacucaggacaauuaaguuauccagcagccaugcugaggaguucauagucuagcaauacguugcacacaggcaaauacacuuaagacgaguuggagauauacagaacuaucauuuagaaaugauuuuacucuggauggcucaaaaaacuuugaaagggcuaugaagaaaacuugaagucugucaaaggagagaaguaauaaggaauaauuuuaggcagauagcacagcuaagaauguuucccaaaaucccgaaaauuuugcucaacuuucaauccucauucuuauauggcuucaugaucuuaugucuucaggaucuuacagaucuuaauagguauacuauaauuaagaacuaggaagugaagaaucacuuucaaaauguaaaaacagcucauugccaguuguguuucagaaaaugucugucugggccaggcgcaguggcccacgccuguaauuccaccacuuugggaggcucacgcaggcagauugcuugagcugaggaguugagaccagccugggcagcauggcaaaaccccaucucuacuaaaaauacaaaaaaauuagcugggcaugguggcgugugcccguagugccagcuacuuggguggcugaggcgggaguaucacuugagcccagguggucaacgcugcagugagccaagaccaugccccacugcacuccagccaaaaaaaaagaaaaugucuguuugcaaaaauuucauuuuccuaucaaaaaugcauaauuacagaauauuuagcccaguccuuugaguaaacugccuuugccaauugugaauuaaggcugugauuaaaacagacaauuccaaaaacaaaaaucccaaauauaauccagugcauuuucacucauccugcaaaaaauguucaaaccaucacugaccacuucaaauauggacguaaccuagcccgagauucaaagguuauuuucagauuaaaauuuuaacugcuaucuuugcaauucuauuguuuucacauuuuugguuugauuuuuuuuuuaagaagguauacacgaacuuucgguuuuauucuccaaaguaauguaguuuuucaacuuuccaguuaauguaguuuuucaacuuuccaguuaaugggucaaaauggacaggucagaagacauaauccagaggauggcagugaaagaucagagaaagguuuaugugcacacuggaucacagagagagaaccacaaccuuuuuuuaaaccuuuguucccacuguaaacuuuguucauaucucuguauuuguaagucugaauuauucuauaaaaaucacauuaaaaagguaaaauuacuuaagugcaauauuaacugaucuguauuuuauaaauuuuaauccauaaaaauauaaauaagaaugguaaauuuuuaagaaaaaaaauauacauuuagugcaaguuaugaauuacauuucuucuucagugucagccaugagauaucuugagaaaagaaaagaaugacugaucuaauuucaauuuuaaaaauuccaguguuuuaacaugcaauuaauaccagauacagcuaaucagaauacuuccuucucuuuacugucaaagcagcagcauuuuauuuaauuaugcucaacagcacuuguauaucauaguaguaguuuuagaaauagaaaauuugcauaagacccggucacauuauccauaaagucugagaggaaaacaaaaaagaaaacuuuauccuuuaaaaccaagcuucauuguuuucgguuuugagccacacggcacacaaugagagauuucguucucgcuuccuucgagacuuuaccuguuugaugagccuuuguuguggugcauguguacuguuccaagcauuuagugaugguacaaacuacaugguuaauggcacaagaaacacucccuucuugugaugaaaccucaguaaaaucacaguacaucucaauaugagaaaggacugcuucaaaaggauacaccgauuuaaagaggcuuuguuacagcucaguagagagagagagagagagagagagagagagagaaauaaaggcucuucuggaauguagaaagguaaugcuuaacuauacaauucaugaauuaaacagaacaguuuugauuaaaaaaaagggcaagaccuugcaguuuuauagauggcucaauucaaaguaaucccucuagaaauagggacugauaaugugucuuugcaauguuggagcaacaggccaggugcucgaggacucugcugucaucucuguugaggcgcaagccugcacuaucaggcacauccucagcugaaugcauccagugcagaacaauaggaguugauacgcugcuuucuguuagacgggaaauaccucacuccuuuccuucucucuccuuucccuccccaaacaacuccuccauuccaccagcauuauuugcaaaccauguugcaaaaacccggcuuuuauauuuccuuucuuuuuuuguaaaggaggaaaaaaaaguagaugacucccucagguuaaagaguugugcuauucaacaaauaaacuuccucuuccguuucuucucucuccucaucugugagauucaguugaacauuauugaagcggggucuugguuugccgucugggccauaugccggaggauaucuuuuuuuguuauaaugccaaggaggcgccugaaaggaauaaacagaagacuccuaugaaauaaaagggaaaauaaaaggagaagcuaaaucuauagcuaaauccuuuuuguugacaggaauagagcaaagcaagcagccugauuuuguauuuccaaaaaguacuuuauugguaaagauauuaaaauuauccagcaaccauccuuugguauaaaaaguuacuauggucacuaauaguaugacagccuuuccaccgagagucugaggacugcaugccucaaugaagcagagcuauuuugauuaauguaugccaacaaaaaaguaacaaaaacuggauggauguaugacuaggaaaugauacugaucccauuugagaaggaaaauugauuuccaucacaugaagagagcaguaaaaugaugaccaaauccucucaauauuuucucuuuuucauuuauuuauuuauuuauuuuuugagacagagucucgcucuguagcccaggcuggagugcaguggcgcgaucucagcucacugcaaccuccgccuccuggguccccgguucaagcaauucuccugccucagcuucccaaguagcugggauuacaggcaugugccaccaugccccaauuauuuucaguagagacaggguuucaccauguuggccagaaugggcuucaacuccugaccuugugauccacccgucccggccucccaaagugcuggggauuacaggcgugagccacugcacccagccacuuucccuuuuuuaaccaaaauuaaccaauuuuucaaagauaauuuaaggauugcccacuuguaucagaaucuucaugaaagcacauacuauuaagauaaaaugcauauaaaauggucagcacagaacgucaaucccaaacaucagagccccaagaacaaaucuauaaaagaauccaaguuucuaggacacuuaucaauguuuuccuuuuuuugauuuaggccaggaaaguuaagauacagugcuuuuaugaaagucuuaguuguuaaugcuuacauuaaaagauaggugaaaaaucagaaggcaguccuaaaagauuauuauaggugaagcagaaagcagaaugaaugaguagcuacgauaauauucugguuaguaguuuuuuaaaaaaggaugcaugaaacacuugugaaauauuagcauacacacaggaauacauaaucaguugugcacuuaagcaaacugggacagguuucauacagguaugacaauugcagggcaaaauaauuucgggcauuaauugcuaaagccagacauuuuuuauguuaugcaguaagauaauucaaauuuguagucaugaaaccacuaggacauaaagccaguuaaaaugaaugcauuugacucuaaaagcugcuuauagcguuccagaaacaucauacaaaaggggcacacacauaaucuagguacaauucacuaaugagauggcaggacacacacugugacuuugaagauaugcaggguauagcagaaaaagaacuaaugcuaugaucacaaauaauauacacauuacacucuaguuagugugcccauuaaaaaauccauuuaacuguaagcaguucuaauugcuaagcuccuuuaaaauccuuuaggagcuuagauuuaccauaagacuaccacaagaucgggaaacauuuaaaaaaaaaaaaaagggcuugcggggaugggucagacauuuuuaaccagucaggugucuucugagaccgguguauccacugagguagacagauuugccauauucacuuuaagaauguccaauaauauucacuuauuccacuaccaaacuguuuacaguucugaaauuguaaugaaugauuugaugagagauguuaacuuuugcuuacuuucuauaaaugggauuuuacacauaucuaaauuuaucuuacagacacauuuuaucagauacaaauguaauuggcagcauaguaggauauuuuuguucagcagauaucugggaaagacagaacucaacaguucacaaguuucaugcuuccugacuucuaaggugucuaaugaggagaucugauauaucuaaucaccaaggguucgacgugcugcuuuaguugcucgagaugcucuaauauguucuucuuugugaugauccccaagacaauccugaaacagauuauuaugcuaauaacugugugagaaauuaaauuaaaagaguuuccaaucauaaugauaaagaaugagagaaaaaauaaaaacaugaaccauaagaaugagucucaugaacuuuagaaaauaaaaacaaaaugauuuaaaguuccagguuccuuuugcauaaauucuacugacuuucaaaagugacacaauacuaaucuucaauauugguggguuauuuuucuuuuuaaaguaaaaauaauaauuaugaaaguuuggaaugaagaugacuacaaagcaaaguacaaaagaaacuuaauauugauacauagcuauagaccucugauauguagaguuucauuuacaauguucuuuccucagaggaaaauauuuuucuaauuucuaugaugucacaacacagcaguuaucaucuggaucuaccuuggugaaaagguagcaaaaggcugugaggagacuuaaaaacucccguggauuuuacuauaauuucaaauuaaaauuaaaggcaaugugcacuaaauaaauaaugcugaccaaaagaaacacucccuaauguucaggagcugugacugccacuucuuaaaguaagcuaauaaaauguauuuaugauuagggauuaaaaggacuuucacuuugugcauuuuuuucuaaauaacaauuguuucucauuuagcaugucacuguuaucacaucaagcaaagugauggacauaaauucucauaaugaggauacaugaaaauaauuagauugcuaauuaaaacaaaacuaugguuacugguuuuauaauggaaauuaauguggcaauauaaacagugaaaauaaaaaaaccuuaaaaaaacuuuaaucuuuaaauucuggaagcccauccaaaauacccuucaggaugacuggacauuuccuugaugaucucauuaagucaaccucccuguuaaacugccuuugaacauucagacuugaaggaugucacuaggagacuucaaaguagccuguuccuauagcuacguccagguguaaaauaguuacuuagcuugauggcuggggugggaggugggggagcaggaggauagagaaugggaaugacagaaauggguucucugcucauguuuucucauuauuauguuaaaaauaauguaucgauccuuaaaaguucucagagcaugggagcaacuucccccuccaaaaaagcucagaaaaugcacuauauauaaugaacauucacucauucaauagauguucuucauugacuaaacauuugagauuucuuuuuuuuaagccaucaauucauuugauuuuauuguuguagucaggaaaugugaaaaucuuggcaauuaauuaaauauaauaccaauugaauucuuacucaugcuuuucuauccaauuauacagaaugauuaauuucaguuaguaucaucuauauugguaaacucugccaaaucacaaaauauacugugaggaagguuacaaauguauaacgacccaguggcaaauuuagaauuuuacacaguaaucucuguauuuauaaaguaaaaacccuaaaagauggagaaacacacauuaauggagaagagcgauuugagcauaauaaagucagagugcugcuuuaguaauuuuacagaguggaaggaaaaucaacgcaaaauguggcucauauaaaacauuauuugcuguuuccuuuugggcuaaaaacuaaugauguaagaguuaacagggcauaacccagcauuuccaaagcauguuccaagaaacaccaguucccaugaguucuacuauauccuucccugcaacccaaaaauaguugcauuuucaaacaagucuggaaaaccauguauccuauuacccauccccucaucugggaaucaaagaauaucaacauauuauaaguucugaggaguuccauaguaaagaaaccucaauuguauuuaauccaauacuuuccaaacuuagacagucacaaaauguuuuuucugagucacuccuauuaacauccugcuaauuccaccaagauuaacugauuuugaaaaauucugcaguuaaaauauaaagugcagaaaaccaauagcuaauugaaauuuuuauaauuuacaaacaucuuucccuuucaucuauucuuuuucuccuugcaccuaagguuccagauuuguuaucuuccuccaaauaacuauuuuccacuucuaaaaaugcaguaugaacuacacaucaaugauagcuaugcagaacuucauggucuccuuuaaaaaccagaagauaucauuucuuuucuggguuuuaaauaauuuaagugagaaaaaaaacacccgacuuccuaauacacuucaaacaaaacaaaaagucccaugagccacuucccuaaaugaucucuuuucuccccauauauguaucaauuuauuuuccuugacagacagaaauaaggaaaauaugaugaaagcaauuuaauauauucccuuagaagaaaguccaaccccuuuuuucauaugaacaggcaggaccagacaaaauuuuaauuagcuauccaccccucgcucuauacacuucguuauuuuuacacuuucuuuuaaauauuuuccuuucuaauaucuaugcugccaaauaccugggaauuaaucaacaaacugaaauaugaaaauuaaucccuaacaguucuguguucauaguuaaccauaacucaacagaauaacauuuauauuugucaguacacaaaagaaaaagccaugccaggaacagaaaacaacuugaagcaaauaauaguuuguaacaacucagcuuagguuccaguugagccauuuaacaaauaaaagggcucaaggacuagcaaagcuuuaugaaaaguugccccauuuaacuaguacugaguuuuuaaacuuaaugaagucggugccaucauuuaaucaaacaauauuacacaaagacaaauaguaacaauaauaacuuaugaauacaucucuucuccaaucaguaucuaaauuauuagaauuuaauaauucuaaacucccugccuuuaagggcuuuaucucuuuaaugauuuacuucauauuccuaaagaguuauuuuaauuagcgcagugaaaaacacuaaacauagaucuaauucucuaguuucauauuucuauucuuaacucaaucuaauauauuggccaagaaaauguuuuaguaguuuaagaaaucacaaagaaagaggauuucuaucagucacuuacagugcaaaauaguagcaagaggcuggguuuuaaaguaggaaagacagucugauuccuugaaccaugacuuguucaccacaugacuuugggcaaauuauuaaagcuucuugagcuuuaauuacuacaucuguaaaguagggcuauaacuaccuacuuugcagagguccugcaaaguuaaaugagaaaauaugaagguguucaauaaacaaauuuccuuccuuucuguucuuuuucucuccuuucucuggacaggagucauguauucugucaccaauguguuuucuacaacauguuaaaaaaaaaaaacaacaaaaaacugcuaugauucucuguuuagaauuucaaccagcuuuacgcuguucaggauuagccauccaguuuaugcauaauccaagaauacccucuguuuuuugguauuugccuucggauaaaacaacauucuuaaguucaacaagaaagaauauauaguggaaaugaaggguccuaaagaaagaaguguggagaaacagaucccagguccaggaaaagagagcaguggugacgaaguaguguauuugcuaaaucaauucugugcauuaaggucuccacaacccccgugacaucuguuucuuuccuauauuccugucaauggagaaacacuggcaguucauguguaaaagguggaaaaauaaauuaucaauguauacauuuuaaauacaugaguauuuauuuguccuuagcaguuauauaaauauaaaagauuuguguauagagaaagguagacaaaaggaaacaaagcauuuguuaaaggagauuuuuagcucauuuacaaauuucauuuaaguauauauucuuuccuucauuacaugauaaaucaaauauuggcugaaagaguaaauagcaaaauaucuagaaacuuauuauuguacuagaaauuuauauacuaaaaaugaaacauuuacaaaaauaaaacagguuuuugcagugcuccaugcagguuagguccacucuucccuaggaaaagaagcacucuaagcucaacaugcuuucaugcuggagaucuuucagcaccucuuuuccaacuuugagguauuauuuacaaaugucacuguuuggcaaagagcaggcagaugacaucuuucuuauuccuuaguaaaugugaaauuugauugacugauccuauauuugugacuauaccauaggacagacuuucccaccugggagcugacucacaugcuccccuaauaacuauauagauuccacuaaaaaggauccuauauucuagcaagugaacugauuccugugguaccagacuuacccauugugaguuacaaggcacugccucagucccagcuuucggaaaauauccaccacgaucuccauugggguguggucugucacuguaaaagggcucaugucaagaaugcuucgaagcuucaauggccgaggacuuucugcuggaagagauggggugugcugugcaaaacacacccgagaacugccaacgauaccuucuuguuuuuuccuggcacuuucugaaaagagagagaagagaccaacacuuuuaaacugauagauuuuuaaguaggcaaccuguuuauucagagauaaaaaaaauuaauguauccuaugacuucugaucccuucauuuuuuccuaucuucuccuuaaccaagaaaggagucaacugaaaagccauuuagcaauuguuuauauuugauugaauuagaagucaacaauaauauaucaucuucauggaaagaaauuauuuuuugguaaaguuauaucaucguacaauuuucuuuacugaagcuguuuucuaacuugggggcuaaggaaguggguuuggaauacgggauuuuaaaaccugcacaaauucugagcgcaguuuauuauaggaauccauuaucaaaugaaaccugccucugcugaauguuacuuauucugcacuggagguggcacuaaagagaguuucauucuugcuuugacuaugcuguguccuccaucccuaugaauuagcugguucuuuuucuuuucucauguuaaaguauaauuuucuagaaaagucaugaacauuacagaugagaugaaaguacaauuaugcucauaaugcacacagacugauauugggggguuguuuuauucauaaaggcuuuguuaauuucuccucuccagugugcucugcuucaaguucuucuguccugcugccuacuuccacuccaccguugaaagaacuaaaaaaaaaaucugaaugaaacugcugauaaaaaaaaaaugcuagacaagaaguggcaaagauggagaaaaguucagagaucacacaagacggagaaggaaacucaauggagagaaucugaaaauaaaauagucauucagcuuuauguuucuacuuugaguuaguauuaaaacugaguauauacagauaugauauuuguuauagugaaaauauuuuggccggccaugguggcucaggcuuguaauccuaacacuuugggaggccgaggcaggaguaucacaugagcccuaaaguucaagaccagccuuggcaacauagggaaaccuugcuucuacaaaaaaaaaaaaaaaaaaaaaaucggccaagcaugcugguggucccaaguaauugggaggcugagguggaaagaucacuugagcccggaaggucagggcugcagucagccaugaucauaccaccacacuccagccugggugacaaagcaagacucugucgcaaaaagaaaaaaaaauauauuuuuugaauacaaauuuuacuacaaaaacauuuaagccauaauaagcaucaguccuaaauugagaagcagauauuacugcaaacacugcacugcuuuuuacuccuuuugaacacuacagccuucuuaacuauguucuaacacauuugaguaggagggcacuaaguaaagccccagcaacuaguacuuacucaaccaccuuaaaagcaugaucaggccaggcgcaguggcucacgucuguaaucccagcacuuugggaggccaaggugggcagaucaacugaggucaggaguucgagaccagccuggccaacauggugaaacccugucucuacuaaaaauacaaaauuagcuggcacgguggcacaugccuguaaucccagcugaggcaggagaaucgcuugaacccaggaggcggagguugcagugagcugaggccgcgccauugcacuccagcccaggcaacaagagugaaacuccgucucaaaaauaaaaaaagcaugaucauggcauagaaaagaaguccauuagcaauugacauaaaugauuuuugaaaaauacccauuaaguugcuuuuagcucauaacaaucuaacaacugaauggugucugacaacugaauaguggaguguaaaaacuaccagaaguaucauuaauggauucacaaaauaaaaagauguaaagugugacaucaauaguauaaaauguggacgggggaguaaaacucuguaguuuuuguaagcaacugaaguuaaguuguuauaagaaauauauagucaaauucauaacgcucuaaaacugcaauaggguuuguaaaucauuucuaacucuaguauaaaaguugaaagacaaaagaauuaaaaauaacuacagcaggccagauacaguggcacacgucucuaaucucaugugcuccggagguugaggaggggauugcugaagcccaggaguucaagucuacccugggcaacauagaagaccucaucucuaaaacaguaauaacuauagcuaaaauaauucauuaauagauauacaaaauaaaaagacaugaagugugacauuaaauagaauaacauucugaauuaaaacuaaccccaauuaucaaucuuaaacaccgacaaaauaacaaacacuguaucaaugaaauuauacugauuguuuaaacauuuaaugacaaaauauguaauuuuagaaauguuuaaaaaauuauuuaauggaauguuucucuuauauacaaaguaccagaagugaacauucaaucucuuugacuuaaauuugucauuuaaaaaaauaacacuuuucgccaggugugguggcucacacuuguaaucccagcacuucaggaggcugaggcagguggaucguuugagcccaggagcuugaaaccagccugggcaacauggcaaaaccuugccuauacaagaaauacaaaaauuagccagucaugguggcgcaugccuguaguccuagcuaauuaggagagugaagugggaggaucaccggaugccagggaagucgaggaucaaguaagccaagaucgugccacugcauuccagccugagaaacagggugagaugcugucucaaaaaaauaaaucacuuuuauucuuucauuucauuuggaaacugcuaaggagagggauuuuagauauucuccccacacacacaaaaaaucugaguuaauuagccugauuuaaccauuccacaauauauacaucacauaaacauacauacaauuuuuaucaauuaaaaauaaauaaaauuuaaaaaacaaguauuacuuuuacauaaauacaguuuuuguuuguuuguuuguuuuagagacagggucucacucuggacucuagagucccagggauccuccugcaucagcguucccaguagcuaggaauacagguggcaccaccacacccagacaauuuuuuuuuuuugguagagacaaaggucuugcuauguuacccaagcuggucuugaucuccuggugccaaacaaaccucccacccuggccucccauuuaaaaauauuuuugaugcuacucauucaagggccuuuuaaauaaggaacauuacaauuuucauuuucuucauuuuuuaaaaaauauuuuuagugcuauucauucaagggccucugaaacagagaacaacauuacaguuuucauuugcugauauaauucaggcuuuuuuuuuuuuugagacaggguuuugcucuucgcccaggcuggagugcagugguggggcuuacugcaaucuccaccucccagguucaagugauucuccugccucagccucccaaguagcuggaauuauaggcaugcgucaccacacccauguauuuuuuuuguauuuuaguagaggcgggauuucaccacauuggccaggcuggucucaaacuccuggccucaagugauccaccugcuucagcuucccaaagugcugggauuacaggcaugagccaccacgcccagccucagacuuuuuuuuuuuuuaaagucucagcauuccuguugaaauggccuuaaucugagacaucucauuugaauuuaauauuuuacaacauucugcuuuaguaugaaacaggagaaucuaucuaguuuagcauaugucaaccaucuuauuuuaugagacagcauggaaauuuuuucauccuucaauaaaguauuuaucauuauauauaucaauuauauguauuauaugauguaacuauauauaacacauacauuuuuaauuuauauacagaucuguacacuagguuuucuauauauauaauguaauuauguuaauauuuauauaauuaauuauaaauuaacauuuacguacauaauuuucauauauagauauguuuuuuuauagaggauauagaaauauauaucucucccauauaaaaguuacauauauaaacauauauauguaauuuuaaauuuauauauauauauaaaacuuaauauacaggucuguuuuucccaguuaaaaauuuaaaacuuuacaaaaacauacacgguaaaacauuuaaggugugcuuagaaagucaugugacuaacauuucugaugacauggcuuggcaccucaccuacagaaaguacccucauucccuuaaaccaacauuauguccuaucucaauauucucucucucaagacaguaacaaaacuuuaaaaaacacauccacacaaucagugggauaaugaauaguucuuaauuuccacacuuuaaaaacaugccuggccuuuuccccuuaaauuucuauguaaauaccgaaauucugaccuccuuuuucuuuucuuuggcuggcuacuaguaaaaacuagagaaugggaaucuuaaacaaugaaauucuuuugacugggucuagccaugguaauggcuaaaaaacuaaaaugcuugaacggagccaagcaugacaaaauacuaugucaucagcucuggcaacuacuauuguauuagcuaaguaaaauuuagaaugaugggaaugcuaggccuugaaaaauccaaagcuguagccuguucccaaacugaacaggguguucucuguaggaucuuuuuucuuuuccuuucuuuuuucucucucugcuuaaugguucuuacaaauuaaagaguuuccaguuugauuugagaaacacucccccacauacacugucuggucuugugccauucaaauggcacaaaaauuauuuuuaaauccuuuugcaauggccacagagguaagcuggaagggagaugauaugcucacaggaaugaccuuucagacaggccaaaggcuugacacuuccauucagggucuggcacuaaaaccuggggaguaacaaagcaauggcuugauguaccuauccucagucacuuuuuagggguuggaggaagagauauaagauugugucaaaaaaauauuaagucuuaauggucuccucaucaauacugcgggacuauaagguaaagagaaaaacaaauuuuagagaaacagaacuauagaaaguuuaauuuaucuccaagaaauacacuauggcuaauaccuuuaaacaguauuuucaggaaagucugcauaaaacacaacaggacugauacguuauacuuuuucaaccuggcauuugaucagaaauaaaaaucucagugauugucacuuuaaaucagauauuauaaauuaauauuauaauucuaaccccaaagacugauaaagcaaaacaguguuauucuaauaugaaagagacugaugaagaugagauuuucaauaacuuguauuccaauaagccaacuuuauuaaauacaagaauguauuugacugaaugcauuuagcuaaggucuuauauuacaugcuguuuugaauaaccaagaucaacuuaucuaggcuuaucugagugggaaaauaaucugacuccaauuucugguacaaugccagaucaaaagacaaaacugaaauacagauuuucugcuaaauagcagaaaaucauccacugaagcauaccuuccuuuccuaaagaacagaagauuuuaagggacauaaaauaaugucccuugcccccacaaauccaacccauuaaauguuacugcuuauugcuuuccuuucuuccagaaauccaucucauauauacauauauauauuuuugaaaggguaccuauugcaauugucaggucucuucugagggcaaaucccacuaaucucugagauucuuuugacauuaugacaggaaauccauuguagcugguuucauuaaucauguuuucuauaucauccacugucauauuguccugugucaggacagcuaagggaggaucauuccuucgaggucucauaacgucagcagccagggugguaugagugaauucuucuuuugcauccaagaaaggguauccauuuaaucggaugugugcuucauaaaugccuucccugccaaaggcaucuccaacccauuuacuggucaugacugcagccauaaggggaacaauauauuccaagccuccaguaagcucaaaaacaauaaccaccagggagacagucauucuugucacaccaccugaaaaaaguaagcacccacuggucaggaaggacaggauccucaucauuacauuuuauuagaauuuuugcacuaggcaguuaaaacuaaauggcaaauagaacucagucagggaaaagcauuagcaucuaaaacugcuacuccucuuuuaggacaauaaucacuacuuuuaauaagcucuagagaaacaccaauuuucuuuguuuauaacagagaagacuauuaaaauaacauuuuaaaaaccuguuuauuucauauuuuaaaaaagcaaagcuuaccgacuaaaacaauuuugccauuuugguuuagugcuguagcaaagacauaauuucacccuuauaaaagcuuauucuaauuauaaaggaauuuaguaaagcacaucaugcuuugcuacaauuuacaaauuaaacucauauauggguagaauauuaauauaauaaauuucuccucuaaauuuuuuucaaaaagaguaaaauacuuugaugccuuugauuuacauuaacgaugcaaguaauauucacucacagaaaacuauuugggccaggcacuguggcucaugccuguaaucacuuugggaggccaaggcaggaagaucacuuaagucaaggaguuugagaccagccugggcaauacagugagacccugucucuacaaaaguaaaaacuaaaaaaaguagucaugcauggugguguaugucuguggucccagcuacuugggaggcugaggugggaggcucguuugggcugggguuugaggcugcagugagcugcguucacacugccuauggucccuuucucgguauucucacuguuaucaauccaguccaagcccucaugacuuuauuccuuuuuuacuuuguauuuuuuaggauuuggggucucacucaguugcccaggcuggucucaaacuccuggacucccaugauccucccaccucagccucuccaguagcuggcauuacaugcaugugccaucgugccuggcuauuccuuaauuauaauaccauuuuaucuuaccuccuugacuccaggccccauuaccacuguauaagccauguucccuuguuaaucuuuccuaaguacuacuuuuacuguguugcucuuuugcucaaaaaccuaccagggcucgucaguucauacuguauuaagcugaagcucuuccuuuuguuuuuuuaccuaaaaauagcaaggagacagauccuaccuacuauguauuacauaccuacccuauaccaggcauguccuaagcaguuuacaaagacuuguuuuuaaaacuaggcacuuauuuuaccaggcacuauuauaacaguuuugcaugcauuuuaucucauauaauccucaaaacaaaccuagcagaucaccagguguuauuacuuuuuauauacagaaaauuaaaacuucaagaaggaacuuucucaaagucaucaaacuaaaaauggcaaagccaggacugccauaaaucugaccaacuucaaauauaaaaucauccugacauuaaucagguuucuugucuuuucauaaucuguuccuucucacuaauccaacuucauuucccaaaaguacccaaaauauacucucuagagucaauuucuucaaagccucaugaauacaaaauuuauucccauccucguuccuuugucuucacauuauaaucuucaacaaagucaccuuuuccuuaaauucugcuaaucuuuuaaauaaagcucauguucuacucuuccugaaguacuucagcucuuucuuccccuauauuccuaccauacuuagacucuuuuaaccuuguauauauuuguuaguauuccucacuauuguauucucaguguucaucuugucuccucaacuugauuagagucgagauuggguccauguucuuuuuguauuaugcacuguaucuagcacaaugcuaaaaagaaaguggacauuuaauaaauacuugcuacuuuggugaaaaugagucuguccuuuccuuuuaauugauauuacauuuuuaaagaucaauaaucacauaauuuuuauucacuaaacaaaacuggucaaaauggcaaccauuaauauuaucaccagaguguagcugauauuuuaaauaugaaaagcaauaaccauuuuuuccugcccuaacagacauuaaauagacucaaguacuuaauguagguauuuugcuuuucuucucauuaaaaugaaguuaccuuuucucauuuuguuacaaauauaccuuagaugauggagcauggguaaauacaucuuuuacuaaggcuaacaauaaaucauuucagaaccaaaguaaaccuacucugaaacucuguugcaaugcuaaucuuagguauuaugcuauaguuguuauagguaagccaagauccuuaacgaugaaagaaucaaagacaucuuuggucaggauucaaauuaagcuuauguuguacuuagauggcuucugccauaguguauuaaguuauauuacaauaugcuaaugccauuaaauucuuguauuaacaaauguuguaagacagaaaaccgguacuguauaauacccuaauaguacuacuguuucuuaucuguuaaaacaucuccuccuggcacccuccuuuacucaaccaauccgcccaccaauuaagcaagaaugugucccacuuucucuuggcucucucagacuugcaaacauccacacacaggcagacacagccauauuaccuaagcaugcagcagcaccaaccauggcauaaaggccagguguaaugcaaucagccccgaccucacaccacuccuuaaagauaaaccagucguggugauaguaggcaagcugcuccaccgcaauccccacaauccuuccugcgaucgcuccaauggccaugcuggggaugaacaagccugauggaaccuauaacaacaacagaacucuuuauggagcagagauccucuacucacaugccugaaacuuacauucuaugcauuuauuucuaacacuuuugauucuuuucacauuguauuaauauagcaaaauccuaguacaaauaaaacuaaagcaaaaucuuguaccuuaacaaucccaugaauucaguuacaaaacaaaccacauucucuaggccaaacagaaaaaaauucaaggguuauuuccuuuagcucaagguagcucaagggugcccuaaugucagucccuaacaaaauuuucauuaguccauggugaaaugaaaaaaaaaaaagaaaaaaaaaaggacaauaugcuggauacaauauauacuacuugggugacaguugcaguaaaaucuuagacuucaccauuauagaauucauccacguaaccaaaaccacuuguaacccaaaagcuauugaaauuaaaaaauauauauuuuuaaaaguacaauaugaaguauuuuucauaaaacuuaacugauucaguuuuaagcacugucuuuuacuucaagauuaugugauuauguccuccuauauauuuacaaaugacggaaaugguagaugcuauucaucuuaagugguacaauguuaaguggacaaacuuaucagaguugcccaauauuuugacugauauacagacauaucuuguuuuacuaugcuuuguguuacugugcuucacacauguugcaguuuucacaaauugagguuuaugacauccuugcaucaagcuaguccaucagcacuacuuuuccaacagcauguggucacuuugugucucuguaucauauuuugcuaauucucucaauacuuugaaaauuuucacuauuauuauauguuacagugcucugugauuaaugaucuuugauguuccuguuacaguuguuuuacugcaccaugaaccaugcccauagaagaaagugaacuuaauaaguguuguauguggucugacugcuccacuaacuggcuguuccccugucucucccucuucucaggcuucccuauucccugagacccaaugauauugaaauuaguccaacuaagaacccuacaauggucucuaaguguacaacugaaagcagaagucacgucucuuggcugggcgugauccugccgacucagccucgugaguagcugggacuacaggcgugcaccaccacaccuggcuuucuuuuuuuuuuuuuuuuuuuuguagagaugggucuuacuauguugcccagguuagucucuaacuccugaccucaagugauccuucugccuuggccucccaaagcauggagauuacaggcgugagccacaauaccuggccauuuuuagcuguugauauaaagugagagacgugacuuuuuuuugagaguaaucaaagacuuuuuuuuuaaguaauccuuaaauuaugccaaucuacucucucugugcucuauaaauggaauaacaaagccuggauaacagcauaucuguuuacagcaugguuuacuaacuauuuuaagcccacuguugagaccuacugcucagacaaaaagauuccuuuuaaaacauuacucaucacuaauaaugcaccuggucuuccaagagcucugauggagauguacaaggagauucauguuguuuuaaagacuaauuuugacuuuuaaguuuuacugaagaaaugcauuuccuauggcuacagcuaccauagauaguacuuuuguuacagcagguagcuagucaggcaugagcagggcaggacaggcauccucccaaccccaccaggaaugucaggcaaccaucaggugaugauggugagacagcucucaugcucucucucuaaaguaauaauugguugcagccagcaucagggaaaggccaucuuccaauagauagaaacaccugaaacuagcgaucggcagcuuuccgauaagaucccaggaguugggugagugggcucaagcaugcacauuuagaggcaaaaucauggaguuuaugaauaugaccuccuagggacauuuggcugguaagcaacaaacaccucagguaagcaugcauacaacuccaguaaauacacugugcacacuccccucccaagugcuagcaggccacugagcaugugggcaacucaccccaaaagaagaaucaauggaauagggaugcaagaugccagaaguaugccaacauauaaaacccuaaguccaaggucaaauggggcacuugucuuccaagaugcccacuuggcccucuuucaaguguauuuuaauuucuuuucauucccacucuaaagcuuuuuaauaauaaacuuucacuccugcucuaaaacuugccucagucucuuuuucugccuuaugucccuccguagaauucuuuccucugagaaggcaagaguugagguugcugaagaucuguaugguucgccccugacaacuuggaaacccaccacugauaacaacuucucugauugauccgggcaaaauaaauugaaaauguucaaaaaguagucaccauucuagaugccauccagaacauucacguuucaugggaggaggucaaaauaucaauauuaacaggaguuuggaagaaguugauuccaacucucaugaaugacucugagggguucaagacuucaguugaagaaguaacuacagagugguggaaauagcaagagaacuagaaugauaagcguagccuaaagaugugacugaauugcuagaaucucauuuaaaaaacuugaauguauaaggaguuacuucuuauggaugagcaaagaaagugguuucuugagguagaauccaguccugguaaagauguugugaacauuguuaaaaggacaaaagauuuugaauuuuccuuaaacuuaguugauaaagcaguagcaggguuugagaggaugacucuaauuuugaaaagaaggucuacuguagguaaaaugguaucaaacagcaucacaugcuacagagaaaucuuucaugaaaggcagugucaaucaaugcggcaaauuucacuguuaucuuauuuuaagaauugcuacagccaguccuaccucuagcaaccaccaauaucaaggcaagacccuacagaagcaaaacagauuacaauucacugaagacucagauuacuauuagcauuuuuuagcaaucaaguauuuuuaaauuaaaguauuacuuuuuuaaaagacauaaugcuauuguacacauaagacuacagcauaguguaaacagaacuuuuauaugcacuaagaaacuaagacuuuuaugugacuugcuuuauuaugauauucacuuuauuguggugcucugaacugaaccuauaucucucagguaagucuauuuauaugaaucaauuaaaaagagaaaaauauuuauugauuaaauuuaauaaggauaauaaacagggauaagaagcaccauaagcaagaucauuuaaagacuacugaaagaggccagguucaguggcucacaccuauaauccuagcacucugggaggccaaggccucccaaaggaucaccugaggucaggaguuccagaccagccuggccaacauggcaaaaucacaucucuacuaaaaacacaaaaauuagccgggugugauggcccacaccuguaaucccagcuacuugggaggcugaggcaggagaaucgcuugaaccugggagguggagguuacagugagccaagacugcaacacugcccucuagucugggcaaaaaggcgagauccugucucaaaaaacaaacaaacgaacaaacuacugaaagaguaauaaacuccucugaauaugaaaugagccaaacacaaaaugauggcauguacucuugagucucuuaggaucauuaaaaggauaaacaauagaaaaaaucaaaguguguuuuacacucucuugccagguaugauccuucagccagagcugagucaaaggugggacuuaacaaaggccugccaauugccuccagcuucuuguaguucaacugacugugagaaaguugggauuuacccaacacuuacuuauuguaggaaaaagagcuuuaacagcucuuuuaacuugauucccuaagaaaaaaagguaaaauguuuaggcuuuucuauuacuauuauuauuuucuucuuauuauuauuuuuugagacagugucuugcccuguugccugggcuggagugcaguggugugaucuuggcucauugcaaccuccaccuccuggguuuaagugauucucuugccucagccucucgaguagccgggauuacagacaccugccaccacgccuggcuaauuuuuguauuuuuaguaaagacgggguuucaccgcauuagccaggauggucucgaucuccugacauugugaucugcccgccucggccucccaaagagcugggauuacaggugugagccacugcgccuggccaggcuuuucuauuauuuaacucuagauacucaguggacuacagacuuaggacaagagaaaagagaccuuauuucaaaaacuaaaaccacucuaauuuuguagaaacaaagcuguuauuccacauuaauuuacaucuguaaaagcacaucaucacuagcaaauacuauuacaugaaguacagggguaguaauuuaaagaacaagaauaagcugauaugugcuuccccauauauaucacugauagucacauaagaaauuauauuuacugauagaccauuaaucaacaaauuuuguuauuuuauaaauccaaaagaagcaaugucccagggcauaagacccagcugccuuaauuucuugauggaaaaaggcauguauuuauagaucuaguaauuuaacugagucugcaguguccuuucaagcuaauacccuauacugguaugaggcagaauaauggcucaucaaagauguccauaacuuaauucccagaaccugugauuacauuacguugcauggcaaggaggaaucaagguggcagaaagaaaguuucgaagcaacugaccuugaaaaaggagauuauuuucugauuuaucugcgugggccuaaaguaaucacaaagguuuuucaaauguggaagggagauuuagcagaguuugggucagggugaugagacaagagaaagacuugaccagcuacugcuggcuuugaagaugcaaauagacagccaggagccaaggaaugcuggcagcuuuuaauagccagaaaaggcaaaaaacaagacucucuccuacagccuccagaaugcccuacgaacaccuuaauuuuagcacagugagauccguuucagacuuuugauuugcagaacuguaagauauuaaauuuguguggcuuuuaagccauuaaguugugguaauuuauuacagcagcaauaggaaacuaauaaaagugguuuuaaaacaugaucaugaauucucuuacacuugucccagcaaguguaugucccuccucugaauguggucgggccucugugacugccucaaugaauagaauaaaacaagucacgcugcaagacuucuuuggcuacauuaaaaacagcccucuugggaauccugagcuauaauauaagaaauccaauucccugaggccaccacccuagaaaaccacagagagagaggaaaaaggaagcgagagaaagagagagagacagcgggagugagcacaagagacacaguaugcgugauugaucccaggagcccaggugucugaauuuuuuuagccuaggugcuagucaugaaugaagaagucuuugaacuauauucaauaauuuaauuguacacuuaaaaauaauuaagaguguaauuggauuguuuguaacacaagggauaaaugcuugaggugauggauacuccauuuacccugagauuauuaugcacuccaugccucuaucaaaauacuucauauaccccaaaacuauauauagcuacuguguauccacaaaaacaguuuuuuaaaaaggaaacgaaaaaaagaagcuuugagaugauuagcccucgccaugucuaauaacaacuauaugaaagaccacaagcaaaaauugcccaguugagcccuucccaagucguugacucaauaucaagaacaaaauaaguaguuaccuuaagcugcuaaguuuugggggguaauuuguuaaauagcaacagauaacauggucaacaauauaugcuaaggaauuaucuuuuucauuacuuaaaauuaaacucaaaagauaaguacuuuuuucagucauuuaugaaacaacaaccucucucauuccacauauaaguuuugaacaugccaaaauuacccaaauaucaccucacauuagcacuuaccuugaugccaaaagugaauacugucauuaugauuuuaaauaugagugccaggcauaacugccauauagcugaauauacuccaaugccugcuggacgaucaggaaugucaucgacaauuuuacuggcauucaugucauuucuguagucacaaagagaagaggauuccaggggaccacagucuguaaaaagcucuuugaucaguucacugguguuuagccuaguguauggauuagggaaggcuaucacagcaguaauggcugcaacaauaaugacuuccagaacgggauacuuuccaaauuucguggacuugcgucgacgacaccaggcaauauuugcccuaaugaaaaaggcuccccaaagcccuccaaauaccccuagaagaauaaaaggaaacaguucaaaaagguaccaugguguaugauacuccacauaaaaaaggaccagacggcuguuaccaaauggauugauggaccucaaaacaaaugcagccacuaaagcagcaaaaaaugaucuccauaaaguuuugagaggaaaauaauagcuaaccuaaaaaaaagaaaaggaaaagaaaaauuaaugcuauaauuuuauaagauguuucugauauauuauaacuugaaugguaaauauccuagcucuaaauuuugcuguaguuagaauuuacauguaauggauuuuacuguaauaagaaaaauugauguuauuauuauuuuuggagauggugaucaucauuacaaauugacaguaucaauugaucauaaaugucuaauaaauacuaauagaauaccuagugcuguuuuauauucaaaaugaguuucacauucaauucaaucaugguaguuaaaaauaaauguaccaucaccaacuccuguuaacuuauaaugcauuuaauuugccucuucuacauuaaaaaaaaaaaaagaauacaaacaacuaaaagaaaaaaguacauuuaaaaacaucuugaacuaaaagaguuaaauucauagaaguagagaguagaauagggguuaccagaggcuagggguuggggaggugaacagggaaaggggagacauuagucaacggguaugaacuuacagaggaggaauaaguucugguguucuauugcacaguaagaugaccacaguuaauaauauguauuauauauuucaaaauagcuaaaagaggauuuuaaauguucucaccaccacaaggacauaauaaauauuugagggauuugcuaaucacucugauuugauuauuccgcaauguauacauguauagacacaucacauuauaccccauaaacaaaaacaauuauuauuugucaaaaaaaauuaaaaaaaaauuccugguuacauuuuuauguaaaaagaaaagucuuaaacaccuauuaagaaaacaaaaacaaaauaauccacugaagucacuaaaauuauuuucuuuaacaucacuaacuguaucagaaauaaucacaugggaaaaacuuuaaaacacaacauaggaauugauuaaaauuuuuuaaacaaaaacuacuugggaggcugaggcaggagaaucacuugaacccuggaggcggagguugcagugagccaagaucgcgccauugcacuccagccugggcaacaagagugaaacuccgucucaaaaacaaaaacaaaacaaaacaaaacaaaaaaaccccacaaaaaaacagccuggccaacauggugaaauuccaucucuacuaaaaauacagaauuuagccaauggaaauagauuguuucacauguccucuauuaagucaaauucacaucuucuuacuuuuaaauaugucaacaaaguuagauuuuaaauaauuacuaacauucauacauuaauaaauuuuuaaaaaguuuccuccagguauggagcaugaauaacauuuacuuuuuauuaagaaugaguggaaaacaacuuuagaaaaauaaauuugaaaacaaagucucuaccuauuacaucaccuacaaaacugaaaugugugaaauauauuuguaaugguaauuauauauaauuuuaauuguuguauucuuuucaccuaccucuuccaggcuaaaaagaacuccuccaauuggugcaccaaaagcuacagaaaccccugcagcugaggcagcugauagcaccuagaaagaggauauggcuuauuucauaauuucauagaaauucaaacauaccaaauaaaaauucuucauguuacuugaauuuuccaaauggauuuucugaauuuaacuugcauguuuccuugcucccuaagcaaaggguaacuauucauuucuucuauuaagauuuguuucuuucuccuggcuuuaauugaaaggucagucaugcauuuaccauucaguuaaaaaaaauuuuugccagauauacuaaugugaauaggguguaaagaggaggaggcaaugaauauagacaauuuucaagacguauguuuguguagguaagaggggagggcaguaacugggauggggagcuauuuuuaaauaggauaucauuucuucaaauuuuagagcuaacugcuccaccauaaauacucuauuccaaaucguagcaagauaugcagggaaccgaagaccuuguaagauucccuauauuuucacuacccuaugcauucugaaauacugcuaaaauacuaucaaucuagagagccucauucugaaagcacacacaacagcuccucaaguuacagucucaccaaccaacaccucuacaaaaaaauuaaaggaaaagaaaaauccaaggacacucuuccguguccucucuccagcuccccagucuaucaguugguaauggucuacuucccaccuguaagccaacuauaccuaacuauaccuauaauuucacuaggguuuuauuuguaauuauuuuucuaagagucuguauuccuuuauuuuuuuugagacagaguuucucucuuguuucucaggcuggagugcaauggcgucgucucagcucacugcaaccuccaccuccuggguucaagugauucuccugccucagccucccgaguagcugggauuacaggcgccugccaccacgcccggcuaauuuuuguauuuuuaguagagacgggguuucaccauguuggcaacacuggucucgaauuccugaccuuaggugaucugccugccucaaccuaccaaaaugcugggauuauaggcgugagccaccgcgcccagccaagugucuguauuacuuucacuacuuuaauacagcaaauauccaaagcuaccuaaaguauuucuucaaauggucaauuguuacauuuccagaagagaaauuauaaauaauaaaaauuaagcuguaaaugguuaagaucaugaacuccauagucaggcugcuguguugaaaucauggcucugcuacuuacuagcuguauggcuauggguagauaaccuaaccuauaugugccucaguuuucucuaaaauggaaacgugauaauauuacuuagcucuuaaggacugaguaaauauauacagagugcuuuagaacagugccuggcaccaguaaauacuuuauaaaaguuuggugaauuaaaaguaaauaaauauuuguuuuaaucaaauuguuggcauuaaaauguagacucugcuuauuuggggaggaaagggagcaaauuuagcuucuuuuuuuuuuccuccacuaagaggaaagcaaacauauuuauuugaauguccugauccugaauuuacaaccaaacuaacaccuagguaucuauaacucauauacauguuuuaauccauuucauacguaucuaagaagcauuuaauuuaaaaauaucaacgcucuccccucuugucuacacaaaacuaugggaccuuaaugcuuucaacuaaccgugaauucuugccauuuauauauacacuaaggugacagaauaacaacguauuaaacauuaacuaaucacuacaguaugaacauuaaaauuuagguaaacuuaauuucucaaacaucuaauaaauuacauuuuuugaacuuagaauaaguaaaagucuuaccaaaaaauauaaagguacaacagaaaguaauggaauugaauugaggaggcaaaugcucuagcuucaucuuagccacuaacuugcuacgcuacaggaugguuuugaguuuguuuugaacacacacaaauauauacccacauagucguaagggcaguaauguaaguagguaagaccacagacuuugaagucaaagaaaaaugaauuuuaaccuacguuccaccacuuacuagguauguagucucgggcaaguuaguuagcuguuuucagcccuaguuuacuaaucacuaaaugaggauaacagggccauauuacuaaauuacugugaaauuaaguauuaaaauccaaguaaaguaucugccacaguaccagauacacagaaaguaaucaauaaugcuagcuauuuuuguuauaaaguacuggaaucacaauuauucagagaugaaacuacgacaaucugaaguauuccacuuuugggauaucuacguccaaugcaaggacaauauuuuaaugcgaacauuaaaauguacuagaauuauuucaauugaagauuaaacaguuugauaaaauauucuacuuuuuugguuacaguacauuaaaaaacucaacaagaugaaaagguucugccaguauuuaaugagauguuuuucaaaaaaucauaucuuaaaaacucaaagaucucuguaccaucuagggcuguagauuuagauuuggaaaauaggaagggacugggcucccaaagucuagagcuaauauaaaggauucaggaaaaugcccagagcaauauggaaacaucagaggaaauccauaauauauauaagguuucaaggucuuguagaagaucucaggcuggccuaaagaaaugguaaaggaaauugccuuaaacaaucaaaugaaaaggauuuccuguaaucucuuuaaugugaauuucugauuuaaacuucaagagcuucuaaaggcccucagaacuuccccauagcacuggauagcauuuuucauaucacacaccacuuacacuggcaccagacacugccuccaggaggaaaacauagcuauuaagauuucccaaccucuuaauguugaaaguaagagugaaaaacaaagcuaagcuuagaaaacacuucagaagaggaaagauguaagguaaagugauaacaggaagaucuucgugaaaugcagcugaaacccaauggacaccagcugucuaucuaaagcuucucuaaaauguaagacgaacugagcagcacugggaauggauucuagaaagauguuauagauuauucaggaaaaacagaagcacaaaucucaaaauuuuuuaucugaauacagaauuuauuauuuuuacacuaagaaauucuuuacuuaaauaaauacuauauaauauauauuuuucagucaaauuaacuacaaaagacacuuaccucccuuuuuuuagcuucguuugugcuauacuuuggaaagagguaggaaaagauauuuccgcagcaacaggcaacauguaccaggggaccuucuuuuccuaaacucaaaccugaugccacagccaggacuaaugugaugguuuuaaucauuaaaguccauuuucccaaguaaccucugaugaugaauccacuuaaaauaguuuuaaucuacaaggcaaagauuaaggcagcuuaauguccuuuaagaaacaugagaauguaacgaauccaaguuauuuucuuguuuuaugcacaaaaacaaccuugcaaauuuuagcagucuacagaaaaauuuacaguuaauuuuucgaaaacuuugccuauuaugcuacauauaauaaauugauauuauaaucuaauucucuacccaagaaaggagagagggcaacacuaucucaggaacaaaaucaaaauaucaggccauguuaaaaugaauacagaccuuaauuauaaggauuauaauuacauaaccaaaaaaagggcaaauuugaauauuucuguuguaaaaauaagcauaauauuuuaaauauauuuuggacauuauguuagaaauaagaauauuauguuuucucugaguacuguaauuaugugcaauaguuuuuuauguaucaagaaugaguaacaacuguuauauacugcaugauauugcuuuuuaugaaagauauucuuaauacaaacuuaaagaucaauacaauuccauuuuaaaaagaaauguauuaggaaaaaguugguaacuuauuuaacuacagaaaaauaaaagagaagagauaaguucaaaucaaguucaaucaauccuauguauaacucuacuuuauugugaugaaaaauaaaacccaaaaguuuguacuguugacccacugugauuaacuacuuucucaaagcauaaaauggccaaauucaagaauaauuaacuuaucuaaucaaaagguaauuauaaaaagugaaugaaucaaaaucagggucauagccacgugugguggcucacaccuguaaucccagcacuuugggaggcugaggcgggugaucacuugagguuaggaguuugagaccagccuggccaacauggugaaaccccaucucuacuaaaaaaaaaaaacaaacaaaaaaaugcaaaaauuagcagggcauggugacaggugccugcaaucgcaacuccucaggaggcugagacacaagaauugcuugagccugggacgcagagguugcagugagcugagauugcgccacugcacuccagucugggcgacagcacaagacucagucucaaaaaaaaaaaauucagggucauaacagcaaaguaacaacuaacccgucaaagaacauuaggucacaagauacuucuuccaggcucuugauguuuaacuaaauagucugaaaauuugccuagucauguguuaaauuaguggugagagaaaaaaaaaaucagccuucacaguaaaugaccaaaugacuauggggaacaauauuuuucaaugaugucuaccaucagcuuauacuuaaaaaaauuuuuuuuucauauuaugaacaaacuauccccucccuccagaaaagccaacuuuuauuaucacuaaggucaaaaagauaagcaucauaauaauguuuaaugacacuaaauauuacuuggcuuaccucuggaauuccagagccacaggcauauggagcaaauaccuuuaccagggaaacugcaagaaaggcaaaacucaaggcccagaagauguacauuauguaguucaugauauaagaaccaggacccuaaaaagaaaauaguucgagaguaugaauuuaauuuacauugcaccucuaaugcaaaugcuugucauaagaaacuucaguaaacggccaggcaugguggcucacgccuguaaucccagcacuggggagguugaggcggguggaucaccugaggucaggaguucgagacuagcuuggccaauguggugaaaccccguugcuauuaaaaauacaaaaauuagcugggcaugguggcgcacgccuguaauaccagcuacucgggaggcugagguagaagaaucgcuuaaaccccagaagcggagguugcagggagccgagaucgugccacugcgcuccagccugggcaacagagugagacuccaucccaccggccaaaaaaaaaaaaaaaaaaagaaagaaaagaaacuucaguaaaauguguaaaagucuccugguuuauuuccacaauaauaaaaacuuuauaugaacaaaauauuuaaguagaguccaaaaauuaaugccuacauauaccaaggaacccugagcacauuuaaucuuuuuccuaaucccuaaagucuuguuaccaacacaucucagcuauacuucaaucucugccuacaaaccacuuuuuggaaacaguggaaacaaauugcaucaccacucagauuucauucugcugcaacuuuccagaucauuaaacucaauucaauuaagccaggugagaaacagcauacuacucaucuuaccgcaaauguauaccuuuuagcucuaaaguucagcuaaaacaaaauuuaaaaaauauauccaugucaucauguaaaaaauauacauguaacauccuaaguucuaaaauguucuuuguagaucauaguaaaucaaucauuuaaaugccguaaugccacaaauaaaaaugucugauuaucuucaauguaucucuacguagguugauuuuacuaaauuauuugauaauacuuucauaauucaaacuucccaaucuuaguaauauauuaguuuuaauaacuugacuucuuaguaacuuuacacagaucuuacugcaauaacuaucacuucuuuucuacuacagcucaaauauauuugcaccacaauccagaggauuuguuauaugacuaugcaguuaacuaauaaaaaagcuacuugaaacaauauugcacuuaauucuuucuugcugcaauguguugaggguggauccauuugauguguauguaaucaucuaauaugugauuaguucuauaauuaaaugaauuggaaacauuuugcuauaucaauuauuaauucaucuugagacaaagcaagacuuaccucugcuugaccuaugauuaauucugcccauguuuuccacuguggacauuuaucccucucuucaaauguuguuucauuagauccccaacagcacuguucgugguuguaccacaacgcacuaaggcaaaugcccuccuuuaggucagucauccaaucggcagcaaugucuauuaauccggccagugccccuauaaaaacauguuggagaugguaaaaaaauuaagucaauuuuuugggagucgagaacaaucuaguuaaaaggcaaguagaaagcaggagacuccuaaauaaagggucauuuaugaacuacauauaaauuuaagauuuucaaauuuuaguuauaaacuguaaagaguuauuuuuuacaauaaaagugcuauuuuuguuuggaauuuuaaaaaguuacaucauucaaauuaauugugaucugaaaaacaauguuuaaaagauacuaaaauaucuucaaaagacagcuacuuggcaggagguucacaaaucuaauuuucaaucgauaacuuaauuaacagacuuauaaaugaugucaauuucauuaaaauuuaauguccauuagaaauaauuauugaaacucauaggaauaauauuuucuuaaauuacagaaaaccauauaucaagauuauuuuauugugagaauauaaaaaauacacaaauuuauggucaaaucuggguccuucuuacauaaagagaucaguggguuacauacacagaggccauaaaauuacuaugcaugccaauuagaauuaucaguacuuuauucuccacaaaaauuuuaauuuuuauggucuucugaacauaaucuuccaucauggaagcugaaagugauuauaacagugcuuaauauuuguuuucagguccucaacagcucuuucuuaaaaucucacacauugggacuuuguggccacgcuguauagcagggugaugaaggggauaggucuugagcuagaaggcuuuaauucaaauccugguuuagccauuuacuaaacuguaugaccucagucaaacuaaguuacuuuucuucugcuucagucuccucaucugcaaaauggugauaaugacagcacugguaccacaggauuccggugagguuuaaauacaugucaaguuuuuagaacaguguacaacacauaggaagcacucaagaaauauuagcuauuuauuacgauguuaauaucaaaagauacuuuauugaucaucugauccaaaccacuuauuuuacagauauagaaacugaguccagaaagaucaaccaagcuggauaaacacguaaagugauagagccaagacuagacuuggaagccucugccuccuagucuuauauuuaaggagauuuuuugaagaagagaaacaaaugcuuuuuaaaauccaaugguaccugaaaaaaaauugagggaaggagggaagaacaguuuauacuucuguuaacuaaaaaaggauugcuugaaaaauuuucuuuaccugaugccaauccuguuaguguuacuacuagccauccugaccacgcaucauacaaacuuuuugucauuucccaugcugauucuuucuuuuugcuguugaucugaaauuagaaauguuuaugcuucauuuuuccaacuaugaauagaagccacaguucuagaaucuagcaauuuuucucauuuaccauacauagaacaguaauuucagaacuaaauaauggaaaagguaagucuggagcaaaaucacuacauuacagacaguuguuaauaccuguaaaccagacuacaugucuuuacccaagaucugcuuuuauuuuuuauuaaaaaauuuuuuuucuuucaaugagacugggccucgcuauguuggccagacuggucuugaacuucugagcucaaaugaucuaccugccuugggcucccaaagugcugggauuacaggugugagccaccgugcccagccaagaucugcauuuuaauaagaaccuugagauuugagugcaaaggguccacaaacuauauaaaaucuggccuagauuguuuuaaauugaaucaaauuugaaccucaauugguacacauaaccaucuuuuauauaugucuucuguaagacaauaugguuugaauuaucggucauucucugguccuagcaguuaaguggauuauaauguucuuuaaaagacaggaucuguguauaauaauaccauguccauaaauacaauguauuacagaauaaucauguggacaaagggaccccccaaaacuuauaggccuuuuaauaugcagguuuggagagcuccgaucccauugguagaguccagaggcucuuucuuuacuguguaaggcaaaaguguccucuacuggauauaguguaggaaguuaggagauuaauaagaguaauagauuugauccagaucucacuauacuaaaacacaagaagguaagucucaccucucuuacuaagaauguacuucuaaaccuaaaucccuaacuagucaacaccucucuucuguuguacuaggacuguugcuuuagaaacccauauuuuuggccaggugugguggcucacgcuuguaaucccagcacuuugggaguccgaagcagguggaucacgaggucagaaguucaagaccagucuggccaacacagugaaaccccuucucuacuaaaaauacagaaauuagcugggugugguggcgaacgccuguaaucccagcuacuugggaagcugaggcaggagaaucacuugaaaccgggaggcggagguggcagugagcagagaucgugccacugcacuccagccugggugacagagcuagacuccaucucaaaaaaaaaaaaaaagucaauuuucagcccaggacuucagugcucaacuguucugaaggagggcuacagcuggaauucaaugacccagucuauuucuuuuuuuuuuuuuauuauuauacuuuaaguuuuaggguacaugugcacaaugugcagguuuguuacauauguauacaugugccaugauggugugcugcauccauuaacucgucauuuagcauuagguauaucuccuaaugcuaucccuccccacuccccgaccccacaacaguccccagugugugauguuccccuuccuguguccauguguucucauuguucaauucccaccuaugagugagaacaugcgauguuugguuuuuuguccuugcgacaguuugcugagaaugaugguuuccagcuucauccaugucccaacaaaggacauggacccagucuauuucaagaaucgggucuauuugaagucacaacgccccacuaaaaugacacgguaaguucuaaguugaaugaggcaauuuuaccccuucuacccuauaagcaaccaaacacagauauuaaccauucuuuagaauuagaaauagguuauuucuuucaaaaauaaucacuaaacuccauguugcuuuuccucaauaaaaauaauguguaagaaaacaugauaauauuaagccguuuucaggcugagucacugcuguuuucuuuauauaacugcuugcacagcaucauagucagucacuuaaguaguugcuugauggaguguaccaaguaaaaaagauauauguacagagaguucaaucaucaccguuccuaaaaucuggaaaucauuuaaauguucaucaacauagcaucagauaaauaaauugcaguauaccuauguaaugagaaauucugcagcaauuaaaaagaaugagauauauuuagcauuauacaggaaaaaagcaagauggcuaaaagcaugcuaaaagacaggaauauaaauauuuaugcuuauauuuuuaaaaaucagaagauaaaccacaaguuaaaaauguaaauuauuacuuauaaggggaagaagacaauggguuggaugggacagagauagaaacuagacuucuuugaacaugccuguuuuguucauuuaacuuuggaaccguggaaauacuucauauauguauaauaaaacaaaacuaaaucuaaaaagcaaaccuuaaaaauugaaguaaaguuaaaugaaucaaaggugcaucuaacugguaacauaaugccacagaagaaacuauuccaagggacuuuacaacaaaguaauuuguauaaauaacuuugguggaauaaauaaaggauaggccagacgugguggcucaggucuguaaucucugcacuuuggaaggcaaaggcaggaggacuguuagaggccagaaauuucagaccagccugaguaacauagcaagacccagucucuuaaaaaaaaaaaaaaaaaaaaaaauuagccaggcaugguggugugcaccugcagucccagcuaccugggaggcuggagacagauuaccuaaaauuuuucaguaggcauauuguuggagaugguguugguacuguuauacugacaauguuguauguguguauugugggguaaacgaaaugacuauguuugugauguucagauuuuuggcaugacuuaaaggaaaugcagauuuaagaauuagaaguuuagucccauaguuaugaauucaaauuaguacagucauauaaacuuaggaggcuagaaacaauagccaacccagaaguaacaaguaucaccuagugccuagauuguaccuauauuauauuuuccuucaauggaaucagagagcuccuugagaaauggcugauuccagguuugcugcgggaaaugucuacgaugaaucaggauuaggauuaggauuaucuaaggacaugacgaaggacacagauagcaaacuaaaaaagcucccacuaaucuaaaauaacaugaacaucaauaagaauaauaacagugaugauuaaaccacaaauauacuuaaauccaugaguccaugaagacacagaaaaaaacaaccaaacaagcaaaaaaucucauuggucaacuuugaggaugcuaaggaaccuaguauuucaagauuucucccuuuccuguaccacccuuacuucagguaauccaaaugguugaugugggguaaacucucuauagaaauaugcaagcuaauaaauaaaaaaggaacaacaauuaaacugcaaccauuuuguaaaauacugaaauaguaauauuugaaauuacagaaugacaauuugcuucgaaauaaucugggguaggaaggcuacaagcauaacaaaaaaguucacggaaaaaaagaauuagguuggguauaugcacugacauagaaaggcuuuaaaauuuaauguaggccgggcgcaguggcucccaccuguaaucccaacauuuugggaggcugagacagguggaucacuugaggccgggaguuugagaccagccuggccaacauggcgaaaccacaucucuacuuaaacuacaaaaauuagccagugugguggcguaugccuguaaucccaguuacuuggggugcugaagcacgagagcugcuugagccuggaaggcagagguugcagggagucgagaucgcaccacugaacuucagccugggcaaaagagcaagacucugcuuaaaaaaaaaaaaaaaaaauuaauuuuaagaacaauaguaaguauauaaauguguggaauuuuccagcuuuaaaaaaucuuguucauauaagcauggaucaaaauauugaaaaauauuugauuggucuaggaagagaugauugauaaaauuagcuaggacacauacuggcuacuucauauauugcuauacuauuugcaauguuuucaaggacuguacacuaaccauuuacauacucagagaaaaaaguguuuuuuguuuguuuuggagggugacagggucuugcuguuucacccagguuggagggcaguggugcaaucauaauucacuguaacuuagaacuuccaggcucaagggauccucccaccucagcuuuccgaguagcuaggacuauaggcgcaagacacuauacccagcuaauuuuuguuuuguuguguagagauagucuccauauuugcccaggcuggucucaaacuccugggauccagcgauccucugccucaaccuuccaaagcacugggauuacaggcaugagccacuaugaccagccuguuuugguuuccuuugaucucaguuuucucuaaaauuuuaugaacauagugucauggauacucucuagguaccacacuuuaaaauauacuuaaaucccaaccugaauacuguuaaugucucugaauguauacuucuaaguacaaauguauuuaccuaaugaucauacaagacacaggauuuauagugugucugaucuaggcacuuuggauuaaaauagugauuuucaaaguacggucuacuggcaccuuggaggauccccgagaccuuuucaaggggucugcaagauaaaacuguuuacaaaauaauacaagacauuaugugccuuuuucacuguguugacauuuuuacugaaaaugcaaaaccaguggcaaaauugcugacuccauagcaaaaaucaagcaguggcacucaaauguacuggcagucauuacauucuugacugccaugcuucccaguaaaaucaaauaaauaaaucauauuaugccaguuucaaauaagagcaucuuugaugaagcaguaaaaacugcuacgucucaaucacugagucuuuuuaauauuuugugugaugaaauaagaaccaugcauaaggaacuaugcauaacuacacacaucugcugcuuguggaaguauguaugaaguuauguccuaaagaaaagcacuugcguaauuuauuugaguugcauaauaaacuagacacuucuuacauggaaugccauuuuuacuugaaagagugacaucaaacuaugguuuuccagacuugggaauuugacagguauuuucucaauaaugaaaccaaguaauccugucauuuuuaaguuaaauaaauguguauuuguuuccaaugauagaauuugagcucuccaguaaaaaucagaauuuuaggaaacuuguaucuaucacugugaggaugauagguucccaauacuuagagucuuuucugaauagaucaaagguaaaauuaacaaaugugauuuuuaaaauauuguauuauauuauauaagugucaacauuuaaaagauccacauaaaucagugaaucaauauuuucuaaaugaucacugcauaauguuacaaaaucauauauucaaaaucaauggauuuuaauguaacagaagacaaaguucauugaugcaguuucaaaguacacauuacaacuaaucuuuaagaaacuaacaacugucacuuuaguguaguaucaaagaagaauauuugcaauaaucuuaaaagacuauuaaaauacucauagcuuuuccaacuauauuaucuguguaugagguugaauuucuucacauacuuccauaaaaacaacauacaacauauugacugcaaaagcagauaugagaauccagcaguguuuuauuaagccagacaauaaugagauuuauaacaaauguagcacaaugucauucucucacuaauuuuugaaaauauaguuucguaaaaauguuauuuaugucaacauguaauggguuuuguuacuguuauuuuuaaaugaauuauuuuuuuuuaaaauccucaguuucagugucuaauaugguaaauauccauugauaaaaaccacguaaacaaagccuccuuggagcucuucaauaucuuuuaagaguuuaaaggggaucugagagcaaaaaguuuaagaaucacuggauuaaagcacuggauuucauguacuguauuuuauuuuuagauaugcccuaaagguaaauaccaucugaugaaucucagaggcuguaccuuucauaaacaauauaauaaaauuugaauuucagguucacacacauauauauuaauauggaagcuuauaauuuguguaaauagucauuuucauugacaaguaaauuuccaacaccaaaauuauauagggccuuuugagauuuggaauuuuauuuuucaagaagauuuucuacuuugggaggcugaggucagccaaucacuugaggccaggagucugagacuagccucgccaacauggcgaaacuucaucucuacuaaaaauacaaaaauuagcuuggcaugauggcacacaccuauaauuccagcuacucaggaggcugaguacaagaaucgcuugaaccugggaggcagagguugcagugagccaagauugcaccacugcacuccaguuugggcaacagaaugggcgacggucccccgaccuccaaaaaaaaaauuguuuuuuaaaaaacguauuuuguauaaaaacuagccaggcaugguggcguacguuuguagucucagcuacucaggaggcugaggcaggagcaucgcuugaauccaggaggcggagggugcagugagccaauaucacaccacuauacuccagcaugggcagaagacugagacuccgucucaaaaauaaauaaauaaauacaaaauaaaaaauguauuuuggauuauauuaucaguaagucacgaccacaaacaaaaaggauccauaaguuguacuuuuauauguuaaagccauuuuuaaaaaaaacaguaaaccauuacaacacucaauaagcuuuauuugggagccaaauugagaaauaucucagaaucaaaugcugggaaaggagauaaaagaaaacagcaaaaucccacaagaccaucugcccccaguagauuucuucuuuuuccauagguaagagcuaugcaaugaguuuccuuuuuugccuuagcuggugggcugcucaaagcccaaaaucaugcugaccuccauaucuggaacuuggcuuguucuuccccccaacuccugugcuguauuuuucccuuuccuucuuauuuugucuucuuauuguauuucuuuguuuuuuagcuaccugaaauccuuucuggaaaguuacaggguauaaguaaacuaaaaaaauuaaacauagaaaaagaaaaaaacauguaccacauaugaaauguagacauuuacuuauauuaaauguaaacauuuggcagccugagaucauuggcagaaauauauuauuaaaagaucuaauuaugcacuauguuuuuaaaaauuuuuacuaaaaacacuuacccgucuaugccuuucucugucuuuacauuuuucucgcacccaaucaauaguauggaaaucaucauauguaccaacaccuggaauugguucauccaaaagauccaguaaauguguagaacuguuaaugcugccuccauuugucauuguauaaugaguuccuacagaagagaaaaggaaagaugaguauguuuuagaagagacaacagugagcuaagugaccuucuuagaaauucauuauuaagucauacagaaauaaucccucucccucucccucgucuccaccucccgcuuuccacggucucccccucucccucgucuccgacucccgccuuccacggucucccucuguugccaaggcuggacuguacugccgcgaucucagcucacugcaaccucccugccugauucuccugccucagccugccgagugccugggauugcaggcacgcgccgccacgccugacugauuuuuguauuuuuugguggagaugggguuuugccguguuggccgggcuggucuccagcuccugaccucgagugaucugcccgccucggccucccaaggugccgggauugcagacggagucucgcucacucagugcucaauguugcccaggcuggagugcaguggcgugaucucggcucgcuacaaccuccaccugccagccgccugccuuggccucccaaagugcugagauugcagccucugcccggccgccaccccgucuaggaagugaggagcgucucugccugacugcccaucgucugggaugugagaagccccucugcccggccgcccagucuaggaagugaggagcaccucuucccggccgccaucccaucuaggaagugaggagcgccucuuccccgccgccaucccgucuaggaagugaggagcgucucugcccggccgcccaucgucugggacguggggagcgccucugcccggccgcccccucugggaugugaggagcgccucugcccggcugccccgucugggaggugaggagcgucucugcccagccgccacccugucugggaggugaggagcaccucugcccagccgcgaccccaucugagaagugaggagccccuccgcccggcagccgccccaucugggaagugaggagcgucuccgcccggccacccagucugggagguggggggcgcccccgcccggcagccgccccgucugggagguggggggcgccuccgcccggccgcccagugugggaagugaggagccccucugccuggccgccacccugucugggagguguacccaacagcucauugagaacgggccauggugaggauggcaguuuugucaaauagaaaaggggaaauauggggaaaagagagaucagauuguuacugugucuguguagaaagaaguagacacaggagacuccauuuuguucuguacuaagaaaaauucuucugccuugggaugcuguuaauccauaaccuuacccccaacccccugcucucugaaacaugugcuaugucaacucaggguuaaagggauuaagggcggugcaagaugugcuuuguuaaacagaugcuugaaggcagcaugcucauuaagagucaucaccacucccuaaucucaaguacccagggacacaaacacuguggaaggccgcaggguccucugccuaggaaaaccagagaccuuuguucacauguuuaucugcugaccuucccuccacuauuguccuaugacccugccaaaucccccucuccgagaaacacccaagagugaucaauaaauaguaaaaaaauuuaaaaaaaagaaauaauaucacuugaaaucauugcaauuagagaaaaauguguuaagaaaaauuauccaaaacuuggaaguaaggccaaaagauuauggcauguucucuuaaagucaagcccgagugucaacaauuagccugcauaauagucaccugacgcugcggagaauuuugaagacuauuuacuacugauuagggaauagacucuguaaaauuagaaaaugauuuguaaaagauaaauugaaaauaguaauuuuuaucugguaaaaugcaaaugaauucuguccaguagaaacaauaacccuuagaguugugguuuuguuuuugcccuguaagaauuugcuuucuuucacugaugauauacacuucaucucacacauccucuucucaaucagccuugucaucaggcggguucccucauuagagucaaauaaaucuuugacacauguucaccauauaucuuauaugaguaucacagacuucagaaauguaucaggaaggacauuaaaagauagcucaagaaaaagaaauacaauuggcuuuuaaauaugaaaauaagcucaagcuaacacauaaaaagaaauggaaaucaaauccacaauaucauuucccucuaucagauuaguaaagaugaagugugugaaugcauuaauuuagcaaagcuauggagaaagaaguccuaucacaaaauuaguaguuuaaguaugaaauggaauaaucccuuugggaaggcgaaagcuaacaaaauuuaacauacacagaugcucuucaaccuagcaaguucacuucuagguuuuuuucuugcagcuacacuugcauaaauccuugaauaaacccauaaauuaugcacaaugugggcagaacaucuuacugugugcuauagaaagaaaacaaaaacauaauaaugccaaagugcucauaaucuaaaacggguuggcaaagagccagagaguaaauauuuuaggcuuuggaugccacacaguugcaacaacucaauucugccauaguagcagaaaauaaaucauagacaauauguucaugaaugagucugaauguguucugauaaaacuuuauuuacaaaacaggugaagggcaggauuuggcacauggcucauaguuugccaaucccugaucuaaagucuguacagcagacuuuacaacugaagacuucuauuaagaauuuuuuacauaaauagcacuuuacaguguagcagauacaaagagaauuaaaaaaaacugccccuaacuuccaggugcaauauauuauaauauuuuuauaauauaacaaauuauauuucaaaauaaaguucaaauacugaaguuccaagguuccaauauucuuugacuacaauucuagucauguuaccuauauuuaauuuguuaaaaagaaagaaaucuugggacuguagcaccuggaacuaggcggauuaaucuaagaaaacuuccuaaaaaauaugaauuuuaaauuguaauaugaaauaaauuaggcuaugguuucacaaugagaauuauagcuauacauuccauguuagauacacuuaacaccuauuucugaaagaagaaacauauaugaguauagucuguaaaagacaauuuauauugcuauuagaaaaagagcuuuugggccaggugcaguggcucacgcuuguaaucccagcauuuugggaggcugagauggguggauugcuugagcucaggaauuugagaccagcuugggcaacauggcaaaaccucaucucuacuaaaaauacaaaaaaaaaaaaaaaaaaaugcugggcauggugauaugugucuguagucccagcuacucaguaggcuaaguugagagaauugcuugagcccagguuggucgucgugccacugcauuucaaccgggccaagagcaagaugcugucucaaaaaaaaaaagaaaagaaaaagaguuuagaguguaaaaaacaggcuggguaagaaauaugauaauccaagugaaaauuauuagaccugagaguggaaguaaagagauacaaacauuuugggaagaaauuuggaaauaccuaucaaaauauaaggguucuaugucuaggaauuaauucuacaagugcacaaaagcuuaaauauuuaauugaaccauuaucuguaauacugaaaaauucaaaccuauggaaaugucucaucuauugguaaugaaugaaaugcagcaguuaaaaagaauaagguugaucaauauauacugguauaaaaaauuggccauaauaaauugcaguuuuuaaaaaagggccagguguagaccagcauuuuuaauaugcaaauuacuguguaaaauuuauacaguaauacacagaauacagagaaaacaguaugaccaaacaugagacaacauauuaauaacgguuaucucuggggauuacaauugucaaaagcagaaaaugaacuuucauuuucuacuuuguacuuacagguauacauauauguauaagcacacacacaguauuuucauagaaccauagagacagcuaugaaaauagagaaauucuaacgaauccaaucaucauuuaaguaaauagagcaaugaacuguuaccaaaaggcccagauucuaguccuggacagcuaacuuuagacaagucuccuuuaaauauuaaguaucuaucagcauccuugacaacuacaugauauaugcuacagcuuauaauaaagauacauaaacaaagaaacauuuaaauuuuuuccaaagcacuauaaacuuugaaaaccucauacauaauuucaaauaggugauuuuagcauaagugauuauaaauuauauccucaaauuauuuuguaaugcagauuuuaaugccaaaaauuacucagagguuauuauugaaaauguagcucauuauuugauauagaauauaagaaguggcacucuguacuaauguuuaaaaaaauuguaaaaauaaaacacaagauauguuuauuuuauuauaggacuuuuaaggaauggaacaaaauucccagacuacucuugccaucuuucuaguuuaaacaaacucauucucuuugguuuacagauuaaaaaacaauuauauauguuaaagccagaaucugaacuucucguaaucacuauaaacauucuuagacuagaucaagagaucaugugaaaucaacuuggggugggauaagggaggaauacacaaagaaccacgaugccaauacuauuaacuaauuuuauuacuccugagauauaagccaaauaaacuauagaguagguuuuuugauaauucugggaggacaugaauauagaaggcgcuaauauuuuaaacaacguaauaguacuaauaaauguuugcuucuaccagguccaacaggguucuugcuuaucucccuauuuauuacauuuaaaugccugccuuggaagccgggagugguggcccacgccuguaaucccaguacuuuggcaggcugaggaggacggauagauugagcgcaggaguuggagaccagccugggcaacauggcaaaaccccaucucuacaaaaacuagcugggcaugguggugugcaccuguaaucccagcuacucgggaggcugaaguggaaggacugcuggagucugggaaacagaggcugaagugggcugugauugcgccaaugcacuccagccugggcgacagagcaaaacucgucuccaaaaaaaaaaguguaccuuggaaagguguaaaacuucuaaaaggagaguggcacacugauuucaguguuuuagcagaaguacuccaaaaaauaauaauaauaauaauugauaccauucuuggccaaagguuuaaaggcccaaucccugcaucaaugcccacuuucauuuacauacaacacauacucaaaagcucaaucuuaaagcuuuaauaaagcucuuccccacccucccauccuaauguuauguaguaacuuccacuuugaaaagcuagcugaaaggccacaaauuuucuugagaaaaagcaauuggagaauaaauauaacaggaauacuuauaauaucuugacauaugugagaaucucugacucugcuuuccauauaauauuaaaauugaucauuuagaaaaugcaaaugccacuuaggcuuucugguaagauauacaguacuucugugguacucuggccagaaaugcauaaaaugaaucuuauaaggaaaaaccagacacacccaaacuaagggaaauucugcaaaauauauggauuguacucuccaaaaaugucaagguuaugaaagauaaagaacugaggaacgguucuagauuaaaacaacaggauguaacaugugcuccaggauuagcuccuagaccaggaaaaaaaacuuuuuucuuuuguacuaaaggacacagugggacaacuggcauauuggaaaauggucugcagaucaugucauaguaugguaucaauguaaauguucugauuuugaaaaguguagaaguguacgguagcuauacagaagaaaaugcccuuucuugagggaauacacacacugaaguauuuaggaguaaaagcacgucaugucugcguuuuacucuuuauguggcucagaaaaaaauauauagugcauacaugcccuaugucuauauaaaaugcuacauauuacauauaauggcauauaucguacuuggagaauacagacauaaugaacaaaugugguaaaauauuaauauuucaggaauuggggugacagguauaugggauucuuuguacuauuuuuaaacuucuguaagucugaaguuacuuuaagaaaaagccuacuaugaaauauuuugcaaacuucauuuucccuccuacauugcccuucucuggguagagcugaagaaauauggacuacuggucuuguuacucuuuaugcaaaaaaaaaaaagugaaauuucuauaccacuuaacauguauccauaauacaucgcuagccccacuuaaagaauuuucaagcuauuuacagcgugaagauaauaagcaaacaaaauaugaauuucugcaaagacuuacgaaugacgaaguggaaaaguacagacugcuauucucauuuuuaugagguagaaaaagguacaguagugcaauaaacauuuacauuaggcaugugucuugcuuucagugacuuucaaauaauuacucuguggaaacuacucaacaucuuaauuuacacaacgauucagcaauucaaaaucucugaaaaccagaaaauuuucaaacauucaaacauuuacuuuaguaugugacauuucaaauauuuucucuuauaauuuguucugucaaacaugcaaaucugaauaguauaaagaaggagaagaaaaggaaaauuucuauccuaaacuggggagaagccacuauauuucuaaugugaaaaggaauuuuaaagguauuauguuuucuaacaauaacaauagcuuuaaaauaauccuauugcacuguuucuuugcauauaauucucugaaugaaaccuagauuuguguaagauauaacuuacagccgggcgcgguggcucccgcuuguaaucccagcacuuugggaggcuaaggcacauggaucacaaggucaggaguucaagaccagccuggccaagauggugaaacccugucucuacuaaaaauaaaaaaaauuagcugggcgcgguggcaggugccuguaaucccagcuauucaggaggcugaggcaggagaaucgcuugaaugcaggaggcgaagguugcagugagccgagauugcaccacugcacucuagccugggugacagagcaagacuccaucucaaacaaaacaaacaaacaaacaaacaaaauauauauaacuuauauaggcuaaaaugagauaaguacaaaaaauuacauauauguuaaaauuuuuuaaaagcaacaguauauccaauuucaccucucgauuucaucuuacgcaugaauaaaggauguaucuuuuagguaccgucacagcauaaauuaaaguucucuucuacauaaaguacaucuccucuuuuuuccuauaauaauauaucaaaggcugggcguggugacucacaccuguaaucccagcacuucgggaggcugaggcaggcagcucacuugagaccagggguuugagacuaaacuggcuaacauggugaauccccgacuucauuaaaaauacaaaaauuaucugggugugguggugcacgucuguagucccagauccucauuuuaucuaucuaucuaucuaucuaucuaucuaucuaucuaucauuuauuuugagauggagacucgcucugucacccaggcuggagugcaguggcgcgaucucggcucacugcaagcucugccucccggguucaggccauucuccugccucagccucccgaguagcugggacuacaggcgcccaccaccacgcccggcuaauuuuuuuuuauuuuuaguagagacgggguuucacgguguuagccaggauggucucaaucuccugaccucgugaucugcccgccucggccucccaaagugucgggauuacaggcgugagccacugugcucacaguuagauuuuauuaaccuaaaaugacaggauuugccuuggaucagccauuucucaaagcauaugcaguucucacuuaccugugaagacaguaguagagcuguaguggaacaccuccaggaaagacuaagcaaguuccuuaguccaugcuauuuucuugaccccuccacacaccuuccccacaccaauucagucagagacauccauugccauaggaaaagaaauacacagcagagcauggagaacacgauucgauauuacaguaucccaguuucaaauguaggcuucugaaacccacagaggagaaaaauucuuuuuuuuuaaauuuaaguucugggauacauguucagaaugugcagguuuguuacauaggugcacaugugccauggugguuugcugcacuuaccaacccaucguuuagguuuuaaaccccaaaugcauuauguauuuguccuaaugcucucccuccccuugucccccacccuccaacaggccucggugugugauguuccccucccuguguccaugugcucucauuguucaacucccacuuauaagugagaacaugcaguguuuggcuuucuauuucuguguuaguuugcugagaaugauggcuuccagcuucauccaugucccugcaaaggacacgaucucauucuuuuuuauggcugcauaguauuccaugguauauaugugccacauuuucuuuauccagucuaccauugauggcuuuuuggguugguuucaagucuuugcuauuguaaauagugcuauaauaaacauacgugugcaugugucuuuauagcagaaugauuuauaauccuuuggguauacacccaguaaugggacugcugggucaaaugguauuucugguucuagauccuugaggaaucgccauacugucuuccacaaugguugaacuaauuuacacucccaccaacaguguaaaagcauuccuauuucuccacagccuuacccacaucuauucuuuuuugacuuuuuauaauaaucaccauuugacuggcaugagaugacaucucauugugguuuugauuuucauuucucuaaugaucagugaugaugaguacaacuuaaaagagacgugaaggaccuguucaaggagaacuacaaaccacugcccaaggaaauaagaaacgacacaaacaaauggaaaaacauuccaugcucauggauaggaagaaucaauaucaugaaaauggccauacugcccgaaguaauuuauagauucaacgcuauucccaucaagcuaccauugacuuuccucacaaaauuagaaaaaccuacuuuaaauuucauauggaaccaaaaaagagcccguauggccaagacaauccuaagcaaaaauaacaaagcuggaggcaucauacuaccugacuucaaacuauacuacaaggcucaguaaccaaaacagcauaguacugguaccaaaacacauauacagaccaacggaacagaacaaagaccucagaaauaacaccacacaucuacaaucaucugaucuucagcaaacuugacaaaaacaaguaauggggaaaggauucccuauuuaauauuaauaaauggugcugggaaaacuggcuauccauaugcagaaaacuggaacuggaccccuuccuuacaccuuauacaaaaauuaacucaagaucgauuugaggcuuaaauguaaaacccaaaaccaugaaaaccuaggcaauaccauucaggacauaggcacuggcaaagacuucaugacugaaacaccaaaagcaauggcgacaaaagccaaaacagacaaauaggaucuaauuaaacuaaagagcuucugcacaguaaaagaaacuaucaucagaaugaacaagcaaccuacagaaugggagaaaacuuuugcaaucuauccaucugacauaggucuaauauccagaaucuacaaggaacuuaaacaaauguacaagaaaaaaacaaacaaccccaucaaaaagugggcaaaguauauuaacagacacuucucuguucauaaaaaggagacauuuaugcggccaacaaacauacaaaaagacuaauaacagucaaaacuuuugaauucaaaagauggguuucuggguuucaaaaagcuuuaaguaaaaaggcuuagggguuucugcaacaagccugaugaagaaccaacuuuaccuaacuauaugaggauugcuggggaggagaaaaaagggaaucaaguaaacaagagguuagaacuauuaaacuggugacuggcuucagccuuuuauauuuucuauaagugagauacagguaagaucauacuagccacacuuaaaaguugauuuuuuuauucauacuuccuaaaaauuauuucacaucauuaaaugcacaugcacauuuucugugacuucagauaacuauauuugucauaacauauuauaauuuauucauuuuacuuuauuuuuuuagagauggggucuugcucugccaccuaggcuggaaagcagugguggaaacauagcucacuguagccucaaaccuaggcucaagcaaucauccugccucagccucccaaguaguugggacugcaggcaagcaccaccacaccuggcuacauacuacaauuuaaacaaaucuucagguugguuugccauuaugaacauuaucuaacauauauguaucugcucagccauccucuuuuccaguuaauuuuuacgauuuuaagucuuuucuuauucucgacuuuuucuccaaccccacuaccagauauccaauacuaauaaccagguauauuuccaaacuuaaaauaaucauauuauccauuuauuaucgucacauuagguuuauuauuuauguaauagaaccugauuguuuugcccacuugguaucuccuuccccuucuuccuauaacagaacccaauuauuuuaaggaaacuucugucccucacugcaugcaguccuggugaagguaucaaucaagauaccuucuccuccccagcuaaagaaaacacauagauccaaguuagaccaaucaaacuguggcuccuagaaauguaaaucuugagcacaguguuaaucagaaccaauuaauuuuaacagcugaagcuucaagaggacuuaggauaauuccauaguuucugcuaccuaaauauccagcucuuggaugauaagaaaguaugaccugaaaguuaguagcuuccaaguuuaagacaaaaaaaaaaaaaaaucaaaaacuuuuuuggagggcugacuaccggaugccagugacuacuauucuacuaccuaacucuacuaucuccuggcugaaaaacaguaacaaaaaagacuggaaaaaagaucacuuuucuuccagguggccuaguagagaaauuccaugacuuuacugcacuuugaggucagaaagaccuagagucaaauuccagcccugccucccguuaguucugugauccagcgcaaguuacuuauuaaccucuuugaguaccuugguuuuguuacccacuucuacuagaguauuguauguggacuggagacaaauuauguaaaacauuuaauacuauacuugacagauaguagaaaaacaauaaacacaagcuauuauuucugcucaaauauuuggguauuuaaaauuucaucaggaaagccacguguaguggugcacaccuguagucccagcuaaucaggacgcuguggcaggaggcuauaucaucugagcccaggaguucaagggagccugggaaacacagugagaucucaucucuauuuaaaaaacaaauaacaaacaaaaaacaacccccucucacacacacaauucagcauguugcauuauauuacucauaugacuaaguuauaauaucgcuuaaccaaaagacuaacaauaugacaaagacagcaaaaaaaaaaaaaaaaaaaaaaaugucuggccgggcgcgguggcucacaccuguaaucucagaacuuugggaggcugaggcagguggaucacgaggucaggaguucaagagcagccuggccaauauggugaaaccccaucucuacuaaaaaaaaucaggcgggcauaguggcauaugccuguagucccagcuacucgggaagcugaggcagcagaaucacuugaacccuggagguggagguugcagugaguggagguugugccacugcacuccaaccugggcgacagagcgagauccaucucaaaaaaaaaaagaaaaaaaagucuuaaaaauuuggacaaugaguucuucuacaacuguauauugagcaaaaauccuguauuuuuaacagauaacuuaauucauuaugccugguauggacacagaaacaaauuccuaaaaugcaucauucaugcaucucauaguucagguauuaccaauacugaaauaccuccagcaagcaggaaaaauuauccaaucgaugaacuaaaacuggcuugcaacuuucuuguaaaaauaacucuacuaagaagauuguuuugccuuauuuuaguuuuuccagagacagggaacuuuauaaagaucaagcauaccuauggaauacaaauccauuauuuccuaauauguguaaucuaaacauaaagacuuaaauuuaccuguaggaaaauuacuuaaaauuauucauuauucuuuuuccaacugaguaacagcgguuaaaaagaaaaaaaaaaggauucauuauucuuuaaagaaauauuuuuucuagugaggaaagaauagucuuuugaauaaaugaugcugggacaacuggcuauucacgugcaaaagaaugaaaccguaccccuaccucacaccauauauaaaaauuagcuaaaaauggauccuagaucuaaagagcuaaaauuauaaaauacaggaguaaauuuuugugauccugaguuaggcagguuuuuuagauaugacaucaaugcaaaagggacaaaaauaaaaaaaauagauaaacugaacuacaucagaauuaaaauaaucuuucccauguagaggccacuguuaucuagcucaugucuaauaauaacaguaagaacagcuaauuuuaauuaacuuaauguguaccagacauuguucucaggacauuacauauauuaguucauauaauccucacaacaacacaaugugacagauauuauuaucuccacuuuauaaauuuggaaaacaaggugucaagaguuaaacaggcccaaggucacaccgcuagcaaguaguagaacagggauucaaacucuagcacuuugauucucaagucacuaaaauaauuucauuguugguuuacauguauacuuuaagaaauguggacaaccuucucucagaguagguuaagaacuauuacgugaugccuucucccaaacacauauguauaugcacuuagccuuuggacaauaaauacaaucuuacccuucaccaucaccaucccucuuugccuuugguugcaguccacuuuuucccauauuauuuaaaaugcugcaauagaaaauugcagaaguggugagcacugcuuugcucccagcacucacauccuuaugcuuuagcagaaguuuacgauaguaaugcauccccauucuuacccucaguuguucccgacaucuuaugccacaggguguaccuuuaccccagguguacuuacaaacagguuuucaaacuuuuucuuagcuuuugaaauguuuuucaaacaugaaguggagaaauguuucucacugacauaguauauagauauguacuuaaauaaaaccaaaguuuaguaaacaaugcuuacucuuacuacuugguauauacugauauuuuauuuuguuuuuuuaaucuuuccuuuuaaaauacuggucacaagucaacugguuucaugaucaacauguuaaaacuugaaguuugacaaacacugaacuagaaaaauauaggcauuaauaaaauugucugcuuucccaaaaauacaaauauaauuuuacccacaagcuuuccacauauauuugcugaacugaacuuaaaaaaaaaaaaacaacacaaccuuaauugcugcgccuuaaacugagcuuauuaguaaauaucacagugacacuggcaggagccuaagccuuuucucaaagggguuuauccaaauaauaguuuuacaugaaaaaugaugcauauaguuauuuaaaaagaguuacuuauuaccucugugaucaaucuccaaagaugugaaauggugauccucgucauuuaaguucauaaugcagauuacuguuacauaagacacacauaaaacauaugaaccuuuuuaaaaaaauuauggaaggaagaggcagaaauccaaaauacuauguauuccuucacaaccuauuugcuucuguauguuaagagcaggaagucuagccccagaugguuuuuuuuuuucucucucugugacccuacugauaagaaauggccauccugguaagggaugggaaaguaaacguucuaaguugauaguggaaguuccagaauguuagcagacuccaaaucaaagauuaaaaagguaauggcaagaauagugccucacauuuagcagguggucaauuaaaugucuacuggguaaauaaauagcaaaaaagaagcauacgcuauuaaaauuuguucagccauucagucauauuuaacugucuaaacugcaaagacuugcaaguuaaugccaaaucucaaagaaguuuaccaaagauacacaaccaggcagcagcaauacuaagcccauuacucaauucacuguuuucuuuucuguucuguugccaccucaaaauaaaaagccacauccuuaguuagagaugauaagguggauauuaagacaucuguguaauuggaaacaaguuccacauucaauuauuaugucugcaaauaugaugagcuguacaauacaugaauaaaaagguuuauaaaauuugcuaaauuucauauuucauaaauuuauaaaauuuguuagagaaacuagaguaaauccauuuuaugaccuaauuaaaguugcaaagggcuacaaagaaacuagaaauuaaacauauguuaacuuaaaaacaagaaacaaaaccuuaaaguucaauuuaaacuaccagucuccugcauaaacgcaaagcagaaaccucgaugcugggaaaauagccaaaauuacaaacuuaaucaaugcggcaggaaaucuguucacacucggaaaucuugauacaaagcauuucugacaagccaugagauggcauaaaauuaaccauacuaaagugucagcuauuuuuagaaaaucaagcuagagguaguaauaugaaccagauuuuauugaagauuugaaauucagauacugugggaaaaguacauuuaaaaacaggcuuuguuuuauacuacuguuguagaaacaaggaguuucugacaccaaauaaagaaucuuuaguuguuccuuuaauuuacagacacuuagauggauuaauuuuuaagaagagguuuaauuuucuaguuggauaaaauauuagggccaauaaaaauauaauaaguaucugaauccuaaaaucauuuuacaaagagccugcagaaugucccucuggcaauaagaauaucauauaacaccuggauuuucaaauaaugugcaaaaaaugauacuuuucaaagggaagaaaaaggaacaaaccucuauuauaauagaaacccaaaaaagcuuuauuuagauacacugcugagcuaaugaaugucaagaaauaauuucagggagaaacuugaaaaaauaagaccccaaacuuuuauuucaauggcaaagcgacacuuuuugugguuuaagcccaucauuaguccucuaggaucugccacucuuccaacuuccaccuuucuacacuacccucucuacugacucacaacaaagcugccuuuguuguaucaaaacuaauccaagagcaacacacuaggcauuuccuccuguuaucgcauuuacucauuuuauuauauccaccaggaaugcccuauugaguccccuguguaugugagaacagucuacuuugauaacacuugucaaaagcagacuaaucuguucuugggacuuugggggaagaagagauuucuaucauuucuaucguucacuagaaauuuacuaacuuccacaggauucugucuguguuuaaacuucuuaugcuucuaccagacuuaaaacacaaguuacuaugaagauacguguagagagaagcaguuuagccucaugauuaaaguaugagccaaauaucuggauggaauucugacuuuuccuuaacaauuccuuaccucagucuugucaacuagaaaauggggauuauaacaguaccuacuucauaaacuugugaugaggauuuaaauaauuucauacacauaaagcacuuagaacaagccaggcacaguggcucgcaccuguaaucucagcuacuugggaggccaaggcaggaggguugcuugagcccaggaguuggagaccagccuggacaacauagugagacucucccuaaaaaaaaaaaaaauuuuguuuuuuaaauuagccaggcaagguguugcaagccugcagucccagguaccaaggagggugagacggaggaucuaagcccaguaguucaaggcugcauuugcuauaaucacuccacugcacuccagccugggugaaaaagugauaccucucucuuaagaaaacaacaacaacaacaacaacaacaacaacaaaaaaacccacuuaggacaguauccagcuaacaggaaauucuaauaaauauuaacuauuauuaauauuacuauuuuuauaauucuccacagcaccuaggagugccauauguguguguauauguauauauauauauacacauauacgcacacacacacauauauauacacacacacacacacacacacacauauaugcucacucugaaugaaacaauuaaauauuuaaauaauuguuaaaggccccucauggaguaaauggaggcucaggcccaaaagaucaaauccauuauaaaggguugguagaagaaagaaauuugaccucuaaaacuacuuaaacaucuugaacaaauuaagaagaaaaaguguaaaacuaacaguccagauaagccaagucuuuuuuccugauaaaaaaggaagagacauuuugagagagcuugauuguuucuauauaggaaaucuaccccuaaagauggcuauuucugaaaugucaucuuaauuucuaaucuaucaauaguauaucaaacuaauucuaauuugaaucuacuuauacuuccagacuugacauuauuuacuuaaauaggaagcuucaccauuuaccaucucgccuugaaaaguaguauuaaauucaauuuacucaacaaagguaauccuuggcuauagcacucagggauuuacuaaacagauccauguuuacuuuauugauauccuucacaauuuuauacuuuaucugccucuucacuaucaggcugaagaucaauuuuaaucauuauaguuuuguucuuccucacagggaagcugauucaguuuuuucgauuuguuagcugccugucuccaucaauuccauuguguugacccauggcuacaacaggucauaaauuauggacaaaaaauaacaucuuacgcauagacacuaggauacuacaguauguuugagguaauacaguacagucacgaaagccuaauaacugacuuaucucuacuacacauacacaauguuacuuucaaauaacaaugacuuauauuaauagaauaagucucaucaagggauaaagaaccuauuugagcugccaagagugggacugauuuagauccuaagcaagauucuuaaaggauuauuuaugaaaguauaauagaaauaaaaagcuuacguuuagguaauaucaguaaccaugccuacucucacauaaguuuugacuuauuucuuauuauuugcauauuuuacacuaagacaguccauaaguaaguucugucaaagacuguuaagcuucacaaaaggaauuuaaauuucugaagcccagguauucugaucuaucaucauuaacaaccaaauguuguaauagcaugaggaaaauacagucugucuuguuuuacaguuuaauuacugauuagcaaauaaugugacauuugaacagucacuauucauucaccuugcuuccuguuuaaagaacuccuuaccagaaaacugauaaucagaacauaggaaauagaagaauuuaugaucguaacauuaagaaaaaaaauuuaaaaagcucuggguggugugauuacaagaaauuauuuucuucuuuaugcuuuuagauauuucuuccaaauguucuaacauauacauauacacauauaucaaaauuuuauuaagaagguaacucuguaagagaaagcacaauguauguaacaugauccuuacacagcuuuucucaaaauguaaaaagcaaguuuuuacuaacuacagaauacugcaagauaaauaaugcuacaacuguucagacccuaaaauaguguguagcagacacaaugcaaccaacagacauuuguugaauacauuauaauguuuaaauuauaguggaacuuaauacuaaaaaaaaaguguuaucagaacacaaaguauauuuuaaauaaagcaggcuaauuauauuagaaaaacauuauuacuuccuuauauacuuacaaauaaaaguuuggguuaaaucauaaggugaguuuauaauaucaugcaguaauucaaacuaauguggcucaaaaaugaagucacauaagcuaagagauuuuucuugaaguucaauuuuuuucuaggacaacaaaugucgaccagucuguuuuucgaauaagcaauuaaacaaaaaugaaaaaaaggguaguaauuaacaugcaauuaauuuuaaggagacugaggaagugccugccaaaagauuuacaggcaugcugggugcucuucugcuuuucacaaaccaauauuauuuuuucugacauuuagucaaauguguuuuaucauaucaaauuucacaagauaccuguggaagacaauguaguauguuacucagccgaaauacauauuaaauaaaaaguauuaauauagaaauuauucaucuuuacuaucauuuuaaaauguucuaaaauguagguaaagcuuuugcuauaaauuuacuuugugguguaaaaucuacaugguaauuggcagcagcuaaaauauaaugguacauaggcaccugauuucucuguguaaauuaaaggaaauguaaguuuucugaaggaagaaaaacauuacuuuuuagaugccaaccaacacgacuuuaguuggcuguaaaagcagauuaauucauuuucagaguuagaaagaagauuuucaugcagaagauggagucggagcccgacgugaucugaagcaguacuaaucugcacagagaaaacaaucagggauggcuacacaaccauucagaagguugcauuuuccccuuacuaacaacccagggcaacuaaacaacguacugcaguauuuaaaggacaaacgagaaccaguuuaagcuagaggaccgcccagccgcaugcaaaacauaccaacagagaauucacagcaaggggauaguauuaccucuuuuauguaauucccucaggggaauacugucuccucccccgucauaaggcaaauaagggucggaagaagcauccaugauuagaauuuuuaaauagaagaagaaaaagaaaaagaaaaagcuugcuagcuuaaaaagaaagugacauuucuuccaucccugcugcagcaagcaagggagaugccauauuugaugagguuaaaacuguaguucgacucgcugaagcaacuggguucuuccacaguggaugaugucaucaaagggaaauuauugcagccugguugcuaguggcuacaaucuagcaaggcuuagaggcggcacagccuucuuaaucagguccugcuacguaugacaaugacuaagcuccaaguacaacacacaaaacugguuugagaauuuugaaacacucacaauacagcuucgguagcaucagugguaacuacaguaaaacaauagaaacauuauuucuuuugguuuuaagauaaauauaaaggggaaaaaguaauacagagauguaaaaaggaaauuuugaaugcagacaaugcccuuuuucauuucuaauguagaaaaaugagagcagcacucuaguaaguuugugugguuuuacgagagaauguacuaguuuuauacaguaaugucaugugagucauagccauaaaaaaacuacaauaugccaaagguuucucaagaaacuugguucuaagucuauuaaaaauaaaaaaaaaauacucuauaauacagcagccuuucauugaggauuuaaaaaccgaauaacugaagaguugaauaguguuuuaucccacucaccaaucuccuccagcggcuucuuguuuccuuucuugaaggaacuagcuaguaagacauuguagcuuuugaggagaaagaaaacuaucaacguacuaaguaacuuuacuauuguaugugucuaaacuacgcaaaaaagagguuuacuaagcagagggcuuuccuaucucuacuagcuuccuauuuuaucucauaaggguuuuguguuuuuaacuuuuagcaaaaaugugucucaaagugagguacucaacuguucuagaaauuguuauaaaauucagaaauugucucuuuaauagaaauuuuuaugaaguucagaaauaaagcaacuuucuuguuuaaaacugucauuaaaaacaaaaacaaaaaccgcacaaugcuuauugaagaucagaguucaauauuuuauagcuaccucugagaggauuccucuagacugggagauucuccuccugaaaugccuguuacacagugucacuaaacaacaacaacaacaaaagguguuguucauuagaagcaauuccacagaacucaaggguucuauaaaauuuguuuuccuaaaguauugaaugagacaaucucuaagguccacucgaacugaaaguguuuacaugaaaauuggaggugagagaaggaaagagaaaacucagagggcaguaaagagaagagagaaauucucuucaauuuguggaguacuaaauuuuacuuauuuagggucuuuuuaaaaaacuguauagguuaaaucaaguuuuuauauuuuaaaucucagauaaacagagcuucuuauaaaaucucaccugaaauuugggagacaggguuccaggaaaggaauauagacuagaauuacugccacaggaauauucuaucuuauccugauucuagcuauuaaaauuuuugauaggauaguaggugauuuuuuucuuuauuuucuguauuuuucaaauauucuuggcaauuuuuucuccuaugcuccuuccugcacacugagccaauaguuuuuuuaaacaaggaaagcuuugacaaaggcuaacuguacuaaauuagcucaauguaaauuugggagugugugguucuuuuauauguuuuaccaccauauaauuuuucuaaauauauaauuguauggcauuuauaaaggauuuuguuuuuauaccauucauguucuuauaugucuuuacauaaaaaaugaaaaucuauccacaaguuuucccgguauuuguaggcacucucuuaacuuguuuuuccugaucuacaacuugaucauaaagaaugaaaaugacagucagcacucacugaugggggaaauccucccgguaaaauaaauacugacaaugcuucauauuguaaaaguuuuguagccauauuugaauuauuuuuaaagauaaacaauuguguguauauauaauauauaucuauauaauuauauuuguauagaauuaaguuuagaauaaaacacaucaagcccuuagcaauuguuaucacugagacauaagguagagagguugaggaguacauucaguguuuauauaauuccacacuguuuaaacaaauauauuacuuuuguaauaauaaaccuaaaaaucuuuaaaacuucagaaguaaacacaucucuuguguuuaugggguccacaacugccacuuucuuaaaguaaaagaaucaguacacagguuaaguccaaucacaauuuagaaaagcacaagguagacuggaagauguggcaaaagaggacuuugacacauaagaggacuuugauagagacuuuuuauuaccauauuaacaaacugaauuacagucaggguggagcccagauagagagagagcagaagacaaauucaagaauuccuaggcauagcucuggaaaaaugcucaggaugaauucuaaagaaccaaaaucacaaguagcacacaugaagccaucaaaauucaaaaggagaaguuauuuuuacuuucgaacgcacccuccacuguaaucucaacuugauguggaaaucuggauaaaucacaaccucucugggaugucucuguaucuacaaaccaggaaggcagaauagaugauaauaauauuuuaagaguucuaccuuuaagccgccccuuguaacaguaaugaucugagaaaucuacaauauuagaaguacuuaaauuuuaaaacaauaaaaauaaauuuuaaacaauuuuuugccuuuaaaucuaccaacuuauagaaaauacaggagcagagaaacauguuaaauuauagcucaaaaauguaaucaggaaaaaaccaaacuaggaaacaaaugaccuguuuucuucaacaaauacaauuuaguaaggaaaaagggagagagggaaaccuacagaauuuuuuuuaaaaagacuuaaaagauacagcaauacaauuuuuuaagaaacaauuggggaaaugggaaacacaagauauuugauuuuaaggaauuauucauauuuuaaaauaaugaccuuuaaaagaaucuuaaucuuuuagaaauacacaauauacauguauaucuaccuaccuauauaaaugacacaauguuucagauuacaacauaauugagggaguagaaaugaaacaaaauuggcuaugaauugauaauuaauuaaaguaagugaccaggaugaaaagguacacaauauucuucuccauauguuuccauguuuuaaaauuucuuccauaaugaaaagauuuuuuauuuguauuuauuauuuuagagacagggucucacuccaacguccaggcuguaguacaguggcaugaucauagcucacugaagcuucgacccccuagcucaagugauccucucaccucagccuccccaauagcagggaauacacacgugugugccaccaugccuggcuaauuuuuuaauuucuuuuuuuguagagauaggucuuacaacguuguccaggcccacccaacacuguccacugcaccaagccaaaaagauuuuuaaaagaaugcuuauaaauaaaaccacuuacaugagauaaacauuaauaaaaaauuacaaccuuuaccccucuaauuaauagaagcagguuaaaaacuguaguuuacaauccaucaguaugguuguaauaugguuuggaucuguauccucacccaaaucucauguugcauuguaauccccaauguuggaggcggggccuggagggagguaacuggaucaugguguggagccuacaugaaagguuuagcaccauccacuuggugcuaucucauuauagaguacucaugagaucugguucuuuaaaaguguguagcaccucccucacugcccuccuugcuuuugcucuggccauguaagacaugcuagcuucuccuucaucuuccgccaugaauguaaguuuccugaggccuccccagaagacgcuaugcuucgcguacagcgugcagaacugugagccaauuacaucucuuuucuuuauaaauuacccagucucacguauuucuuuauagcaucaugagaagggacuaauacaggcugcuuuaaguuuacauuuggacacacuauauggcacuaaaccuuaacuugcauugucagucauucuccgaaucaaaaugcaucagagaaaaaaaaaaaagauacagcaaagcuuuucugggggacaaucaauaaacuacacaauuaguuguaaaguuauugaagcccuaaagaaagaagagguggaaauucuuaaaacugacaagccagaaaauaaauggaaaaaacaaaaugguuuuauaauauucauaccucauaaacauaagaaguuuuaguuuccaauauagcuauccgguuacccaaauaacauaucacaggaauaaaaauaugaagaguuugcuuucacagacaucacacaauuggcccaggcauggcggcucaugccuauaaucccugcacucuggaggcugaggcaggaggaucacuugaagccaggaguucaagaccagacuggguaacauagggagauucccagauucccgucucuacaaaaaauuuauaaaaaugagcuggacauaguggcacaugccugcgguccuagcuacgcaggaggcugaaguaggaggaucacuugggcccuggaggucaaggcugcaaugagucaugauugcacuacugcacuuuggccugggcaauagagcaagaccccaucuuagaaacaaaaacaaaaaacaucacacgaugaucaauuuuucaaaaucagaaccaaaaccggcaaaccuguuuuaaugccuaaacaauuccuuuugaaggaguuucucaaauauucaggcaugaacauaagcuaauauaaagacuaagcaaaaaaagauuuuaagaguucuaaauuuuagaaauauuuaaauccaaauaugccacuauuuaccuuaaguggaaccaaacuaaauguuccaauuagaaaauaaaugcuaccuaauuggauuugaaaguucaacuauacaguucaagaguuucaacaaaacaaacagaugcagaaagacugaaaguaaagaggauaaaaacaguauaauaugcaaacucuaauccaaagaauauugggaguuauauuaauaucaaaguagauuguaagauaaaaaacuauaauuagaaauagaguuauuuaaaaaauaaaagugguucaauucaccaggaagauauaaccuaauaacauaagaucaaaguauauaaagcaaaaauugacagaaugacaagaagcaguagauaaaugugcaaauacagugaaaauuuuuaaaauacuuaauagaaacaaacaaggagaauaaucaguaaagaaacagaguauuuucauagauuaacaaacuuuaccuaauggacauggagagaacaccauaacugaaaacuucacauuauguauucuuauagcauacauggaacauuuacaaaaguugacuuuuuuucugggccacaaugcaaguugcaaaaaauuucaacacacuguaauuacauaaugcauauucccggaccgcgaugcaauaauguuauaaauaauuaaaaacagccagaaauuccucauguguuggaaauuauaaacugaacuucuaaauaaccuauagcccaaaguagacucauuauaaacguuaaaaaugauuuuuaaauagugauaauaaaaaaggcauauggcauagaaauaaaacaguaucugaaaaaaaauuuauagcuuuaaaugcacuuaaaggcaaguuaacugaggagcuaaccauccaguucaagaaauuagaaaaaaaacucaucaaaauaaacucaaagaaaguagaagaucagaaauuaaugaaacagaaaagaaauacauaauagaaaagaacaaaaaaggcaaaccaauucauuggaaaaacuaacuauugauaaaucuacagugacacagauuaagaugggggagggcaaggggagagaaaggagaacaagagagaggaagaagggaaaggaggagggaaggagaggagggaauaggagaaaggaaaggagacggagaagaauugggaaaaagagaagaaaaagacacacaaccauuaucaggaugaaaaaccaauaguacaaaauggggagucuagaaauaggcccuccuauauauaaugagcccuucauauauguaucagagguggcacuguacaagaguggguaaaaaauuguuuucuaguaauugauguugggacaacuggcuaucugauaugguuugguuguuuuguccccuccaaaucucauguugaaaugcgauuuccaguguuagaagugggcuuaguggguguuuguuucauggagguggacccuucaugaauggcuuggugcccucaccaugauaaugagugaguucuugcucuguuaguucacaacaaagcugguuguuuaaaggagccuggcaucucucucaugcugccucucucaccaugugacacgccugcuuccacuucagcuucuaucaugauuggaagcuuccugaggcccucaccagacagaagcaaaugccagcacuaugcuuccuauacagccugcacgaccucuuuucuuuccuuuuuuuuuuuuuuuuuuuuugagacggagucucacucugucacccagccuggaaugcgguggcaugaucuaggcucacugcaaccuccacccuccggguucaagugauucuccugccucagccuccugaguaggugggauuacaggcgcccaccaccacgccugacuaauuuuuuguauuuuuaguagagacaggguuuuaucauauuggccaggcugguuucuaauucuugaccucaggugauccacccacaugggccucccaaagugcagggauuacaggcuugagccaccgcacccagccaaccucuuuucuuuauaaauuguccggccucaaguauuccuuuacagcaaugcaaaacagacuaacacacuaucuauaugagaaaaaaaugaauacacucuaacacauacacacacacacacauauacaaaucagaugacuacacaacuaaauguaaacggcaaagcucuuacaaaauaauauagaaaaaugucuucauaacaucaggguagggacguuuuuuaaaauuaagacacaaaaagccuuggccauaaagcaaaagauuaacacauaggaccacauuacaacuaagaauauuuguucauaauuuguccauuagaagagugaaaugcacuccauagaagauagcuguaacacauuuauccaacaaaaaguuugugucuagaaaauaaagaacuucuacaaaucuguaagauagacacuccaauagaaaaaugaguaaaugacccaaacugguacucugaaaaggauuuccaaauagacaugaaaagaugcuacaucucuuugacuacaaagaaaaugcaaauuuaaaccacaaucaaaauccauacauagcuagcacacugacaaaauuaaaagugugacaauaucaagugguuagugaacaugaagcaauggaagcucucauacauucuuggucugaauguauacugaaacacuacuggggaaaacaugaccuaugacccaacaaguucacauccaggacaaauaaaauuugugcaccuaaggaccuaaguaccacacaaguacaugcauaauauucaaaguagcauuguuaguaaccaccaaaaccuguuaggagcuucaagauccaucaaaaguaaaaugaauagguaaacuguaguaaauucauuuuuuaaaaaaugauauauaauaguuuagagcaaccacacagcuacuaccugcaacaacaugccugauucuugaaagccacauugugugaaaccaagaaacaaagacauauacacuauaugauuccauuuacuuaacuuucaaaaacaggcaauccuaaauuauauacuucuuuuuucaacacaccauuucuggcuugaaugaauuauauucuuaaggaugcauaccuagaugagcaaaccacaaaguaaagcaagaaagugauuagacaaagagaaaauaguauuuaccuucagagggaaaggaaggguugugauuaggaacguacacaggaggcuucuggaauaugguuaugcuuuauugucuuaaccucagugggcuacaaagaugcuugcuuuguaauaacuaauuaaacuacacaauuacguuuuaugcauuuucugauguguuaugucacaauucaaaagucuuuaaguuaaaaacauauccuaaguaucucuaauucuauuaauaucuaauguggauuucuucuuuuuuucccuaccuaaacccuucuaguuuaaucuuauuuacagucucaaucaguuguagguaacaaauuucauaagcaucuaaacugacuucaauguguucuaaggugcugguuuuuccaaggaauuuccucuguauuucagaacuguguaaaauagguccauagacuuauuauuuuauguauaaucaaucuucuguauccagggauucuacaucugugguuuccacauauguggauucaaccaacuauggcuugaaaauauuuaggaaaaaaauggaugguuguucuguacugaacaugaacaggcuucuucuucuugucaugauucccugagcaauacaguagcacaacuauuuacacauuuacauuuuaucagguaucauaaguaaucuacagacaauuuaaagcauauaagaggauguguguaggugauaugcaaauacuaugucauuuuauauaggggacuugaaaauccaugcauuuugguaccugaggggcuccuggagccaaacucucacaaauaccaagaaaugacuauauuugcuucagcuuaugauuuuacagguuuagcacauaacuccuccagcccuuuucaacugaaauucuuaaccagaaccacaacacaaaacaugaagcuugaaaauuuucucaauucucccaaggacaguucauagguaauauucuacaugcacagaagaaaaguuaauuugucgcaucaugauauuagggugagaaagguagagugaagagguaaucauuuuaguuaacuuucuuugaaauuuuuuuaagaagaaaaauuuuuuuugcaaugcaaugacaauaauuaaggugguaagugagguauaaaccaccaguuucuguauauuauaaaauuaagcugauuucuuuccaaugaccuuucugaugauaucuauccaguacuugauugacuuuccacuggcaucuuaggcuaauuuuaucaaggcaccaguuuauuauuaauaccaacuucuuuccuaguucauuaguaacauccugaauuacagcauuucauaaaccuaguaugaguuugucuucccuaaaugcauuaccuuacucuuauauaaacgcacaaauuugggcagucuccuacucccucauauaaguauaauagguuaacuaaguugcucuggcugaagcagucuggagacacagguguagaaauguuuacaaaguaguuggcaacagaaugugaagugucaaauguauuaagaacaugacccugcuuagaauaaauaucagaugaacuuuagaauuauuuguuuauuucuaaaaauaauucagaguagagcauuuaaaagagcucugaccuuuucccaacagacagacauuaaaugguagcagugauauguuaacuucauuuaagaauuucuuacaaaaacucugccaaagauuuacaauguaaccaccauucuauacuuucuaaacuggcuuaagaauauauguugucaaauuugacuuuagagucaaaugucuuacucauuagaauacuaccaauguuauuggaaaaugccagauaaaacaauaaaacuaaaaucaacuugucaucuacugaagacaauaugcgcacacauaaccuuugaaacucuguagcaaagccaaauucuucuaacuaagaauacuuuucuuggagcuauaccacaacuuuauacuguuggaaauuuuucugugcuuauaaaucuacauacgagaauacuguguuuccuaaaacaccuuucuuggauuguuuuauuaauguuuucuaccagcaguuaauaucaaacaaagagcuucauuauucuuagucacagaaagaaccaacucaacuguuuuaucagcacucagacuaucuuuagcaacaauuccaccacucauuuuuuuuuucucuuagauagggucucgcucugucacccaggcuggauggaguccaguggcaugaucauggcucacugcagccuuaacuucccaggcuccaguaauggucacgucccagccucccaaguagcugggacuacagucgugcaccaccaugccccagcuaauuuuuauauuuuuuguagagacaaggccuugccauguugcccagacuggucucaagcucuugggcucaagcaaucugcccgcuucggccucccaaagugcugggauuauaggcaugagccaccgcgcccagccuuucaccacuaauuuucaaaacaucauauucacuacacauuaacagauguuuuauuucugggaacugaaaauacauuuguguaucugauuauuaugcaaccauuaaaaaugauuaagcucuugcaccauaaggcaguguuuuauauauuaaaaacucucugccuuauaaauggcacuaccaacugcaugugcuagaaauacagaacauuuauccuuauacucccucauucuacaucaaaacaaucaguauaucuggcugauuuuacuccuaaaucuauuuugaaucucucuacucucuaucacuaccuauaguccuagacacuauaauuucuuuucugaacuauuauauuuaccuccauacucucaccaccuaacaguccauuugcccacauggccucugaaugaucuucuuaaauuacaaaguucguaugauucccuugauucaaaaaucuucagugguuucccaccacucuuggggaaaaguaccaaaaacuuuacauguauuauuuagaccuugcuuagcuacgucuucagccucagucccucgcuuucuaguuaucauucucugcacuccagacauuuuaccucuaacgcuccaaguuccuucccucugccugcaacugcaccuguacaagcuccuagcaccuccaaugcccugcuuccuucuuucacaugccugacuuguauucguuuuucaguucucaucuuaaauaauacauauucaauuuugauuuccccacuuauauguucucacauucauacuuuuuuuuuuuuuuuuagauauucucccuuuaucacccaggcuggaauacaguggcaccaucucagcuuacugcaaccucugccuccuggauucaagcgacucucgugccucagucucccgaguagcugggauuacaggugugcaccaccacaccuggcuaacuuuuguauuuuuaguagagacaggguuuagucacauugccugggcuggucucgaacuccuggcuuuaagugauccaucuaucuuggcuucccaaagugcugggauuauaggcauaagccacugugccuggcugacauucauacuucuuuacagcccuuaucguaucacaguuguaacuuuuuuugugagauuguuuaauaguacccucuaucacuagaguauaagcuccauaagagaaggacacaucauucuucuucacugcucuaucauuagcaccuaccaagaugucugguccacaaaggagucuaauaauuauuugcugagugaaauacacauagaauuaagucuagaaaaagacauauccaaauaaucaguuaucucugggugguaggauuauggguaguuuucauuuucuaccuuauauuuuucaucauuuauauuuucuacaauaagcacauuuugcuuuuauuauuuaaaaguuaacuccaguccauuuuuaaaaauaaacuucauuuuggaauaauuuuagauuuaugaaaguugcaaugauaguacagagaugucccaaauaccucucauucauaguuuccccaauuguuaacacguuacauuuccaugauacauuugucaaaacuaagaaacuugacauuuguauauuaaguaaacuccagacuuuacauagauuucagcaccuuuuccaugaguguccucuuucuauuccaggucccaauacaggauccacauugcauuuagcuaucuugucucccugaacuccuucggucuuaguuuuucagucuuuccuaguuuucaugaucuugacuagucagguauccuguaaaaugucauucagucuaagcucaucaguugcuuuucuuaugauuagacuaggauuaugggucuuuggaaacacuaucacaaaggugacaugcucuucuugucacauaucaagaguacaugauaucuaugauuuaucucuggugauauuaauguucacuauuuggcuaagauaguguuuuccagguuuuucccuacucuauucuuuggaaguaagucacuaaguccaguccacccucaagggagguaggaauugagcuucuccuccauagaauggaauggguacauaaauuauuugaugggagauuugucucuuuugccucauauuuauucaauccuuuaugucaacuuauauccuuuauaucauauauaugggauuauuuuauacuuugaguuauaauucaugcuacauuauuuuuguugcucaaauuauuccagcuuugacccuuaggagcuucuucagguaaguuccuguguuccucugaugugcccccauccuuuguuuuaugaguacuucuucacuccugguacuacaagacacucuggccacaucuuguauuucuacucucucaguccuagacucugccauuucuccuaggcaauccaagucauuacuaagaccuaaaguuaacuauauaagauuuuuuuuucuugagauggggucuugcucugucacccaggcuggagugcaguggcugaucucggcuaacugcagccuugaccuccccaggcucaagugaucuucccaucucagccuccugcauauugaggaccacagacaagcaccaccauguccagcuaauuuuucuauuuuuuguagagacaggguuucgccauauugcccaggcuggucucgaauuccugggaucaagagauccauccacccaccucagccucccaaaguguuggcauuacaggcaugagccaccacgcccagccaaccauauaagauuuuuaugaacccaggauaaucuaucugaaugucaugauguagguagucuguuugauagcugcagaaaguauaaguaaguuuaaacuuugggcacucaggcuaaaauuaucauaaaggacucucacauauaauauuaaauagcaacacuuccaucauuucuucuaccguauucuuuuguuuccaaaacuaaucugaaucagguagguagaauagauauguuucccuucauuuuuuagaugagaaaaucuaaaagggugugaugacacugacuaaugucaggcagguagccauuuuccucugugguuuucuccuggcuuucuauucuaucccuauuuccuucuggauuacacuaccauuuuggugggcccuuaugcaauacaguuuaacaauauagauaaguggcuuauauccugcuacucuacugaauaacccaccaguuuaguguccagcuaaaccaaaacuuuauauaacuguauuaguucgauaauuuaaaaggucugagugcuguggcucacgccuguaaucccagcauuuuggaaggccgaggggggcagaucauuugaggucaagaauucgagaccagccuggccaacauagcgaaacccaucucuacugaaaaaaaaaaguauaaaaacuuagcugggcaugguggcacaugccuguagucccagcuacucggaaggcugaggcacgagaaucacuucaacacuccaccugggaggcagagguuguagugagccaaaauaucaccagggcacucuagccugaaugacagagugagacucugucucaaaaauaauaauuaaaaaggaaaaaagacuccuaaaagguauaaaauaugagcagugaauauguugaauagaugacuauuuuacaaagaaguaaacucuuaacgagcuccuacucuaugcaugccaauauauuagacauuuguaagaaggaaggauaaaauaaacaguauauauggcugcccauuauauaugaauaucccuuccccacaaaacuuggaaauagaaaaaaauaagaaugcucaucaagaguuaaacuauguaaucaaaauguaaugaaucagcucuaaacagaacuauguacauaggaaaauaaauuacuuacaaacuaacagaaauuacuaggauaauuuuacugaaaaaaaauguguugcucaauuuaggaggagggcaggcuauaaacaaguaagacaaauacagauaaagucaagaaugcaagcacaauagaagcaacacccaguuuacuacauacgaggggcccuuaacuuuaacugaguaguaagguaaggcuuacuaaagggacugagggcuaauuuaagaagcaaaguaaaaguaguacuuuagcacuacuugguauuggaauacuacuaguauucuagacaaaggaccauguauaaagaccuggaaaaaugacagccaggcacaagcucaaaccuaacauuuacaagggccagggcaauaguacaacagaaggcccaauuaccauauggacaaaauauuuaguuauacaucaaguuuaaacuauuaauauguucuauccuauauacaaauauaccucggaaugaccuggaaguuuaaauucaguuuucuaauucugcagccaaauugcugacaauuuggaaaauacugaaaguauaaagaaaaauuauaaauccccaaauuccaucaugaagaaaaagcacauuauuuugguguauuuuccuccaauguuuuuucuguguguguauauaauauuugaagagaauugggaaaucauauauguagauuuuacccuuuuuauauaaacccuucacucuuaaaguuuuuaauacaauauaacaagucaccuuauucauguacccagugugcauuuggcagcuagcuuaucuuagaauucucaaaguguggucaagaauugucgagagaccccaaaaaucuuucucagggguccacaagguuaaaaacaacacuuucgauaauacuaagauauccguguccguuuccuacuguuaucguaacacacugccauaaacuuaguagcuuaaaacaacacaaauuuauuuucuuauaguucuggagaccagaagucuaagaucaaggugugucagcagggcaguguuccuuuuggaggcuucaggggagaaucuguuuccucgccuuuucuagcuuccaaaggccacuuucauuccucggauuauggccuuuuucucacaugacuucuuguuuccauuaucaugucugcuaccacuaacucugauccuccugccucccucuuuuaaggacccuugugauuacaucagagauacccagauaauccaggauaaucacuccaucucuagauauuuaaucacaaaguccauuuuaacaugaaagguaacauauuuacagguuuugggaauucggguguggggauggccauuauuaagcagaccauaacauucuuugucuuguucauuguauuggccuuucauuuauaguacaaaagcaauagugaggaagacagcuugauaucuagcauaaaucaaaacaguggcaccaaaauuuacuagaacuuguuguauuggccaggcacgguggcucacgccuguaaucccaacacuuugggaggcugaggcgggcggaucacuugaaaucaggaguucaagacuagccuggccaucucuacuaaaaagacaaaaauuagccaggcguggugguguacaucuguaaucccagcuacucagaaggccaaagcacgagaauugcuugaacccgggaggcggagguugcagugagccaagaucgugcuccggccugggcaacagagggagacuccaucucaaaaaaaaaaaaaagaaaaaaaaaagcaguuguuauauuuuucaucaacaugaauuugcagaaaacaaaagccuguuucacuuccaaauguucuugauaaaacaguaaguauucauuuuauuaaaucacaacucuugaguacacaucuuuuuaauauucuguguaacaaaguagaaagaacgaacagaacacuuucgcucauacuguuguacaauguuccguccugaggaaaagcacuuaucugaauauuugaguugugggcugaacauuuuucaugguacaccauuuuucuuugaaagaaaaacugacacacucacuuuaguuauuuaggcuaaagauuuugccagacauuuucucaaccugucuuuucaaguaaaacaacugacaguauauuguugccaauaaaaaaaauuugagcucucaagcaaaaacuaaauuuuggaaaacuuguauucaccacugugagccagacagcuucccaacacuuuggaaggccgagaugggaggaucacuugagcccaggaguucgacaucagccugagcaacauagugagauaccccaucucuacaaaaaaauuaaaaauuagcugggugugguaguauaugccuauagucccagcuacuugggaggcugaggugagaggaucacucgaguccauggaggucgaggcugcagugagcugugaucaugccacugcaccccagccuggaugacagaaugagacccugaauuuuuuuaaaaaaauuauuuugaggccaggcgcaguggugcacgccuguaauccuaacacuuugggaggccgaggcggguggauaaccugaggucaggaguuugagaccagcuugacuaacauggugaaaccccgucucuacuaaauacaaaaaauuagccaggcaugguggugcgugccuguaaucccagcuacuugggaggcugaagcagaagaauugcuugaaccuaggaggcagagguugcagugagcagagauugcgccauugcacuccagcuugggcaacaagagcaaaacucugccucaaaaauauauauauauuuuauuuugaaugaagacuccugacuuugcccauuggcauagccuuuacuuuucauuaagaugacuucugguggcuucuauucagucuuacauucagcuggguuguguucuguugcuaaagaaaaacuagcuaaauguaaauaauauacucuuuuauaauauagcucuguuauaauucuaaaaucacuguuaccuaauauauaucaaaccucagaaaaaauauacauugaugaccuccugaaacucucuauacaguccaucuauucgaagauagucuaaaauacaccuaugaauccuaccagaacaucacaaauaaucaauguuuauacuauauaauaauggugucauuguggaaucuugugauucaaguaggagauauugaagaauguuaauaauaaaagcccugugaggacgggcacgguggcuuacgccuguagucccagcacuuugaaaggccaaggcagguagauugcuugagcccaggaguugcagaccagccugagcaacauggagaaaccccgucucuacaaacaaaauacaaaacaauuagccaggugugguggugcacaccuguagucccagcuacucaggaggcugaggugggaggauggcuugagccugggaggcagagguuagaaugagcugagaucgugccacugggugugacagagucagaccccugucuggcaagagagccugggcaacagagccagaucccaucucaaaaacaaaaaacaaaaaacaaagcccugugaaauuuuacugcuuacuccaagcauauuccuaaaaaucacuguuucauacacuagcuaguaaacacuucauaaugucaccggagauuuaucuuaauauuaguaauagggugucugcugaacaauugguuagguuuuuguuuuauaaacacuuugaaucauuuaacuaaacagguucuuuuauuuacuugcugcuaugaaguuuagaggcaaauuuguagucuccucucaagaaguauacugguaaaucgggcaugguggaucacacuuauaaucccaccacuuugggaggcugaggcaggaggagagcuugcggccaggaguuugagacuagccuggucaacauagugagaucccaucucuacaaaacauuuuuuaaaguuaaaaaaaaaaauaaauuuuaaaauguauauugguaacuuuuauuggucucauaucuacauuuuacgucaccucaaguuguuuucccuuugcuucaucugugucagauacuuaugcaaaugauugaauucuguuuaucccuuuaaguugcuuuauauccuuuuuuggaaugaaguagauuauuaguauauuucucacuauaaauacauuuguauuaugguuuuaccuaaugagaucuaaaacccuaguuaauaugaauccgccucuuagagacagcuaguuucauguugaugccauguuucugcguuuacaggaggaaaggcuggacccuguauuuguguuguguacccucacucuaggaggugucuucacacuaagagauggccacucagcuucuggcauuaucacucugcaucuacuuugccaagcuucuucuuuugaaacgucuuguguaggcaguaguuaugaauaugccacccagaagaauaccagaugaauaaacuuacaaauauuuugaauaaagcucaaucuaacaauagauauuugaaugaaaauacuggaaucucuuguaauagcucagaagguagcuuaaguuuuagcacaggugguaggaucacaacaccuugaccaggacaguccaccucugagccucgucuacuaugugguuucugaguucugaagcucagaauguuacauauaugggaaguagaauauaauaaucuauguaauuucucuggauuccauucccaguuaucacaugccccaagauucccaauaaaucagaaaaccucacauuugcauuuuaguauuuccaaagguuuuuuauuuuuauuuagagacuggguuucacuguugccuaggccagagugcaggggcuauucacaggugcgaucauagcaccccacagccuugaauaccugggcucaagcaauccucuugccucagccucccaagcagcugggacuacaggcacccagcuuccaaggcuguuuuuauuuuuauuuuuuaaaguuauguauagauaggaaaucaaacacuuaggagugagcccucucaacucuuacuccucucacauuucccucucagucuauacauaaucagaaaccugggagacccuugauguugucaaguaaacauuucaggugugauaaaaaaggauauaggcgccuaaauuuuaaacuuacuagcauaaucacguuaucaacauaaauuaacuacugaaaguuaauuugcuuaaacauggcugaucacaguuuuuaccccaucagucaaucucaauaacuucucuuacuucaagugaagauaguacuaucuauuauaagaauaauucuaaagcugcacucaugaacagucaugugcuucauuuucaaugagucaagagccauaugguucucuuuaaugaauacaacucuggcaacaaaaucuuggcucucccuuccuguuacuugcaauaaaaaaauuuugcauuuuccauggaaucugaauuauugaccaaaaugacucauucaaauuagauauaccuaauauaaacacauuucaggccuacuuuuucagcuuuuugcuagcugacauuucugacugauacuacuagucaucauuauacagaauaacuucuauuuuuuaaucaguguacucuagauuguuuagcacucacucugagcagauugauuacauuuuugagauuauuaaguacacauaguuacuuucaaagcaagggcuaugcaacagauaucuacugaagucaguagauuccaaagcaguuuaucucugacaagcuaaauccuaauccagaugucauauuugaguucuagagcuacagcuuuucauuaauacuaguagagauguuacugacaucucauuugaacaugaacauaaaagaaaacugcuuacguuggggguacagagucuaacauauccaaagggaaaguaaucuagaagaaaacagaaacagcuacuauuuagugaguccuuaccuuaccauaagccagucacacugcuaaggauucuauaugcauuauuuguuaagaucucuauaugcauuuaauucucagagcaaucauuuaaagacuuuauuauuuaggaguuuacuacuauguuguacgugggaauaaacugaaguauaaacaggcuaugugacuugccaaaaguuagagagagaauaagugacagaaccaggauguaaauucaggucaccaacuugaaagccacugaacaucauggauuuucauucaacacauauucaaaaaaacacuaucaguaccuucugguaauaguuauuuuuugguaugcuaaaaagauauggagucacgaagaauuacugcuugacuuacuaaccacuuccauacuccccagauacugagcagaaacagaaauaaguuuuuuccucugaaaucugccuuaacccauagugagagaccuaaugugaggcuccaacuucuuccaagacauuccccucccugcuacuguuaacagaagaauaucagcuauguugaaagaaagaauauucacugucuuaaaaaaggacauucacuguuucacauauauaauaauuaucccuauugcuggaucuucaugcauuaucuucccuuuacaaccuucccaauucuaaagggauaucaaaaugauaucuuuuuuuggugacauguaacauuuggaaucuguaccaccgaauuuaaaacucacacaguuauuuuugacugcuacuccacaacuuauaccuucaacuacacuaacuuugaggacagacucuuuauauaaacuaccaauagacugggcacaguggcucaugccuguaaucccagcacuuugggaggccaaggcaagaggaucguucgaaccuaaaaguucaaaaccagccugggcaacacagugagaccccauuguuacaaaaaauuuuaaaaaauuagcugggucuaguggugugcaacugugguccuagcuacucagaaggcugaggcacaaguaucucuugagcccaggagguaaaggcuguaguuagccaucauuguaccaccgcacuccagacuaggcaaaagagcgagacucugucuccaaaaaaagaaaagaaaacaccaaugguugccuacgcuauagucauuccaacuuuauacuugcuaauugggccuuccucuuguuugcauguuaaagugccuaauuucagagaaggaaucauaauuguccuaaccaaucaguaauuucauuccccuuugccaguuaucagucuuggggugggcaugugacccaauuauggccagugacacauaaggaagucuaaugauaagguucuagaaaaauuauccucccugauaaaagagcaacacaaauagauccuuuuuaugcccuugccccauccuuacugcuuggcacucucuccuguugaagaccaugaguaaagacaucaccagcacuugacggcaacgugggaagguggaaggagucagcucuuccuauaucuuucuacuuccuggaguuaauuuucugccucacauaaagggcuaaagagcuauuuaaacacagaaaaaauggguaugcuauuaauuucaccuguuucaaauuaugaauauauguauuuuucuuguuuauaauuuugucauuaaaauuagaaaaaaaaucugugauaaagacagcaaaugacaaauaacagcaaaauauuguauuuuaaaccaguaaauauccaagggagccagaacuugaagugucaauauucugaaaagaagugaaacaaagaaagguaaaacccaauagucucaaccauuuucauucuugaccuauuuccuggugagaaaaugguaaggaagcagaaagggguaaaaagagguaaaguauucugaagucccugcauuuuccaugaagugguaaaaguaccaaugccuagaacuaauaaaucaaggauacauguaauaaucucuaggguagccuacugaacaaaaaguaagagaacauauaacaagguuuugaagguaacagaaauaaggggagaggaaagaacagaugugacaaacagaaaacaaauagaggauggucugaaaccaaacauauuggugauuauguuaaaugcaaacagacuauaaaucaauaaaagacaaaaacaaauuuaaaaaacaaaacucauauauauccugggcauuggcauauggauaagacaauuauuucaauguaacacaguagaaaguccagaaacagaucuacaaaaauauagccacuugauacaugacaaagaugucacuguaguacauuagaaaaagcaaaguuuuuuccaacaaaugguguggggucaacuaguuauucauaugggaaaaaaaugaaucugaacucuuaacccacaucauauuuaaaaaauuaacugcagguaggcagaucuaaaugugaauacacaaaaauaaaacuucuagaacaaaacaggagaauaucuuugugaccuugagguaugggaagacuuguuaaacagaacaaaaaaaaacacuaagaauaaaggaaaagaaaaaguuuuuguuguuguuguuggugguggugguguuuguuugguuuuugagacgggguuuugcucuggugccuagcaggagugcaguggugcaaucaaaacuaauuuuuuuucuuuuccauuuuuauuguagagacagagucucacuuuguugcccagguuggucucaaacuccuggccucgagcaauccuccugccucggccuuccaaagugcugggauugcaggcauaagugacugagacuggcuuagaauaaaggaaaagauuagcuggauuucauuagaauugaugauaucuucaccaaaagauuccuuuaagagaguaaaaaaaauaccacagaaugagagaagauaacugcaauaccguacauguaucugaaaaaggauucauaaucagaaugcauaaugaacuccuauaaaacagggaaaaggacugaauaggugcuuuaaaagaggcaaucuaaaaagccaauaaacacacaaaaaggcauuuaaacucauaaaucaucaaguaaacauaaauugaaaccaaaaugagagacuacugcaaccacacuggaauagccaauuuuuuaaaaacuguuaucauguauaggugaagauguggaguaacuaguauucucacacauugcuaguagaaauguacaugcuauauccacuuugguaguaucuuugaauaggguaauugacaaaaaaaaaagaaauggaaguaucucugauaguaucugauaaugcugagauauacauauucuaugaucuaagcauuccauucugugauauaaaucauacagaacuguguacauaaugugcacuaaaacauaugcacaugacaauucauaguggcacuguuagcaauagccaaaauaugaaaaaaaaaaaaaaaaccaaauaaugaaauaucaguguagaauaacuaaauaaauugaagcauguuuacacaaugggacacuacaccaacaaugaaaauacguuaacuauugcuauacacgacaauauagaugauuuugaaacguaaguaaaagccacagacauaaaagaguacacaguaugaauuccacauacauaaaguuuaaauacuugcaaaauuaaucuagauagaaaucaaaauaauauugaaacugaagguggaacaaggaaggauucugaaacuacugguaauguuuuacuucuugauugaggaguaguuauauaauaaauguucacuuuguaggaauucaucaauuuccacacuaagaugugaugauugcacaccucucuguauuacauuauauuuaaaagcuuacccuuaaauguaguaguuucuuuugggguggugagaauguuuggaacgagauagaaacgguaguugcacaacacugugaaccugcuaaaugccacucaguuccacacuuuacaaugguuaaguuuauguuauguaaauuugaucucaaauuuuuaaaguuacugaaaaauucaaccucaauaaaauaguguacauauuuauuaguggauauucaugaauacaaacauuaggcugucaugcugaacuuaccaacugcagugucaccaucuaauaaauugucaucuucagauguuugaaaguccauaauaacaccugcuccaucuaaaaguuccucaucacuacuugcacuuguuauacuguuguagcuguuucuauaguagccucuauggaacagcugcucagacuccauuuagcugucugauuaucugugggggggaaaaaguaguuuuaacauuuuucaaacauacaauaaaaaucaucuaguuuaacaucacaaaaggaaaguuaugaucuaugugcuaaaaaaaauuaagcguauucacuguaacaauaguuaccuuuauuaaguauuuuggggugagguaauaauuuuauucucauuauacaguuguaaaaaagaaugaagaauuucuccagguagaucuccaauuguuaaguugaaaaauguaacguauauuuacauuuuugcuuguguauguauagauuugucucaggagagaguuccaaguaaguugcccaaaggguagggaacaagauggcugaaguacaagguuugaaagacagacugccccuuuugaauauuuuaucagguguaagagguguaaguacaaccugauuuuaaaaauaaauacuacaauuaaaaaauuuuaaaauauuuauuucauucuccuuucauccuuuuaaaauuuaaaucuucagagccuauggucaaacauuagccacugauaaaaugguaacaggcaacaaaucaaaaaaggguauguuuucauuguucuuacucuccauauucuuaaaucuguauuacuccuaacuaguuugauuuuuaaauaccuccacuuacuuacucaacaccaaaauaagaguucaacauaaguauggggacauuaguaauagacuuuuaagcugcaugggugggacuugaaagaugcagucauaaaagcagucaaaccaguaagccuuguaaaacaagacuuagcagauauggccuaguaaguacacacagaaaaugacagaugaagacuaaaguaagcacaguucaauuccagugaugaauucuagcagugaauucuaacacugaagacguggaguguuuuaagacaaucucuucuacucaguaaauuuuccuucugcaaauggaaagauaaccucaaagagcuuuaauaacaaaaagguauuuaugaaguuuuagaaaacuagacuauuacugacaauaaauaucuuuuaaacagauuauauaaauuuccuaacuuaaagaucacuuugaaaaaggugaaguuuugagagcuccuugagagcaugccucugcucuccacaucuggcauaaugacuggcacaguguaagaacaacaaaugucaaacuauucaauuaaugaggucaaaaagagaaauguauucaguuuucaauuuaaaaaaaaauccucucuccaagaguauuaaacuguucuuggaggaauaaccaaaauuagcaaauuaaaaaagaaaaauguaaauacuugcugcuuugcaacuuuaugaauguuuuauaguuaucgcuaccaaagauggcauauuauacugagaugagauuuguuagaguauauuaauuaaaacaauaggaaaguaugaaaguaguuguucauacuaagaaaucugcaguuccauagaggcaaacaaauuaaauauuauguggcuuuugagaaaauuaccaaaaggcuuuuaaaaacauaaacauuaauagcuuaagaaucauuuaauuuugauguaucaaagcauguaugcuaagauuuuugugaagaacacagacacucuguuuuuauuucuuuacagaauagaagggcuuaauacauaugauaacauuucagugaacauuagcuagaggcuacacagcacuaagaaaucucuguaaaaucauuaaaccuuuuuauguguuaauacuucaaucagcaaauuccaauauaucuccuccauuuuaucccuaaaagucucucaaaaaucguaagugguaacuggaaauuuaacuauuuccguuaaaaaaauuaauuucauaauaccuuugagacaccuagccugcagaucauucuuuguaacacaagcaugcaacucugcuccaaauaaaccaauuaaacccaggccugcauggguuucuauuucuauaaauuugauaacuuaagauaaaaaaaaaaaacuauuccacguauuaacccagaaaccuauagagcuguacugacugaugcagcagccagcauacauacggcuaucgagccauugaaacauggcugguccaaacugaaaugugcucuaaguguaaaauaccuaccagauuucuaagacuuaauauuuaaaaaggaugucaaauauuugacuagaaauuuuauacugauuacauguugaaauauuuuagauccauuggguuaaauaaaauauauuugaaaugaaucucaccacuuucuuuuuaccuuuuuaauguggcuacugaaaaauuaaaaauuaccuauguggcuugcauuugcagcacuaacacuuuuauugaacagcacugcuauaaaauauucaaauuucuauaguagcauaaaggacauauaacagaaggaaaucugaacacuaguguuaaauauuuucagguucuaaacccaauucccaggcuugggcacaaaaggcuauuuagacucuaacacagcagaugaaauuuuacauauuuaaaaaaaauaaugcaaagucaccuuuuccauuuuaaucaccaaaaauauacuuauaaucauuucaaaacauuguaauagauacacaguagcuuguaaauauauucuuacaaaauuauaaaaauuagagauaagcugggugugguggcgcaugccuguaguuccagcacuuugggaggccgaggcagcuggaucgcuugaggucaagagcucaagacccaccuggccaugguggugaaccccaucucuauuaaaaauaaaaaauuagccgggcgugguggcagccgccuguaaccccagcuacuaaggagccugaggcaugaaaaucgcuugagccagagaggcggcaguugcagugagcugagauuaugccacugcacuccagccugggaaacagagugagacucugucucaaacaaaguaauaauaauaaucagagauaaacuaugaaaacuuccaguaauaaggccucguuuaccuaauaaauuccuauauuaucuacgugcaauuauuuugcuuccuucgaaucugaugacacugcagccagcacaguuuuuuuuuccaaaaaguaaguuugcucauaaucucucuccauuccauguuaacaucucuuaaucauuuccugcuacccuuaagaaacaaacucuuuaauauagcagaaaaaguucuaugcagcccaaccccugcuaguuccccagcacuuuuuuuuuuuuuuuuuuuuuuuuuugagauggagucucgcucugucacccaggcuggagugcaguggcgcgaucgcugcucacugcaaacuccgccuccuggguucaggccauucuucugccucagccucccgaguaccugggacuacaggcgcccgccacugcgcccggcuaauuuuuuguguuuuuaguagagacgggguuucaccauggucucaaucuccugaccucgugauccgcccgccucggccucccaaauugcugguauuacaggccugagccaccgcgccuggccccagcuucuuuuaauagccauucugacuggcgugagauggugucucacugugguuuugauuuccauuucgcuaaucauuagugauguugagcauuuuuucacaugcuuguuggccaguuguauaucuuacuuugagaaguauguacuuccugaaguacucuagacucacugaucuuucaaucucucaguccuaucaagcucuuuccugacuccugccccaaggccuuuguugcucccucugccuggaucauacccucuucucuuuaacaacucacucucuuaauauuuuguugaagguuuuuacaucuauguucaucagggauauugaccuguacuuuuccuuuuucauugugucuuugccagguuuugguaucggggugaagcuggaaugaguuaaggaggagccccuccucauuuuuuggagucguuucaguagaauugguaccagcuuucuuuguacaucugauagaauucagcuaugaauacaucugguccagggcuuuucugguugguagauuuuuuauuaccgauuccauuuuggaacucgauauuggucuguucaggauuucaauuucauccugauuuaaucuugggaggcuguuuccagaauuuacccauuuccucuagauuuucuaguucguguuuacagauguguucauaauagucucuggggaucuuuuguauuuccaugggauugguuguaaugucaccuuuguuguuucugauuguguggugauuuggaucuugucucuuucucuguuaaucuagcuaacgucugacaaaggucuaauaucuacaaucuacaagaagcaaacaauucaacaagcaaaaaacaacauuauuaaaaagugggcaaagacggccgggcgcgguggcucacgccuguaaccccagcacuuugggaggccuaggugggcggaucacgaggucaggagaucaagaccauccuggcuaacauggugaaaccccgucucuacuaaaaauacaaaaaaaauuagccgggcgugguggugggcgccuguagucccagcuacuccggaggcuggggcaggagaauggcgugaaaccaggaggcggagcuugcagugagccgagauugcgccacugcacuccagccugggcgacaacagagcaagacuccgucuccaacaaacaaacaaaaaaaguaggcaaggacaugaacagauacuucucaaauuaagauauacaacuguccaacaagcagaugaaaaaaugcccaacgucacuaaucauuagagaaauggaaaucaaaaccacaaugaaacaccaucucacaccagucaggauggcuauuauuaaaaagccaaaaaacaacagaugcuggcaaggcuauggaaugcuuauacacugucagugggaauguaaauuggcucagccccuguggaaagcaguuuggagauuuaucaaagaacuuaaaacagaaauaccauuugacccagcaaugccauuacuggguauauacccaaaagaaaauaaauuguucuacauaaaagacacaugugcuuauauguucaucacagcacuacccacaauagcaaaaacacagaaucaaccuaggugcucaucaauaguggacuggauaaagaaaauaugguacaggcugggugcgguggcucacgccuguaaucccagcacuuugggaggccaaggcuggcggaucaccugaggucagaaguucaagaccaaccuggccaacauggugaaacccuguacuaaaaaaauacaaaaauuagccgggagugauggcaggugucuguaauuccagcuacucgggaggcugaggcaggagaauugcuugaaccuagaaggcagaguuugcagugagccaagaucgugccacugcacuccagccugggcgacagaacaagacucugucucaaaaaaaaauaaaaauaaaaaaaggaaagaaaagaaaauaugguacauauacaccauggaacacuacacagccauaaaaagaauaaaaucaaguccuuugcagcaauggggaugcugcuggagaccauuauccuaagugaauuaacacaguaacagaaaaccaaauacagcauguucucauuuuaagugggagcuuuaacaucagguacucacagauguacagauggcaacaauagucacugaggacuaccagcgcgggcaauguagggaaggaagcaagggcugaaaaacuguugagcacuauacccacuuccuggguaauggguacaacuguaccccaaaccgcagcaucaugcuguauacccauggaauaaaccugcacaucuaaaauaaaaguugaaauuguaaaaauaaaaaagaauuaacucuccuacucauuuuucuuacaaggucuuacaucaaguaucccuuuauuuaacaaacucuuaaccagagcuuacuauaugcuaggcaauaucuuaagcccuuuacaaauucauucauuuaauauucauauuaaauauaugacaaccuuaaagaauaggugcuauuauuguccccacuaaaaaugaggaacugaggcacaaagcauguaaauaacucgcccaaagucaugcaguuaguaagcaaagcuucgcugacccacuuacuaucuggaucaaauuuucucauuauuaguucuuauagcucucuuuuacagcacuuaccacaguugaauauuaaauuuauuucugugauuauuuaauaucugucugccauuguagaacgugucaugaggucugacacucaauuuuugcucaacacuguauacucaaugguuagcaaaauaugucacauuagaccaggcgcaguggcucacagcuguaaucucggcacuuuaagaggcccaggagggcagaucaccugaggucaggaguucaagaccagcauggccaacauggugaaaccccgucucuacuaaaaauacaaaaauuagccgggcauaguggugagugccuguaaucccagcuacucaggaggccgaggcagaagaaucacuugagcccaggaggcagagguugcagugagcugagaucacaccacucacugcacuccagccugggcaacugagcaagaucugccucaaaaaaaaaaaaugugucacaguagauguucaauuuuuuuaauuaaauuuuuauuuugagauaauugugguuccacauguaguuacaauaaauaauacagaaaaaaauccuguauaucuuuuacccaguuuccauuaaugggaacaucucgcaaaacuauaguacaauaucacaaucaagauaaggacauugauacagucaagauacagaauauuccaucaccacagguaucucucauguugccguuuuauggccaucccuccuuaaccccuagcaacccauagucuguuuucuacuucaauaauuuugccaguucaagaauguuauauaaaugauaugauauggggauuaacucuuuguucucagcacaauucucuggagauucauccaggguguuacaugugucaauaguuccuuccuuuuuaucagaguagucuaugauaacagauaugccacaguuuguuuaaccauucacccacugaagaacaucuggcuuguuucuauguuuuggugacuaugaauaaagcugcuacaaacaugcauguacagguuuuugaaaaugaauagccuuuauuucuuugggcuaaaugucagaguacaauaguugggucauacaguagucacauauuuguuuuuuaaagaaacugccaaauuguuuuccagaguggcuguaccauuguacauuucuaccaacaauguaugagugauccaguuucuugaccucguugccagcauuugguguugucacuauuucuuauuuuagcuauucugauagauguacgguaguaucuuguugcuuuaaucugcaucucccuaauggguaaugaugcugaacauuuuuuaugugcucauuugcuauauguguaauccucuucagugaaaugacuaugucuuuuguccguuuucuagcuggacugcuuucauacuguugacuuuuaagaguucuuuauauauuacagauacuaguuauuugucaguuguguugucugcaaauauuuucuccccucucuaguuuaucuuuucaucuuuuuaacagggucuauaacagagcaaaaauacuuaauuuugaugaaguuuaauuuaucaauuuugccuuuaaggaguauucuuuugguggcaagucaaagaaacauaugccuaacccuaccuccccaaaauuuucuucuauuuuuccuaaaauuuuauaguuuaauauuuuuauauuucagucugugauccauuuuaauuugugcaugcacaggguaugagacauagguugagguuccuuuauugggggguugggaaugggacaguguauggaugucuaauugcuccaguaccaacuguugaaaaaguuaucuaccuccguugaacuguuuucaugcuuuugacaaaaacuagguauauuuauguggaucuauuucagaguucucuguucuguuccacggaucugugucuuuaucuaugcccauaccacacagucuugauuacuguaacuacauaauaagucuugaaauugaguagauugaucuuucacaccuuauucuucuuuuucauugccuuuucauguaaauuuuagaauaaucuuguccauaucuaaaaaaaaucuuguuggguuaauuauauuguaugaauaaauaacaaauguauaagaaauaaaugguacaugucuuccuugauguuguaaaagagcuaaaacucaacaagaccuaaacuaaauaaauauuugccccaaaaguccuuguccuccuacuuuuccuaucucaguuuacaggaucaccauuuaucuaguauucaaagcuaguuuuuggagucauuuauuaauuuauuugauaaucauugacugcacacuuagcauguaccaggcacaaagccagaugcuaggguaaugaauaagauaugguuucuguuccuaaggcagugaaggugacagacaucaacaaguaacaacaauaugguaugauacacaucacaggagagguacauacaauguauuugauaaaccugagaaaaguaagcaagcuggcuggcacacaguccguaagcacuuaauagagggaauauuuuagcaaaauauugaagaauuaggauaaauuaauugggcugugagguaaaaagucaauacaggcacacacacaaaaaaaguaugcgcaacagcauaaaagcaucauaguaaaaccugcuuggguagcuuauguaagagguaaaggaccagagaguagcuacagaggcagacauaggccagaucaugaaggggagggguucaugugucacacuaagaaacuuacauacucaucuauacacaggggaaaccaugaagaacuuuagagaaaucacaugaucagacaugaauuuuaguaagccaacacuagcagcagugugaaagccagauaagaaggguaagagacugaaggacuacagauagagaagcuggagaugagacuagacgucugaacaauucuaaacguaagauagggcauaacugaauuaagagugauaugauauauauugguuuucauccaugguuccugguuuauaagucccacagcucuuauuacauucuuuuuuaauauuaaauuuaauuuuauauaaguagagacaggauuucacuauguuggccaggcuggucucgaacuccuggccucaagugauccgcccacaucggccuuccaaagugaugggauuacagagguaagccacugugccuggccuuacuacagucuuuuguauaauguuggggcacauuaaaccucagaaaacagaaucucuucucuugcugaccuuuuccugcccuccuuuccaccaacccaaggcagaacucuaaucuuccacagccugucugacugugggucauaagaccuucccuuuagaagggagcuugccccagacccuggaagaaggaaugcugcagacaggcagaagaaguuggacaggcaggccuugcuggguuuccccacugggucuauuagugcuguuaggucauacucuuuuuguccaaucacauuucuacacaguuguugacugugccuauguaaugaagccuccauaaaaacccaaaaggaguggauucagagagcuucuggauagcugaacauuggaggcuccuggaagguggcgcaccaugggaaggcauggaagcuccaugcucuuuccccuaucucccccuaugcaucuguucaucuguauccuuugaacauccuuuauaauaaaccgguaaguguuucucugaguucugugagcugcucuagcacauuaauugaacccaaggacguaaggagugggggggucaugggaucccugauuuauagccaguguuaucagaagcacaggcaaaaucaaaauaaccuggggcuugcgauuagcacuggaagugggggaagucuuuugggaacugcccucaaccaguggugucugacacuaccuccagguacaccguauuggaaccggggggcacccaguugguaucugcugcagaacuaacugguugguugcuguggggggagaaacccccaagcaucuggucacagaagucuucuguguuaauuauuguuguguugagugagagaauuaaaaaauacuuuggcugugauuuuacccugcucacuaagacacaucaauauugagaagcagagagaguuugaagaaauauuuaagaggaccugguaauuaauaagauauagggaaugguaaagaagaaucuaagauauccacuaagguuccaacuugauuaacugaaaacaguuggcagaaacaaauuucagucuccugcaacucacagaacucaagaccagcguguucuuuccaacuuuaggauuauaugucgaggcuuuaguuucuauuccaggucagacuauaaagaagguuaccuccauuacacugaccugagccccaaaacugcaaacacuaagcaauaugccaccagaauuuggggaggggagcaaaaauaggaaaaccauggaaauggguggcgaaaggauccacagccugagauaugcacacuaauuuuucaugguucccaacaaaguuuugucucucccauaaaggagacugacuggguacagcugaggaccacaucuaauucccaaaggugugucagucaacucucuguuaagcuaaaaagaaaaguggauauaaacugggugaaagaagaaaaagauugucaaugucagcaacuagagagauggaacaaaagucucaagagcaacgauggcagagaggugaaaaucugagcuagccauuuguauguaaggagcauuuucauauaaauauuguaaaaacugugcuaaguacuagucacagauugaaacgugaaaagaggccaggugcaguggcucacaccuguaauuccagcacuuugggaggccgaagugggcagaucaccugggucaggaguucaagaccagccuggccaacauggggaaaccccgucucuaauaaaagcacaaaaauuagccgggcaugguggcgggcaccuguaaucccagcuacucaggaggcugaggcagaagaauagcuugaacccaggaggcagagacugaggauagcugagaucgcgccacugcacuccagccugggcaacaagagcaagacugagccucaaacaaaagaaaaaaaaaugugaaaaggaauuucaacauaacuuauucauuuacuaacauuuauagaauagcuaacaauguaccagaaauuauaauaaauaugaacacaguuuuuauuguauuaaugccauuauauuuguauaggcccuacagcuuucaguagacuucagcauaaauuacauuauacauuuuccucaagagggaugcuguaauagcuuucuaaaaauuaguauguauuccagcccagugcaguggcucaugccuguaaucccaacacuuugggaugccgaggugggcagaucacaugaggucaggaguuugagaccagucuggccaacagggugaaacccugucccuacuaaaaauacaaaaauuggcucggcacgguggcucaugccuguaaucccagcacuuuggguggccgaggcgggucgaucaccucaggucaggaguucaagaccagccuggccaacaugguaaaaccuugucucugcuaaaaagacaaaaauuagccaggagugguggcgcgugccuguaaucccagcuacuccagaggcugaggcaugagaaucgcuugaacccaggaggcagagguugcagugagcagagauugcaccacuacacuccagcugggguaacagaacaagagucuaucucaaaaaaaaagucacuacuauaccauaggaauuaguguggucuacugauuacauuagcacugggcaagguucaguuuaaaucaaguucucagaguacccaaaguaaaaucaacauaucuaauccuugcuauacugaccuaauuuuaaacugauuuuauaggauuacuuuucuuucuuccaauacagugauucaucuucugcauuuaaggucgauauuagagauaucuaaaaggaucuaugaugaauggauaaagaaaauguaauauauauacagaauggaauaccauacagccuuuaaaaggaagaaaauuaugucauuuucaaaaacguagauuaacccggaggacauaaugcuaagugaaauaaauaagacacaaaaaaacaaauacugcaugaucucacauauguguaaaaucuaaaaaaaaaagucaaacucagggaggcagagagcagaaugguggucuacaaaggcuagggagaagggggaaaaaggaaaggagagagguuagucaaagaauaccaaguuucaguuagaggaguaaguuuuagagaucuauugcaugccacggugacuauaauuaauaauaauguacuauauaccucaaaauugcuaaaaguuaauuuuaaacguucucaccacaaacaaauggcaaguaggugauaugauggacguguuaauuugcuugauuuaaccuuucuacaaaauauacauuuaucaaaacaucacauugaaccccauaaauauacacaaugauuaucugucaauuaaaaauaaauaaaaacagacaaaaaaacccaaauuccucaggggcagcggguauaaaugcuagaggcuuucaagaggacaacggaauaaacacacauacaaauauaacacucagauuauaacaaggaagaaagauaaaacaauaaaccaauaaaaaguugcuguggaagacagaaacuuugaaaacuaaauagucuucaugauuuuaaaagacagaaacuguucgauuauuucucacaagaaauagcaagaaauauauuuauuuaacuugguuccagucaaaguugcagaucaaaucucucuggauuucaacaaugaaagugaggcagugggguucaaucuccauauuaaacuucacugaagauuuaucuuuaagaaccaaaaugaaucacagcuacaauguuuauguacagaugugaaugugcauauuuaaaaaauuaaaauguuuauuagaguaguaagauuaugaguauuccuuuuaaaaacacuguuucccagacucucuguaauuuuacauugcuuuuauaauugaaccuacaagccacgucccuccuuguuuuucucuagcauuuugacuauucuaaacuacacuauggugcagcagagagcaggaacucugaaaucauacucccaggcuucagucucaguucugacaguuacuguagggcaaguuaguuaaauuuucugugccucaguuucuacgaauguaaaacgggauuagugaaaguaccuacuucgugggguuagugugaaaauugagauaauucacaaaaauuacuuggaaaagagccugaaaacacagaaugcauucaacaaauauuaacacuuauuauaaaauauuauacauuuuagaucacugcugacaaguuugacuaccaaacuaaguuggaaguucuacaaaacagcgauaguggccaaaccccacaggauacugcuuugauauaagacccaccacagagaucaaaucuggcuuccugagccgucugaaaauuaugaccaacaugucacaacaggaaauggaaagccuaccacuaacaugaccuggaaaauagccaauuuacuaacacaaacccacaacaucaacaaaucuguuccccugaaccacaucuauccaaaaguaguuuaaauauuuacauucuuaaugagcuauguaugacugauaacacauacugaaguacaauuuccaaguaaaaauguagguacuauacauucauauugacuucuuaaaauaaugugacucaucauucaaguaaagcagcaaaguuuucgaggugcugaggggaguaaggggugggaaggguaugcaaucugugaugaauucugccaacaguggcugucuguauuaaccagaggccauauacgcauauucaaguugagaaaauaucuguaggucacacacaugguuuuuaaagccauauuauagaacaagacacugaauagcagcagcaccuuuuaagaugaaagucaacaauuuauacacaagcacuuuaacucccauauguacuccugaacugaacaaauauuauuuuguagugacucacaaagggacgcaguuauuuccauaccgaccucauaaaaaaaaaucuucuaaauuaacucuuuaaagaugaaaguaaaagcauuucuggaaagauucaacaauuauacaagccacaaugaugcugcaguaacugaacugcauagcuccaaaaguuuacguuuguagaacugaacuuuugaauuauauaucuguguaaaagguauggucgcuguugauucaauuccaugaacaggaauuucuuucuaaaggaaacagaaaucucaguuucuaauaugcacaaugcauauguaauuaucuucuauaugcuccgcaguuuuaaaaugccauacaaacaaagcauaccacaugcaaagucaauuucugagauucuaaggcaguuucuggucaaguuuaagaucaaaccacaaauauauauacacaaaaaauauuuuacauacauauauaucuaaagauagaaaaacugaauauuauuuuuaaauuggggaaaauuuagcgaaaguaaaacccacuccucuaaguuuaaaguuaaucuucuccuggaacccacuuccauuuuauucagagguccuucgacgguuccugaagcagaugugugaaauuuuaaagaaugucugaggguauauaccuaaucaggauggguuagcaucccaauucacgauguaccuuucaacauuauguagguacauuguaagagaaaccaagaugagcgcuguggccucacaguugacccaaaaucugugaacaggagagcugacaacucuucgcucauacaaugcaacucaccucgcagcucagagacauagcaaaaucgguggcuguuuuuugcgcugccuuuggauucugcaucuguuucaaaccuagaaccuagcuacccucggagcuccaccgaagaaagccugacacagcgaaaacuaucgcgauuuaaaagauaccugacguuuucuaccgcagagguuacgaaaauuuugcccggugggacuuuuauuguccuccuucaaacacgggagcaacaugaaguuaaauccucucgcucuggagaucccuagagucaaccugcuucugcccaaaauuaaaaauaaaaaucuccaaucucacuucccccuuaagacuaaaacugaauccaugcucuaacucgggaguaaaguaggauggcuuucaacccaccacacccuccuugcucauuauuccgggucacgggcgaacuagaacacugggaaaggggcugcagguuccggaccggaccggcccugacccacggaaggggaagagaagcggcaggagucaggagcccgaaagguacgccccagcgucgacgcgugacgucacuacguugacgug

SEQ ID NO: 15622 - RNA, 2482 nt, Homo sapiens
uucuccucaccuuuugaaggauaauuucacagggcacagaauucuagguuugugguguuuuuuuccauccacgcuaaguauuucauuccacuuucuacuugccugcaugguuucugagaagucacauauaauucuuaucuuugcuccuuuauaggcaaaguuuuuucucucuggcuucuuuuaggauauuuuuucuuuaccucugauuuucuagucuaaaaaugauaugccuagguagaguuuucuuuuggaauuuaucuuguuuuguguucccugagcuuuuucaaucuaugguuuggugacugaagacaauuugggggaaauucucaaucauugcuauucaaauauuucuucuguuccuuucucucauucuuuuccuucugguguuuccauuuguguaugucccacucuuuucggauauucuguucugguuuuuuguuuuuuuuuucagucuucuuuuucuguuugcucuuuagucugggagguuucuacugagguaucuucaaguuuacagauucuuuuucggcugugugcagucugcuaauaagccaucagacacauucuucauucugauuacacugcuuuugagcucuagcauuuauuuuugguucuuucuugggauuuccaucccucugcuuacauugcccaucuguucuugcaugcugucuacuuuauccauuacagcccuaagcauguuaauaauaguuguuuuaaauuuccagccuaauaauuccaccaucccugacauauuuuaggcugguucucaggcuuucucugucucuucaaacuacauuuuugccuuucaauaugucuuguaauuuuuucuugauagcuggacaugaggcacugguuaaaaggaacugcugucgauuagccuuuaguaauguggugguaugguguugggguggggaaguguucuauaauuucacaauuagguaucuguucuuuaggcagccugugccucuggacugugaacuucacagaugugucucaguucccacccugcacagguggacugaauggcuagaguggguuggaguugggcauuuauuuucccugggucaguuagggucugaugaaaccccagcagguuaggcucugguuaaauaguuucuccugagggcaggcauuguuaagaacacaguuuucuggcguauuucaaaaugguuccuuuucuccuccccaugccagaaggagaggauucgucuccaauauucacugcgaggaacuguuugagcuccuggagggggacucaguccccuggaauauuuauuaauaucucucaaacuuguccacacugagccuccagcaauucaucaguugcaauucagguuucccuuccccaacacagguuccugagagguuucagcuuguggguuuccgcucaguugcuccauuaugggggcagcgguuugcccugugacuucacuucucuuauggaucuaagaauagaauuguugauuuuucaguuuguucugcauuuuauuuguggugggaaacaguagcaacuucuuauaagcuagacuggaaccacaagccuauuuuuuaguuugguuuucuuuagguagaaugaauggaggcaggacaaaagugggaauccaaguuuugaaaugaguuauuuugagaccucaggugucugaauuugagcagaguguaucgcauucauuggccuuuuacauauauccuauaucguuauucagagauugguuugauuucaacuuggcccuggggauaugaaccuaaauacgguacauuuugagugggaucccugaugugaucggcccugaaugauccuaucacaucucaaauaaaaguugacuggaaggacucagauugccucucuuugaucccauccuuagguucuuccguucccucccgugcgcuguuucgucugcggcccccucccuucuggaguucugugcgugugcuccgguugaccuggcuccucuccaggccugcugcaccgcucauacucgggaacggccccgcacugugcucccugccgggauugacuuuuucuuagugcucacauuuucuucuuucuuguuuuacucucuuguuugcuugaggacaucuucacauuaccuauucauaaaaauacucgagaaagaggauuucugaggguuuucaggucuggaaauauuuuugcccgucuuccuacuuaaaugauagguuagcuggcucuaagaaucauuuuccucacauauucuaccacagcuaccuaacgugcaccucugugucuccuuuuccucucccagcuccauguaacuguaacuccuucucaaauggagccuaggaggcagaaggaagggcaugcaggguuuuaggugcuguggggauucaauacagagagggccuguacuggaccugggccggagcauccuucaggccagagagagcuuggggccugagagguaccuugaggcaagggucagagcucugagguuacugaagagagcuuggcccaugggauccauagaca

SEQ ID NO: 15623 - RNA, 20119 nt, Homo sapiens
uccgagauggacaaagugugugcuguuuuuggaggcucccgaggcauuggcagagcuguggcccaguuaauggcccggaaaggcuaccgacuggcggucauugccagaaaccuggaaggggccaaagccgccgccggugaccucggcgguagguaccaaacuggaguuguccaguuguauggccgcgguccaggcgccuaaagaaaaucuccuuuguaaaaagagcgggucuggccuuuagggcucuaggguuacucgauguagccgcgugcaggcgcucucccguuccaaggguagaaugcgucucgugcagaaacccgcgaucucccuaugccucgcagaaugccggccacgcagcuugccgccgagggcugaacacuugggguguucuuugagaccucguagucuuuugaggccccgcuauacgcacccuccgcccugcggcuagugcuaacgcugaggagcuucccuguugugggagagagccacguaacaguuuacuuuuaauguagggaaaagggcgaguucucggcccccggagacagggcugggucgaaaggaguucaggcaggaaaggugggagugcagguaccaacggcucccuucaguuuugcccaagggccgugccuuggcccugcgcgaaugcacaaagcaguguuugauagagaaacccuuuugaguaccagccaguuuugagauauaccugguuugcuuuaauguuauuaaauuguuuuggugaguuuugcaaauggacaauugaacuuuguucugccaaauucuuuuuuauugcauuuaaacuucaggguuuuuuauuuccggcuuauuaugaauggauuagucauuuugugaauauaacucuucauugaguuuagggagaaauaggacguuagauccgaagaugcuauuuguuuaaucaccagaauggacaaaauuauacuucauuuacuaucagggaggcauggggagaauagaggccuaggggugcgucuuguggcucuuacuguuuuuguguaucugguuuuuuuuuuuuuuuuuugagagggcuucccauuauguugcccgugcuggaccccaacuccugauuuacuggcucuagagaucuucucgccucagucucccaaggaccugggacuauagacgccagguguggcuguucauuuuuaaguuaacauuauugaucgguuugguaucaccuguucagugcugguugggagacuauugggcucucuaaaagaaaaaagauucuguaaguuauaggucagggagagugucagugaaugcuucuugaagcucauauuccuuaccauucuaacaaaggaggggaagaguggugacccuuacugugucaccccaagccaucaguguuugcuggacuggauugaagccauuaguugggcuuucaaaggugguuguggacacaagucuucgggugaaaaccaagaguaagagagacacaggaugcuuuugggcccugcauuccuuugaaucguguuccaugagugauugguuuucaucuagaaaguauaauuccccgggucgcuuacuguuuccaaaggcuugaugggguaguguugguguaagcauauuuaucaaggucagacagaaaauaaagaauuguuuuagcuuuuaaaaacaauccuacauuuuagaguauuaaaaugguagauuacauagggaaugcuuuguuuuccuuugaaguguaguuuuuuuuuggcauuuaaccauuuuuuaaaagugguaaguaacaguugcuuuuaguaaaaaguguuuuuuuccccccgugguuuguaguuuuagcauuuuuauagcuuccuguguugucucaucucuccugauggucagguuugaauaauagucguuauaauauaugugccauagugcauccguagcacuuaaaaagaagaaacccaagaguucccguucagggccaaagaaacuaauucaacaaaaaccugacagaauuagacauaaauuucaaaaaaggaauauaaaacccagaagacugucgaauuggguagcaugaauucaguguuaaagcuauaaauauuagaugaaucuuacagagccuuuauaacuugaaaaagcccuccccccuuuguugauuaaaaagaaaauuuuaaaauuaacuuucuguaguaguacuuuauuuccucuuuguucccgcaucccaguuucauuagaccaacucuaugaaagccaggccucaugacauuacuuuuuuaaucuuuagguucuagauuagcacaggccugccaucuuagauagaugcuuaacaaauguguauugaguaaauuuaaaauuugaguuauaaguaauucuuauuuaacuuuguuguguaggagaucauuuggcauuuagcugugauguugcuaaagaacaugauguucaaaauacauuugaagagcuggagaaacauuuaggucgaguaaauuucuugguaaaugcagcugguauuaacagguuggucacagauuuaaauaaguuucuuauauauauauuuaaaacuuuuauuccuaauaugucuuugauugguauaaguuaauauguuuauuuugcuucuaacugggagaaaaaacuauuuuaaaacuugucaauccauaaauuauuuuccuuuauauugagauacaacauauaauaaauguccaguugagucgauuuuaacauuguaaucaucacccauauugagccguagaauguuuccagugcuccagaagguagugucuucucaauacuuccuuguugguaacuguuuucugaguuuugucaccacagauaaguuuugccaguuugugaacuuaauacuaauagaaucauggaguggauauuauuuuuuaaaagaugaauuuaggagagaauauuuagauaacauauuaauuuucuugcuaaacaaggcuuaguauggcaguugcucaggccauucaaacuauuuuggcuauauguuacuacuuuuuagggguuaagaauauuugccacucaagcugagaagggguagcaaccugucuuccaaguggauccuuucugguuuaucaauuguuauuuuaauguuucucaagccaaguucaaaaugggacucuagguauucuagcuauucuagcucagauaggaagcacuucuugcacucucaguaaaaauguuacauuagucuugaccuuuuugguuuuuaucuuguuauuauaugcuauuauaugcuguuucuuuuuguagggauggucuuuuaguaagaacaaaaacugaagauaugguaucucagcuucauacuaaccucuuggguuccaugcugaccuguaaagcugccaugaggacuaugauucaacaacagggagggucuauuguuaauguaggugagucuucaccuuugugaauuuaugauuaucccauaauaccauaccauaaaaauauuuaauccacgaauuugugauuuauugugaaacaugaaugaaauuuauauuaucuguggaaaaaaggauuuaauuaauugauuaaugaguaaaauaagaaucacacauucacaucccuauaggagucaggcagguguuaaaugagugacaccacugaguacuagaaaaaugacaguaccagccaugugauaaaugauauccagcuucauuguccagagcccauauggaaugguggaggccaccacuuagauucaguagauuguugccgugcaagaauguggucccaguuuugccagcaauuuugauuuuucaagagaaauuggaucauucugauuuuuaugugaauuuuuuuuuuuuuaaauagagacgaggucacacuauguggccuaggcuggucuuuaacucaugggcucaagugauccucccgaagugcugggauuauagaggugagccacgugcccagccaggaaccugauuuuuaaaacauggacaaggaauuaaaguagacagugguggcuaaauaauauugucuacagcaguuucauggguuacuguuaaaucuuguguagagguuuaaaggaagauaaaauuucucuguuuuuaagaauggauguaaguaaccccuaguuuucaguucaucuaacccacagggcagauaagcuguggaguauaugccuguagaacuuaaaaugcaaaaugacuugaaauuuuauuucaguuugguaauuuggaaauaauaguauaccaucugcuuuuuauuuucaaaugguaauaccuuaaaaggccacagaagggagaugcugcuccauaaaaguaagugacccuguucuuuuaaauguaggaaaugguuuuucaagccagaauuuagaguuuuucuguuuugaaagugagaaaaggaaagaauacuaugcuaauaaacuaaggggacaugagagcauuuuggacauuuacucuuaaaaauuuaagggauccguuuucuuauguaagagauuagucaaugagucaaccuuugccuuuuaacacagccagauaaggacuuuggauacuuacaagcaggcaaacaggccuguaucugucaccugauaaccugagguauauuuguuuaacucuaaaaucuucuuuuuuuuagguguauuuaaaaaacccauuaguccuccuuaugcaugcaaaacuuuuagaauugagcuaaaaguaaauaauagauaguaaauugagaaucuuacuacaggaaggacuacuuuaaacugccagacacuucauugguauuucagaaauuaccacuuuuugaccugaugaacaguagugcguggcacgaaucaaagcugcuaaagcagcuuguguuuuuuuuucuuuuaaaagccacucauauuuagcaguuggggguuguauacuaacuuuagugacacuacuguuaauagguucugauaacccgcuaccaucggaccagcccuguuuugguauuuuuuucgugcauguauuuuucuuuuuuugugucucuguauuuuucuuucugauaaacaccccucuauccauaugcauuucuucagucugaugucuguucucucuguguacuucacaguucucuuccuuuguuauuaauuggccuacaauauauaauguagauaaauauucuaauacugaacuuguugauucuaauagagaaauguuuggaauguuuucuuuuuuuaaaauuacuuuaaaaaaauuuugugagguccuugauuaauuuuuguaucauaaguacaggucaguggugcagaaaauuacuuccccacuucuguuuugcaagaguuuauuugcauauaguugauauuugaauuaaaaauuauuauuacauauucauuagauguggucacucaagaaucuucaguaggcaguacaguuuacaauauaucacugaauguaaugaaauugcacuuuuacaaaaaguguauaauugaagcuuugccaauuuagauugacaguacaagcaugucucgcagauauuguagcuuugguucugcuccaccggaauaaagcgaauaugucaagaauguaagucacacaaauugaauugcugcaaucucaugauaaaacaaaugggugaggaguugcuucuuauguauggauaaacaaaguuguuucucaagauggaaucuacuugugaagaugugaauacuguugaaaugacaaaggauuuagaauauccuauaaacuuaguugauaaagcaauagcagggauugagaggagaggcuccaauuuuuaaaguucuacuuggauaaaaugcuaucaaagagcaucacaugcugcagagaaaucuuucaugaaaugaagagucaaucaauguggcaaauuuugucuuauccaauuguuuaguuucucagugcauguaaaaguuauauuauggucuauuaaguaugcaguagcauuauaucuaaaaaaaauguaaauacuuuguugcuaaaaaaauacuuuauugcuaaaaaaugcuaaugaucaucugagcuucuggcaagucauaaucuuugcuggcggagggucuugccuugauguuuauggcugcugacugauaauaguggcuguggcaauuucuuuauuuuuuuuauuuuuuuauuuuauuauuguuauacuuuaaguuuuaggguaccgugcacaaugugcagguuaguuacauauguauacaugugccaugcuggugugcugcacccacuaacucgucaucuagcguuagguauaucucccaaugcuaucccuccccgcuucccccaccccacaacaguccccagagcgugauguuccccuuccuguguccauguguucucauuguucaguucccaccuaugagugagaacaugcgguguuugguuuuuuguccuugcgauaguuuacugagaaugauuuccaauuucauucaugucccuacaaaggacaugaacucaucauuuuuuauggcugcuuaguauuccaugguguauaugugccacauuuucuuaauccagucugucauuguugcacauuugauuugguuccaagucuuagaauaagacaaaauuugccacauugauugacucuucauuucgugagagauuucucugcagcaugugaugcuguuugauagcauuuuaugcaaguagaucuuuaaaaauuggagccacuccucucaaucccugcuauugcuuuaucaacuaaguuuauaggauauucuaaauccuuugucauuucuuucaacaguauucacaucuucacaaggaagagauuccaucuugagaaacaacuuuguuuauccauacauaagaagcaacuccucacccauuuguuuuaucauaagauugcagcaauucagucacaucuucaggcuccacuuguaauucugcuccacugaagucuugaaccccacaaagucauccaugaggguuaaaauaacuucuuucaaacuucuguuaauguugguauuuugaccugccaugaaucacaaauguucugaauggcauauagaacggugaauccuuuccagaaggcuuuuaauuuacuuugcccagauuccuaagaggaauuacuauuuaugacugcuauagacuuauaaaauguuucuuaaauaagacuugaaagucagaauuaucccuugauccaugagcugaagaaaggauauuguguuaacaggcacgaaaacaacauuaaucuccuuguacauauccaucagagcucuuuggugaccagaugcauugucagugagcaguaauauuuuguuuguggcaccccaacagcaguaaacaucaagaaucacugaucacagaucauuauaacagauguaauaauaaugaaaaaauuuaagaugguaugaaaauuaccaaaaugugacaaagagacacagagugagcacugcucacagugagccaugguguuggaaaagugcuaauagaauugcuuguugcaagguugcuacaagccuucaauuuguuaaaaaaaaaaaaaaaaaaugcaauaucugcaaagcacaauaaagcagaacaauaaaaugaguuaugcauguaauucaauuuuagugagauuuagcuucaaaugaacuaguuuuuagggugaaaacgagagcuuucugccuuaugucuguguuguagaaucauaaaauuagucagcuuuugucugacuuuuucuggcuuuaaccucuaccugcuggaagccuuuauaaauaccacagaauuuucaucauaucugaccuacucagagauuagagugcauccccuucacguagugaaucaauucgcaagcaccugcauuggcaguuuuguaucagcugcuuucagaugcuauuuucuguauguaucuggagcagacuuggacucuuaaaucuuccguaaaugacugaugacaaugguuagaauuucuaauuuuaacaaaggacaaggugaaguggguuuuaccuuuuuguuuacuauaaauuaucuaaauuuucaaguaaccccauuaauugaauuuaauacgcuuuuuuuuuuuuuuuuuuuuuuuuuguccuaggaagcauuguuggcuuaaaaggcaacucuggccaguccguuuacagugccaguaaaggaggauuaguuggauuuucacgugcucuugcuaaagagguagcaagaaagaaaauuagagugaauguaguugcaccagguuagugaaaacuuuauuaaaauaacuugauuaugauuauuguuuuauagggaagccauuauuuggaacauuaguaauugacaucuggguagaauaguuuguaaaaugauugugaaaagaaucaaauaaugaacugggggacucaaaaaaauuuuuuguaccucauauucuauauaaagucuauguguuagccuguuugcauugcucuaaaggacugucugagguaauucauaaaaaaaagaggcuuauuuggcucucgggccugcaggcuguacaagcaugacaccaacaucugcucagcuucuggugaggcccaggaaacuuuuuuucagucauggcggaagguaaagagguagcagccaagucauauggggauagcaggagcaagagagagaggagguggcaggcucuaaacaaccagcucuggcaugaacuaacagugagaacucauuauuuaccauguggagggcaccaagcuauucaugaggaauccgccuccaugacccaaacaccucccgcuaggcccaccuccaacauugggaaucacauuucaacaugagauuuggaggggacagacauccaaaccauaagagucuuuauuuuuaaauuuugcacuaguggaauaacuuaagguggagagggucuuagaaauaauuuuuuccagucauuuuuguagauuagaaaacuguaccugggauucagagugacuugccuaagguuacacagcuaguuuauggaagaacuguuacuaaaagcuuugucuuuugauuuccaccuaaugggagcuuaaaaauaauguccuaccagguaugguagcucaugugggaggcugaggcaggaguauugugaggccaggaguuccagaucagccugagcaacauagcaagaugcugucuguaccgaaaaaaaaaaaaaaaaauuagcugggugugguggugcacaccuauagucccagcuauuugggaggcugaagcaggaggauugcuggaguccaggaguuggagguugcagugagcuaugaucaugccauuguacuccagccuaggugacagagcgagacccuguugagacccugucucuauaaaaauuaaaaaaaaaauucuuuuuagauuuucuuuauaucauuacacaaacuuuagauaguuuuguccuuuuacuacuauggucugucuaaacuaucuggaaccucccauuuuccuaauuuuuacuuuuccauuauuugccuuucgccaggguacuaguugauaaaauugccuggauuaaugaagaggguaauaaaaaggugcuaaaacucaaaaauauaugaucacuaauuagcuggugugcuagaaauuuugauuagguauuuacuugguuuuugaguaacacaaguguuuuuaucuaccucugccaguuagccauggaaucuuuguccuagccuacuguagguacuuaagaauuaaucaccuauauaagaaaaggcaguuuauuuugguuugcugguccuuuguaagaaagagagggcugaaguagaccuuugcuaccuuucccuuuccggucacuaauggcuccagcuuggaccuuacaguugguguuuucuuuggcacugaaguugagccagcagguaucagggauuuaucaaaauauccuauuaacccuuuuggucuauagugugucuuuauuucaauucuuuucuuuucuuuuuuuuuuuucucauagcaacuagcuacauucagacauucuaaaucuaugaauauuugauaagugacugugguucagauacaucuauuugcugggaguagggagagaaagaaaaagaaaaaacaauccagaagcagcauuguuguuaucuuagcacuguuuucucuuuguguaugcuuuaugcaagcugauugauuuuuagcguuagccuagaugaacuaucuguggaauaaauuauuugugguuuggaacuacauguauuugcuuccuucucuuuucaggauuggaauacuguggguaaugaaggguuaauuuuaguucaugauaauacaaaagcugaaugguuucggggaauggaaguguacuuagcuaacaauaacucaugcagcaaacuuucuggcaugucuccuacguguagggacugagcuagcuccccaaauuacaggaaugaauaagauauuucugcacaaggagcuaaguauagugaaaaagacugacauguaaacaaauaauugcagugucauaugacgaauauaaaauagagguacauauauggugcuauagaaauguugaagaaggaaagaaugcuuaauuuugucuaguuuagaguaaauaguugucaaggcaguagacuaaauagugggaauccaguuugcauacuaaggggaaguuuuaagauuguuauggaagugugguuguagucuuucuuucuuaaagauuuuacuuuccagugcaguuuuuuuuuuuuuuuuuugaaaguggugguuuuauuuaucacuccccuuuuuuguugagcauacaacccuuauagagcauaauauauauuuauauauuauggauuuccagugcaauuuauacuacagauaaaaaccuguagcugaaaauguggccauuuaauagaguggccuuuauguauauuuagcagauuugaugguaugaauaugcaucauuugucagaagcaaagugcaacuugaaauaguagaauuaaaucaguucuguggauuacuuaccaacuuuauuuuagauaguaauuucaaccagauucuucaacagaucuuguaacacagcuaacaaacaucacaguuaacaaauauguguccuuuuaugucaguuuuccuggucaccuucaaauggaguuuccaauuagcaggaaaacaguuuaaaagcaaauuauaacaggaaaagcaaggaacaaggaaaauaauaaauuaggcugcgauucauugccuaauacuguugacuuuuuaaagaucaauagcugcuaaucuuugguauuacuuuaaauauaaaauaaacuguucaugggaaaucauacugauuggaagauauugaauauuagaaauaauauuugauaaauggaaacuguaauggcuguauuaccuuaaaaaauauguguuuugaauagauaauacauauaguacgaaauucaaaaguacaaaaaggcauaaagagucuuuucuccucuggacauucaguuacuuaaaaguaguugcuguuaacuacaaaguuucuuuuguauuucauauauaagccaauaaagcaugcugggcaugaguguaagaaaacacaaauuguaucaugcaauucacagcuuucuguaucuuccuuuauucauagaacaagauaccuuggugauguuucuguguuauuccauauagagcugcuucacuuuuuuaaauaacagcuuuguggaaauacaauucacauaccauacaauucacccauuuaaaguuuacaauucagucaauucagugguuuuaguauagucccagaauuguucaaucuucaccacaguaaauuuuagaacguuuucaucauccuuaaagaaauccuaaacccauuaacauucauucccuauuucuuuccaaucuccccaguacacuaaacuacuuucuguaucuacagauuugcauauucuggacauuucauauaaauugaaucauguaauauuugguguuuugugacuguuaugucacuuuuaaugacugaaugaaaacagaaaaugauguuuguuuuaaagguauaccuaauuuauuuaaccuguugccuuuugauggacauuuaguuuuguucugaacuuuuucuguuacaacuaaugaugcagugacaauacuuguauggaguuuauuuugcacauuugcaaguauaugaguguaaucuugggacuggaacugcaaaggcuucagagguaugugcauuuuuaauuuugacaaauaguauuauguuuauuucuacaggauaccuuaaguguuucaguacuuuauuuuuuaaguugaagagcuuuuauguuuacuacuuggagaaaaucuuguugacaaagauuugcaugaguuuguuagcuacucagagaagauauucuaaguguucuuaugugcuguuuggaaugaaguugauuucccacucugcuucccucuacaaauauaauauuaagacauagaaauuuguucuaguuaaaaucuugguuuagcuuuuugguaagagccuuauuucuucucccuuagaaaaguguuggguuguuuuuguucuuuuugaguccuagaaacuuacaucaaagaguggacaucuuaucuggcagauacaucaaauagugccccaucucacaauuguuaguacuagugauaggcuaaaauccugaugccuuuuuaaauauaaaggcucugcuguauauaaaaauguugaaaacuaaaauaaugaccuagggauauggaaaugagguguuucuauuuauaguuuauagcuagucagaaaucgauaaaggauauaaucuuuuuaaaaaaauuguuuaaaaauuuuuuugagaugggguuucauucuguugccuagguuggaguauaguggugcagucuuggcucacugcagccuagaccuucuggguucaagcgauccuccugccucaguaguagcugggauuacaggcauaagccaccacaccuggccuauaucuuuagaguuuaucaaauauaaauccucauugggcaggagccaugcauuuaccuuuuugagcaagagugucccuguuccuaaagaguuccuauaaaaauugaacuggguuuuuaaucacauauauggaacuaaacuagaaguaucuuugcucuaaauugguuuaaugcuugucauuucaguuaucuuuucgucgaguuaagaagugauaacuuuguagccaauuggaaaccucugacuguccaggugaugcaguagcaucauuuguuggacaguggcaucuacugguagucuguaaauuuuauagccuaguuugaaaggcauuguuaauauauaccuagcaaaaaggggaguagagcacaauuuccagaauuuuauaaaugaagugaaagaaugauaugggggagaguccuuuggggccaaggagagagagcacagaccggaaaguaauacaaguaguaagaagggugugugaguuguuuaaggacuauuaaucucucucuucaggucugugauacaugauauggaaccuaagagaccauuuauaugucauguccuggguugugaauauauuuauaaaugaagaucacgugguucauaaccuuuaauauaaaaugacauggaaguuccauacagcccagaguaauuuaucauuagagacuagcuuuacauuuuuaauuuaauuucugauaaauuuuauuuaauuucugauaaaguggggacagauacaugaguuuuaaaaagcuacagacagauuauuagggcaguaaaacuauucugucugcuacuguaaugguggacacaugauauuaugcauuuguccaaaccuguagaacuguacagucuaaagagugaacccuuagcuugugaagacaaaaugguauuaauaaaugaauacauaaauauauaaaauaaagagugaacccuaauguaaacuauggacuuuacuuaauaauguaucaauauugguuuaucaguuguaauaaaugugccacacuaagguaagauguuaguaaugggaaauggaaaggggggggugaugugaaaagggggugcaugggaucuaucugaacguuguguucaauuuuucuguaaaccuaaaauuccucaaaaauguaaaguuuauaaauuuuuuaaaaagcuacagaaaaugaagagaggcucuuuggacauguucauguccuccauagaaaauaacauaaucaaagaggaaaaaccagcauuggugaauucaucccuuccuuucaacuuggccucucucacccacuuuacuuuuagugcagaguucagugauggcuagcagcuguccccugauauuuguuauuccaaguauccauucauaggucuggggagagauuguggcaagcuuucccuaaauaaaucacacccuuaucuucuaagcuugagcaguggagggagacuuuucauucgagguggguggcugaacaucaucauuccuguucuggacuucuuguaaucauguuggauucagagggcaccacucucucuuguacagaucugaccuaacauagacauagacuauagcagagaugaauccaggcuauaacauuuaacaagaccuuauuaaaagcuucaagauguuagccuuuaucuguuccauaucuagcuuacuugguuguuuuugggggaucacaugucuguccuccaaacuggaaacgucuaacucuccaggagaugcaguagcauuauuuguuggacaguggcaccuacugguaguuuguaauguuuauagccuagugugaaaggcauuguaaauguauaccuagcaaaaaggggaguagagcaaaauuuccagaguuuuacaaaugaaaugaaaggaugauaugggggagaguccuuuggggccaaggagagagagcacagacuagaaaguaauacaagcagaaagaaggaugucagcccaugucugugugguagaggucaucuuuccaucucacugggauugucccugaaagugucucacugcuuaggucuccuugccugucuaaggcuuggagaccuuccaguaucucaugccuuauucuagaucugcuuuuuuccccgaggugaaaaaaccuguucaaauggucacucacaacuuuuguggccuuacuuuuugucuccgaaaggacaaacauaucagaacuaacauccacccagaagaagggcugaucaguuccuuucaacacagcauggaugaaaacccagguuagcguuagugcuucuugaauuggaaguauucuaaccucuauguaccuaccaauguaagaacugagggcccuuuuaagggaacuuacauuccuaaaguucaagucaaguugucaugaagaguacuuaaugaggcauacuuuuaaucuuugaaucguaguguuguagggcuaaaagaaaccucaggccaggcugcaugguggcucacgccuguaaucccaguacuuugggagaccaaggcaggcugaucaccuaaggccaguaauuugagaccagcccaaccaaccuggugaaacccugucuccacuaaaaauacaaaauuagccugguguggugaugcaugcguguaauccuaacuacucgggaggcuaaggcagaagaauuguuugaacccgggaggcggagguuucagugagcugagaucaugccauuguacuccagccugggugacaggagccaaacuccgucucaaaaaaaaaaaaaaaaaaaaaaaaaauuagccaggcguggugguaggcgccuguugucccagcugcuggggaggcugaggcaggauaauugcuugaaccugggaggcagagguugcagugagccgugauugugccacugcacuccagcuugggugacagagccagacugucucaaaagaaaaaaagcaaaaaagaaaaaacagaaaagaaaccucagagaucugucauuuuccaccuauuacauucauuuuaugauacagaaauggucauucaguugcagauaguacaugacuguugggaucaggcccccaaaucuggccauaaacuggcccccaaacuggccauaaacaaaaucccugcagcaccgugaccuguuugugauggccaugacacccaugcugaaguuuguggguuuaccggaaugagggcaaggaacaccuggcccacccaggguggaaaaccgcuuaaaggcguuccugaaccacagacaauagcaugagcgaucugugccuuaagggcuugcuccugcugcugauaacuagccagacccaucccuuuauuucggcccaucccuuuguuucccguaaggaauacuuuuaguuaaucuaucaucuauagaaagaaugcuuaucacuggcuugcugucaguaaauaugugggugaaugucuguuugaggcucucagcucugaaggccgugagaccccugauuucccacuccacacuauauuucugugugugucuuuaauuccucuagugcugcuguguuaaggucuccgugaccgagcuggucuuagcacgugacuuuucucgggugauagcuuuaauaguaucagcagagcagggaacagaaucuaguuuaauguguccuaauccagugguuuuuuuuaaccacaaaauacugccuuugagaaaaggccaggccagcagagucagaaguugagccugggauuugcauagucacaaggucuuucuugcaaaccauuucuacuguaguuuauuguguuuuucuguuuuuguuuuuuggguuaaaaugcaucgauuuuuaugcugacaguuugugagaguuacugggaaguauucuaugcuaauuuugcuagaguuugaaaagaacuuaaaggauaauugugucuaucuuugagaagauaacaugaacuuuuacauguuuuugacaauuuuuauucauucugcuuuuauuacaagugugagaugagguuuucuuccuaggauacucucugaggcacuuuugaaaauacuuuuguuggcugggcacaguggcucacgccuguaauccuagcacuuugggaggcugagguggguggaucaccugaggucaggaguucaggaccauccuggccaaccuggugaaaccccgucucuacuaguaauacaaaaauuagcugggcaugguggcgugugccuguagucccagcuacuggggagccugaggcaggagagucgcuugaacccaggaggcggagguugcggugagccuagaucgcaccacugcauuccagccuggugacagagugagacucuugucucaaaaaaaaaaaaaaaaggaaaauacaugugucuaaagacagaaaacuuuggacagcgagaacccccaugauauuguucuuaagcugauuggauugccuguugauuauuguggcucuucacuguaaauuaaguuucauuuauaguuuguuggaaauucugcagaggcuaguaucaauaucuguguuagcugcuucuccuuuuauucuugcauuccuucuggccuucucauucuucuuaaagaugagaggauaugaaggaaauauugcugacuuuuaaaauaaaugugguaagauguuauggcagagaagacuguauuucacuguguaauuucacagugaaacauacauaauacaaaauuaguuuuguuauuccaggccuucauuacagacuaucugaagguaguacugugugcauuuuuucaacaacuuuuuaucugaauacaaaaauaauauauauaucuguuguagacaguuuggaaagagcagaaaaauauaaagaaaauaaaaaucauuaccuguaauucuaguaucuaaugauaaucacuguuaauauuuugguauauaguacuuuuuucagucauuaguauaaguucuuuguuguguuuuuaauagugguauaacuuaauucauuuguaaccuacauuuuauacacaaauguuacuuucagauuuaaguauccuucuauagcauaauuuuuauuuuuuauuuuuaucuuauucauuuauuuguauaaauacaaaugaaugcaggugcagaugcaguuugguuauaugcauagauuucauagugggaagucagggcuuuuaggguaucugucaccugaauaacacccauuguaccuauuagguaauuucuuauucaccucugucccacccucucacccuucugaaucuccauugugaucacauccauguguacacauucuuuagcucccaguuacaagugagaacauauagcauuauuuuuaauaccugcauuauucuguuguauggcuguaucauaacuuauuuaaccaguuucuuauugaaagacauucagcuuguuucaguuuuuuccuaaugaaagugucauucauaagcuucaugauagacaaaucugugaauauuuuucacaagacuuuuaagaaaaugcguagauauuuauaacugcaaaccuaaagaaaggaaaguuaaguaauuacauaguauugcauaauaaaccaauggccuaauguuaauucuuaauucauuguuuacuucacauuuauuaugguacuuuaaaagguaauauauuuagguuuaucuauaguuugagcuauaaaugauuuaguuuuaacaggcaauuugaaaacuguauuuuugagauugcacauuaaauguuuacuucacacgucauguugaaguuuuaguccaucuauuuuucaugaccuuaaaaauuuuuuucuauucuuuucaugaggauuaauauugcuuucuuuuuaaaaacccaaaugauugaguaauauacaggauacugauuauaugggcuaagcauuuuauuaauacguauuuguauguccuguauuaaucuuguaagauuuucuucauaagucuacaguucucccugguauguauuuguaguuauuuaggauugguugguuauauauuauguaguuaguucuuuauacuguagaaccuaauacauucuuuagaacauuuucuuggcaggcuuuacugaauuugaauuuucuauguuuacuuguaucagaauuggauaugaccguaagauuuuaaaauccagauaugggaaauacuggccuuucuaaucaucagcuaccaaaucaguucaugugaccacuuuugugaugccuuccuucccuugacacuacuuucuacuuuucuaucccuaccuaagugaaaauuaauguauucuaugauauuuuauauauacuucuaucaggauauucaccagacuucuuuacguuauaaucgggugugcaagugaccauuuccuccacaaaucauagguuccccaaagaguggaauuuuguuuuauucauguuugugucuaccuacuuauauuuugcuaggugggccagauacuugggggucagauauuuuaguguccaauaaauauucauugaguuaaauuguauaaaaauguaggcuuggugucuugauuacuaacaaaacuauuuuguuuuguuuugcuuuuuuugagauggaguuucacucuugucgcugaggcuggagugcagugacacaaucucggcucacuccaaccuccaccucccagguucaagcgauucuccugccucagccuccugaguagcugggauuacaggcguccaccaccacccccagcuaauuuuuuguauuuuuaguagagacgggguuucaccauguugggcaggcuggucucgaacuccugcccucaggugaucugcccaccucggccucccaaagugcugggauuacagucaugagccacugcaccuggccaacaaaacuauuuuauauaaacaagguuuauuaauaauuucaaauuauaggguggguaugguggcucaugccuguaaucccagcacuuugggaggcugaggugggccgaucccuugaguccagaaguuugagaucagccuggcccaacucuacaaaaaguacaaaaacuagccaggugugguggugcaugccuauagucccagcuacuugggaggcugaggcaagaggaucaccugugccccagagguccaggcugcagugagucguguuugcaccacugcauucuagcuugggugacagagugagacccugucucaaaaaaaaauuuuuuuuuaaauaauuucaaauuaaaauuuucagaaacaaauuuauuauuuuuuuugaaauucagcagaugucuuaguguguacccuuuucaacuaaacaaacauuucucuuuuaggauuuguacacacagauaugacgaaagacuugaaagaagaacauuuaaagaaaaauauuccucuugggagguuuggagaaacuauugagguggcacaugcgguuguguuucuuuuagaaucaccguauauuacagggcauguucugguaguggaugggggauuacaacucauuuuguaauuugcagauuauucaguuauaggggugauuagcaucaagggcacacuuuggcuacugauuagacaauuauaccuacauggguaacaugugcuaaucaaaccugcugaugcuacaaauguuaauuucugucuuuauaaaaauaugucucaaaagaacaaugugugacaaauugu

SEQ ID NO: 15624 - RNA, 3516 nt, Homo sapiens
uuuacugaccuccccagccaggcaggccaacccuuccgagcaggggaaauguccaucuagcugcccucugcuggguugcagccuaugccaugagaggguacuggaagcaggagggagcccuggcuagggcaggccuuaaacgcaagggaagcugagcagagaucugcacacucaaccccauuugauauucuucuccuccucagucauggccagcguguuggugacuagaccggugccaauaguccgguugccaucucgcagggugaaacgcuggccuuucucuaagaucauuggcugccgcaagauuagguugaacuucagguccuccccgggcauggcaagcuccuagaguaggaagagaaggaucaugcguggccuccagggugccuucauuccuuaagucuuuuuuggcuaccucggagguuaagagucaugggagaaugcagcaggggaaugguucugccuggggacagcuucauccaucccaggcugucaggcagaugcaaacagcauauugagacaggaaaacauaaaagagaccagugaugaguguuccuaagguauguucuugagaaaaaaaugucuaggaaguuguggguuaugcagguuucuuggucacagaacuucuuaagccuucauauauaaugaaacgcucaaaaagaagagaccuuuucuaggaaaucuuucuguggguacaugcuggcagagcuaaacuuuuaaccugcuucagcuuagggcacacuggaugaggacucccgccccuaaguccaugggccaugccccuucuguuggcuagcagcggcaagcagccccuuuccaccuaaggaaauaaagccacucggguugucacaguguaucuuuggaacuaugagugaagcaaagguaauauaaaaaguccccccuccacccuacauuccucccacccaccguaccuucucugggggcaggauaauccgacaggccaugucccaagucagggagaacaugacaggcaugaagugggacacaaagggcuuguggcggccaccuuccuccuugcugaggauguaaaccuggaggagagcaagcaaugacggugagcugggcuuggcuggaggcuggggagagcuuggcucaacccugcccaccgucaccuggagcccucaccugggccuccaccuucugguggggcuugauggaaccuggcuugaccaugaccaggccccgccgcaaguccucccgcuucaagccucggaccagggccccgagguuaucuccggccucggcccucuccaggcucuuguggaacaucucaaugccuaggacggaaagggaaaaggagcagggagaaggaaggcgaaugugagacagagggaaggcacaagggaucugccgggguaaggccacccuucagccaggcccugcucuccagacuggcuucccaaaccugucaccacagugcggauguucuugcuauguccuaggagcucacacucgucucccuucuuuaaaaugccacgcucuaguguaccugucaccacggugccacggccugggagggaauaagacaggauaucagggaccccgagcuaggcuucugcuagagagagugcgugggaacagacagaguccucaccagggacggaguacaccgccuccacaggcagcaggaaaggcuucuccaggucccgggcgggcacugggauguaaguguccacagcauccaguagcuucugcacagacuucaggccuaacucagggucccgacccuguugaggggaagugccaggacucugaaauccccauucuacuucccucgauuaucaagagccacuucccagacacaaagcagagcucugggugcccauccagccccacccucugcagcagcugcccugccugaccccgcguucaccucaagggcacagagagcagagccuacgaugacuggggucuccuccccuuuauagccaaacucggugagcagcucccggaucuccaguuccaccaguuccaccaucucagaguccuggacagcgucagccuuguucacauacaccaccacaugcuccaccccaaucuguagaugccagagagacagggacaauauacagaggggcccaacuccccacucuucccuuuugcauccuuacccaggcucugaguaccugucuggccaguaauaagugcucucgggucuggggcauggggccgucauuggcugcuaccaccaggaugcagccgucgaggggugcagugccugugaucauauucuggagaggagaaggaaaggaaacagccaaguucaacgagcucuucaguucacauccauauagccaaguguagcaguuagaaacucaggcccaccuuucucuaccaucuccucaccacccauucugcguggccaagaccacaaaccugccaucucauacccaaacacugaauaucuuaaucuccuccccacaagccuaacauuuauccugacaagaggcagcuucuggcccugucuccagugucccagcaacccucaccuuaacauaaucugcaugacccgggcagucugugugggcguaguggcgggcggcagugcuauacuccacaugagccgcauugauggugauaccccgagcucgcuccuccggggcauugucaaucuccucguacuucuugaacuuagccccaccucccucagcuagaacuaaaggaggaaaagaacacaccucucagcuaaaguuccagugcuagaggcagagcuuagaccacgccccugaacccucccaccuaaauacauaaccuccuccaaucucuaacucuuccagcagagagaacugugggucagaaagaaauguuagagggccuuaagggucugcccugugacuucuuuaggguacagccucugcuugcagagcauuccccacgacuuugugauccccaagccauugguggaucacaaaguucuuccuguucaggagaaauuugucucuugcaucucccaauccaccugucgcacaaauucgggcucuuggggccacaguaaacuccuccagcagacacucugcuggccuugccucccuggcuccaggucccaucaguagauagggcgcugcuggacgccccaaccccacucacucuucgugauggcugcagucagcguggucuucccgugguccacauggccgaugguacccacauucacauguggcuugucgcgcacguaagucuucuuggccuccacggccaggccgcggcacaagagaggcaaugccggggcuuucagcagccgcaacagacccugcagcaggaagguccggccggcggcgagaccugccgggaccgaagcuuggagucaggcagggaaggggucagaccgaacccagccaccuaccacucccccaaaguguuccugggccgccaucgcccucccugaccacucaccgcugaaguggggcgucgcgcgcagcaggguggcggccgccauuguggucauacucgcgccccgguaaccggggagccgggaccaggagcccgagcgcacag

SEQ ID NO: 15625 - RNA, 3516 nt, Homo sapiens
cugugcgcucgggcuccuggucccggcuccccgguuaccggggcgcgaguaugaccacaauggcggccgccacccugcugcgcgcgacgccccacuucagcggugaguggucagggagggcgauggcggcccaggaacacuuugggggagugguagguggcuggguucggucugaccccuucccugccugacuccaagcuucggucccggcaggucucgccgccggccggaccuuccugcugcagggucuguugcggcugcugaaagccccggcauugccucucuugugccgcggccuggccguggaggccaagaagacuuacgugcgcgacaagccacaugugaauguggguaccaucggccauguggaccacgggaagaccacgcugacugcagccaucacgaagagugagugggguuggggcguccagcagcgcccuaucuacugaugggaccuggagccagggaggcaaggccagcagagugucugcuggaggaguuuacuguggccccaagagcccgaauuugugcgacagguggauugggagaugcaagagacaaauuucuccugaacaggaagaacuuugugauccaccaauggcuuggggaucacaaagucguggggaaugcucugcaagcagaggcuguacccuaaagaagucacagggcagacccuuaaggcccucuaacauuucuuucugacccacaguucucucugcuggaagaguuagagauuggaggagguuauguauuuaggugggaggguucaggggcguggucuaagcucugccucuagcacuggaacuuuagcugagagguguguucuuuuccuccuuuaguucuagcugagggagguggggcuaaguucaagaaguacgaggagauugacaaugccccggaggagcgagcucgggguaucaccaucaaugcggcucauguggaguauagcacugccgcccgccacuacgcccacacagacugcccgggucaugcagauuauguuaaggugaggguugcugggacacuggagacagggccagaagcugccucuugucaggauaaauguuaggcuuguggggaggagauuaagauauucaguguuuggguaugagauggcagguuuguggucuuggccacgcagaauggguggugaggagaugguagagaaaggugggccugaguuucuaacugcuacacuuggcuauauggaugugaacugaagagcucguugaacuuggcuguuuccuuuccuucuccucuccagaauaugaucacaggcacugcaccccucgacggcugcauccuggugguagcagccaaugacggccccaugccccagacccgagagcacuuauuacuggccagacagguacucagagccuggguaaggaugcaaaagggaagaguggggaguugggccccucuguauauugucccugucucucuggcaucuacagauugggguggagcauguggugguguaugugaacaaggcugacgcuguccaggacucugagaugguggaacugguggaacuggagauccgggagcugcucaccgaguuuggcuauaaaggggaggagaccccagucaucguaggcucugcucucugugcccuugaggugaacgcggggucaggcagggcagcugcugcagaggguggggcuggaugggcacccagagcucugcuuugugucugggaaguggcucuugauaaucgagggaaguagaauggggauuucagaguccuggcacuuccccucaacagggucgggacccugaguuaggccugaagucugugcagaagcuacuggaugcuguggacacuuacaucccagugcccgcccgggaccuggagaagccuuuccugcugccuguggaggcgguguacuccgucccuggugaggacucugucuguucccacgcacucucucuagcagaagccuagcucggggucccugauauccugucuuauucccucccaggccguggcaccguggugacagguacacuagagcguggcauuuuaaagaagggagacgagugugagcuccuaggacauagcaagaacauccgcacuguggugacagguuugggaagccagucuggagagcagggccuggcugaaggguggccuuaccccggcagaucccuugugccuucccucugucucacauucgccuuccuucucccugcuccuuuucccuuuccguccuaggcauugagauguuccacaagagccuggagagggccgaggccggagauaaccucggggcccugguccgaggcuugaagcgggaggacuugcggcggggccuggucauggucaagccagguuccaucaagccccaccagaagguggaggcccaggugagggcuccaggugacggugggcaggguugagccaagcucuccccagccuccagccaagcccagcucaccgucauugcuugcucuccuccagguuuacauccucagcaaggaggaagguggccgccacaagcccuuugugucccacuucaugccugucauguucucccugacuugggacauggccugucggauuauccugcccccagagaagguacggugggugggaggaauguaggguggaggggggacuuuuuauauuaccuuugcuucacucauaguuccaaagauacacugugacaacccgaguggcuuuauuuccuuagguggaaaggggcugcuugccgcugcuagccaacagaaggggcauggcccauggacuuaggggcgggaguccucauccagugugcccuaagcugaagcagguuaaaaguuuagcucugccagcauguacccacagaaagauuuccuagaaaaggucucuucuuuuugagcguuucauuauauaugaaggcuuaagaaguucugugaccaagaaaccugcauaacccacaacuuccuagacauuuuuuucucaagaacauaccuuaggaacacucaucacuggucucuuuuauguuuuccugucucaauaugcuguuugcaucugccugacagccugggauggaugaagcuguccccaggcagaaccauuccccugcugcauucucccaugacucuuaaccuccgagguagccaaaaaagacuuaaggaaugaaggcacccuggaggccacgcaugauccuucucuuccuacucuaggagcuugccaugcccggggaggaccugaaguucaaccuaaucuugcggcagccaaugaucuuagagaaaggccagcguuucacccugcgagauggcaaccggacuauuggcaccggucuagucaccaacacgcuggccaugacugaggaggagaagaauaucaaaugggguugagugugcagaucucugcucagcuucccuugcguuuaaggccugcccuagccagggcucccuccugcuuccaguacccucucauggcauaggcugcaacccagcagagggcagcuagauggacauuuccccugcucggaaggguuggccugccuggcuggggaggucaguaaa

SEQ ID NO: 15626 - RNA, 35475 nt, Homo sapiens
gccuccagacaugcgcaguagccucccccgcgguggcggcggcggcggcgguggcugccguggcggcugagaguccagagccggacguuccggccgcuucgggcuggcggcuggagagcgcucgggucaugucugcccagggggacugcgaguuccuggugcagcgagcccgggaguuggugccgcaagaccugugggcagccaaggcguggcugaucacggcccgcagccucuacccggcagacuuuaacauccaggugaggucccggcugugcaugcggccgcucugcguggaggugcgcgcucccgucgcccgggcugcccuggcccagagcugcgccugccugggggcugccgccuccugcccggcccccugcuuucuccccucccacccccuccucucuccccucccauccuacaccuugcuccuacaccuuucacccgccuugcuccuacaccuuccaggagcccucuccccagcacuugagagacggccgaucccgcuugaggucgggugugcuuaggucccuggggcucagcgugccaucuggccuagacagcacaugaucgccacuagcaaaaggccauucgcuccuucauucaucauaauggcagcaguuuguucagggccugcgacuuuggaaauauuauccuacuuaauccugggagccugagauugcaggugaaccccagggucacacucuaagcccaauggcaagucugccauguauguggcgcugugucaccaggcggagcuucacucucaggcccucccuuccugcaggagggccaacgagcgaugcuggaugagcugggagccuucugggcaggggugagugaccagggugccugauguguguugcaguaugagauguacaccaucgagcggaaugcagagcggaccgccaccgccgggaggcugcuguacgacaugugagugggacgcuugacaucacuuuuacugcacugaaucucuccaugagguuuuguuucucucugcagaagugggaguugggggaagaucuucaaguucaucuauaucuucgauaccuaaagcaaaccuaguaaggaguccaggccugccauaaauugcugacauggcuuuugcagaagaguuuaauuauuauucuuauguuuuauccuuguuaaaacuucuguuucauaauuuauucuagaaauaauaugugcucauuacaaaaauucaaacacuacuuguuauagagaacaaaaagugaaagugcauccuaaacugaaccagaguuaaguuuuguaggcaguauaucuauacauguaugcauaauacauaaauaagguuuuggggggaagggguuacaaaagugagaagaccauacuaccuuugcccugcagcauguuuccuuuacucacucucauggaccccuucccauaucaguauguagagauccacuucauuccuuuucaugccuguguaguauuucguagacacucucuucuugguagacauuuaaauagauaguuuuaaauuauuugaaauuauauucagugugucaacaauuuuguagucauauuuugguguuuuucuguggaauagauucuaagacauuuucauagucaaaguuuaugcgcauuugaaaauuugauacgcuaugaaauuacucuccaaaaugugcgaucccagucuacauuaccaccaaugguguauaaagaguguguuuucccauacccuucccaacacuggauauuauuagucucuuuuuaguucuugucacugugauaggagaaaaugguaucuugcuauuuuaaaaaaaaauuuguacuacucauacuguuaauaagauucaguauuguuucaacuguucucuuuggcuguguguauucugugauuugccuuugccuauuuuuucuuucaaauaguuuguuuuauucuuguugacuuuuagaagcucuuucuauguuaugguuacuugucuuuucaccuauaaaacccacuaaagacuuaugugaguacucucauuuuuauaaaucaaguaauucuuauuuuuacauuuuuauuuugguuuguuuuggcacgucuaagcauucacuuggaauaaaggaaacuuuuucaccaaaugcuaacguuuuuucuuuuggauacuguauagacuuugacauuuuaauuuaauguauuuauuuuaaaaauagguuugugaauuucccagaccagccggugguguggagagaaaucagcauuauuacaucagcauuaaggaacgauucacaggacaaacaaacccaauuuuuaagaaguaagaauaaugguguauaaguuaccauuucgggaauaccaaaucauauauaguaauuucacacacaaaaaagucacaccugggguauugguaaccauauguauguuuuauucuuggcaaccaaagucuauaauaaugucacucgguuccuugacuugcuuagaacccuuuaagcuucuuuaaaggauauggauuuaucagugagacgaggaauuaauuguauauauuuuuaacagguuuuacaauaaccagauagcagcuauagauuaaccagcucuccacaaaacaggagagaagcuuuuaguaauuuagaagcuuucucuuuaaacuucuguauguugcuguagucaaucaaagauuucaaacucuagauaaaauagcaaguagaugcauaggucauuugaacuucaacaagcacaugcucucuaucucaaccugcaacaggcauucuugugaccauucacauacaucauuguuuuuugaauuugaucagucuugcaaauauuuuaccauuauucagcaaacauccugugccagauacuauuggcuccaaaaggcugccagguuguaggugaaacuuaacugcauugauuucacauguaguguuuacuguucuguacaugaaaaugccuuacucagcacuguugcugcagucuuuucuguccgcaagaaacuuuuaaaagugaaauauguuucguacagguuuauuugaaacucuuccuggucggguccagugugaaauguuacuaaaggucacggaacaaugcuucaacacguuagaacgaucagaaauguugcuucuacuuuugaggcgcuucccugaaacgguggugcagcauggggugagauuugauucuuccccuucuuuuaauauaaaauacaaugggucaucaacagauucaucgguauggugaggagcuacaaagcagaaguuucugaagaguacugguuaagauugaacugaaauagaagguucuuuguuaguaaagcuaaaaggacauucuuuucaccauauuuuguaaguuuccaggagaagcuguuuuaucaggaaaaucaccaagcucugacaguacuguuuauugcaauccauaugguaaaaaguaaucuuuuuccguuguauucuacaaugugcuuuugaauuuagcguagaguuuauagucuuaacagaugcguuuuuccugugcuucugcccuauggagacuauuuucauucuauuccugccccuuuccuucaucuguaauaauuaucgagugcuauuggcaggcaugggaaagugcuagguaucuccuaucuuccuaaauccccugaaguaaauaguaucccacuuuacagaugacgaaacugagcauuuuguguuuuaguaacuucccauagccagugaggugucagguuucaaaccauucacuccauucguucauacucugcggcuuauuucccaugccauuuucuggcgucuggcccggguuaaucauuuccauaccugcuuguguuagucuccuaggguugccauaacaaaguacuacaaacuggguagcuuaaaacaacagaaggacucccacaauucuggaagcuagaagucuaaaagucagguguuggcagaggcacuuucccucugaagguucuggggaagaaucuuucuuuaccucucccuggcuucugaugguugucagcaaucuuuggcauucccuggcaggcagcuucaucacuccuccaauuucugcuccaucaccacaugaucuucuuucuuuugugccuuugucuuuacauggccuuuuuugucguuguuuuuugaggcagagucuugcuccguugcccaggcagcagugcaguggcaugaucuuggcucacugcauccucugccuccuggguucuaccaauucucaugccacagccuccugaguagcugggauuacagguguguguacauggccauguuauaaggacacuagucauuggauugagggccuuucuaauccaccaugaccucaucuuaauuaauuauaucuacaaagauacuuuuuuuaaaaaaaaagguaagaugucuaugaggucacauucugagguucugcggggauaugaauuugggggggcacuguucagcccagcacacuuucuggucauaacucugaccuuucaccuucugugugauguaaucuuucgcacuuuuccacuccuguggugcaucccuguguggucacaaggaaguugauaccagugucuugguggauuugaguaagggaccgucuacuaugcuaaggcauugguaauggaaagguagccuuaaaacucugacuuuucuguccauucuacaccagacuguaugacuggcuacaccucagaacuuaucuugaacgugauacguuuugucuauauugauacaucuucauguagagaauaaccuuaguuucuuuauuucuuagaaaaucucucuaccucuguauuaucauuugaacuccaguuccauugcuuccuuuacauuucuauagacauuuuguuaauucuuguucaucguuaauuagaauuugcuaauuaugaagagaauaaccaagacagaguggucagauguucaggugaauuuggccuucuaggguguguggcuggugcauucuuuuauuuuccagucuuuaaaaugugauuauuuguuucucagauaaguuugauuaugcaaacugugauaaguaaaaaaaauaccccauuacuucauauaguucugacaacuuaugcuguaacacauuuaaaugaguaauuuuguuuugaaauagguuggccuuggggaggcacuauuagaggcugaaacuauugaagaacaagaaucuccagugaacugcuuuagaaaauuauuugguaaggaaaauuguauucucuauuacuucuaugguaaauuaauaugcugggguaaguguugguucagggauaagcucauauaugaaaggcaaaggagcuuuauguguuauggcauuuaaguucuuuuuuuuuuaauuuagaagcauuuuagcugggugcgguggcucacgccuguaauccuagcacuuaaggaggccaagguggguggaucacgaggucaagagaucgagaccauccuggccaacauggugaaaaccugucucuacuaaaaauacaaaaauuagcugggcaugguggcgcacgccuguagucccagcuacuacggagguugaggcaggagagucgcuugaaacugggaggcggagguugcaguaagccgagaucgcgccacuguacuccaaccuggugacugagugagacucugucucaaaaaaaaaaaaagcauuuuaaacaacuucuaaacuuuuguuauguaagauuugauaccucugaaagaauaugcauagcuguauauguaaguaugaagcauaguaauaaacaucugaauucaauggaagaacuggacccucacccacagcauaaaagugucuguguuuccucccugacuccagccacuggugucucucugcacagcacauuuugaauacaugagucauaagggauuuuucccccuauauauuuuagauacuacaucaaaugaacucugaaagcuuuuguauuuaucggaacucuaggguagacaaccuaauuaauuuauuucuucuuuuucuccuccaacaguuugugauguccuuccucuaauaauuaacaaccaugauguucgauuaccugccaauuuauuguauaaguacuugaacaaagcagcugaauuuuauaucaauuaugucacuaggucuacucaaauagaaaaucagcaucaagguaaguaggaauacccuguacuuuuacuuaaauaggcuuuaguaauauugcaaaauucagaaaccccucaauguucugauuauucuccucuggauacuuaccaguuugggaguguuucaaaagaugguaucuagaaaaaaaauacuaaaagaugaggcuuuucuggaagcaaugccaccccuugaucaaaacagucuucuggcugagcuguaauguuauugcauggaacauuacaaauguaccaugaugaaguaguggaaauuacuucuugcuuauaccaguggccucuugucgguccuugagcaaaacauaaguauguuggaauucugugcucugugcauuuucauggggagucagacuuucuuuaucagguaccaugucaacaguaagucauaauguuaauuguaggcuacuuuuuucuuacaucucaggcgcccaggauacaucugauuuaaugucaccuagcaaacguagcucucagaaguacauaauagaagggcugacggaaaaaucaucccagaucguggacccuugggagagguuguuuaagauuuugaauguuguuggaaugagaugugaauggcagauggauaaaggaagacgguaauaaauagcuuauuuccagaauugccuauugauucuuuuggauccuuauaaaaacaaaaucaugcuuuuuaaaucuguguaaugcguagguauaguuuuugggcaaauuuugugacacucaaugcaaaagaggaugguuuuucauuuuaucaaaacauuucugacugggcacaauggcucacaucuguaaucccagugcuuugggaggcugaggugggcagaucacuugaggucaggaguucgagaccagccuagccaacauggugaaaccccaucucuacuaaaaauacaaaaauuagccaggcgaggugaugcgugccuguagucccagcuacucgggaggcugaggugagaaaaucacuugaacccaggacguggaggcuacgaugagccaagaucacaccacugcaauccagccugggugacagagugagacccugucucuaaaaaagaaaaaaaaaaagaaaaacagauuucuaacugaaauaugaacucuuaagacgauguuguguuugaacgucuccuagauacuucagagaaaagagaagcuacuuagcauguuugugucaugaaaucuugaucaccacccuaauucagaagggaaaaguuaccauuuauauuggacaauaaagaauaguuuuacaugccuagggcaacauuugguacauguaaugguaccaccagagcuuuucucuagacuucuugcugaccagcccagaguaaucaaauaaguuucaucauuccuuccuuuuuagaagcuauggagauauuuugcauagaaugaaggaucucugcagauacaugaacaacuuugauagugaagcacaugcaaaauauaaaaaccaagugguguauuccaccaugcuggucuucuuuaagaaugcauuccaguaugucaacagcauacagccaucucucuuccaagguugguuuacaaauuuuagaguguccaaaaagccaguucauacuguggggaugguaaggaaaaugaaaguguuuauccaguauugcuggauccgaauaacuguggggcaguaccaguccuuuuuauaguuggcgauuuaguuuuguuuaguuuggcuuaauugguaguuuuuauguaaguauauuucauuaaaaguuucuauaucaaagggcguaaugguacugcacaacuaaaaagagauaucaaaugccacuauuuugaaaauaacagcaggcugggcgcuguggcucacaccuguaaucccagcacuuuggcaggugaggccggugaaucacuugaggucaggaguuugagaccagccuggccaauaugguaaaaccccaucucuacuaaaaauacaaauauuagcugggcaugauuguaggcaccuguaaucccagcuacuugggaaccugaggcaggagaaucgccugaacccgggaggcagaggcugcagugagcugaggucgcaccuugcacuccagccugggugacagagcaagacuccaucucaaaaaaaaaaaagaaaaaaacagcagauguaacaacauauuuaaguagauuucaugaagacaucacaagaggcaaagauuuauuuaguaaaauauccauuuuauauauagagaguauaugcauaaauauacuguagaaaauuugaaaaauagaaauaagagugaaaucacccacaauccuuccaguauaauacagcggucguuuuuacguauugccuuauaauauuacauauauuuagauuuuguuuggaauuuguaaccauaauguaaguauaauuugguagucuuuuaugguacuuuaaugacucaugaucauuauaaaaagugcagauacauaacaaauacaaagaaggaaccgucacuuguauucuauuagugacagggaaucuuuaacaauuugguauauaucuguacagucuuuucuuucuaugugcauauacuuguuuguuuaccuaauugagaucacacugaacguauuuuuaaugacguuucucaugacaguugaguaagcuucucccuuauuuuaagaauucuuuuccuagcugcauuuuuaaauuuuuuuuaauuuuauuuauuuuuuaagucucgcucugucgcccaggcuggagugcaguggcgugaucucggcucacugcaaccuccgccuccuggguucaagcaauucuccugccucagccucccgaguagccgggauuaacaggcgcaugcuaccaugcccggcuaauguuuuguauuuuuaguagagaugggguuucgccauguugcccaggcugguuuugaacucccgagcucaggcaauccuccugccucagccucccaaagggcugggauugcaggcaugagccaccgcgccuggccuccuugcugcacugguaaguguugguguuuuuccccguccuuagguccuaaugccccgagccaaguuccacugguucuucuugaagauguaucgaauguguauggugauguagaaauugaucguaauaaacacauccauaaaaagaggaaacuagcugaaggaagagaaaaaaccaugguaaggcuuucaaauauacuuauuaacagauuggaugggacgcuuugcuagagaugaaucuuuguaaaauauggcuuuggagcuaaaucgauaaagccuggguuuuaaaauuguaugauauauuaauaauuacuaagucagugguucuccacuggaggugauuugcccucaggggacauuuggcaaugucuggagacauuuuugguugucacagcuugguggggaggggccaggguugcugcugagcacuuuacaguguacaggaccacccaaaaggucagugaugagguggagaacccaugguauauguuccuuauacauguuuugacugaauggcaucgauucaguuuaaacaacaaaagcaaaauggcauuggaccucuagagcagggugcagugugggguacuggccucggaaugggaagcucugaggugggcagggcagcaggaacagccuaugggcagaugcagaaaagauuucaugaaggaggucaacauuugaaaucagugcugaaaggcgaaggguuuugucaguuggaauugggagguagauuuuguugagagggaaaagugugcacaaagaugcaagaagcccgagaaugugaagaaucgucaguccucuaaccugaccaggcaguaccccgagcccgucccugccucccagccucugcccguugaagcugugcucugugguuacagugcuuuucccuuggaucucugccuggcuagguccuugucacuuggucccagcccaaacgagucucccucugaggcuucuccugaacacccaucugaaguagcugucugguucucucuuuuuauuccucuuuuuuaauucucugcagcauccuccuugcugucuguuuuuucuuguuuauucacugacugguuuacugucucugucccuccuucacuagaguacaagcuccguggggccuagcauuuucucugccucguccucuaccauacccugggcaucugaguagugccugggcuggagcagguguguggugagcaucuggugaaggagggaauucucauugaucccuccuggguuugguguccaggcuaugggauggcuguuuaaaccugguccagcgguucuuccuuccgguuuuuuuugccugucaagcacucaucuagcaagcccuguucucauaaccuggccuucuacccaaugcggaauuuccauccauuuuuguuuucauggucuuaacugauuuuguccugauuaucauucuaucccugagucugccccaaccugaugcagguccagaccuuaaaggcccaugagcucagcucacauauaucuugcuuugcucacaguguuuuguuuguuuaaauaaccuaguauuuaaaaauuagaaaccaggcugggugcaguggcucaugccuguaaucccagcacuuugggggccaaaagaggaggaucaccagcccaggaguuuaagacccaccugggcaauauagugagaccccgucucuauaaaaaaugaaaaaaaaaacuagcuggcugguggcaugcaccuaucaucccaacugcuucagaggcugagaugagaagaucccuugagcucaggaguucaagguuccagugagugaugaccacaccaccgcccuccagcccgagcaacagagggagaccccgucuauaaaaaauaaaaaaauaaaauagaaaccuagcauuucucauaacaauccagauuucugacuuccuuuuuguaauuaggauaucugaucacacuggccccuggugguaacccacaacuggaguugggggguggcccacaucaguucuccagccagcugacaucacagacucaugugacgucauaaauggcuggugcugggacaggccucuccugugggcaucugucccccaccugcugcauucuugcuucagagcacgcucucagugcuucagaguguacuugcacauuucaaaaucaguuucuuuaaauguaaaaacauuuggaacucacacuagucccaccacaucugggguccuuucauaaauuccugaucucguguugaggcaggaauguuuucuguaagcugcagcacuagcagacgcgccauguguguucguguaugauauuagguugccguuacuuggcaaagaacaggccccugaugaaacaguaccuggcagauacgguugugguuuuuuuuuuuuuugguggagacaaggucuuucuauguugccuacucuguucuugaauuccuggguucaugcaauccucccaccuuggccuccaaaauugcugggauuacagggguaagccacuacaccuggccugguagacagguuuugauuggaaaagguguguuuuucccaaugcaaaaacauuacuuagggaggauaagaacaugcagcagaacagugggguagggaaaagucaccaagaacagggacuagcaggaagauaccaagcucagaaaguggaaaggaaggugggcaguggagggaggugcugacagcuuccugcgcaccuuaccugagaugagcuugaggauuggagcuuuuagugacaguaguugcacauauuuuuauuuauuuauuuauuuuuuagguuuucuuuuaucauuauuauacuuuaaguucuaggguacaugugcacaacgugcagguuuguuacauauguauacauguaguugcacauauuuuuaaaugaucuuaguggaguaaagaucugcaggaagaauuucauuuggguuauuaaaucaguaaaaugaccuagguggauuaaaagauugagaaaauucuuagcaaaauaaaauucaguggagcugcuuuuaccuuuacauuuuuuuuuuuggcaaaacaucugacucuacccagcgguauuuccaauaauugccuuucucuguagccuucucuuuucugugggcuuuauauuacuugagaugaagagcaagaaaaguagaaauguguauuguaaaauacagagggcuuuacuagguaagugcagacaaauguacuuucugaccaggaccuugcacugggggaggagagcgagagaggggugaccagugcaggggagucaugcgcagugaaccaaagauaacuaacaguuauucucugacauuauuucuuagaggacgcaggcuuuaauuuuguuguuguugagacagagucuugcucugucgcccaggcuggagugcaguggugcggucucugcucacugcaaccucugccucccgggcuuaagaaauucuugugucucaaccuccugaguagcuaggauuacaggcacgugccaccaugcccggcugacuuuguauuuuuaauagagacuggguuucgccauguuggccaggcuggucucaaacuccuggccuuaagugaucuguccuccucggccucccgaagugcugggaauauaggcauaagcugccacgcccggccccaggcuuuaauuuuaucccaguacaugccaaaccauuauuuggaagccaauuaaaucaugucacguauuagaaaaaaaaguaaacuauaaacaggugcuguuuaagcugugucucucaauguaaaaaucuaaauuuugacuuucauaaaauugauauuuuuaaacuuugcucuaaaaccaccauaagcaaacauaagaauuuaacaucagaaaaaaaauucacucaauuuuagaaguaaaaauggaaugugugagaguauaaagacaaaaaaaaauuaauuuucaaagcuaaauuguuaaauucaaaaaaauuguauguaugugguauccuuugauauaaaauucauaucacgggccaaacuggcagcaauaauauguuuccauauaugacuauauuuauaacugaauuaaccauguucuccacauucuuuaagcagaguucagacgaugaagacuguucggcgaaaggaagaaaucgucacauuguagucaauaaagccgaacuugcuaacuccacugaaguguuagaaagcuuuaaauuggccagggagagcugggaguugcucuauucccuagaauuccuugacaaagguaagaaagcgcaugucauuggugcuguuugauguuuuauauaaaaucauuacgcuacuucaaaugucaggucacuuacggcaaauuaaguugauuacaguaguucaugcauuuuuuuuuucuuguuuugagacggagucucacucuuuuucacccaggccggaguacaaugguguuaucuuggcucacugcaacgcucaccuccuggguucaaacaguucuucugccucagccuuccucguagcugggacuacaggcacgugcgaccaugcccggcuaacuuuuuguauuuuuaguagagacgggguuucaucguguugaucaggcuggucuugaacuccugaccacgugauccgcccaccuuggccucccaaagugcugggauuacaggcgugagccaccaugcccagccauauugcuguuuuuaucugcauuaacuccauugucugaaaaacucaaaauccaaaaacuauaggaagccuauuuuccuuugaguauacuggguauuuugacauugcuuagaaaucacuagcuguuugcuaacuaagguauucuuacuacacuuuggaaucggggccccuuauuuuacuuuuagcccguggacauucauccccuggcugcagucaugugucauacagagcccuuggccagaugugcugugucaucuuuucuaaguaaauucagcaccguucaguuucucuuuguuacauuugggauugugaacacauaugugacaauuuuggaggggaucuuuccuuuaguuagaaauugauuuuuuuaaaaaugaauaaaaccuuuuagugucauuguauguuuguuauuuuaauuaggucaaaauaaaaugggccaggcaagauggcucaugccuguaaucccagugcuuugggaagcugaggcagguggaucauugagcucaggaguuagagacuaaccugggcaauauggcaaaaccccgucucuauaaaaaaacaaaaacaaaacuuagccaagagugauggcaugugucuguagugccagcuauucaggaagcugagguaggaggacugcuugaggccggaagguugaggcugcagugacccauguuagggccacuguacugccagccugggugacagggagaaugucucuaaaaauaagauaaaaauaaaaugggaccuuguuuuggggaaagcaaaguggcuuaaaagauaaaugaggaaauacaugaaaagcacuuuaaacaguucuuggcaccugguaugugcucaguaaguuguuagcaucuacaaaauauugcuuguguauuacugauaaguguuguauguuucuucucuacuugaaauucuagagcaguguguuagaaaucaaagucaaaguuacuauacauuuuugguagguugucucucuucucucuuacuggauuuguuaguuuguuuucugcuucuuugcugcauauauuugguaaauuuguucuugaauucuuacucagaauuuacaaggauuugcuuggccuggaagacggauacuuggcuuugguuaagaaucuuccucacugauaugaucaucuaucagguagaguauuauacauauuuuagguaccugugucuguacagcauggcuaugguggcaaaccagcuuuccuaugcagaaugugucauguucccucuugggcuaguccacugccuccugacaccuguucuguuuucaguggcugaggggguaugguccauuuuccuuucaaaguaacuaucggccgggugucguggcuuacgccuguaaucccagcacuuugggaggccgaggugggaggauugcuugagcccaggaguucgagacuagcccuggcagcauagugagacccugucucuacaaaauaaaaaacuuagccaagugugguggcaugugccuauaguuccagcugcucaggaggcugaggcgggaggaucacuugagcccaggaagucaagacugcacugaaccaugauagcgccacugcaccccagccugggugacagugagaccuugucucaaaaacaaaacgaaacaaaaacuccaaaaugacaagccuguaccuucuguguuacuuuugguauauccaaucacaccucucuguaaaaguaagauuuuuacuuuucgguaaaagaggauuacuucucacccuccucucucugcugguggagucugccuggcuguacuguucuccagcaucuuagaccuugaauggagauagucgauaauucacgaaugagguggugucggaaugggcagguugcugcuuccauccuucauaaaggagaaguggugcuuguaguaaaauauuucuaaagaaauguuauauccaaaugugcuggaucacagggccugguuauuuucuuuagucucgagaccuaagaccagaaagaaaaaucuucauccuuauaaaguaccgccagaaagaacucccaccuggcuuuaauuaaguugauuugauucuauugccaauucuccguuucuuccucagaugaucaaaccaagcuaccgucuuuguauaguugcuugcucguugcuucgugaacccuggaacgguauuuuuuaaauuucuuuuuuuaacagcgaugcuuuuccccuccuugcuauucuaucuuucuuagggucaauauaaaaaggcgauagccagccugcaucacuuagcagcucuccagggauccauuucucagccacagaucacagggcaggggacccuggagcaucagagggcgcucauccagcuggcgacgugccacuuugcgcuaggggaguacagagugaguacugcacacauacaugccugccgcaggugcacggggccaccuggccuuucuccuuucccuagcguggcuuuucauucagugcacguuuauuucaauuugaucuuucugccuagauuuauuacuuaaucugcuagugaacaucacaaugauuuuguuuuacguaauuuucucuuuacuacagcuucccugaaauaaggcaucaguacuuuuuacauuucuuguucauuguuccauuuguuggaggauuuuucuuuuuauuauuauuuuucuuuuuauuauuauuacacucuugucucuucuguuguacuuggaaacacaaggccauuauuaagugggaaauggagauuuauauuuagcuuacucaaacuucagauucucucuuuaaaugguaauaacacgcccgggugugguggcucacaccuauaaucccaggacuuugggaggcugaggccagcacaucaccugaggucaggaguuuaagaccauccuggccaacauggugaaaccccaucucuauuaaaauacaaaaaugagcugggugugguggugggcaccuguaaucccaacuacuugggagacugaggaaggagaaucacuugaaccugggagguggagguugcagugagccaagauugugccacugcacuccagccugggugacagagccagacucugucucaaaaaaaaaaaaaaaauggugauaauacccaauaggggcagauuuauaaauggguguguuuccuccaggagguuucaagcccuuccuacuacaggguggggacuauguuuuuaucuuugaacucucaugacaccuaccacaguacaauaaguguuugaauucaguuaaaaugauaaccguguuguuguguaugcaaggacuguauaaacucaaggccacagcauaacacaaacugauuucuucucagcccucuauauguuguugaucacuuugugauuaaaaucccuaaauguuuuuuaacuugaacuuugaaauaugauuacuaauuugucauuaugaucuuuagaaaggaacaauuggagaauguguaaagcauucaaaauugaaaaugcuuuuccaccauuauuuauauaauuauccaucaguuacuuaacucuaaguuuuaauuaauuccuuuuaagaacuuaaaaggcagcacguauuuacucacaccgacauacauaucucaaguagaauuagcuauacugcauacuaacuucauuguaguagggaauauaaacuacugaacaagacagacuugucuaacuuaaacaagacagacucauuuccuuugagggcuuaguuccaaccucugaguacaucacuauuaggccuaugggcagugucagacugaccugauuccugacuucccaucuuuagcccagacucaauauguccagauguaaguguccuuaguucucuggcugucuuugucugcuuggguugcuauaaccaaauaccauaaagugggaggcuuguaaacaauaggaauucauuccucacaguucuggaggcugggaaguccaaggugaaggcaucagcagauucagugucuggugagguccugcuucccggaucauagaagggacaagagagcacuguagagucgcucugauaagggcacgaaucccauucaugaggguuuugcucucaucaucuacucaccucccaaaggcugucccuccugaugcccucacauuggggguuagguuucaacauacaaauuuuggugggaauguagacauucagaccauaguacuggcccuuagacacaaaacuuucaagucuugguggacucuuacucuagcgaauccuuuugauucuuccagugugauacuaaucucuuugcuauauuaccuuguauuucuauugucaccacccuaauccaugccuuuuaacuaaguuuuuggccuaucacccuuuuuccaacccuauaaaauuauaaucguugcuuucuaaaauacugcuuucauccuucuacuuaauugaaguauugguuuucuuggugcucaguguugaaucccgcuguuggcuggggaguagaagcaggguguggggaauaugggaacccugaauucaggggcacaugguuugaguuagggaaaaaaguauaaguguuuguauaagacaaugaaaaaaacaaauauuaguugauaguccucagucauaggcacaauaggcauucagggaaggguguuuucuuuguuggguccaaagacgacucaaggaaagauugauagaaaagauuggcuggagaugggcaucgaaggauggcagcucauagcucuggaguacaaguccuggcuagcucugugacaucgguagguuaccucauccaggccuauccaacuccagaguucaaguuuucaacuaccaggcugcucaucucucuaaacuagagcuucacaacccugugggcauagguggguucuagaggugccaauauauggauccugcagcuuuuggggcagucagccaugaccuagggcugcuggggccacccaaggucaauugcugccaacccugagcagccacacacagguuacuuucaggaugugccacaacaugaaaagggucgggaagcauggguuuaaauccccacuuccaggaguucaacagugagaacacauggacacaggcaggggaacaucacacacuggggccugucagggggucgggggcaaggagagggagagcauuaggacaaauaccuaaggcaugcaagacuuaaaaccuagaugacggguugauaggugcagcaaaccaccaaggcacacauauauguaacaaaucuacacguucggcacauauaucccagaacuuaaaguacaaaaauaaauaaauaaauaaaaaauuaccuagagacccagagaugucucuggccuuuugcauaaaagaagaaaaaaaaaaagcuccaauuccuccucuggaaaauagagaacaaaaggguuugcuugacacagauaaaaggcucauugcauggaaucugacuguuguuaggagaauuugaguagauagagagggagcggugaugcagacugucuggaucaagggcagccugcacagaggcacucgaggcuccucuccaccagcagugcauccguccagugucucaucuguguccuagaccaaaccgcuggcccucaaguaaaucaccuaaacccauauauagcccuuccccaugucuuucucuccugccugaaaggcgucuuuucugcauuccaaauccuuccucucuuuaaggcuuaggucaagauaaccuuccugccugaagcuuuucuugcuaguuucuccuguguguauuuucuccugcauuuuaaguuaugcucuauaucauacuccuuagaccucugcuacauuuuuuauuguuaguuuuucuaugcagugaguuagucaguaucuuucaggcagggacaucuuucuuuuggcugcugcugugcuguugaacaccucaguacuuaaugcuugguuaauuuuuaaguuuuguuuuuuuaauagcaaagaauggauuaguguucccucuaaagucuaguacauagcuuugagucuuauucuuuacucuuucuguauucacuauugagcaaugguaaugaucacauagagagguagaaauacagacuuccauguacacauugccugauuguaugcugcaaauauuuugguacuuuauuugauuucaguucagaaagcuucaaguuaguuccuuuuuggucuuuucugcuuuagaugacaugugaaaaaguccuugauuugaugugcuacaugguacuccccauucaagauggaggcaaaucccaggaggaacccucgaaaguaaagcccaaauuuagaaaagguacagugacauguuuuaugacuauuuuguaaaaauagcuuuagaaagccaggcacgguggcucacacuuguaaucucagcuacucggaagucgaggcgggaggauagcuuuugagcccaggaguuugagaccagccugggcaauguagugagaccccaucucuuaaaaaauuuuaaaaagaaaagaaaaauaguuuuaggacccaaggcugaacaauguuuuacaguuccuaaugagauaauacugcugcagggcuugccaaauuguauaaaaaguuaaucccuuuccaaguuuuuccuuggcucugauuucaugagcagcuguaaaugucuuucuuccaaagcucucuucacuuccugaguguguuaucucuuugacaaauuucagugaacucuuuuuccugucuuuacaauucuagaaaaauguguagaugauuaauuaggagguaucugucagcacaucccucugaaaccauucugagcuucagcucaagcuucguguugcuugaaaaaugaaauguacagcugaucugaguuuguuagaaaaagauacauaaauuaaacuugaagaaaauagaugacaggaaagaauaaugcuaagagcagaagucaaugaaauagaaaacaaaauagagaacauuaauaaaacuggaaguuuuuuuuuugaaaaauauuauaaaauugauaacccccuaacaagaucgauaaggaggaaggugaacauaaauuaccaguaucagaaaugaaaaagggagugucacuacaaauccuacugaaaucaaaaggacaguaaaggaauacauuaugaaaaacuuuaugccaauaaauuuaacaacuuagaugaaaugaaaaaguuucuuaaacacaauuuaccaaaauugacacaaaaaauaaacagaaaaucagaauguucugccaggaacaguagcucaugccuguaaucccagcauuuugggaagccaaggauggcagaucguuugagccuagaaguucgagaccagugugggcaacauggugaaaccccaucucuacuaaaaauauaaaaauuacccggguguggugguacacaccuguagucucagcuacucaggaggcugaggugggagaagcauuugaaccugagaggcagagguugcagugagccgagaucacaccacugcacucuagccuggucaacacaaccagacucaaaaagaaagaaaagaaaucagaauguucaagaaagaaagaaagaaagaaaauaaauaaaucagaauguucccuuagcuauuaaggaaauuaaauuuguuaucaaaaaccuuccacaaagaauucagguucaaauggcuuuacuggugaauucuaucaagaauuuaggaagaaauagugccaauucuacacaaacucuuaucagaaaauagaggaagagucccaauucauuuuuaaaggcugacacaauaacccugauaguaaaaccaaacaagaguaucacaagaaaagaacuuuaaaggccaguauccaucaugaauuauaauaggugucaaauccuuaacaaaauauuagcaaauugaauacagcaauauagaaggacaauauauuaugaccagguauaccaggaaugcauaggcguuugaacauacaaaaaucaguggccaggcaugguggcucaugccuguaauugcagcacuuugggaggccgaggcaggaggaucacgaggucaggagauagagaccauccuugcuaauauggugaaacuccaucucuacuaagaaauacaaaaaauuagccaggccugguggcaggcaccuguaaucccagcuacucgggaggcugaggcaggggaaucgcuugaacccgggaggcggagguugcaguaagcugagauugcgccacuacacuccagccugggcgacagagugagacuccguuucaaaaaaaaaaccaaacaaacaaaaaucaguguaauucacuccauuagcagacagaaggagaaaaaucaugacugucuuaguagaugcauacagaauucaauaucaguucaugauaacaaaaaucuuagcaaacuaggaauagaaggaaacuauuuuuuaacaucaaacuuaacuaugaaguauugaaugcuuucccccacuaagauuagaaacaauacaaggaugucugcccucaccacuucuguucaauaaucuggagauucuaggcaguacagcaggcaagaaaagugaauaaaggcauaaagaucugacaaauaugaguaccuuuauucacaguuacauauuuggccaggcaugguggcuuaugccuguaauccccgcacuuugagaggcugaugcagguggauugcuugagcccaggagcccaaaccagcaugggcaacaaagugagaucccgucucuacaaaaaauuuaaaaaucagucaggcuuaguggugugcaccuguaguuccagcuaucuagaggcugaggcaggaggaucgcuugagcccaggaggucaaagcuguggugagcuaugauugugucacugcacuccagccugggugacagagaaagauuucccugucucaaaaaacaaaaacaaaaaacccaacacaguuacauauuuggcuauguagaaaacuugagggaaucuccacaaauccccaaggcugggcgcaguggcucacaccucuaaucccaacacuuugggaggccgaggcagguggaucacuugaggccaggaguuugagacaagccuggccaacauggugaaaccccaucucuacuaacaguacaaaaauaagccagguauaguggcacacaccuuuaaucccagcuacucaggagguugaggugggagaaucacuugaaucugggagguggagguuucauugagccaagauugcaccacugcacuccagccuaggcgacagagugagaccuugucucaaaaaaaaaaaaaaaaaaaaaaaaaaaauuccaagacguuuuaguguauaaaaaaucaauucaauuuguaugcuauuaauaagcaauuagaaaaugaauuuuuuaagauacuauuucuaauagcaucaaaaaaacauaaaauacuuagagguaaauuuaaugaaagauaugcaaaaccuccacuuugaauaucagaaaacauuucugagaaaaauuaaagauuuuugaaaauggacagaucauguuucuauaucagaagauucaauauuauuauggugccaguucuccccacguguaucuguagauucaaugcaauuucaagcaaaauuacagcagacuuuacgguuuuuggugguuuuuugcuagaaguucacaaagugauucuaaaauguaaguggaaauauuacauaaucuagaauagucaaaacagguuuuaaaaagacacaauuaagugacuuauacuacauaauaacaagacuuaauauacaagcauaauaaucaagacagaguugacaaaauaucgacauaagaauggagaauccagaaauagaccugcauagauuugaucaaaugauuuucgaugaaggcaucaaaguaauucaauaaggaaaggaaagacuuuucaaccaauggugcuggagcagauuacguuguauauguuugaaguuuucuauaacaaauggucaaaaaaaaaaaucuagcccagacuucuucaaaaauuaaguauuucugcagaacagaaaguuucugguugaaacucaugacccuguagaugaagacucacagcuugagaaacacuaaucuaagguguacaacuaggaggcaaggcauauaauuagguaaugacauguucaacuugguaaugcuaaguuaguuuccagaguggcugcaugacuuuauauaccuuccagaaacugauuagguggauaggacugaccuagcugacuucaagacuuauuuuaaagcuuuaguaauuuaagacaggguaguauuggcacagggguugaccaguggaacagcauagaaaacugagaaauagaugacauuaaaauucagugggggaagaaugaauuuauucaauaagugguacuagaacaauuuauuauccaaauguaaaaaacgacaauaaaaaaaugagauccccuccuucacacuacauagacauccuuuaaauuuuaagguugaaaugugacagcaaaaacuccaaaacuuccaaacuuuuagaagaaaauuuaaaaauagaaagauuaguaaauuugaucacauuaaaauuaaaauaccaacaaaggcuguuacaaucaaagugaaaagauaaggcauaggcugccagaaaauugucuaucacacaaaaucaacaaaaacuuaguaucuagaguuuugaaagagcuccuucagaccaauaggaagcaauuauccaauccccauagaaaaauaggcaaaggacaggaagaacagauucacaggagcagaaauccaaauggccaaaaacuauuuggaaagauucucaaccuuuugucauaugggcaauucagaauaaaacaauaaacuaccauuucacacacaucagaaugcaaaaauugaagaggaugugaaggaacacagugccacgugcuucuggaagguguauaaagucaugcaaccauucuggaaaccaacuucccaugaccaaguugaacaugucauuaccuaauuauuaaauguaccucgcguccuaguuguauaccuuagaugaguguuuuucaagcugugaguuuucauuuacagggucaugaguuucaaccagaaauuuucuuuuuuaaugagauagaauucaauaauauuuuaagacgacaucucagacaagaagagagacuguuauuccaugcaccuuuuguuuuggaucuaucacauuauguaaguauguguguacaggaucccaugugaaaaauauuuauuucuugcuaucuugccucugaguagagaaagauaacagacauaaagaacacagaccagaaaggaaagauugggauuuugcuuugaaagcuauugcuuaaaguuauuuccacaaauguacaagaauauguaagaauguauauuuaucauuguaauagugaaaaauuggaaaugucaauauccucuguaaaaggaaugcagacaacagaauacuauauaacacugaaaaugaaugaacuagagcuauguguauugauauugaccaguugauaaaucugaaccacaugaaguugaguaaaaaaagcaauuugcagaaggauacauacaaaaugacaccauuuauauaguagacugaaagcaugcagaacaauccauuguuguuuacguguguaacagucauaggaaugacaaccacugccuucagaauuauggcgaccucugcgauggaagagaaugggaucagagaaggauacacaauaggcuuuaacugauuuugugauuauugauauuagaaauguuuaaaauuaagauauuaacauuucaugaagcugaguggugagcacaccaguguuauauucucucuauauaacuuuguguauauuugaaauguuuucucauaaaaaguauuuaagcaaguuuaggaaagaauauugauaaaugaaaucuagagaccaucaaaagccaauuucaccaucacaaaguauaauuguguuucaaauauaauugaaauugugugacuguugcauauucucuuuuuuguuguuguuaaugaaagcaucuuaaacaguugccuuucaaagcuguuaucuuugauaauaacauacauuaaccuaacauuguggacuucuguuagguucggaucugaagcuccugccuuguaccagcaaggcuaucaugccauacugccuccauuuaauguuagccuguuuuaagguaagcuuaaaguugauuagcuugaaaaaaaauguaauuucaaauauuauucucaugacucgagaacuugagaaccuugcuaaggauuguuauuuuaguacuuuugagggcaggcccaaacaguuagaaaagcacaugggcuacuaauuaacaaaucuauauuaaauaaugacugcgcuaggcaaagagaaguaggaaguucuccccguccucaaaaaguguaauagugggacagauaugcaaauaaccuugacuguuguaguguuugguaaauauuuuaucaauauaaauauauuagcuacaaagaaagggaauacaaauugcgguuagguucauggagggaugaugaguuugucauuguaaagaugugcuagauuaagcauguuagguguugagaucaacaccaguaacagcccaacaguugggaaaguuccgggacuugaaagaacgccaaggcccuuggcuacagguagagcagagccuuagagcagggaggcuucauuguuucuggaagguuuguuggccagagaguaaaacauugggucuccacuucagugcaguaacucccacuuaacucaucauccauaucacuuuuuuagggcaacaaaaacaauuuaaagugugauuuuaugcauaaccgcucauuugaaacaaaaacuguuuugaccauuucuuuaguucacacuucugcuuauuuccuuguggcucaccaccuuuccuucucugcaaucccauguucucuacaaacaguucucuccuggauggccucuugcccaccuacucccaucugcucccuuucaaagaaaucuucagauuuauuucuccauuacacaggaugaaucagaguucucugccccugauucucauaugcaaaagcuucaggcccacccauguccaacugccaucuacacacugccagcagcugugcagagggagccugaggcuucuuugguuagaauccacccuccuuagaaggcagcugugauguuuaccagccauuucguugugccuuuguuuccuucuuacucuaaugacguuuaucacacauuugcauauacagcauauuuuuggaaagugauguuugcuguauuucagauuacccugugacuuccuuuuccuucugucuuguauaaaucuuugucuugcagcuuagagcuuucacagacaacagagacgacauggcauuggggcaugugauuguguugcuucagcaagaguggccacggggcgagaaucuuuuccugaaagcugucaauaaaauuugccaacaaggaaauuuccaauaugagaauuuuuucaauuacguuacaaguauccuuuuuucuuguuuaagcauaacacauucugauuuucuuuagaaugaauacaugauagaaaaagaaugaaccauucuggauagaaauaaugauuuuuacuauuuugcagcgaagagaaggaauggggauuaaaacuggggcuguggcaguugaucuucugaaagucgugaaagacaugauucaaggaauugggaaucuuacaacccucuuccauuuuccacugcuaggugacuucuaagaagguacgcaaaaugccuccaguaauagccuacagguugcugauagguccagcuugcccgguuuagucaaggaauauaauacuaauaguuccucuucuuccaucugucaaaagaaugccuccuguagccucuggggacaguggcugugcccugcaaucacuuguuagggcacccugccauagcugucuuaccuaccaaugaguacccaccagagaugcugcacagcacaguagcugcuucugacauuagguaaugcuguauuucacacugcuuauuagggaaagaccuuugaauuaaagguuaguuaucaauuuggguguuuuuacuucauuguuuaucuuauuacauuauuucugaauugcaaggaauauaaaugauauucuuguucaggugcucagagcaauaguuuuuauuuuuauuuuguuuuuuuuuagaguuggggucuugcugugucacccaggcuggaguguaguggugugaucauagcucacugcagucuuaaacuccugggcucaagagacccuccuaccucagccuucugaguagcuaggaccacaggugugcacuaccauaccaggccaaaguaauaguuuuuaaccaugguuugggacagauaucuuuugagaaucuaaugaaaguuacauaauuuuucacuagaaaaaugcauacaugaaugucaucgacauauugcauaaaauuugggugacucacagaagcuuccuccucugaugcaucuauaaacccuugcaccccaguuaugaagaaguaaucacuugauuuuuaugaauuuuauguucuguaacaccaaagaauccucccuacuuucaccuccucuuucauuucuuauuaagaaaacaaaaaaauuuugcucuugugaccauguaguauuaauuauuaucgauauggaaaacauguuguccucaugcucuuuagccuggcacaucucaugccaagaguuaucugugcgagggaguuuaguggguauaagaaucagguuuuggcaucagacagaucuggguucaaauauggagucugcaguuagugggguagcaaugggcaaguuacucaacugccaagaccccauuuccuuaucagagagaacuggcaccuuuuuuagugggauggcaaugggcaaguuacucaacugccgagaccccauuuccucaucagagaaaacuagcaccuuuuuuuacaugugguuaaccugaaucuggccugcagauauugauaugcuggaggaauuugccuacuugagaacucaggaaggugggaaaauucaucuggaauuacuacccaaucaaggaaugcugaucaaguaagcauguucucuuuugcucuuccaugcugagugcucaccuuuugugucuuuguaugaaguauuuguaaaugucuauaccuaucaaaaauuuaauacaaaggacuuuaaaccuggucucuguuaugauaguuugauucuggguaccuuuugaaaaacuugcauuuccuuaacuacauuucuuaaaacacuuugcuuaaauugggguauuuuugucacauuugcaacuuuuucacuagacaaaagucucauucaugauaucuuuuacuuucaaaaauuuauagggugagucuauaaguuucugauuagucacagagugccuuuaauuaagaacaguuguguggccaggcaugguggcucacgccuguaaucucaacacuuugggaggccaaggaggacagaucaccuaaggccaggaauucaggaccagccuggccaacauggugaaaccccgucucuacuaaaaauacaaaaaaaaaaaaaaaauuaugugggcaugauagugggcaccuguaaucccagcuacuugggaggcugaggcaggagaaccgcuugaacccaggagguggagguugcagugagccgaggucgcgccauuacacuccagccugggcaacaagagugaaacuccaucucaaaaaaaaaaacaaacaaacaaaacagcugugcuuaauuaaaauugugcuggguuagaaaaauucuuuaggaaaaacuacagacuuuuuauuuauaaacuaccuaugaagcccuccuaugcaguccucaugacuuacauaacaacgaaguauuaauagccagguauagugccucuaagaacacaccugucccaagaaaugauggugggagugguuggucuccaccaugcuccccugaacucacaagauguuacuaaaauuccggguuggcccagaugaaaaugccaaauuagugaccauuuaugauuuuuaaauagcucauaaaucuugcuucucuccuucaauccucauuguaguuuggguaauauauccucucugcuguaaaugccacguguaguuuuauuuucauacuuccuccuuugcuuccugcacauucagugugucuguaagucaguguuagaguuucugcaagagacugaauccugaaugagaagaaaguacugcuaaaacuaaaaacauuuuucuuuuucccucaguuguggaauaaacuaguuuucagugguugaaagcaaaaauccacaucuuguucuaucuugauagucuuagaagugccuagggaaagaaguaagaaauguucauuuuagauuucuguaaccucaguaguuugcugguagcaaacauuucuuuuugugucuagcaagaauagggucuuguggacuccauucucaagaauggaaagauuaagugguuuuuucuccuucaucuuauaaguguuauuaaauuauaaacuuuuaaaauaaaagaacagugcucuuuuuaaaaauacacgagaccuuucugcauugguuugcuuaagcaggauggacaaggacuggcaucuuccaauccccauuuacuuuucuaagaucgugaaucgaaacuuugggaagaauaacuauguuguucaaaauauucuuaacaguguuuggggauaaagauuaccuuuggauacggaagcccagguaaccccuuuuguauugugauuuguuuucuagacuuugaaacuggauauacaaauacacccugaaucaagcuuuuuaguuaauucccaucagcagucacuauacgaguuaauauagagacagccauaguggaaccgaagucuguguacauaggauuaaaccugcagaugauuaucacuuuaccuagauaaugccuaacuguuagugcaggugugagagauggauugucaaaaaaucaacaguugaaccucagacuucauuguacugaaccuuucuucuucuaccaguuuuuacugagcugaagagugacauaaguccaaguggacaaacccuaggaugaggaaugagagcaaggggaguguuggguaccagcuaguaucacagggaagaguguuuggaguuguuuguguaaaggauacccaucaugcacuucuaacuagugagggagaacuccagggucucccaccuugaucaauacaacccuuaauuucuucuaacuuucuauagaagacaagccucuuaggaaggcugcaguuucaucaguuuggaagcaggaauagggauuauuccuuagugaucugaccucguagggauuugcccagucuucacugugugaaucucaagguuaauuacuuaugccuaaauuaacaugguagaaagcacacugcuuaagccagagagcucuuccuaacugaggaaugguuggaaucuuuauuaaacaaucugaauuccuuuucccuuuggguuccaaacaaguuuucugaagccauuacagaccuuuuggguggucccuccagaugaguggcagagauguugugagcaguguacacuucuccccggggguaaggcugugagucugcccuagcuguggcaucugggaugcaagcagguacaguaccaacacugagggcacccggugcuucacucaaaggagggagaagcucuuaaucuguuauacagaccuuuugcucuuaaguauuuuaaaauagagaaauguuucugugcugauaaaugcaguaucuuaguuguauuagaguggauuaaaauggaaaacaauguccuacuuauacucugaauaggguggauaauaauguucuaugaggugaucaccagcuaauacacuaaaucuuuguuguuacagaauucugcacagccaugggucccggacucuuauuuucccccaucuguucucaauacguuuuugaaauugaaacucacccuuuuuuuaaaucaaaaacauugccagaccauuuaguccucuuggaagggccucuccgguggggcuucaguccuguuaaagaugguuaccagacaucaccagguugaaugcugggacugguguaccgugagaagaguggaaaguaaagaggcuggcuuugaaaaugugucuucucaaaggcugccccuacucccuauugccauucagcugcauuccaucauccucuuccucacuggucgcuuuuuauaccaccucaaaagggggcugagcucugggaccaggaacugagacgccucuggacacgcaccagcagcagcgggugcagugagggcuggcuagcuucuccccagucuccuuaaacacccagccacggccaggggcuuguugagguuaaugaguuucuguuuagucugcuucuagucuuguguauuuucucuggaguguuguuuuugcagugcagggugagucgguguggguguuugaaugcugcuguuugcuguuuuuuaaaggccuucuagcccucccaugggguuacugcagcaggaauucuuaccugugcuucagcccagcauacagacugcugacagguaccaaguggaaucaacgcccgcucauagugugcuguuugucaacauguucgcugcccaugguucucagcucuucguuccucagugcucuuuuucaugcuuucuuucuuuuuuaauuuguuccgcauuuuggcaaaccaucugguuguaauauuguaacauuucuuauuuuuuuuccauaaguugccaguguguuuguguucgauuuaaaaaucauuauggaucuggaaaaaacaaugaaagcuauauaaaucuguauucaauuaagugcacauuagcuuaggugcaccaugauucucuuuugauaaaacguuaaggcuuucggucauauauauuuaaggaugcugacguuuauuuuaaguacauuuuuauuuguggauacucauaugagugaccagucauuauggucauauuagcaauuaguugccugguaucuaaauaggcacuaauguguuuuuuuuccugcuacugauguuuuuucagaccuuaccuuucugaauugaaaauauuugauaggcuaaaaugccacauuuauuagcugguuuauccuguucuuaaaccacaaaagcuuacuaauucucuuuuucauccaaacuuaccaaagugauagugcuucuaauagaaauauaauugaauugugccacucuuuauauauggagauaauacaaauuggacccugaucugcaggauguagcauuuaguuauauuuuuagugguauuaaaagcaggguuuauuagccaggccugguggcauaugccuguaaucccagcuacucgggaggcugaggcacaagaauugcuugaacccaggaggcagagguggcagugagcugagaucauugccacugcacuucagccugggugacacagcaagauagcaagaugccaucucaaaaaaaaaaaaagaaagaaagaaagaaaaaaaaaggaggguuugcccuuuagcuaacugucugcaagugccaguaaccuccgcuuggucagagggucagcuccaguuugaggcugcagccugggacccagaagagcaguaucucagggcagcauaaaugguuugcaucuauccuagcgggaccucaccgaugcuauguccuaacuacugagcuacccauccagauuugacgagagauagucacaaagaagugugcauuuaccccacggcccugcuguuuuccccuguaguucuuuaaaacauccaugggcauuagaagguucugugauagcuuuacuuaucuaacaaagcuggauuuuuuuuuucuuuucaucuguuguuuuacaauuuggugacuccuguuguccuuauuugauaugaucauuaauacaaguuuuuaaaaacagaaacauuuuagaguaauuuuaacacuuuuaucuugcccagaacauaaaaaaaucuucauuuucaauccuuauaacuuugugugagggaaauuaggcaucagggugggaaacagaggugacuuuuauuugucuaagucuaccaaauugcugaacuaguagguaaaacucccuuccucuuaacugagcugacugauuuuugcuagauuuuucuuuucguuucuucauuuuguuucuuccguuuccugggauuucaugugugauuucuuuuucuaaagcacaaccuuugggguguaguuaagagacauuuuucccuguguccccaccaccccuuccacacaugugcaggucuccccugagugcccagacagcgcaggaccacgcaguccacucccucugccccucagagauucugccucucucuccugaccugugccacauucuugugucaggaccccaccucccgcugcguuuucuucaacauaugagagucuagaugggcacagcauuuagaggagcugcccuauucugguguccuggggagagagacgugcuugugaccccggcugugcaggagcccugaaccuuucugggagcaccagcugcgggggccauggugggagcucacuugggugauuggcucauucaggucuccucccuccuugcugcugccucuggagggucugcuggccgggcuggacaugagcucuuuguagccaguguggacuggacccauuuggcccuaaguaacugaauuguguaccagucagcaguagggaugcauaacaccagagcuucauugauucaaaggcaaagcagguggcauuuuacugaacaauuaaauguuugaaguaaccuuuuauagagugagaaagaugucugucuaguuuuaagucuuucugaagagaaaugggcuggaauguuugguugguugcagcuauucuuguguucuuuuuaaaauaucugaaauuauacuuagauauggggcaggcuuuauuccuacccaaguagcagcgaucagcgaugcuggugcuaaccccuggucuuugucuguuucccuauugcugaccucaggcaccacacuguaacucgaggcaucaccaaaggcgugaaggaggacuuucgccuggccauggagcgccaggucucccgcuguggagagaaucugauggugguucugcacagguucugcauuaaugagaagaucuugcuccuucagacucugaccugaguggagaccuuuccaccagacacagcucgggccuguguaauuguaggagaagacacucagcagugauugccauggcacagagccguggucauuguugcuguuacaaagaagaaaaccaucugaguucuaacuccuugguugcuuaaaaguaguucccaagagucugagaagcuauuucuauuuuuaagagucauuuuuuguaauuuuuguaaaacaaaaguaccaaucuguuuuguaaauaaaaaucauccuaaaauuugaaguuuuuaaaaauuuaauucuuaugaguuuuugaacaggggugcauuuuucuucuuuucuaagcauauagcaagggggaaaauccagcauaauugaauugaguaaugaauuuuacuaauauagauacuuacuuaaaagacauaugucuuccaugaccuuaagauuuuauuuuccauaguuaggcuuuggucgguauugcauaucaacauaauauuagacguuuucauucaggugaucucuuuuuuagaaacaaggucucacucuacacccagguuagagugcaguggcacgaucauaacucacugcagccucaaacuccuggccucaagcaauccuccugccuccaaccucccaaguagcugggacuacaaguauacaccaccaugcucagcuauuuuuuuuuaauuuuauguagagacagggucucacuauguuacucaggugggucucaaacaucuggccuccagcaaucccaccucagccucccaaaguguugguauaacaggcaugagccaccauaccuggccucauucgggaaguuuuaacaccaaaaacauuuauguaaaaaugaauuugagccugaccucucccacugaugguccccugaaggagaggugcucagggcugcugaaaagcccaggacaggaaguggaggugagaggcaagguguggcagagcagccuccccauugcugucuggcuccaggaagucccugcugcugugccaggguggcccagugguuucuacccaggggcuuuggagccagguggccuuguguggcuuugcauccuggcuuugcccugcccuuacuugcuaug

SEQ ID NO: 15627 - RNA, 581 nt, Homo sapiens
aaaugggaagcauggugaaccccaaucugccguuccucaacucaacucaaugccuuccuggcuuacuuagaucugccuuggaagggacagaccugucucugaacacuguucuguuauuugauuuuucuaucugugccaauggguuuccaaucaaguuuguuuuuuccauuucaugcagguguauugggcugauguaucuaugacaagugguagguggguauuuuaagaaagcuugugucaucaucuucagguaacaggaauguaugagaguugggugccaaaacuuguggccgcccuguacaagagagaaccagacuccaaugucauugugguggacuggcugucacgggcucaggagcauuacccaguguccgcgggcuacaccaaacuggugggacaggauguggcccgguuuaucaacuggauggagguaagacugggagaaggagacuuauguguccaaaacaguguuuuugacuggagccagaaaaccggcuguucuuucuuccuuuucucuuagauuuaaauauuuucugggggcauucaaaucuucagaaucagcguggauauuauuuuauauc

SEQ ID NO: 15628 - RNA, 1891 nt, Homo sapiens
cuuaaaacccaugaaccuucagcugaucguccuuagccaguccaaucugaaaagacaaaagggcaaaguuuuaaaugggggacagggagaguuaaagccuccauuucuaauggcaacaacccugucuuccugcuacuacacugcccaagagccaggggugcgcacaaugguucaacagaggguccucaguuaagagcuaccuuuuuugaacacucagugccuuccaagguucugaauuagugugagaaugagacucaucagguaucugaaaucucuucaauuauaucaagagcugaucauguaacaguauuuuaguauuaauacucaggaaauucauuuuuaaaaacucauguccuuacaaauacaggaacaacccagcauuuggcuuauuuuacaaugcaucuauaugcuauucaaauuugcaucugugaaguagauccacagaaacaguaaaccaaagguagacaagucccuucugcuuuuuccuauaaaacagaaauaagucuauguacuuuaaaacccaacugagguuuugcucagccuuacaaagccaacuuuuauguccccagcagaagcuaacagacaggaucugagauuugccagcagagaggcacaaaucaaguagugacugaacucaccucuacgaggaacuggcauauguucuugcguuggucacccuguagcugaauuacuucuccauauuccggaugcucaauuacaguaccauugcaggcaaacuucugcaagcacaaaggaaaacgaauuaggccuagcaagagcaugaacgcauuuaucaccccuuccgcuaacaauacauacaacacagcuggcacccccuuguggacaaauccauuaugacuuucccaaaaucucacugaagaccuacuuucuuaaacgccuucacuaguuucuuuuuaucguaaucaucagcgaucccuuggacaguaguaagggucuuccugccguuucucuguugaauucuuauauggauauaauccucagugccagcaggaagcaggucaucacccuuacuugcaucagcaaaggggucugaaaaaaaagguuaagcucguucagagcugucaaagauaggaugccacugccauccccucgguccccagguguuuugcgcgugcagaaaacaacacugaaaucgucagggcuugggccaggccgaauguguccuuugcuggcucuccccgagcaggucaguccgggacggccagcuuccccaggcucggggaacgcccgggccucccgcccucccugggaagccgaucacaugucgggggaguccgggcugccaggcggugccccacccagcugaugcaacccgccggaacccgagcucccgaggcggggcuaagccucccacccccauuggugcacccgcuugccacuuagggcuggcaccgccuuucccuccggauccgugacaacggguggugacguaacggacgugacgcaauggugacgggaggggcggguguggcccgaggaggcccaggagccauuaguaaaugcgccacugagacgccgggcccgcccaagggcugaccuaccgccugcuccuuccggucgcgcucaggguccgaccccggggcccaggccuugaucccgcugcccugcgacccuggucaaguuuccccugcccgagcuuacgaaggcccggagcgcuuggcaacuucccggaacacgucuccgggcccggaaggccccgcugccccacccgggcccgcgaccuuucccauagcuuaccgaaagaguggagguucuggauagcggacauacgauacgauuccuuuuccucgguggaaacggccugcggaaggcggcggcggcgguggcgggagaaggcgggcaggggggaacggaacgucgggaagcgagg

SEQ ID NO: 15629 - RNA, 14186 nt, Homo sapiens
cagggcgacgcggaaccgaggcggcggcggcggcugcggcggcaggaaaucggggcucggccccgccggcgcgcgaccccauccccaucccggucccugcagagcgauccccgggcccagauauggacgcagcagagccggguagggggucggggauccgggaggggccucccccgaccauccccugcuuccuacauugagggcacacacuugucccgcuccguccugagagccaggagaggaguuccugaaugggaaggacccagggauccuccauuguggggagcccugugcccggauggguucaggaccccagcccuucacucccccucccccuuuugaucccucaccccagacgccugggggagggggcccaggaaggggaagugacugcuucugcuucugauuuuugugaugggggcagggugccacgacugcugagggagagggcaacgcgguaggauccccacagggccccucuguagcccuggggagucggcagugcuggucuaggccccuuaggagagggggcaggggggcagcaguagaaauguggcgggguccgacuugguguuuccggccgucuuugugucuguguuguguauguggagugucauucggucuuuaugucccucacggcuucagucucuccauguguguuucugccccaggcucugccuggcugucccuuguguauuuccaucugucuagcccgugguuccauugucagaccggcuuucuucucgggacagccugguugcaucuggggcaucuguuuuguugguuugcuucugggugcaggcagacccagggagugggugucucuguuccccgagcagcugucucuggucucugguggugugugaguccaucugccugccucgaguuggccccaaccaagccccccccagcccucucuuucucucucucacucuucccuuucucuuccacccccuccaaaugagacugguugaggugccguggguggagggaggcagugguuagcccauguauuacacuccccuccccuaggacuccccccagguccugagggcaggaagagguacagugacaucuuccggagccuggacaaccucgaaaucucacuggggaacgugugagucugagccuggaucacccccaaauccugccaagaugccccaagccccuaaccauuuaggugccuugcagucccauuuggaaccuguaacaucuggaccuacauaccuaauaaccagagaagucuaggaugggacccuccaaaaugccucgguauccuaaaagugucccccuaaauagacuggaaauccccaaagugguccuagaaccccuacauauccuuguaaccccuuaaaauauuugcgaucccuauaaucccacucuaugaaccucaaaguuaucuggggcccuucagaugcuuuuucaaguccuauuuaaaaaaaacucaccugauucccccaaaacaccauucuucagaccucccagacacaagagaugccacagaggugauguuugccacaaacaacccuaagguccccagcaccccuuggcaggacagacuggguguaagguggcauccugacacaccuuuaucccccaggacccuugagaugcuggcuggagacccucuacucucagaagacccagaaccugacaagaccccuacagccacuguugugaguggggaguaggggaacagggaggaagaccucaagcagagggggccuuaggaaggccaggccccugcccuguuugcuucugaauacugucucccucccgcacagaccaacgaagccagcuguuggagcggccccuccccagaggguccuguaccccucacagguaggggggucuggaggccaggacaguggggacagacaggagucuuuccuucaacaaaucaccacugauccccuguuccaugcaaggcaucguuuagguuuugggaauauggcaguacacacaacagaucucagucccagcccucagggagaccccaggcaggguggaggcugagguaggaggaucacuugaagccaggaauucgugaccaugcugggcaacaguaagacaccaucccuaccaaaagaaaaaauauuuuuuuaauuagcugggugugguggugugugccuguagucccagcuacuuuggaagcugaggcuggaggacugauuaagcccaggacuuugaggcugcagugagauacgauugugccacugcacuccagccuggaugacagagcaagaccauguccaaaaaaaucaaacacaaggccggacgcaguggcucacgccuguaaucccagcacuuuggaggcugaggcggguggaccacgaggucaggagaucgagaccauccuggcuaacauggugaaaccccaucucuacuaaaaauacaaaaaaauuuagccgggcgcaguggcgagugccuguagucccagauacucgggaggcugaggcaggagaauggcgggaacccaggaggcggagcuugcagugaggcaaaauagggccauugcacuccagccugagcgacagagcgagacuccgccucaaaaauaaaaauaaaaaaacccaucaaacacaggccgggcacgguggcucaugccuguaaucccagcacuuugggaggccgaggcgggcagaucaccugagauugggaguucgagaccagccugaccaacauagagaaaccucgucucuacuaaaaauacaaaaaauuagccgggcaugguggcgcaugccuguaaucccagcuacucaggaggcugaggcaggagaaucgcuugaacccgggaggcagagguuuuggugagccaaaaucgcgccauugcacucuagccugggcaacaagagcgaaacacagucucaaaaauaaauaaauaaauaauaaaauaauaaaaaauaaaaaacaaaaaacagugaaucuguaaaauugcaaccaggacaagugaucccaaaguaguguuuggggagcugugaggcuguaggacaggugccacugggcuggucugggggcuuagggaagacauccauagcagacuagggugcaaaggucagagguccauccaucuuccccaggggaggaacuggacuugcggcucauucggacaaagggggguguggacgcagcccuggaauaugccaagaccuggagccgcuaugccaaggaacugcuugccuggacugaaaagagagccagcuauggugaggaccucuuccgcccagccccaguuaccaggcaguccccagaccccagcuagacccagagcccggcucucucuucccccagagcuggaguuugcuaagagcaccaugaagaucgcugaagcuggcaagguguccauucaacagcagguagucaugaccagacccccccggagagcccaagcccccuagaaccccaccuuugucccccacagaucuucaguauccuccuacaccacucugucuuccccagagccacaugccucugcaguacaucuacacccuguuucuggagcacgaucucagccugggaacccuggccauggagacaguggcccagcagaaaagagacuacuaccaggugaggggggcaggguggaauguuacagaggucacccugcuauccugcuguccuucaggccugauccccucguuucccagcaagcugggaggaaggcaccacuaccaacgucgccauuucauugaugaggaagcugaggcccggggaugcuugggaacuugcccaagguuacccagcaaagauucaagcugggcuuccugugcaauugcaaaacuucacuuuacuuuuuuucuugagacagaauaucuugcucuuuugcccaggcuggggugcaauggugcgaucucagcucacugcaaccuccgcuucuuggguucaagcaauucacuugccucagccuccugaguagcugggauuacaggcgccugccaccacgcccggcuaauuuuuguauuuuuaguacagaugggguuucaccauguuggccaggcuggucuccaacuccugaccucagguaauccaccuaccucagcuucccaaaguggugggauuacaggcgugagccaccacgcccagccaaaaacuucguuuuuguuuguggggaggggaacgaggugcugaguguucucaggaggaaagccuuggugucucugcuuccaagcagaaaggauggggugacuacaugagacuucuggacucaggggucggggagagcaggucuggagaagaccccaggaggagaauacugacucagaaaaggguccagccuggcacgguggcucaugccuguaaucccagcacuucugggggccaaggagggaggauugcuugagcccaggaguuugagaccaaccugggcaacauagugagacccccugucucuacaaaaaaaaaaaaaaaguuuuuuaauuagcugggccuggugcacaugucugcagugcuagcuacuaggaggcugaggguggaggauugcuugaggccaggaguucgagacuaaccugggcaacauagugagaucccugucuuuaucuaccaaaaaaaauuuauuuauuuauuuuuuuuuuugagacagagucucacuuuaucauccaggcuggagugcaguggcaugaucucagcucacugcaaccucugccucccggguucaagugauucuccugccucagccucccgaguaggugggacuauaggagugugccaucacaucuuuauaauuuuuguauuuuuguagagacgggguuucaccauguuggucaggcuggucuugaacuccuggccucaggugaucugcccacuuuggccucccaagugcugggauuaaaggcaugagccacuacaccuggccaaccaaaaaaaaaaaaaaaaagaagaaauuguuuuuuaaauuaacuaggccuagugcacaugccuguaguccuagcuacugagaggcugaggcuggaggauugcuugaacucaagaguucaaguucaaugcugcagugagccaugauugcccacuugcacuccaaccugggcaacaagagcaaaacuccgucucgaaaaaaaaaaaaauagaguccagagguggcaaagcacauggcgcaggaauggaaggacuggguggcugcuucuggguuggcccuaaggcagcgucuccauccccauccccaacccuugccagccccucgccgccaaacggacugagauugagaaguggcggaaggaguucaaggagcaguggaugaaggagcagaagcggauggugaggcuuggaauugguggaaggguagggugagagagaggccgggacgcugaccuucucaucaucccccagaaugaggcggugcaggcacugcggcgcgcccagcugcaguaugugcaacgcagcgaggaccugcgggcacgcucccagggguccccugaggacucggccccccaggccucgccgggaccuagcaagcagcaggagcggcggcggcgcucgcgagaggaggcccaggccaaggugggcacccggccccgagccccuguagcgcuguggcgcccccugcccuccacucucgcccacacgcgccccaccccgcuccuggccucccguuuccccaggcgcaggaggccgaggcgcuguaccaggccuguguccgcgaggccaacgcgcggcagcaggaccuggagaucgccaagcagcgaaucgugucgcacgugcgcaagcugguguuucagggggaugaagugcugaggcgggugaggcccauccccaaggccauccuccccucaccccguuggggccccgacugagugccccacuccucgccccuaagccacccuggagacaccaggacuaggccauuucccucgacagccaguucccgcccccagacccacugucucggcuccgccccaugagguccuguccccuggaugaccagccccugcucugaccaugccuggguccccuggccgacugcccuaguuccuaagccgcccaggugcgucccaaacccugaccacguucgcgucucucaagccccgccccagcucuggcccugcccccaggcucccaggcuccgccccuccccaaccugcugucuccacccggcaggugacgcugagucucuucgggcugcggggggcgcaggcagagcguggcccccgcgccuucgccgcccuggccgagugcugugcgcccuuugagccgggccagcgcuaccaggaguuuguacgggcgcugcggcccgaggccccgccgcccccgccgcccgccuucuccuuccaggaguuccuucccuccuugaacaggugggucacuggagcagggagucgggaacgagccccggaaucgcgaugccaggcuguuggcaccgcaggcugguuacucgagguuagagaacgcaaagccuuaguggaauuuaguacuccaggcucucgggggccauaggagggugaauggguugucccaguccuaggggcaggggcaggaauguggggcuacuguauuucaggggccacaaugcccugggugucaggguuugcagacccaagugcuuggaguugguaccuagacaugaugccugggugccaucaccccaggccaguuuccugggauucaaaccuucaaacuucugucuucucagcuccccucuggacaucagaaagaagcucucugggccucuuccuccaaggcuggaugagaauucagcugagccaggcccuugggaggauccgggcacaggcuggcgcuggcaaggugagugcaaugagggccaggugggaguggugccaggaguucguuccaccaacacauaggugggcugcaggagugggguuugugagcaggggaccauccuuauugaccugugccaccuagggacuccaggccccacuccgggcagcgauguggacagcguggguggcggcagcgagucucggucccuggacucacccacuuccagcccagguagggauaggaccugguccugacccacacuccaccugugaccauccuccagccccuggccaagcucugacccucaaucuuuaacuaucuuugaccucugaccuaccccacaccccugaccuauuuccucaaccucuuuuuuuaccuuuuuaaaaauuauuuauuuauuuauuuguuuguuuauuugagacagucucauucugucgcccagccuggagugcaguggcgugaucucggcucacugcaaccuccaccucccagauucaagcgauucuccugucucagccucuggaguagcugggauuacaggugugcacuaccacgccggcugauuuuuguauuuuuuaguagagacgggguuucaccauguuggccaggcugaucucgaacuccugaccucaggugauccaccugccucggucucccaaagugcagggauuacaggugugugccaccacgcccggccuuuucuuuucuuuucuuucuuucuuuuuuuuuuuuuugagacagagucuugcucuguugcccaggcuggagcgcagugguacgaucuuggcucacugcaaccuccgccucccagguucaagcgauucucgugccucagccucccgaguagcugggacuacaggugccugccaccaugccugguuaauguuuguauuuuuaguagagacaagguuuugccauguuggccaggcuggugucaaacuccuugccucaugugauccuccugccucagcuucccaaagugcugggauuacaggugugagccacugcgcccggccuauuuccucaaccucuugauccagcuuaugaaccaccccccucagguugcugacccaauucuccaacccuuaaccacugaccuguccaaucccccuccugaccucugaccccuugggaauuagugggugguucuggaagcccuaaaaaccaggagugccucccauagcccaggaaucucccaugauuccucugaccccaggcgcuggcacgaggcagcuggugaaggcuucguccacaggcacugaguccucagaugacuuugaggagcgagacccuggugaggcugaagcaggguaggucaggaugggacagggcagggcaccaggcacuccugacccugucucccugcagaccugggagacgggcuggagaaugggcugggcagccccuucgggaaguggacacuguccagcgcggcucagacccaccagcugcggcgacugcggggcccagccaagugccgcgagugcgaagccuucauggucagcgggacggagugugaggagguguggccuggguuaaugaccaaaugaccuuugcugacccuugaucaucucccugaccugagauuccuacagccuuucugccccugggacccacccuaaccugaugucucccaugagcccccauuccuugaggauccuuguaaccuucucuuccccuacuggucccuaaugaccucccugucccugugaccuuccccacagugcuuucugaccugccacaagcgcugccuggagacucuccugauccucuguggacacaggcggcucccagcccggacaccccuuuuugggguugacuuccugcagcuacccagggacuucccggaggagguacccuuuguggucacgaagugcacggcugagauagaacaccgugcccuggaugugcaggugcugcccugacccuucaucauccccagaagugaccugaccgaaucgauggccuaucacgaaccaggugucuguuuuucacccucacccugcagggcauuuaccgggucagcgggucccggguccguguggagcggcugugccaggcuuucgagaauggccgagcguugguggagcugucggggaacucgccucaugacgucucgaguguccucaagcgauuucuucaggagguuggugcucaggacacugagggggacgcgggcaggagcccuccacagcccacccacacucguguugcgcccuccguuccacccccagcucaccgagcccgugauccccuuccaccucuacgacgccuucaucucucuggcuaagaccuugcaugcagacccuggggacgacccugggacccccagccccagcccugagguuauccgcucgcugaagacccucuugguacagcugccugacucuaacuacaacacccugcggcaccugguggcccaucuguucaggugugcaugggucccugagccuugaaacgcgacccuuuucccuggacaugcgacuacuaacuucccuggcugaccccugacacugaccucugaccuuugaccuguguuuucugaacucugaaccuuaauccaugauucauaacuuuggguacugaccccugaccuccaguucuggauauguggcugcuggucucagacgacuuacaccugugacaugggcaagucaccucuaggcuggccugcgugucccacccuuacccucagaccaaugagcuugcauccuguacccugaccuuucucuucacaccauccccaggguggcugcacgauuuauggaaaacaagaugucugccaacaaccugggcauuguguuugggccgacacugcugcggccgccggacggcccgcgggcagccagcgccaucccugucaccugccugcuggacucugggcaucaggcccagcuuguggaguuccucaucgugcacuacgagcagaucuuugggauggaugagcucccccaggccacugagcccccgccccaagacuccagcccagccccugggccccucacaaccagcucccaaccgccacccccgcaccuugacccagacucccagcccccaguccuagccucagaccccggcccagacccccagcaccacaguacccuggagcagcaucccacggccacaccuaccgagguaagaacccacugggcccacagcuauggagagggccuuaucucuguucaauucucuuaccuucucuuucaccuuccuuccuuuuuaaaauuuccuucauucucuuccucccuuccucauuuaacuuauguucauucuggaaggaauagugaggaaugagcagugggcagugaugauguaacaaaaggggacagcccugcagagguacuaacaugggugaucauucauuccuccaacagaauauuuauugaacauguauuuugggccaagcauugucguaggcauugcagauacauccaggagcuaaauauccaaagacccugcccucucagugccuguguuuuaguggggaaagaacaaccauauacaugacacaaagucaguuaucuggaaugugaugaggugaugaugauaaggguaauggaucaugaaaagguagaguaauggcugggcgcgguggcacacgccuguaaucccagcacuuugggaugcuggggcaggcaaaucaccugaggucaggaguucgagacuaauccaaccaauaaggagaaaccugucucuacuaaaaauacaaaaauuagccagguguggugguguguaccuguaaucccagcuacucaggaggcugaggcaggagaaucgcuugagcccaggaagcagagguuuuagugagccgagagcaugccacugcacuccagccuggacaauagagcaagacuuuguuucaaaaaaaaaaaaaaaaaguggaguaagacacaugacaccagggagcagcacggugggagguggaguuuguaucacuaaguaggauggugggggcacgucuuagagagcagacggacuugagcaaagacuggaaggacaugaaggagugagcuggcaacauggagaucaggugaaggguguuccaggcaaagggaacagccagugcaaaggcccugagguaggaucgugccugguguguuaggacgcagccccauccuguaaugaaugacaggaaggugguaugaagugauaccaaagaggagugggcccagguggcucugccagcuauccugaccuugcaucugcuauucacaggcacagaccaccacugaaugugcaccugcugugcaggggacacuauagaggcuuccuguuguccucuccacaguccugagagguagacaguguuaaugaaaaucauuuacagauuaaacaaugaaggcucugagcaguuaauggcccuaaaaggggacuguaagcaguuggaaucuuuuauuuuuuuuuggagacagaaucucacuguguugcccaacuggagugcaguggugcgaucucggcucaccacaaccuccgccucccggguucaagcaauucuaaugccucagagacaagguuucgccauguuagccaggcuggucuccaacccccuaccucaaguaacccacccaccucagccucccaaagugcugggauuauaggcgugagccaccacacccggccgcaguuggaauccuuuauuuuuuuagacggaguuucauucuuguugcccagguuggagugcgauggcgugaucucuguucaccguaaccuccaccuccuggauucaagcgauucuccugccucagccuccagaguaguugggauuacaggcaugcaccaccacacccagcuaauuuuuuuuguauuuuuaguagaguagggguuucuccauguuggucaggcuggucucaaacuccugaccucaggcgauccgcccuccucagccucccaaagugcugggauuacaggcaugagccacugcacccggccuagaaucuuuuuuuuuuuuuugagauggagucucgcucugucacccaggcuagagugcaguggugccaucuuggcucacugcaagcucugccucccagguucacgucauucuccugccucagccucccaaguagcugggacuacaggcacccgccaccacacccggcuaauuuuuuuguauuuuuaguagagacgggguuucaccguguuagccaggauggucucgaucuccugaccuugugauccacccgccucggccucccaaagugcugggauuacaggcuggagccacugcacccggccgccuggcguagaaucuuuaacaaaggucaccagucuggauccagagcucagcugugaaccaggaagauagcagcacccgcugcuccggauugcuagaacaguccaugcccaaggccugugcugcugguaucuugcugcaucugccauuccugagagcaaggaucucuccugcagcagcccagagcugggaagcggcugcuggugaacugugggucucugagagcuggaaugccucauaaagugcucgggacagugucugauguguagacacugccaaccauuuagcuaaggauggaacaguaaaguugguaagguugcagagagcagcccaggauaguaguucagaggcaccaccugguccuaauguggagagggcugagccacucccugggcuggccauuugcuaaacaaggauuuucccacccucauggagcccacgguccagacucaaugaaugacacugcucuaugcuggaagggcaagcaguacacuuauuauuauuuuugagacggagucucauucugucacccagacuggagugcaggggcaugaucugagcucacugcaaucuccaccucccagguccaagcgauucuccugccucagccucccuaguagcugggauuacaggcaugcaccaccacgcccggcuaaauuuuguauuucuaguagagacggaguuucaccauguuggccaggcuggucccgaacuccugaccucagauaauccaccaaccucagccucccaaagugcugggauuacaggcaugcaccaccaugccuggccaagcaguacacuuauaagggcaucgucuauccccaaacaccaaaacugcaaaggaugacaggugcacagucaguggugguccaugcccugugcauaggaggaguucaaugguaguccacacccagugcagaguaggugcaaagucagggguggcuggcagagccaccugggcccacuccucuuuggucucacuuccuaccaccuuucccucauucauuacaggguggggcugcguccuaacauaccaggcaugcuccuaccucagggccuuugcacuggcuauuccuuuugcauguccaggaacaagcccuuggcucuccaggaaucucaaagaacugggauuuuaguguuggggucucauucuuggguuucucccugcagauuccaacuccacagagugaccagagagaggacguggcugaagacaccaaagaugggggaggggaaggugaguauguuagagagaggcucaggaguucugggggugcccuggccccaggguggcuugcuaaaagaugacuccuggggggauauacagagaacuuggaggugcucugcacugaccacccaccccguacacaguguccagccaaggcccagaggacucacuccuggggacacagucucguggccacuucagccgccagccagugaaguauccccggggcggugugaggccuguaacccaccagcuguccagucuggcccugguggcuuccaagcugugcgaggagacccccaucacaucagugcccagagggaguuugcgggggcgggggcccagcccugcagcugccuccccugagggcagcccccugcgccgcaccccgcugcccaagcauuuugagauuacccaggagacagcccggcuacucucgaaauuggacagcgaggcugugcccagggccaccugcugcccggacguccagccugaggaagccgaggaccaucucugaccacccuggcaccuuaaauaaggaagaggcccagauugugaagacggacccauauaucccuaccucccaccaccuaguggccaaacaccccgccaggaguucaaugcugggagagguccagaggguuccuauaaggaaaaacuauuuaauacaugaccuaggggaggccuaaaacccuuuuggggauaaugucccagaguccccccacuagacacaggucacugccaagcaucagggccacucgggcucagaggucacucagggucaauacucagggucagugcagguuaugagauccuugggguccacccuagucucugacaccugggacaggggugcuuuugcuacuuugguuguggucacucccccacaccugccugccuccuucacggacucgaagugaccuuccuggaggaggugggcagcucagacuccacaugcugguggugccugaggucugauggccucuaauaaacuguguccuauaugcccuuggg

SEQ ID NO: 15630 - RNA, 14186 nt, Homo sapiens
cccaagggcauauaggacacaguuuauuagaggccaucagaccucaggcaccaccagcauguggagucugagcugcccaccuccuccaggaaggucacuucgaguccgugaaggaggcaggcaggugugggggagugaccacaaccaaaguagcaaaagcaccccugucccaggugucagagacuaggguggaccccaaggaucucauaaccugcacugacccugaguauugacccugagugaccucugagcccgaguggcccugaugcuuggcagugaccugugucuaguggggggacucugggacauuauccccaaaaggguuuuaggccuccccuaggucauguauuaaauaguuuuuccuuauaggaacccucuggaccucucccagcauugaacuccuggcgggguguuuggccacuagguggugggagguagggauauauggguccgucuucacaaucugggccucuuccuuauuuaaggugccaggguggucagagaugguccucggcuuccucaggcuggacguccgggcagcagguggcccugggcacagccucgcuguccaauuucgagaguagccgggcugucuccuggguaaucucaaaaugcuugggcagcggggugcggcgcagggggcugcccucaggggaggcagcugcagggcugggcccccgcccccgcaaacucccucugggcacugaugugaugggggucuccucgcacagcuuggaagccaccagggccagacuggacagcugguggguuacaggccucacaccgccccggggauacuucacuggcuggcggcugaaguggccacgagacuguguccccaggagugaguccucugggccuuggcuggacacuguguacgggguggguggucagugcagagcaccuccaaguucucuguauauccccccaggagucaucuuuuagcaagccacccuggggccagggcacccccagaacuccugagccucucucuaacauacucaccuuccccucccccaucuuuggugucuucagccacguccucucucuggucacucuguggaguuggaaucugcagggagaaacccaagaaugagaccccaacacuaaaaucccaguucuuugagauuccuggagagccaagggcuuguuccuggacaugcaaaaggaauagccagugcaaaggcccugagguaggagcaugccugguauguuaggacgcagccccacccuguaaugaaugagggaaaggugguaggaagugagaccaaagaggagugggcccagguggcucugccagccaccccugacuuugcaccuacucugcacuggguguggacuaccauugaacuccuccuaugcacagggcauggaccaccacugacugugcaccugucauccuuugcaguuuugguguuuggggauagacgaugcccuuauaaguguacugcuuggccaggcaugguggugcaugccuguaaucccagcacuuugggaggcugagguugguggauuaucugaggucaggaguucgggaccagccuggccaacauggugaaacuccgucucuacuagaaauacaaaauuuagccgggcgugguggugcaugccuguaaucccagcuacuagggaggcugaggcaggagaaucgcuuggaccugggagguggagauugcagugagcucagaucaugccccugcacuccagucugggugacagaaugagacuccgucucaaaaauaauaauaaguguacugcuugcccuuccagcauagagcagugucauucauugagucuggaccgugggcuccaugagggugggaaaauccuuguuuagcaaauggccagcccagggaguggcucagcccucuccacauuaggaccagguggugccucugaacuacuauccugggcugcucucugcaaccuuaccaacuuuacuguuccauccuuagcuaaaugguuggcagugucuacacaucagacacugucccgagcacuuuaugaggcauuccagcucucagagacccacaguucaccagcagccgcuucccagcucugggcugcugcaggagagauccuugcucucaggaauggcagaugcagcaagauaccagcagcacaggccuugggcauggacuguucuagcaauccggagcagcgggugcugcuaucuuccugguucacagcugagcucuggauccagacuggugaccuuuguuaaagauucuacgccaggcggccgggugcaguggcuccagccuguaaucccagcacuuugggaggccgaggcggguggaucacaaggucaggagaucgagaccauccuggcuaacacggugaaaccccgucucuacuaaaaauacaaaaaaauuagccgggugugguggcgggugccuguagucccagcuacuugggaggcugaggcaggagaaugacgugaaccugggaggcagagcuugcagugagccaagauggcaccacugcacucuagccugggugacagagcgagacuccaucucaaaaaaaaaaaaaagauucuaggccgggugcaguggcucaugccuguaaucccagcacuuugggaggcugaggagggcggaucgccugaggucaggaguuugagaccagccugaccaacauggagaaaccccuacucuacuaaaaauacaaaaaaaauuagcugggugugguggugcaugccuguaaucccaacuacucuggaggcugaggcaggagaaucgcuugaauccaggagguggagguuacggugaacagagaucacgccaucgcacuccaaccugggcaacaagaaugaaacuccgucuaaaaaaauaaaggauuccaacugcggccgggugugguggcucacgccuauaaucccagcacuuugggaggcugagguggguggguuacuugagguaggggguuggagaccagccuggcuaacauggcgaaaccuugucucugaggcauuagaauugcuugaacccgggaggcggagguuguggugagccgagaucgcaccacugcacuccaguugggcaacacagugagauucugucuccaaaaaaaaauaaaagauuccaacugcuuacaguccccuuuuagggccauuaacugcucagagccuucauuguuuaaucuguaaaugauuuucauuaacacugucuaccucucaggacuguggagaggacaacaggaagccucuauaguguccccugcacagcaggugcacauucagugguggucugugccugugaauagcagaugcaaggucaggauagcuggcagagccaccugggcccacuccucuuugguaucacuucauaccaccuuccugucauucauuacaggauggggcugcguccuaacacaccaggcacgauccuaccucagggccuuugcacuggcuguucccuuugccuggaacacccuucaccugaucuccauguugccagcucacuccuucauguccuuccagucuuugcucaaguccgucugcucucuaagacgugcccccaccauccuacuuagugauacaaacuccaccucccaccgugcugcucccuggugucaugugucuuacuccacuuuuuuuuuuuuuuuuugaaacaaagucuugcucuauuguccaggcuggagugcaguggcaugcucucggcucacuaaaaccucugcuuccugggcucaagcgauucuccugccucagccuccugaguagcugggauuacagguacacaccaccacaccuggcuaauuuuuguauuuuuaguagagacagguuucuccuuauugguuggauuagucucgaacuccugaccucaggugauuugccugccccagcaucccaaagugcugggauuacaggcgugugccaccgcgcccagccauuacucuaccuuuucaugauccauuacccuuaucaucaucaccucaucacauuccagauaacugacuuugugucauguauaugguuguucuuuccccacuaaaacacaggcacugagagggcagggucuuuggauauuuagcuccuggauguaucugcaaugccuacgacaaugcuuggcccaaaauacauguucaauaaauauucuguuggaggaaugaaugaucacccauguuaguaccucugcagggcuguccccuuuuguuacaucaucacugcccacugcucauuccucacuauuccuuccagaaugaacauaaguuaaaugaggaagggaggaagagaaugaaggaaauuuuaaaaaggaaggaaggugaaagagaagguaagagaauugaacagagauaaggcccucuccauagcugugggcccaguggguucuuaccucgguagguguggccgugggaugcugcuccaggguacuguggugcugggggucugggccggggucugaggcuaggacugggggcugggagucugggucaaggugcggggguggcgguugggagcugguugugaggggcccaggggcugggcuggagucuuggggcgggggcucaguggccugggggagcucauccaucccaaagaucugcucguagugcacgaugaggaacuccacaagcugggccugaugcccagaguccagcaggcaggugacagggauggcgcuggcugcccgcgggccguccggcggccgcagcagugucggcccaaacacaaugcccagguuguuggcagacaucuuguuuuccauaaaucgugcagccacccuggggauggugugaagagaaaggucaggguacaggaugcaagcucauuggucugaggguaagggugggacacgcaggccagccuagaggugacuugcccaugucacagguguaagucgucugagaccagcagccacauauccagaacuggaggucaggggucaguacccaaaguuaugaaucauggauuaagguucagaguucagaaaacacaggucaaaggucagaggucagugucaggggucagccagggaaguuaguagucgcauguccagggaaaagggucgcguuucaaggcucagggacccaugcacaccugaacagaugggccaccaggugccgcaggguguuguaguuagagucaggcagcuguaccaagagggucuucagcgagcggauaaccucagggcuggggcugggggucccagggucguccccagggucugcaugcaaggucuuagccagagagaugaaggcgucguagagguggaaggggaucacgggcucggugagcuggggguggaacggagggcgcaacacgagugugggugggcuguggagggcuccugcccgcgucccccucaguguccugagcaccaaccuccugaagaaaucgcuugaggacacucgagacgucaugaggcgaguuccccgacagcuccaccaacgcucggccauucucgaaagccuggcacagccgcuccacacggacccgggacccgcugacccgguaaaugcccugcagggugagggugaaaaacagacaccugguucgugauaggccaucgauucggucaggucacuucuggggaugaugaagggucagggcagcaccugcacauccagggcacgguguucuaucucagccgugcacuucgugaccacaaaggguaccuccuccgggaagucccuggguagcugcaggaagucaaccccaaaaagggguguccgggcugggagccgccuguguccacagaggaucaggagagucuccaggcagcgcuuguggcaggucagaaagcacuguggggaaggucacagggacagggaggucauuagggaccaguaggggaagagaagguuacaaggauccucaaggaaugggggcucaugggagacaucagguuagggugggucccaggggcagaaaggcuguaggaaucucaggucagggagaugaucaagggucagcaaaggucauuuggucauuaacccaggccacaccuccucacacuccgucccgcugaccaugaaggcuucgcacucgcggcacuuggcugggccccgcagucgccgcagcuggugggucugagccgcgcuggacaguguccacuucccgaaggggcugcccagcccauucuccagcccgucucccaggucugcagggagacagggucaggagugccuggugcccugcccugucccauccugaccuacccugcuucagccucaccagggucucgcuccucaaagucaucugaggacucagugccuguggacgaagccuucaccagcugccucgugccagcgccuggggucagaggaaucaugggagauuccugggcuaugggaggcacuccugguuuuuagggcuuccagaaccacccacuaauucccaaggggucagaggucaggagggggauuggacaggucagugguuaaggguuggagaauugggucagcaaccugaggggggugguucauaagcuggaucaagagguugaggaaauaggccgggcgcaguggcucacaccuguaaucccagcacuuugggaagcugaggcaggaggaucacaugaggcaaggaguuugacaccagccuggccaacauggcaaaaccuugucucuacuaaaaauacaaacauuaaccaggcaugguggcaggcaccuguagucccagcuacucgggaggcugaggcacgagaaucgcuugaaccugggaggcggagguugcagugagccaagaucguaccacugcgcuccagccugggcaacagagcaagacucugucucaaaaaaaaaaaaaagaaagaaagaaaagaaaagaaaaggccgggcgugguggcacacaccuguaaucccugcacuuugggagaccgaggcagguggaucaccugaggucaggaguucgagaucagccuggccaacauggugaaaccccgucucuacuaaaaaauacaaaaaucagccggcgugguagugcacaccuguaaucccagcuacuccagaggcugagacaggagaaucgcuugaaucugggagguggagguugcagugagccgagaucacgccacugcacuccaggcugggcgacagaaugagacugucucaaauaaacaaacaaauaaauaaauaaauaauuuuuaaaaagguaaaaaaagagguugaggaaauaggucaggggugugggguaggucagaggucaaagauaguuaaagauugagggucagagcuuggccaggggcuggaggauggucacagguggagugugggucaggaccagguccuaucccuaccugggcuggaagugggugaguccagggaccgagacucgcugccgccacccacgcuguccacaucgcugcccggaguggggccuggagucccuagguggcacaggucaauaaggaugguccccugcucacaaaccccacuccugcagcccaccuauguguugguggaacgaacuccuggcaccacucccaccuggcccucauugcacucaccuugccagcgccagccugugcccggauccucccaagggccuggcucagcugaauucucauccagccuuggaggaagaggcccagagagcuucuuucugauguccagaggggagcugagaagacagaaguuugaagguuugaaucccaggaaacuggccuggggugauggcacccaggcaucaugucuagguaccaacuccaagcacuugggucugcaaacccugacacccagggcauuguggccccugaaauacaguagccccacauuccugccccugccccuaggacugggacaacccauucacccuccuauggcccccgagagccuggaguacuaaauuccacuaaggcuuugcguucucuaaccucgaguaaccagccugcggugccaacagccuggcaucgcgauuccggggcucguucccgacucccugcuccagugacccaccuguucaaggagggaaggaacuccuggaaggagaaggcgggcggcgggggcggcggggccucgggccgcagcgcccguacaaacuccugguagcgcuggcccggcucaaagggcgcacagcacucggccagggcggcgaaggcgcgggggccacgcucugccugcgccccccgcagcccgaagagacucagcgucaccugccggguggagacagcagguuggggaggggcggagccugggagccugggggcagggccagagcuggggcggggcuugagagacgcgaacguggucaggguuugggacgcaccugggcggcuuaggaacuagggcagucggccaggggacccaggcauggucagagcaggggcuggucauccaggggacaggaccucauggggcggagccgagacagugggucugggggcgggaacuggcugucgagggaaauggccuaguccuggugucuccaggguggcuuaggggcgaggaguggggcacucagucggggccccaacggggugaggggaggauggccuuggggaugggccucacccgccucagcacuucaucccccugaaacaccagcuugcgcacgugcgacacgauucgcugcuuggcgaucuccagguccugcugccgcgcguuggccucgcggacacaggccugguacagcgccucggccuccugcgccuggggaaacgggaggccaggagcgggguggggcgcgugugggcgagaguggagggcagggggcgccacagcgcuacaggggcucggggccgggugcccaccuuggccugggccuccucucgcgagcgccgccgccgcuccugcugcuugcuaggucccggcgaggccuggggggccgaguccucaggggaccccugggagcgugcccgcagguccucgcugcguugcacauacugcagcugggcgcgccgcagugccugcaccgccucauucugggggaugaugagaaggucagcgucccggccucucucucacccuacccuuccaccaauuccaagccucaccauccgcuucugcuccuucauccacugcuccuugaacuccuuccgccacuucucaaucucaguccguuuggcggcgaggggcuggcaaggguuggggauggggauggagacgcugccuuagggccaacccagaagcagccacccaguccuuccauuccugcgccaugugcuuugccaccucuggacucuauuuuuuuuuuuuucgagacggaguuuugcucuuguugcccagguuggagugcaagugggcaaucauggcucacugcagcauugaacuugaacucuugaguucaagcaauccuccagccucagccucucaguagcuaggacuacaggcaugugcacuaggccuaguuaauuuaaaaaacaauuucuucuuuuuuuuuuuuuuuuugguuggccagguguaguggcucaugccuuuaaucccagcacuugggaggccaaagugggcagaucaccugaggccaggaguucaagaccagccugaccaacauggugaaaccccgucucuacaaaaauacaaaaauuauaaagaugugauggcacacuccuauagucccaccuacucgggaggcugaggcaggagaaucacuugaacccgggaggcagagguugcagugagcugagaucaugccacugcacuccagccuggaugauaaagugagacucugucucaaaaaaaaaaauaaauaaauaaauuuuuuuugguagauaaagacagggaucucacuauguugcccagguuagucucgaacuccuggccucaagcaauccuccacccucagccuccuaguagcuagcacugcagacaugugcaccaggcccagcuaauuaaaaaacuuuuuuuuuuuuuuuguagagacagggggucucacuauguugcccagguuggucucaaacuccugggcucaagcaauccucccuccuuggcccccagaagugcugggauuacaggcaugagccaccgugccaggcuggacccuuuucugagucaguauucuccuccuggggucuucuccagaccugcucuccccgaccccugaguccagaagucucauguagucaccccauccuuucugcuuggaagcagagacaccaaggcuuuccuccugagaacacucagcaccucguuccccuccccacaaacaaaaacgaaguuuuuggcugggcgugguggcucacgccuguaaucccaccacuuugggaagcugagguagguggauuaccugaggucaggaguuggagaccagccuggccaacauggugaaaccccaucuguacuaaaaauacaaaaauuagccgggcgugguggcaggcgccuguaaucccagcuacucaggaggcugaggcaagugaauugcuugaacccaagaagcggagguugcagugagcugagaucgcaccauugcaccccagccugggcaaaagagcaagauauucugucucaagaaaaaaaguaaagugaaguuuugcaauugcacaggaagcccagcuugaaucuuugcuggguaaccuugggcaaguucccaagcauccccgggccucagcuuccucaucaaugaaauggcgacguugguaguggugccuuccucccagcuugcugggaaacgaggggaucaggccugaaggacagcaggauagcagggugaccucuguaacauuccacccugccccccucaccugguaguagucucuuuucugcugggccacugucuccauggccaggguucccaggcugagaucgugcuccagaaacaggguguagauguacugcagaggcauguggcucuggggaagacagagugguguaggaggauacugaagaucugugggggacaaaggugggguucuagggggcuugggcucuccgggggggucuggucaugacuaccugcuguugaauggacaccuugccagcuucagcgaucuucauggugcucuuagcaaacuccagcucugggggaagagagagccgggcucugggucuagcuggggucuggggacugccugguaacuggggcugggcggaagagguccucaccauagcuggcucucuuuucaguccaggcaagcaguuccuuggcauagcggcuccaggucuuggcauauuccagggcugcguccacaccccccuuuguccgaaugagccgcaaguccaguuccuccccuggggaagauggauggaccucugaccuuugcacccuagucugcuauggaugucuucccuaagcccccagaccagcccaguggcaccuguccuacagccucacagcuccccaaacacuacuuugggaucacuuguccugguugcaauuuuacagauucacuguuuuuuguuuuuuauuuuuuauuauuuuauuauuuauuuauuuauuuuugagacuguguuucgcucuuguugcccaggcuagagugcaauggcgcgauuuuggcucaccaaaaccucugccucccggguucaagcgauucuccugccucagccuccugaguagcugggauuacaggcaugcgccaccaugcccggcuaauuuuuuguauuuuuaguagagacgagguuucucuauguuggucaggcuggucucgaacucccaaucucaggugaucugcccgccucggccucccaaagugcugggauuacaggcaugagccaccgugcccggccuguguuugauggguuuuuuuauuuuuauuuuugaggcggagucucgcucugucgcucaggcuggagugcaauggcccuauuuugccucacugcaagcuccgccuccuggguucccgccauucuccugccucagccucccgaguaucugggacuacaggcacucgccacugcgcccggcuaaauuuuuuuguauuuuuaguagagaugggguuucaccauguuagccaggauggucucgaucuccugaccucgugguccacccgccucagccuccaaagugcugggauuacaggcgugagccacugcguccggccuuguguuugauuuuuuuggacauggucuugcucugucauccaggcuggagugcaguggcacaaucguaucucacugcagccucaaaguccugggcuuaaucaguccuccagccucagcuuccaaaguagcugggacuacaggcacacaccaccacacccagcuaauuaaaaaaauauuuuuucuuuugguagggauggugucuuacuguugcccagcauggucacgaauuccuggcuucaagugauccuccuaccucagccuccacccugccuggggucucccugagggcugggacugagaucuguuguguguacugccauauucccaaaaccuaaacgaugccuugcauggaacaggggaucaguggugauuuguugaaggaaagacuccugucuguccccacuguccuggccuccagaccccccuaccugugagggguacaggacccucuggggaggggccgcuccaacagcuggcuucguuggucugugcgggagggagacaguauucagaagcaaacagggcaggggccuggccuuccuaaggcccccucugcuugaggucuuccucccuguuccccuacuccccacucacaacaguggcuguaggggucuugucagguucugggucuucugagaguagagggucuccagccagcaucucaaggguccugggggauaaaggugugucaggaugccaccuuacacccagucuguccugccaaggggugcuggggaccuuaggguuguuuguggcaaacaucaccucuguggcaucucuugugucugggaggucugaagaaugguguuuugggggaaucaggugaguuuuuuuuaaauaggacuugaaaaagcaucugaagggccccagauaacuuugagguucauagagugggauuauagggaucgcaaauauuuuaagggguuacaaggauauguagggguucuaggaccacuuuggggauuuccagucuauuuagggggacacuuuuaggauaccgaggcauuuuggagggucccauccuagacuucucugguuauuagguauguagguccagauguuacagguuccaaaugggacugcaaggcaccuaaaugguuaggggcuuggggcaucuuggcaggauuugggggugauccaggcucagacucacacguuccccagugagauuucgagguuguccaggcuccggaagaugucacuguaccucuuccugcccucaggaccuggggggaguccuaggggaggggaguguaauacaugggcuaaccacugccucccuccacccacggcaccucaaccagucucauuuggaggggguggaagagaaagggaagagugagagagagaaagagagggcuggggggggcuugguuggggccaacucgaggcaggcagauggacucacacaccaccagagaccagagacagcugcucggggaacagagacacccacucccugggucugccugcacccagaagcaaaccaacaaaacagaugccccagaugcaaccaggcugucccgagaagaaagccggucugacaauggaaccacgggcuagacagauggaaauacacaagggacagccaggcagagccuggggcagaaacacacauggagagacugaagccgugagggacauaaagaccgaaugacacuccacauacacaacacagacacaaagacggccggaaacaccaagucggaccccgccacauuucuacugcugccccccugcccccucuccuaaggggccuagaccagcacugccgacuccccagggcuacagaggggcccuguggggauccuaccgcguugcccucucccucagcagucguggcacccugcccccaucacaaaaaucagaagcagaagcagucacuuccccuuccugggcccccucccccaggcgucuggggugagggaucaaaagggggagggggagugaagggcugggguccugaacccauccgggcacagggcuccccacaauggaggaucccuggguccuucccauucaggaacuccucuccuggcucucaggacggagcgggacaagugugugcccucaauguaggaagcaggggauggucgggggaggccccucccggauccccgacccccuacccggcucugcugcguccauaucugggcccggggaucgcucugcagggaccgggauggggauggggucgcgcgccggcggggccgagccccgauuuccugccgccgcagccgccgccgccgccucgguuccgcgucgcccug

SEQ ID NO: 15631 - RNA, 7216 nt, Homo sapiens
acuggcugccucauuuucucauucaucaaaagaaacaaggauuuauugagccccuacuguaugcuuggcacucacggggaccacagaacagcccugguacagugggagaacacagguucagaaggaguuugucacuuggucacacagugagcaagaagaggcagaauucaaacccaaaccgaccuggucccaaaacucagagauagguuuccuagagaugacgugacaguaaagagggccccagggggaccccaguacuccugcaggcaagacuucgggacuggggucucccacggccgggauggccuuguccauggaucauguccccccagcugccugucaacgccgaggacuucggcuggguccugaccucuuagcacagaucgccgcuuagagccugguggguguugaauuuuaaagaacauuccaucccuccuggaucucuaaggagggaaaugugggugggggucagggaaggagagaggaacugggugagaauggagauggggucucagaggacaaaagaggagcucagugcuugcauaucucaacagaccagggcacgccauaggcucgguuuccucauuuguaggacgacgacaaacaugcccggguguugcaagauugucucgugcacagcugcuauccggcauagaguuaacgugcaaacggaggguggcuuagcagcuccagaaguccagcccugucuggggaaggggcagccaucaggccccugauggggugcaguaggguagcccuaguaggaggcacccaggacuucuggcccacaaugagaaguuccugagaacuggaagucugguugucaugaggacaacguugacagucucuauggcaacagcuuggugaacagggccccguuguccacaaggaaaagccuagggggacagguguucuguuaccucggacuccagaguuuggucaccauggcaacaguggugggguccaaaccgccuggggguggagcauggaggguggucuggaacuggagugggccuggggacagggacaguuuguuuccauggugagagccggagaacuggauguugggucacccuggcgacagcuucggggagggugaucuccauggcggugagucaggguagggacagccagaaguugagguggaggucucuggggugggggccaaugagaugagaaaugugugguauccaugguuacagcuggaggagggaggcacugucuucaugggugugccugaugagggaaggggugugugacucuaggugacagguagcagcaggacugguugccuuggugacagugggacccaaggcaacugcucugcauaacuagugacauggaucuuaccgguccccaggccugggaagauggucuguuuggugacaguugggaaagggacgucagaggacaggguggguuugcucucccuucaaagaaauaucugaggggugggacguggcccccaguaagugagccagcuggcugugugucagucugagguggcagaugggggugcucgcccaugaaacuagaggggugugcccuguuacccagaaacugcaggggacucucagggagagggggagaaugggagucuccaggacucaggucaccauaagggaaaauaagcgccucggcccacaaccuccaugugaccacggggagugacccugaaguuccuguagucucuccaggugaggaggagggggaggaggaggcgcccagugucccacgugaccgcaagggacuaguguucagucuccagugagaugcagaagguguacggccggucucuagucaaucccggggguccagccaccaggcgaccacgggggcaguuggucuguuuccaaguggucucaggaggcguggccagucuucaggagccugcggguucugcuggccuccugagguccucagggggcgugacccucauggagaaaguuggggaguugggggaauccucuauccagaagaggugagggcuggccaggcuccagggaacuccaaaguacuguucugccaggacuagccagucuucagggaccccaggggcacaguuaguuuguaagggaccacagggaauguggccaguguccagggcuucaagggcguggccaggcuccaggggaccacagggcucuagaccaguggucaagcgcccuggcuguccgccuacucccagccuagacgugcagagggguccaggcagcaggaucgcgcgcgcccccugcccagccgccgccgcccgcccagccccagccccagccgccaggugccggguccggugcuccuggagcgcgguagcaguagacgccgaagagccgucggguggcguccgggaagccgaggcugcgcacaccaggccugcggccuccgcagcgcgcucgcggguucacgaugggguagcgcgcacugccaucggccagccaacccgcggugcagcggucuagcagcugcagcuuccacgcggcgaacagcugccccaccuuggccacggccgcgccacgcgcagcacacgcgcgcgcagcuccggagaaggguacaggucgcagcggcuucaggaagaacacgcgcccugcgggggugaggugggggguggguuauuagugcggcuccugggacccugcuucggugggauucaggacugccccccgcaugcagccuaggacucuggccucggccccgggauccaggaacaguuccuccuuugcagccugggaccccagccuaggcccaaccagcguugguaccaggcggugugugcugcgccuaggcacucuugggagaggggucuccuguuucugaucgcuaagagcuggguggggaagaaggccccgggguugggguaguguugcagcagaggccagucuuggggugaggccuacgcacccggcagguuggacgugaagcagaaggcgucguagcguuccucggcguuauggcgauacccguaguugcgcaggcccccguuggcaucaccgccgcccccugcacucccggucccccccaggccgccgcagggcucccggggccgguucacgggguauugcacugagccgucgcgcaaccagcccgcguugcaccaguccaggccgucgcgccaggccgcgugcagcuguucugcagaugccaggaugccguccugcucggcgcacgcgcgcugcgccuccgcgaaggucagcuuguaucggccuccacgggggugguagggaaagaccacgccuggcggggggcgcacgggaucagcagguacaccccagcccacccucaugcaccugacgucuggggugcuaugugacucuucaaccgggaccuuucaguccauuccuccucacucuggccucagaccugaccacgauccuccccagcucacaccccauauagcugucucccuucacuuuaagcuugggauucacuugacccucccccuuaacauacuauuuguguccauccccuuccaccucuggaggacuuugcucaugcucuuuccaccuuauucuaccuguugaacuccuauucauccuucaaaauccaacucccaaacccucuuccauugaguccugugugccucugacauuccgccaguacugggucccucccucugguccagcccugagcccacggagccugcguucagugcugacucuccuagacuaggacccccuggaagauuggcccuaggugaagaccccuuugauucccccagcauuguccaagggaguacccacuggguucccuucuaccuucaguucugaugacuuuggaacuugucccucauuggacucacaguccguucagcucaaguauuuugugugucuguguuugagggacgcggguugggggugagugggguacccuggaaagaggcagacaggguccagggagaaggccuggagcugacagacuggggauugaauccugucucugccaccaacuagcacuguccugggcaaggcucuaaccucucugagccuguuguccaucugcugguaauagcugucucccuugggguuuuuaggaaauuaaauuagagacuccugagaacucuucaacuaagcaccugccacagaaaauguccaguaaaggagagcugcugcuauuauuguuguuauuuguuauuguuagggaggucagcaagcaagggcccugaaaucucaccuagaaucuucuaaagagaacuggaaaaggccaaucaaaugggagggaauucuucaaauagaaaccccaccucccagcuccagggugagccaaucagagcaucccaucuuccagcuacagugauuggcucacaguugggcacaugacucaagcugagccagugagggacaacucugggacucuagcugcugcuccuaggaaaucaguugcuaagcagggaagugaaagccuaggcacuguggucuugguuccagaaagagaagccugucggaagaaagccuaccugggaagcagagcagaaggaugguuccugacacggugugagugccuggaucucacugugccugaauccuaucccaggacuucucaguguccucauuguggacauuuuggacuggaucacuuuuauuuuauuuuauuuauguauuuauuuauuuauuuuugagauggagucucgcucugucgcccaggcuggagugcaguggcacgaucuccacucaccgcaaccuccaccucccggguucaagagauuuuccugccucagccucccaaguagcuagaauuacaggaaugcaccaccaugccuggcuaauuuuuguauuuuuacuagagaugggguuuuggcauguuggccaggcuggucuugaacuccugaccucaggugauccgccugccucaaccucccaaagugcugggauuacagucgugagccaccaugcccggccuggaucacuccuugugggggacuauccugugccugguaggauguauagcugcaucccuggccucuacccacuaggggcuaguagcaacugccuucuccagaugugacaacguaaaauaucuccagacaucgccaaugucccuggggaggaaaaucacccagaaccagauaugggggcucuaccccaaccaaccuucuaaaugccugcaggccaacuugauuugguuuaugucccuugccauccccgccccccuccuuccucagaagcaagguuuauccuccccaccggcugaucaccuuccagguccagcuugaccaugccagcgucaucuuccagcucauuggugacuucgcacucauagcgcccguagucuugcagcgugacguugcggaggaccagggaggcauccccaggcccgucgcccugcagcucagcccgcccacgguagcugccgaaugcccggugcugggggccuagugccacgaagacgucggugaaggccagcggguccaccaccuuuguccacuugagccggacgccgucgugaccgugggcggcugccucauagugguagcggcagggcaagacgauggugccaccacgguggcuuaccaccugcccaggcgcugucuguaccacuaccgagcccgacucacccucugaggacaaccaagcaggguucagaggaggggccuaggggcagaagggggccucuggggaaggugucucuggggaggggaacgugggaagacucgggugggggucggggaaucagaaggguccaggggcucagggagagggcgaggggcucagauggggaguggcugggggaaccgcggacgucaggaacgcccuacccgcuaccccucuccgcacuuggccacuucugcuuuucgcggagaagaccacuuuuagcggcccugacucacccagcacgugcacgaccuucuuccggccacgcugcgcccccgcaggggcugugagcagcaggacgccccaggccgcggcccagagcgcgccgggaccgagggccgcccgagcgcacaccuggggggcgggcacggggcgcucaguccagccucccagccuuggcuuuucggaggccuggcucccucccgggccugccuuccccacagcgaggaccucucucacgcccauguccccacccuuuccgggguccuggagaacucccccuccuccucuugggaccucacauccuagcuucugcaagaacccacgccccuagacucccccccgcccucaguccugccccagaucccgccucauucccccccaccccaaaacccgaggcucgcugccccgcccccuucuggcccuggcccgggccggggauagggggguggggaagagcuggaggagcggcggcagcaagguuauccgugcgccaggagacugcagcaaaccgggccggggcgggcagggaggggggagagcuggagagaaagagggagagacgcggggagagaacagggacagagagaaaggcagggagaggcagagaagagagugcgcgacacagaaaaaggggaagggaagagagagaggcagagauggagagggagagacagauggaaaagaagagacagauguagagggagagacagagauggagagggagagacagagaggcagagggagagacagaggggcagaggaagauacagagauggagagggaaagacagagauggaaagggagagacagagaggaagagacagagaagcagagggagagagagagaggcagaggaagagacagagauggagagggagagacacagauggagagggagagacagagaggcagagggagacagagaggcagagggagagacagagaggcagagggagcgacagagagggagagggagagacagaaagggagagggagagacaggagagugccagaggcagagagacucagagaagaggagggagagauagggacagggaaagacagaaacggagaggagaggaaaaaggcagagaggaugacagagauggagagaggcagggagaaauggagagggagagaaccuagagugccaaaaagagagaucaaagagggugagagacagagaaaaggaagagacagaagaaacucagagggauauagauucagaggcagagagauauagaauccaagauuggggagacggggcacacaccacccgcgcccgcagccccacuuaccaucuugcccgcgcggcccccgccgagcggccccuacgcacccggacugcgcuccccgcacacccgguuaagacugggcaggucccugcaggcggcgcaaucccggcgucugcc

SEQ ID NO: 15632 - RNA, 3543 nt, Homo sapiens
ggcgccugaauuacaacacgcaugcgccaagcccacgcgguuccgggucccaagauuuggcuccaagagcuauucgcagagaaacagccucgcacaaaaagccaccgcccccgaaacccgcgggaaaucuguuuccugugaaaggccuggccuccgggcauuggcgguuucccugauccucucucccaaauuuuccggcaggggauugaucgaggcgacauuuaggacuggggugggcgagggaguggcgguucucgucccaaguuacaggugaggacguucaggccaaggcguagccaagaucgcgccgcccuguagcuugaggaggcgccgggauucgaaccaaggcugugcccaauccuaagcccugcgaggucuuguggaaccgacaugacccacucuuugguuuguccagagacagugagcagguaagagucuguggggacaggcaguggcgaggcccuaagccuggggucgagcccucaguggacagaucugggggucaggcccuccgcggagcugagagcuggucucagccccucucuucgccuugauccuggugccuccagggugaguucagugcugaaucgcaacacucggcaguuuggaaaaaaacaucuuuucgaccaggaugaggagacauguuggaacucagaccaggugaggcgccucccucgacccuccaucucuagggugauucagauucagaucucaugccuugagaacgucagggggcccucauggguggccaggaaaggaacaugugccgaauuuccuucuuccccuccauuccaagaacuaugugaaugagacaggcauagcagggcucugugccugcagugagcuugcgccucaguuucccugucugcuuccagggccccucccagugggugacgcuggaguuuccccagcucauccgugucucccagcugcagauccaguuucaggguggcuucuccagucgccggggcugccuggaagguacuagaaggcccuggguggcagggguuccaggggucaccccagacacucauugccuuucucugcugaagguucacagggcacucaggcucuccacaagauuguagauuucuacccugaggacaacaacucgcuucagauauccugccccugcuucugggguggguggucugugccucuggaagcuuuggacucacccaaacccgaaugggaacccugaugugugaucuugaacacgugaccucuaggacuccacuuuuucuguaaaauggugcugaugaccaccuguucugugugagaggcuuagagggaccugcagcuuccccagguugcccacaucgguggagugugagcugggucuggaaggggugggggccugcgggugggaaaccagaaaucaccaguuucccuugacugcccacgcucacacuuuccccauaccagcugcugaaguggaccggcugaaggugacguuugaggaugccacugacuuuuuuggccguguggucaucuaccaccugcgggugcuuggggagaaggugugagaccucuaggggcugucuccuccaggaagcccuccgggaagcacagcaaagucccucauucugcacagaagguuuauugguuccucuugggaaggguccccucccaccaccuguccagaagcugccuuugaagucaguucuggguuuccccagcucuggcugaccauuuuguucccugagugucugaguccccggcaggcggccuucacucagggucagcgggcaccagguugcucuggaagagcuugaggaugugguucucgaucaccuguugcacugagauggggcagggaaaaggugggcugugagcuugaaucgggagugggguggaggcacaggccaaccugcgcucuccccuuaggggacaaacagggacccuugcagagaccugcauuacagagcaaagcugggagaaccgaggacucaccccaggaaccucaacuuccccuaaguuuguaaaaaugcacuuuuguagcuuuucagaauuaauauaaaaauauuuccuaccaagcaaaaugugugaauugugacuuucaugaaaagaugagccugggcaugguggcucacaccuauaaucccagcacuuugggagguccaguggggaggacugcuugagcucaggaauuugaggccagcuugggcaacagagcaaaacgcugucucuaccaaaaaaauuuaaaaauuaggcugggcuugguggcucacaccuguaauccuagcacuuugggaggccaagguagguggaucacuugaagucaggaaaggccagccugaccaacaugaugaaaccccaucucuacuaaaacuacaaaaauuagccaggugcagccgggugugguggcucaugccuguaaucccagcacuuugggaagcugaggcggguggaucaccugaggucgggaguuugagaucaccugaccaacauggagaaacccugacucuacuaaaaaugcaaaaaauuaguugggcaugguggugcaugccuguaaucccagcuacuugggaggcugaggcaggagaauugcuugaaccugggaggcggaaguugcagugagccgagaucacgccauagcacuccagccugggcaacaagagcgaaacuccaucucaaaaaaaaaaaaaaaaaaaaaaaaaaauuagccaggugugguggcaggcacuuguaaucccagcuauucaggaggcugaggcaggagaauuguuugccugggaggcagagguugcagugagccgagauugugccacugcacuccagccugggugacagagcgagacucugucucaaaaaauaaauaaaaaagauuuuaaaaauuagcuggguagagugguacaugccuguagucccagcuacucaggaggcuggggaagaaggaucacuugagcccaggaguuugagaccagccugggcaacauagcgagacccugucucuucuaaaaaaacaacaacacagccaggcgugguggcucacaccuguaaucccagcacuuugggaggccaacacaggcggaucacaaggucaggaguucaagaccagccugaccaacauggugaaaccccgucucuacuaaaaauauaaaaauuagccgggcgucauggugugcaccuguggucccagcuacucaggaggcugaggcaggagaaucgcuugaaccugggagguggaaguugcagugagccgagauggcgccauugcacuccagccugggugacagcgcgagacuccauguccaaaaaaaaaaaaaaaaaaagcaacaacaaaaaauuagccaggcauggugacgaaugccuguggucccagcuacucgggaggcuguggugggaggaucacuugagccugggagaucgaggcugcaguaagcugugccugcaccacuucauuccagccugggugauagagcaagacuuucugccucgaacaaaaaaacaaaccccccgaaaacaugaggagggaagaggaaugauuucugucccaaacacaguaaaacucugaaggaaggagggggauauuuccuaagc

SEQ ID NO: 15633 - RNA, 8165 nt, Homo sapiens
aacucuuuuauauacaugguuuauuccuccccagccccagacaagccccaggcacgcuuuauaggggcauggagaugcccacacccugucucucagaagcugggucucuggagaccgggauggggagaagggggaagcccuagcaagacgcagcucccccucagccucagcgccccccccgcagagaggggacauagaaggaaaaaggaaggugacacaggacugggguucaaauacucagaaagccacacaauagaagacaaaaaguagcaagcccccaagaaagcggggacaaggaggaaccagugcccgaucccgcccucuucccagcuggggcacugcguccccaggacuccguggggcaaggggugggacugggaggagaggaaggauuuggggguggaggggcucaaggcuggacccacccugcccuuggacuccugggcucagggcaagugaggcccgaggggcccccugcaguuggcagugauggggccaguggaggccuacagcuuggucagguccagcuucagcuuguagggugguaggcuguccucacaggcgugggacggcggcggguacaggggccaaucgggcuccaucaugaagcccuugugcugcuccagggucagaggcugcaggaagagaggggaggagggaaguggagggacggggagaggccgagcccccaacccugacugucuccuucccaccucugauuguuuuauuuuuuuucuuuuuuugagagagucucucucugucacccaggcuggagugcaguggcgccaucucagcucacugcaaccuccgccuccuagguucaagcgauucuccuuucucagccucccaaguagcugggacuacaggugcacgccaccacgcccagcuaauuuuuguauuauuaguagauaugggguuucacuauguuggcuaggcuggucucgaacuccugaagugaucugcccaccucagccucccaaagugcuggaauuacaggugugagccaccacaccuggacuuuugugugugugugugugugugugugugugugugugugugugugugugugauggggucuucucuguuguccaggcuggaguauaguggugccaucacagcucacugcagcuucgaacucucaggcucaagugauccucccaccucagcuuccuaaguagcugggaucauaaacaugcaccuccacgucuagcuaauuuuuuuuuucuuuuuuuuuuuuuugagauggagucucgcucugucacccaggcuggagugcaguggcgcgaucucggcucacugcaagcuccuccuccuggguucacgccauucuccugccucagccucccgaguagcugggacuacaggcaccugccaccacgcccagcuaauuuuuuguauuuuuaguagagaugggguuucaccuuguuagccaggauggucucaaucucuugaccucgugauccgcccaccucggccucccaaagugcugggauuacaggcaugggccaccaugcccagccacaucuagcuaauuuuuaaaugauuuguagugacaagguuucacuauguugcccaggcucugggcaccacagaggugucaccaacacaccugggcaugauagaggugaggccaacaccacagaaguguggccaccucugacuucaugucgccccaacuaagaguggauuuucuucccaccaauucaaagggcagugaagaaacuggcccaagucaugcagcaagugugagguccuggcugggugagguggcucaugccuguaaucccgguauucugggagggcaaggcagguggaucacuugagcccaggaguucaagaccagccugggcaacauaguccccaucucuacaaaaaauacaaaaauuagcggggcaugguggcacgugacuguggucccagcuacucaggaggcugaggcaggaggauugcuugagccagggaggccgaggcugcagugagcugugaucaugccacugcacuccauccugggugaaagagugagauccugucucaaaaauauauauauaggccgggcgcggugggucacgccuguaaucccagcacuuugggaggcagaggcggauggaucaccugaggucaggaguucaagaccagccuggccaacauggugaaacaccgucucuacuaaaaauacaaaaauuagcugggugugguggcccgcgcccauagucccagcuacuucggaggcugaggcaggagaauugcuugaacccaggagguggagguugcagugagccgagauggugccauugcacuccagcccaggugacagagcaagacuccaucucaaaaaaaauauauauauauauauuauauauauauauauacacacacacacacacacacacacacacguauauguauauauauguauauacaugaaaaaagaaaaaaaugucugagguccuggccuccaugggagcagguggccaaauccaggaccagcaaacagcucucucugccuucacccccucccucggcccagcgccauucacagaucccacccaccuggaacuugaggugcuggccaggcgcggucaccaggguggagcagcucagccacagcaucaccagcacggagaggaagaggcagcaggccaggauccagcgaggcagacccgagcgccugccccgcccggcaggcaccacucagcugcccaggccgggaccagggagacccguaccuccagucccaccccccucccacccccaagguccugccacccaccgggacaugcaacugaggaagucauuguccuguggcucuucagacuccaccuuggccuugcugcuggucuugacucggaucuuggccuuccucaccuuguccagggggccuacagggucugagagaucagcugccacucagcgaccaccaggucuuugcuaagaggccacaauaaccaugaccaggagggaggaggucaggaccuggggcauagaguccuggaauggagaucagagcccugggagauggaccacagaaugcugagacagggaccauggaacccugggagauggauccuaggagaugaaccaugcaacccugggggugaacugcagaauccuaggagaugaaccauggaacccugagagauagaccaaagaacucuaggagauggacccuaggagaugacccuagaagaugaacccauggaacccugggagauggauccuaggagaugacccuuaggagaugaacccauggaacccugggagauggaacauggaacccugggagauggaacauggaacccugggaaauggaccauggaacccugggagauggacugcagaacccugggggaugggccacagaacccugggagaugaacugcagaauccuaagagaugaaccauggaacccugagagauggaccaaagaacccuuggagauggacccuaggagaugacccuaggagaugaacccauggaacucugagagaugaaccauggaacccugggagaugggccacagaacccagggagaugggccacagaacccuggaaagugaaccauggaucccugggagguggaccacagaacgcugggaggcggaacacggaacccugggagguggccacggaacccgggaggugggccacggaacccugagagguggaccacggaucccugguaaauagaccauggaacccggggagauggaccacggaacccugggaaguagaccacggaacccugagaaguggaccauggaacccugggagguggaccauggaacccugggaaauagaccauggagaccugggggaugagccauggaacccaggacuugagagauggagaucccgauccuagaaggucuguuugccaggccgacuccuuguggcaguggggccacccauggaaggaacacuggucuagguugcaccuuacccacgugcaccuccagggcuucagggugggagccucgccaggucaccuccacgcgcugcagacggccccccuggaagccgaggcucuccacuaugggcugagucugggccaggaacaagacagcacagagaggcuugugagaacagcaccccugggcccaggcaggcccucugugacugccaugucccacgcccagcugauacccaguuccccuggguaucaggggugggcuugaugucagggauguuguuuucugcuuucaugggcuccuccauuugccuuaaccccauccuuuagcuccagaaguaggaacaugauccagaccaagccagugaauugccugagagauggucauaugauccagccagggccaaucagaguaaaucccagcucaguuaaaaccccagagggagccggggcaguggcucaugccuguaaucccagcacuuugggaggccgaggcaggugaaacaccugaggucaggaguucgagaccagccuggccaacauggcgaaaccccgucuccacuaaaaauacaaaaauuagguggguguggugguggccgccuguaaucccagcuacucaggaggcugaagcaggagaaucacuugaaccugggagguggagguugcagugagcuaagaucaugccauugcacuccaucuugggcaacaagaaugggaguccaucucaaaacaacaacaacaacaacaaaaaaaaaccacagcguuuguaaccuagagccucuggcauccaccuuacugccaagaagaaguaaaugccugggaaugaagccaccacaaaagaaagcagagucaaggcauggagugagacacugagccccuggauccagcugugccugaagcucgcccacuguggacuuugcaucucaugagcuaagagccaaugcaucccaucuucuuacccugcccacccaucugccacucuggcguggccccugucagaggucucaccugaaacaccaccacuuucccauugucagucugcaaguaguauguccagguggaggagacaaaucccugggcugaguugacaaggucauugcagaggguggaaaacaaguccaagagggagagggccccacuuggagccuccaggaccuuucucuggugaaaaaagguccaagacacaaagauggcaccgaaauagggcauuaaccaaugaaugggagggggcaggaugugguggcucacgccuguaaucccaacacuuuggaaggcugaggcaggccgaucacuugaggccagaaguuugagaccagccuggacaacaucgugaaacccugucucuacuaaaaauacaaaaauuagccaggcaugauggcgcacgccuggaaucucagcuacuccagaggcugaggcaggagauuugcuugaacccaggaggcagagguugcagugagccaagaucacaccacugaacucuagccugggugaaagagugagacuccaucucaaauaaauaaaugaauaaauaaacuaacaggagaggagcuaggagaauucacuuggauuggauguggcuaagugauuugggccaauaggacuucuuauagugaacacagaucucagcguggcaguuggcuuccuguguacccuuagggaaguggauugugcucucugagcccuaaaauggguaucguucucuuccuucauggaguagccaugaaauuucaacuagaggaugccugccaggugccuggcacggcacaggcacuuaaugcguaguagucccuauuacuaaaaauaucaucauccucauuauucuuauuuugacagcgucaagacggaggucugauggccggccaugguggcucaugccuguaaucccagcacuuugggaggccgacgugggaagaucacuugaggucaggaguucaagaucagccuggccaacaugaugaaacccugucucuccuaaaaauacaaaaauuagccgauuguaguggggggugccuguaaucucaccuacaaaggaggcugaggcaggagaaccacuugaacccgggaggcggaggcugcagugagccaagauuguaccacugcacuccaggcuaggcaacagagcaagacuucaucucaaaaaauaaauaaauaaauaagagggagcucugaauuggaagggcugacagugcagugagcuuuucugaacagcagugaaagcugggaagggguggaggaaaaugggggaaguggggaaagggcuuucuggggagucccagccccuaggucucuggcuaugcuacaugauuuucugugccucaguuuccccaugaugcagcauugcuuggacuacaauagaugaaccguuauuauuucucccauaaggcagugugugcgugcuugcgaggcaagccugcucuacccugagccgcaguucugagccccuccaggugacagugaccaccagcucaucacaggggaagggcuuagaccagcaccuggcagcucugggggcgccuaagaggagugaggugaggaguggccacagcucugguggcuucaaaucucgccccuugcacagcccuguguaugaccugggagguugcccccugggcacuaaaugggggugacauuguccuuugugccuccaagugacacaaaaacauuugggacagguugaagucaggcccgaaccaggacagauguuugauaaaugauggcuguuuucugccacuuauuccugaaaaggugguggggcauggggggcguuguugcauguaacuaaggcuggagacaugacggggcuggauggagguugcccugcaggccugguauagaacgcagagucuggcagagccucugcacgugaaugaagauuucccacggggugaagaggguggggguauugggaaaagggaccccaggccgcagugggaggcccaccuucugcuccggcucaggcuccgcgggcuggcuccagcagccguggcuacaggccugcugcucugccuccuucacauaggcuuccacgcaggcugugggaggugggagcgggugacuggggacggcccuucccaggccaccucuccccacgcuggcccacccugccggcgggcccucaccugcuucacacucaguuuggguggcauugggcuuggagcuucuggccacaaaucggcagauggagaagaggcggcagccacgcucgcaagcgcugaucagaacggcucugucauagggagacucggaggcgcccuccagccccgccugggggaggggaggacagggggcucaggccauggggaggggcaggaggaggguggggggaccggagcauucagcagaggcagggaaaggcuuccccgcuccccacgacaucuagccagauggagaugaaguugggagaggcuacaaauauuagugggggcucuuagcucugaggagggagauggggagggagcuugagaagagaaauggacagugaagguggagagaaaugagccuuccccccacuagguuccagggaggaggggagacauggagaaggauucucagaccuggaggaggagggggaggcucagaggaggggguuuuggucacacgcagaucaggcuugaauccuggggaguggugguaugaguaggggcugguagcucugaguggggagggaacacgauguggaggaggaggaaugagguggggggaccaucaggccugagggagcuggggguugggugcuagaggguccuuacccagcagagugcggaaggagcccgggaggugguaucggccccuuaucgcaaggaccugcauccccaagcacucccccaucagagggaaccccagcccgucaacuacuggagagaucuccccauucccgacccccaccuccccacggacacccccaccaaagucuccugcugucauccaagagaagcccaucccaacgccuccuccuucggagagaucccgcgucccccgcuggcaccuggcaccgcacgcgccucaccugcgagggcugcgggccgaggucgcggucgcggcaccgcagcuggcaguucugcguguccccgagcuggggggcgaagggaucgcgggcggacggcgcggaggcggcgggcggcgacgccaacagcagcagcagcagcagcggcgguggcaucagcgccaccgcagccauggccgggcggaacgcggggggcgcgggggacuccagcucaggccgggcacggaggaugcagcggcugcggcggggaccggg

SEQ ID NO: 15634 - RNA, 3560 nt, Homo sapiens
agccuggccagggcugcgcagucaugaucaccgagaccgcggcggagccuacggucccugcagugccugcugcugaggaggccaccgaagcucggggacgcgaggagccggcguggcccugggugagcccaggcccaagcgggaacgggcgcggggcgggcggcgcagacccaggggcgcgggcuucaugccccagccgugcccccugucccgcagaaagacgccccgauccggacgcuggugcagcgcauccaccagcugcaggcugagcgcgcgcagggcuuccgccgacuggaggagugagugggggcgcggaggggcucaggguucggucccccgcccgcuccgggcgugggcguguucucggcgggcgugccuggaggaggagcuggguccuuguguggcugcagagucagauggggcggggauuucggggcaccggguccucaccuucacgaaaaaggccccacagcacguccccacuacccgacgacucacucuucguggcuucucucuccuccccaagagcaggggugggccugucucgcguuccccugcgggagucaggaagcguccuuccuaccuaccaguccuccccucuggugucuggggacacuuccugggggccuuucaggugguuggcgccggugcagggccugagagccugggggcgcggccucaggguccccacaugccgcagaggccaccgccaguaccugcgcagcggcccugacuacgacuucgcgcgcuaccggagcacagugcacggggugacccaggccuucgccgccgccucgcgggaggugcuggcgguggaagcagagcugggcgggccucgcaggcagccgcugcucgccggccacgugcgcagccugcaggagcuggagcagacgcggcugggcacggugaggccaccaccccuuccccgccgugucucuaggacccuggccggcuccucucaugacgcaccccugguugggggguggucccaguaucccauacacagaccucaccccuuccugucccaccccaauccucuauuaaggcuucacuuggggauucucggaccuugcccucugcuguucauccccaauuuuuuucccaaguuuuguccuuauucccagagcacucccgcuuucucccagcuccgccuaaaugcuauuccaagaugcccagaucccgccccaacaaugcuccacccacucugguuguuccgcgucuagggucccacccucaaccucccguagauacaggcgaggggggucccaggccacgccuccuccguauuauuccuccaucacagcuuuaguucuuugccuauuucucucuugcgauccgccugcucggcccugcaaccgugugugacuggaauuccuaggccacgccccccaugagcgacccgucucagcgucucuuuggccuuuuucuuucugguguuuuuuuuuuuuuuuuuuuuuuuuaagacaggcucuugcucucuugcucucucacccaggcuagagugcaauggcgcgaucucggcuaacggcaaccuccgccucccagauucaagcgauucuccugccucagccuccugaguagcugggauuacaggcauaauuuuuguauuuuguauuuuuuuuaguagagacgggguugugccauaugggcaaggcuggucucgaacuccuggucucaagcgauccgcccucuucugcuucccgaagugcugggauuucaggcgugagccaccgcguccaggcuuuuuggccuacuuuuauccuggguccccgucccugggaccaugaggcgcaaccuaacccaccccuacggccaaugccuggcuaagacgucacuguuguucccaggccacgcccacaucgcgcucagcacugccucuggccugccugcugucuccuuucugagagagccucuaaacugaauuucggacucuuccuacacaaagcacugccccucgugguucuacccgggcacugccuuucugggugccucuguuuuuuccugaacauccuuggagggcaggggguggguucugcucguggagacauccuucguguugcucauucccccaccagguggcccugcugcaguugauggagacgccagagcuggcggggcaggaggacgcuguacggaugcagcagcugaaaaugaagugagcgcugcugcccaagccgccuggcuaugcucgauuugcaccaggguuggcacggucaggacgcugccagcagaggaacccucugccagugcacaaugguguucucaccugguggcccucagauguacacuuccccagagggcacagccgugaaacuucacaucaguuucgcugugcauugcugggacacugcuguauaccucgacacaugccaauccugcacacguggcuguccguggagcuuggacaugccccacugagcacagaccuucagaugccuguccucagcccccaagcacacacacucauguacacacacauuugacaaagucacacuucauaaccuccuaaugguacacaccccaccaagauggccuuuucuuuucuuuuuuuucugagaugcagucucacucugucaccaggcuggagugcaguggcgcgaucucagcucacugcaaccuccgccucccggguucaagugauuccccugccucagccuccugaguagcugggacuacaggcgcgugccaccacgcccagcuaauuuuuuguauuuuaguagagauggguuucaccauguuggccaggauggucucgaucuccugaccucgugaucugcccaccucagccucccaaagugcugggauuacaggcguaagccagcacgccugguccuuuauuuucuuuucuuuuuucuuucuuuuuuuugagauagagucuugcucugucacccaggcuggagugcaguggugcggucuuggcuuaccguaaccucugccuccuaaguagcuuggauuacagaugcccgccaccaugccuggcuaauucuuguauuuuuaguagagacggggauucgccauguuggccaggcuuguuuugaacuccugaccucaggugaucugccugccucagcuucccaaagugcuggauuacaggcgugagccaccaugcccagcccagauggccuuuucucucagcccacugugaccuauggggccaccccuucucccuagcaccuaaguguucccucuugcugcuagugcugccuggagguuuggcggcgggcaggagggccuggggcucaccacagccacagcccucuugcagcuucgcggcagcagcuaauucaccccaucuggguuuuauuuauaguucccauccgcucuuguaggguaauuaaaaccauggaggcgaucagcgagguucuccaggaccuuagguuugaugcggaaucugccgagugauggcggcuccccagggaugcgccgagggagaugggaaacggggcggauggcgcccagcccagcccuaacugccagcuggcugggguugcgccccacugcgcugcugaccuuccugcaguuccagacaccucccacaauaaagagcuccuccucuguag

SEQ ID NO: 15635 - RNA, 3901 nt, Homo sapiens
caagagucggggaaguagagggaggcagagucaggucacaggccccaagaaccccagguggaaggagggcugaguggcagcgccuuuauuugugggggccuucaagguagggucguggggggcagcggggaggaagagccgagaaacugugugaccggggccucagguggugggcauugggggcuccucuugcagaugcccauuggcaucaccggugcagccauugguggcagcggguaccgguccuuucuuguucaacauaggguagguggcagccacggguccaacucgcuugaggcugggcccugggcgcuccauuuuguguuccaggagcaugugguucuguggcgggagccccacgcaggcccuggagaggucacacagcuuagcagagccagacacccacagggagaaaggggggguaucccugccaccuacagccccccaagcccugugcauagcuuagccagggggguaucugggccccgggcgggaaccuggaggcuggggugcaccugaggauguucucgaugcagcugcgcuggcggaaaagcgcauugaccaccgggcugccgggcggcacuaguggcgccuugaagaggaagcugagcagggacagcacgggguggaaggucugcggcucgggguccaugucagugcagaagcucacgcgcuggcacagcucggucagcagcgcuagguccagcaugaugggugcggccagcagcgaguccugcggggcgggugggucaggagaugggggcgguggccaagcccugccucccauagcagccccugaagccgcgccgcaccucacacguguugugcagcaccaguguguugguuccgcccagcaucagcuccgagguauacucauccagcgcgcgcuugcugucacccacguacggcacauacuugaugaccaccuggagugcagcaggaguuugcccgggucccugccaccccucgccgggcaaccccgcgcccgcgcccgcgccccacgcacgcaguggucaggcucuucgccgggcguauagagcacuggguugcucugcaccaugucguccaccacguugcucuuggacaccuccuuagagcggaacugcaauggcgccgauagguucuccccaucguuguugcccaggugguuguaacucacgauggacauggucuguggguacaagggaagccccagcagcugcaggcccugcggccccacaagccaggugcucgcggcccaggcccccuuccugcacucggcagcucccuaggcccacgcaccuugaggccggagccaaugaggaaguccacaagcacggacuugacuuuggucuggccugacuugaagucaucuccgcccacaaaaacccggugcugccacgcgagcucaagagcuccgggcaccaggguguucugcggagacccauugaggaaggcacagcccuccaggaugcuggccacggcgaagagcguggagggcgacaccuccagaccgagcugugggcaaggcgggcagucagcacagagcugugucugugacuggcccugccugacccgcuccacccgggcguucgcccaccucaauggugcgcagcagguucucggcugugucguugaggccuggaaucaccucacagaagcgcuccguguucgccguccacagcacuaugacuuuguccagccccgcgcuagaccggaagucucggaugucccugcggaucugcuccagcuguggguuggauggugaggguguggggaggauggagaggguguagggaaguugguuguacauacucucggacucacagaggccugggcuacucaguuccccgggugucaagugaggccuggauucgcgggguggggcaaaaagagggaaccaaguggcgaagaacagguggcaggaagcaagggaugcgggaugggacagcaccugcugcgcacgcgagccugggaugagguuguccgcgcgcgcgcucugguuggccgcgaugaauucggggauguaaacagaaggccggggccgcagggccuccaugugcggccacaguugcuccugcagcccccaguccagcaccuucgcgcgccgcaucgccucggccagguucagcgacgagaugucccagccuggggggacccucacacucggcccugcccggauccugggccccuccagaccccaucucccaucccgccccaccccggcccagggcuccgcccaccaucgaacacgaggucguugggcgccaccaugggcagcaccgcgcugaaggguacgaacaccuccuggcccucggcguccaggcccaggcucacggugcccgccugagucagcgagccguaguaguuggccuccugggggucagcagacacggcgaggugacgggugggaguggugaaagggccgcgacccggccugggccccaccuagacucucaagccccgccccacuuucgggcauuuuucaguuccaggcucacagccaggacggaagccgcugcccccaggccccuccccugagaccuccggcaccuuaagcuccgccccuguaagacucccgaggaguccccgcuaccucgcgaaacccuuccacgggguccgccugcagccaggccccgcccccugcaagcccucccgccccacagagcuucgcccccugcaggucccucgcccacuacaggccuccagacccgggcaggucccucgccccugcagccccucgccccgcggaaccccacccccuacagccccccuggucccgcagagccccgcccccugcaggcucccgcccccgcccgcaaggacucccaccaagccucccuacccaccacgccccucccgcccccaccuugcggccgcugcgcgugggccaggacaaacgcagucgauuggccagcaccgcggcggugaguguggagccguuguucccgccccagccgacaagcaugaccccgagccggggcaccugccgggcgguccggaaggugaagcgcguggacguggggugcaccugaagacaggccgcgcagugaaucccgggucccgugcccuucuccccgagccgccccgcucuccccagcacgccuccuuccucagcccccugguccaccuugagaacgccacccucgcggcugacgcgcgucguccgguacucguauugcgccucgauggccucggggccguagaccacguccgggcucucgacgaagaacugggcggcggccuccaucgcggcgggcugggggcccggggugagcagggggucagcggggacucuaagcggccggggccaagccagccuggguccccacggaggccgucccugccccgaaccgcacucaccggcgcagagucgacucaggcagcggcggcggacagcgcgggcucucgggcgcgcgaccuccggagaaaagcgcugcggccccucccccgccccgcccccuuccccgccucucccgcgcugggagggaggggcccaacgucuggagacccgguucgaggcccgacaacccagagccaccguggccaucggguccccgccuggcggaaguggccaggcguccacgagcgcggcgcguauagguucaccucgcucgcuccgcagcccccaggggcucauggcugccuauccccccuuuacaagaggacaaugaggcuacacaugagcccagccacaagccaggggguggagcugggcagggaagcugggccuccggggggguagguagggggucugggucagagacacugcaggggaaacaggcagaggaccagaacuccaaagccagaaucuccucggagccacacugccaccuacucccccuucgugggcagcagcaccuaccaggcagucccauccccuggcuccccauguccgcccccauccaucucgggggacaaa

SEQ ID NO: 15636 - RNA, 6032 nt, Homo sapiens
gaagggcacuccuggggcauccccugccccucuaccaucugguggcuggacucuacaccagccugcccugcucuaaaaccccagcuccucaauucugugccaccuccucucugggcccagacaagagcagauucaucccugccccaaaggaaccaccagucuugggucagcagagcugggcacagacacuuccagugccguggggcuguaacugugauaggucuguugcuccaugcacuuggcaagucaacagcugagaaaacagguugcaacauggaaagaguuuuaauccgaccggcgugguggcucaugccuguaaucccagcacuuugggaggcugaggcggguggaucaucugaggccagcaguucaagaucagccuggccaaccaggugaaaccucaucucuacuaaaaauacaaaaauuagccaggcgugauggugcgcaccuguaaucccagcuacuugggaggcugaggcaggagaaucaauugaaccugggaggcggagguugcagugagccaagaucauaccacugcacuccagccugggcaacagagcgagagacugucucggaagaaaaaaaaaaaaaaaaaggcugggggcaguggcucaugccuguaauccccacacuuuagaggcagaggccgacggaugacuugaggucaagaguucgagaccugccuggccaacauggugaaucaccgucucuacuaaaaacacaaaaauuagccaggugugguggcgcaugacuguaaucccagcuacucaguaggcugaggcaggaggcggagguugcagugagccgagauugugccacugcacuccaaccugggggacagagagaaacuccgucucaaaaaaaaaaaaaaaaagagauuuaauccuagggccacccaaugaggagauaggagggaaccucaaauccauuuccaggaggaggaguuuggggccauauaaauguauauauacaaauauauauauuuuuuuaagauggagucagccggccgugguggcucacgccucuaaucccaguacuuugggaggccgaggccagcggaucacaaggucaggagauugagaccauccuagcuaacacggugaaaccccaucucuacuaaaaauacaaaaaaaaauuagccaggcgugguggggggugcucauagucccagcuacucaggaggcugaggcaggagaauagcaugaaccugggagcuggagcuugcagguuggagugcaauggcaugaucucagcucacugcaaccuccgccuccuggguucaagcgauucuccugccucaggcucccgagcagcugggauuacaggcaugugccaccacgaccgguuaauuucugaaauuuuuuaguagagacaggguuucaucauguuggucaggcuggucucgaacuccugaccucaggugauccgcccgccuuggccucccaaagugcugggauuacaggcgugagccacugcaccuggccaggggcuagaguuuuaauuuuuaaggauuuuggagugggcugaaguguggaggucauugcuuggugaaagagugcaggaggugaagucacagacaguaagaaacuguauucucaugcagauuccguuccucuguggggucuucacacuggugggugucauugguuaaggauuucaaaaacaucuuaagaaauucuucuaaaaagucuuaugauucuaaggucggaaaucacaucuauagcaaauggucgguaucaggugcuacaagcaacuugcggucacaaggaagugggucaaagugcagccugauuagugcuuaauuauaacuaaguuucuguccagaauucuuuuuuuuugagacagaguuuugcucuuguugaucaggcggaagugcaauggugaaaacuuggcucacugcaaccuccgcccucuggguucaagcgauucucuugcuucagccucucgaguagcugggauuacaggcauguaaucccaccaccaagcccagcuaauuuuguauauuuaguagagacaggguuucuccauguuggucaggcuagucuagaacucuugacgucagaugauccacgugccucggccucccaaagugcugggauuacaggcgagagccaccgugcccggcgcagaauucuuuuuuuuagagaugagguauugccaucuugcccagacuugucucgaacuccugggcucaaacaauccacccaccucggccucccaaagugcugagauuacugacauaagccaccaugccuggcccccagaauuaugaauccugugaggauggcuucaaggugagcgcugagccagacaaaaggaugggguuugggagcacccugcuuagacuggaaagauaauguuggagaagacuuccuggaagaggggcuuuuugcguagaguuuugaagaaugaguaggaguucuccagaggaggaugaguaacugcaauaacacccaguuuaucaagugccuccuaugugucuggcccugugcuuuaccccucauuugaccaccucuccagugagagucucaguccuuuuuuuccuggugaggaaacaggcauggcagagaggcaugacacaucaagguugcccuuccuggcuccaucuagcccguucuccucugcuuccuuuguuuuucaccaucuuuagccuuugaccccaaccaaaaagagaagagaggaaaucccaugggcauagacagccaccucuuaaacucuugucuggaauuuuucacauaguaacaaugucuuuuuuuccuccaaaaagacucccaggcuggaaugguguccucauaucgaggaagaggauacugaggcccagaaaugugcccuagcuuuacuaggagcgcccccaccuaaagauccucccccuaaauacacccccagaccccgcccagcuguggucauuggaguguuuacucugcaggcagggggaggagggcgggacugagcaggcggagacggacaaaguccggggacuauaaaggccgguccggcagcaucuggucagucccagcucagagccgcaaccugcacagccaugcccgggcaagaacucaggacggugaauggcucucagaugcuccugguguugcuggugcucucguggcugccgcaugggggcgcccugucucuggccgaggcgagccgcgcaaguuucccgggacccucagaguugcacuccgaagacuccagauuccgagaguugcggaaacgcuacgaggaccugcuaaccaggcugcgggccaaccagagcugggaagauucgaacaccgaccucgucccggccccugcaguccggauacucacgccagaagguaagugaaaucuuagagauccccucccaccccccaagcagcccccauaucuaaucagggauuccucaucuugaaaagcccagaccuaccuuugagccucaguugccccaucugugcccuggguaggaauauccuggauccccuugggucugaugggguagccgaugccugauuugcacccacaacgugggagguuauaaccuguccccaaguugcaaauggggaaacugagguacagggaugccagggacccuccugaaugugcacagcaccugggaaacccggggacggggucgggcgugcggugugggcauggucccugaccugggcuggggccaggauccaagagaaacaauggggguguggugcauggauagaaguuugugaugggcagagccagcuggagcugguucugaaucugaugaaaucgcuugucaaggcacugcuaaagucacaugcaacgagcgacuuguuaggggaggaggagaguauuuuccccaucucugugcccuccauggaggcuccaggggugcagggcacuggaugaggucugggcuguggugggacccaggagggggcaggcagaggggcacacucuuagcccgcccuaaacccaucugugccgugugacuccggcaaaccucucacccuugcuaagccuagcaacuagguuaaggcacccucaaaccccagucuccccagucucccuaacacuuguaccagccugaggggcugugauuccuagaggcucaguagucuggaaugugauggguuuggcacucuucauuucucgggauuacaccuguaaucccagcacuuuaggaggccaaggugggagcaucgcuuuaggccagaacauugcagccugggcaguauagcgagaauccaucucuaccaaaaauguuuaaaaaaaauuagccagacaugauggugugugccuguagucucaguuauucaggaggcugaggcgggaggagcacuugaauccaggagauugaggcugcacugagccaugagugccccacugcacuccagccuggguaacagcaagaccauaauaaauaaauaaauaagugaagcaaguaaguuuuugacugccagaagaaaagcagagccaugguuggaaucucaggcugccugaauaucagauauacauuaauuccuucaaguauuuacuaagcaccuauugugugccaggcacagugucaaccaagcuaagauucuaaguagggaauaugaaugauacacaaggaaauaaaauagggugcuuccuauuuuaggcaggcuggaaggaagaggaggagccagccauacugagauucaggagauucaaggggagaaaugcccuuuuuuuuuuuuuuuuuuuuuuuuuugagagggagucuuccucuguugcccaggcuggagugcaguggcacgaucuuggcucacugcaaccuccaccgccccgauucaagccauucuucugccucagccucccgaguagcugggaucacaggcgccagccaccaugcccagcuaauuuuugguauuuuuaguagaagcgggcguuucaccauauuggccacauaucggccaggcuggucuugaacuccugaccucaagugauccaccugcaucggccucccaaagugcugggauuacaggcgugagccaccgcgcccgcacggagaaaugcucuugguaggggaaauaacuugugcaaaggcgccgccgccguggugagauccagcuuggcguguuaggggaaaugggcacccucguuccuggaaaacgguaggccugugggugaccagcuucccuaucugucuucccacagugcggcugggauccggcggccaccugcaccugcguaucucucgggccgcccuucccgaggggcuccccgaggccucccgccuucaccgggcucuguuccggcuguccccgacggcgucaaggucgugggacgugacacgaccgcugcggcgucagcucagccuugcaagaccccaggcgcccgcgcugcaccugcgacugucgccgccgccgucgcagucggaccaacugcuggcagaaucuucguccgcacggccccagcuggaguugcacuugcggccgcaagccgccagggggcgccgcagagcgcgugcgcgcaacggggaccacuguccgcucgggcccgggcguugcugccgucugcacacgguccgcgcgucgcuggaagaccugggcugggccgauugggugcugucgccacgggaggugcaagugaccaugugcaucggcgcgugcccgagccaguuccgggcggcaaacaugcacgcgcagaucaagacgagccugcaccgccugaagcccgacacggugccagcgcccugcugcgugcccgccagcuacaaucccauggugcucauucaaaagaccgacaccggggugucgcuccagaccuaugaugacuuguuagccaaagacugccacugcauaugagcaguccugguccuuccacugugcaccugcgcggaggacgcgaccucaguuguccugcccuguggaaugggcucaagguuccugagacacccgauuccugcccaaacagcuguauuuauauaagucuguuauuuauuauuaauuuauuggggugaccuucuuggggacucgggggcuggucugauggaacuguguauuuauuuaaaacucuggugauaaaaauaaagcugucugaacuguucccug

SEQ ID NO: 15637 - RNA, 2142 nt, Homo sapiens
gaggcggcgccggggagaucggucguacacagcggucccggggcggggugacccggcccgggcgcgcggccgcccccaugacgucaacccacaaggcagcgcgcuguuguggcguuuaccgcgcgucgccggggcaacggcggccgggcgggcgucggcggcuuggccccgccccuccaugcaaaugagcgacgucacccgcacccaauggcgaacgggggcggugagcucaucgcgccgagccgaggcuauaagagggcgcacaaguggcgcggcgcaggagccgccgccaguggagggccgggcgcugcggccgcggccggggcgggcgcagggccgagcggacgggggggcgcgggccccccgggaggccgcggccacucccccccgggccggcgcggcgggggaggcggaggauggaaacacccuucuacggcgaugaggcgcugagcggccugggcggcggcgccaguggcagcggcggcagcuucgcguccccgggccgcuuguuccccggggcgcccccgacggccgcggccggcagcaugaugaagaaggacgcgcugacgcugagccugagugagcagguggcggcagcgcucaagccugcggccgcgccgccuccuaccccccugcgcgccgacggcgcccccagcgcggcaccccccgacggccugcucgccucucccgaccuggggcugcugaagcuggccucccccgagcucgagcgccucaucauccaguccaacgggcuggucaccaccacgccgacgagcucacaguuccucuaccccaagguggcggccagcgaggagcaggaguucgccgagggcuucgucaaggcccuggaggauuuacacaagcagaaccagcucggcgcgggcgcggccgcugccgccgccgccgccgccgccggggggcccucgggcacggccacgggcuccgcgccccccggcgagcuggccccggcggcggccgcgcccgaagcgccugucuacgcgaaccugagcagcuacgcgggcggcgccgggggcgcggggggcgccgcgacggucgccuucgcugccgaaccugugcccuucccgccgccgccacccccaggcgcguuggggccgccgcgccuggcugcgcucaaggacgagccacagacggugcccgacgugccgagcuucggcgagagcccgccguugucgcccaucgacauggacacgcaggagcgcaucaaggcggagcgcaagcggcugcgcaaccgcaucgccgccuccaagugccgcaagcgcaagcuggagcgcaucucgcgccuggaagagaaagugaagacccucaagagucagaacacggagcuggcguccacggcgagccugcugcgcgagcagguggcgcagcucaagcagaaaguccucagccacgucaacagcggcugccagcugcugccccagcaccaggugcccgcguacugaguccgcgcgcggggcgcaugcgcggccacccuccccaaggggcgggcucgcgggggggugucgugggcgccccggacuuggagagggugcggcccuggggacccccccuccccgagugugcccaggaacucagagagggcgcggcccccggggauuccccccccccgagggugcccaggacucgacaagcuggacccccugcucccgggggggcgagcgcaugacccccccgcccucgcgcugccucuuucccccgcgcggccgccccguguugcacaaacccgcgcgucucggcugccccuuuguacaccgcgccgcggaagggggcuccgagggggcgcagccucaaacccugccuuuccuuuacuuuuacuuuuuuuuuuuuuucuuuggaagagagaagaacagaguguucgauucugcccuauuuauguuucuacucgggaacaaacguugguuguguguguguguguuuucuuguguugguuuuuuaaagaaaugggaagaagaaaaaaaaauucuccgccccuuuccucgaucucgcuccccccuucgguucuuucgaccgguccccccucccuuuuuuguucuguuuuguuuuguuuugcuacgaguccacauuccuguuuguaauccuugguucgcccgguuuucuguuuucaguaaagucucguuacgccag

SEQ ID NO: 15638 - RNA, 8930 nt, Homo sapiens
uaucuacaugugaggcuccgccccucccuuugcaggacgucacggaggacugcaggggccugagccgcugcugccgccgccgccgcgcagccccacaucaacgcaccgggguccugucaccgccaccgccaaaaaagucaccgccgcuagggucgccguugcaucggugcagggcaaggugagcuccugggcggccgggugugcucaggcuccgagcaccugcauaaccuucauuugacugaugggcugauggaggugggggacgagguugacuaggguugaauggggggaaggaugcggcggucgcgaggcugggaauggguagggcccgggcgccccacuccugccugauccucaccacuaacccccccaaccccccugcucugcggcggagggggaggggagccgagcuccuugcgggaagcugugcgcgcgggaggcuuuugcgugcgcgugcgcguggugugcacacgcgugugcgcgccugccugugucagcgggucugugugcacccuugcuuguguaccuggauaugcucgugugacgccgugggggucugggccuaagugugugagcguugcacgcgcguggagaaagacguguggaccgccugugcagguauggcccgugcauacaagcacggggauccguguccgugugggugaugugcacacgccugcauggguggaggggccugugcgcacgggugguuugcacauuucuauaggcgagucggugugcaaacaggugucugugucuuuguccugugcaccucagugcguucacacacuccuguauguacggaugagcguguuugaggcugugugcacgugagcgugugcaugccccuccuguaucaugugaugcagcggccuuggccggagcucuccggccuggagguuugcggggagcgggggcugcagaugcgcguccucgagggaccaugcacgcggugcacguggggccgcgcggccggguucugaggaccaugaaagauugauggggggcggagccagccgcagucacccccuccgggcucagcccuggguuuaggguuacagccccaccuggggcaccugccccuugaagggggcugcugggguguccccaucggcaacccucugagccccuccucugaaacgcccaggauuucaaggucacaggcugcccucugcugggggcaccaccaauuaauacuggggcuccugaugggauaaggguguccuccauacaccggccguuuucuggagcccuugccaucuucugccugggcuugggcacaugaggauggagagagccccccucacggcucugcuacacccgguauccccagauggcauccgccacagacucgcgcuaugggcagaaggaguccucggaucagaacuucgacuacauguucaagauucucaucaucggcaacagcagcgugggcaagacguccuuccucuuccgcuaugcugacgacucguucacgccugccuucgucagcaccgugggcaucgacuucaaggucaagaccaucuaucgcaacgacaagaggaucaagcugcagaucugggugggucccagcuggagggcucccgcccggcucgguuggauucccguacuuggaaaagcagccccaaccucgucuaucucuuuccugacuggagucauucacuuacacacugggcauuuaucaguaaggugcccacuguguaccggggcagaaacagcaccuguguucucccauaagcaccuaauccuggucccucaguuuccccaucuucaaguucuuccauguaugagguuucagcuggaucuugguccccauucucuuuuuuuguuuguuuuuugagacaggguggucuugcucuguccccuaggcuggaaugcaguuacgugaucacggcucucugcagccucgacuucccaggcucaaaccauucuuccaccugagccuccugaguagcuaggaccacgggcuucuaccaccacgccugcugauuuuuuucuuuuuuguagagacagggucgggcuaugucugcccaggcuggucuugaacuccugggcucaagcgauccucccaccucagccucucaaagugcuaagauuacaggcaugagccaccccaccuggccuuguuaguuuuaagagacagagucucacucuguugcccaggcuggauuugaacucgugggcucaagcaauccucccgccucagcuucccaaguagcugggaguacaggcaagugucagcuuccuuuaauuuuuaaaccuacaguuaaauucucuccaucuucaucuggcuugauuuuucuccuugguccuugucacucuccaauauaggauacauuuauaccguuauuuucuauuucccacacugagugucacuuagcaagggaagugcccaucuuguuaacaacuguguccccaguguccaguucaggguguggaaaagaucagugcccaguccauguuuguuuauuuguuuguuuguuuuuugagacagaguuuuugcucugucacccaggcuggagugcaguagugcaaucuuggcucacugaaaccucugccucccggguucaagcgauucuccugccucagccuccugaguagcugggauuacaggggcucaccaccaagcccagcuaauuuuuuuuuguauuuuuaguagagauaggguuucgccauguuggccaggcuagucuugaacuccugaccacaagugauccaccugucuuggccucccaaggugcugggauuacaagcaugagccaccacgccuggccucuguuuucuuucuuucuuucuuucuuucuuucuuuuuuuuuuuuuuuuuguuguuauuguuuugagacggagucucgcucuugucacccaggguggagugcaauggcgcgaucucggcucacugcaaccucugucuccugaguucaagcgauucuccugccucagccuccugaguagcugggauuacaggugcaugccaccacgccgagcuaauuuuuguauuuuuaguagagacagaguuucaccauguuggccaggcuggucucgaacuccugaccucaggugauccaccugccuuggccucccaaagugcugggauuacaggcgugagccaccaccacacccgacccccuguuuguuuuuugagacaggguuucacucugucacccaggcugaacugcaguggcgcgaucucaccucacugcaaccucugccuccugggcucaagcaacccucucaccugagccuccugaguaguugggacuacaggugugagccaccacacccuguuaauuuuuguacuuuuuguagagauggggucuugcuauguugcucaggcuggucuggaacuccuggguucaagccaccugcccaccucagccucccauagugcugggauuacaggugugagccacagcaccuggcacaguacguuuggugaaugacucuguggaauaauggagcacucauauauucugagcacuggugacccaaccugcucuuccugacacuuugugccccugggcaagcuccugcuucucccagggggcugaacuggaugauaucagagcucauuuccucuucgagggccuuaugugcagguccucucugaccuucaucucuuccucccuaggacacagcagggcaagagcgguaccggaccaucaccaccgcauacuaccggggcgcuaugggcuucauccucauguaugacaucaccaacgaggaauccuucaaugcagugcaggacuggugaguguaccccacuugcucuuuuuuuuucuuuucuuuucuuugagagaggguuuuauucugucacccaggcuggagugcaguggcacgaucagggcucacugcagccucgaccuccugggcucaagugauccuccugccucagccucccaaguagcugggacuacaggcauauaccaccacaccuggcuaauuuuuuuguauuuuuaguugagaugggguuuccucauguugcccaggcuggucuugaacuccuuggcucaagugaucugcccaccuuggccucccaaagugcugggauuacaggcgugagccaucgcuucuggccuuccacacucauucuggggccauugucucugagccaaacuuucuucaaaaaauaauaaauaaaacguaggggucagagaaggauuucagauggaaaaguaaaacuauaaccauauagaaacaaauaucugcaaguguaggguggagaauauagagacuauaaggagaguuggcauggccgggcacgguggcucacaccuauaaucccagcacuuugggaggcugaggcagguggaucaccugaggucgggaguucgagaccagccugaccaagauggagaaaccccaucucuacuaagaaugcaaaaauuagccagacgugguggcgcacaccuguaaucccagcuacuugggagccugaggcaggagaaucgcucgaacccgggagguggagguugcagugagccaagauugccauugcacuccagccugggcaacaagagcaaaacucugucucaaaaaaaaaaggagaguuggcauagguuagagauuguaaacauuucaauuuucugcucagaaguaauaacuuuaaaaaaaaauuucuggguugggcacaguggcucaugccuauaaucccagcaccuugggaggccgagguggguagaucuugagcucaggaguucgaguccaucguggccaacauagugaaacccugucucuacuaaaagcacaaaaaauuaccaggcaugguggcucaugccuauagucccagcuacuuaggaggcugaggcaggagaaucacuucaaccugggaggcggagauugcagugagccuagaucgcgccacugcacuccagccugggcgacagagcaagacucuaucucaaaaaaagaaaauuucugggcuggguggcucaugccuguaauuccaguacuuugagaagcgaaggcaggcagauacuccagccugggcaacagacccagacucuaucucaaaaaaaaccccaaaacacagaaacaauaaugggucagucgggggcuggaguggggugaaagcggggcacauugggggaaaggaugguggggaggauggaggggcaagcuucugggucuuucuuccucggacaaggacacaggcuccacaucagcccgucaggguggagcugggauccuccaagcccugaccugcccccauuggugccuccuauagguccacccagaucaagaccuacucaugggacaaugcccaggugcugcugguaggaaacaagugugacauggaggaugagcggguggugucaucagaacguggccggcagcuagcugaccaccuuggugagugcccagcugggcuggagacccacaagucuagaaaaaggacacuaagagaggggagggcacacacccaaggucuuacagcuaaagccagguaauucacacuuucugcaaacuagccuucauccaggagccauuugaguuggauccugagggauguguaggaguuugccaugcagaaaguuuaaggauuuauucugacacucaccguccaacgcuuuguuggguguugcugggcucaagaggcaucuaggggugccucgagggaccccugagguagagggagggaccuggaugggaggagcacaugagaggagccaggcuuccuggagugguggguagugaagaagggucuuucaggcagaggaaauagcuugggcaaaggcuugcagugagaaagguccuguguguuuugguaauaauuucacaagacuggaacaugagggucagcuggaggaaauguggccgaucacagagggccucaaccaugugcugagaggcugggacucuuuggagggcaauagggagucacagagggugugugagcagggggaggucacagcuggauuugagugucagagccuuccagggccagugcacggggcugggcuggacgcugcagggcaugucuugccaggucccuaaggacaacgagacacaauuuuaggaaggaagggcaggaggccaggugcgcuggcucacaccuauaaucccagcaauuugagagguggggguggaggaucacuugagcccaggaggucgagacugcagugagcuaugaucacgccaccauacuccauccugggcagcagagcaaggcccugucucaaaaaaaaaaaaaaaaaaaaaaagcaggaaaugcaaagcugacccaguuccauguugcuucucugugggauuugucaguaccuucaauaaguuucuucucugugggauuugucaguaccuucaauaaguugcuuggcacugggaaucuccagguguucccuuuccucagagaagcaucucugggaguuggcauagggcguggccaggguccucaucccugccuucucugaccacaggguucgaguucuuugaggcaagcgccaaggacaacauuaacgucaagcagaccuuugagcgccugguggaugucaucugcgagaagauguccgagucguuggacacggcggacccugcggucacaggcgccaagcagggcccacagcucagugaccagcaggugccaccgcaccaggacugcgccugcugagagccaucccacucccuuuccccucuucccugucuuccccaccuucccccaacuacccgggccugacccggccccuaccagccacgggcacaagaccccugcuccugacuuagcccgucacccuuauuuauuauuguagcuauuuauuuauuuauugaagaugucccccaggggcccaggcuccccugcccgccccaagcccugccccuccuguacauauagcccuuuccccacucagcuguggugucucguggccccgugaacucaccgcucacccuccugaaccccccccccccgccuuuuuuuaaaauucacccccauccacaguugucaguugugaagaggggccagaugacacccuaaagcaggcugaucgggcaaugggagguggccaggccugccagccccucggcucugccgcggugggccgaggccgcuguuggggguuucccuguguggaccauggggaucagagucuggccugccaggcuccucuccccguuuucucuuuuggugggggggugugcuguggguauucaccacccugggaccccccccccccccgcccaccagaccuguucugaccucaugagugucaaacgugccccccaguuccuuaggagaugucaugacaacacuacacgcacccaauaaagcgaauggaccauccaugugugucccugugagcaccggguccugcccacccugguuuugaucauccacagcauuuucuuuuguuauuuuuauuuuucaauauaaauagagacagggucuugcuauguugcccaggcuggucucgaacaccuggccucgagcaauccuuccaccucagccucgggaagggcugagauuacaggugggagccacugcgcccagccagcaguuucaguuacauuauagagagaguuuaauggcauuuccacaguucaggaccagggaaagaaacacagaggcugccuggcccuaugugaaacuuuugggggccgacuccaggccugagccugcucugaggggaucagucauguccccgccuuagucccaggaccugagggagcucuggauugguggcuuggcccagagccagguggauggcaguguugaggggcuggugcuugagacugguuggcagagugggcccugugcugaggaugggacaucuuggucacaggucgcaugagguuccugcugagaagggcuaggggaugaucauccaucuucauggguguguuccgguugaggaaacucagucccagaagugagcuuggaaagggcggcucagcccaaugcuccggagcugaaguggugcugggacguggcucaagacccgagcuugcugcaggagcccauuccccuucugucagagggggugguccgccaggagacagucuugcaucugguccaggaagcagacaguucagucugcucggguguccagggccacacagccugggggugucagaggaacugggcucuguccacacaagacaaggcaucuggucagaagccuggcucaucccucccugucccucuaccugcccuugggccagaggucagcccugcucaacagacuuggcagggaccgggcugaggucacaucagacagcagagaaggguugggucuuuuuguuuguuugagacggagucucgaacugucgcccaggcuggagugcaguggcgcgaucucggcucacugcaagcuucgcugcccggguucaggccauucuccggucucagcuuccggaguagcugagacuacaggcgcccgccaccacgcccggcuaauuuuuuuuuuguauuuuuaguagagacaggguuucaccauguuagccaggacggucucgaucuccugaccucgugauccgccugccucggccucccaaagugcugggauuacaggcgugagccaccgcgcccggcaugggucuuuuuuuuuugaaacggagucucgcucugucaccuaggcuggagugcaguggcaugaucuuggcucacugcagccucugccuccuggguucaagcaauucuccugccucagccucucaaguaacuggaauuacaggugcguaccaguaauuuuuuguauuuuuaguagagaagggguuucaccauauugcccagucugcucucuaacuccaauuucaggcgauccacccgcuucggccucccaaagugcugggauuacaggcaugagccacggcgcucagccacggcugggucuuaacugcuagugaggagcucuccgccagcccacuguuggguguggguugucaggagcacaggagacucccacccuccaggguggcuggcuacacugccacuuggagcu

SEQ ID NO: 15639 - RNA, 8930 nt, Homo sapiens
agcuccaaguggcaguguagccagccacccuggagggugggagucuccugugcuccugacaacccacacccaacagugggcuggcggagagcuccucacuagcaguuaagacccagccguggcugagcgccguggcucaugccuguaaucccagcacuuugggaggccgaagcggguggaucgccugaaauuggaguuagagagcagacugggcaauauggugaaaccccuucucuacuaaaaauacaaaaaauuacugguacgcaccuguaauuccaguuacuugagaggcugaggcaggagaauugcuugaacccaggaggcagaggcugcagugagccaagaucaugccacugcacuccagccuaggugacagagcgagacuccguuucaaaaaaaaaagacccaugccgggcgcgguggcucacgccuguaaucccagcacuuugggaggccgaggcaggcggaucacgaggucaggagaucgagaccguccuggcuaacauggugaaacccugucucuacuaaaaauacaaaaaaaaaauuagccgggcgugguggcgggcgccuguagucucagcuacuccggaagcugagaccggagaauggccugaacccgggcagcgaagcuugcagugagccgagaucgcgccacugcacuccagccugggcgacaguucgagacuccgucucaaacaaacaaaaagacccaacccuucucugcugucugaugugaccucagcccggucccugccaagucuguugagcagggcugaccucuggcccaagggcagguagagggacagggagggaugagccaggcuucugaccagaugccuugucuuguguggacagagcccaguuccucugacacccccaggcuguguggcccuggacacccgagcagacugaacugucugcuuccuggaccagaugcaagacugucuccuggcggaccacccccucugacagaaggggaaugggcuccugcagcaagcucgggucuugagccacgucccagcaccacuucagcuccggagcauugggcugagccgcccuuuccaagcucacuucugggacugaguuuccucaaccggaacacacccaugaagauggaugaucauccccuagcccuucucagcaggaaccucaugcgaccugugaccaagaugucccauccucagcacagggcccacucugccaaccagucucaagcaccagccccucaacacugccauccaccuggcucugggccaagccaccaauccagagcucccucagguccugggacuaaggcggggacaugacugauccccucagagcaggcucaggccuggagucggcccccaaaaguuucacauagggccaggcagccucuguguuucuuucccugguccugaacuguggaaaugccauuaaacucucucuauaauguaacugaaacugcuggcugggcgcaguggcucccaccuguaaucucagcccuucccgaggcugagguggaaggauugcucgaggccagguguucgagaccagccugggcaacauagcaagacccugucucuauuuauauugaaaaauaaaaauaacaaaagaaaaugcuguggaugaucaaaaccagggugggcaggacccggugcucacagggacacacauggaugguccauucgcuuuauugggugcguguaguguugucaugacaucuccuaaggaacuggggggcacguuugacacucaugaggucagaacaggucuggugggcggggggggggggggucccaggguggugaauacccacagcacacccccccaccaaaagagaaaacggggagaggagccuggcaggccagacucugauccccaugguccacacagggaaacccccaacagcggccucggcccaccgcggcagagccgaggggcuggcaggccuggccaccucccauugcccgaucagccugcuuuagggugucaucuggccccucuucacaacugacaacuguggaugggggugaauuuuaaaaaaaggcgggggggggggguucaggagggugagcggugaguucacggggccacgagacaccacagcugaguggggaaagggcuauauguacaggaggggcagggcuuggggcgggcaggggagccugggccccugggggacaucuucaauaaauaaauaaauagcuacaauaauaaauaagggugacgggcuaagucaggagcaggggucuugugcccguggcugguaggggccgggucaggcccggguaguugggggaagguggggaagacagggaagaggggaaagggagugggauggcucucagcaggcgcaguccuggugcgguggcaccugcuggucacugagcugugggcccugcuuggcgccugugaccgcaggguccgccguguccaacgacucggacaucuucucgcagaugacauccaccaggcgcucaaaggucugcuugacguuaauguuguccuuggcgcuugccucaaagaacucgaacccuguggucagagaaggcagggaugaggacccuggccacgcccuaugccaacucccagagaugcuucucugaggaaagggaacaccuggagauucccagugccaagcaacuuauugaagguacugacaaaucccacagagaagaaacuuauugaagguacugacaaaucccacagagaagcaacauggaacugggucagcuuugcauuuccugcuuuuuuuuuuuuuuuuuuuuuuugagacagggccuugcucugcugcccaggauggaguaugguggcgugaucauagcucacugcagucucgaccuccugggcucaagugauccuccacccccaccucucaaauugcugggauuauaggugugagccagcgcaccuggccuccugcccuuccuuccuaaaauugugucucguuguccuuagggaccuggcaagacaugcccugcagcguccagcccagccccgugcacuggcccuggaaggcucugacacucaaauccagcugugaccucccccugcucacacacccucugugacucccuauugcccuccaaagagucccagccucucagcacaugguugaggcccucugugaucggccacauuuccuccagcugacccucauguuccagucuugugaaauuauuaccaaaacacacaggaccuuucucacugcaagccuuugcccaagcuauuuccucugccugaaagacccuucuucacuacccaccacuccaggaagccuggcuccucucaugugcuccucccauccaggucccucccucuaccucaggggucccucgaggcaccccuagaugccucuugagcccagcaacacccaacaaagcguuggacggugagugucagaauaaauccuuaaacuuucugcauggcaaacuccuacacaucccucaggauccaacucaaauggcuccuggaugaaggcuaguuugcagaaagugugaauuaccuggcuuuagcuguaagaccuugggugugugcccuccccucucuuaguguccuuuuucuagacuugugggucuccagcccagcugggcacucaccaagguggucagcuagcugccggccacguucugaugacaccacccgcucauccuccaugucacacuuguuuccuaccagcagcaccugggcauugucccaugaguaggucuugaucuggguggaccuauaggaggcaccaaugggggcaggucagggcuuggaggaucccagcuccacccugacgggcugauguggagccuguguccuuguccgaggaagaaagacccagaagcuugccccuccauccuccccaccauccuuucccccaaugugccccgcuuucaccccacuccagcccccgacugacccauuauuguuucuguguuuugggguuuuuuuugagauagagucugggucuguugcccaggcuggaguaucugccugccuucgcuucucaaaguacuggaauuacaggcaugagccacccagcccagaaauuuucuuuuuuugagauagagucuugcucugucgcccaggcuggagugcaguggcgcgaucuaggcucacugcaaucuccgccucccagguugaagugauucuccugccucagccuccuaaguagcugggacuauaggcaugagccaccaugccugguaauuuuuugugcuuuuaguagagacaggguuucacuauguuggccacgauggacucgaacuccugagcucaagaucuacccaccucggccucccaaggugcugggauuauaggcaugagccacugugcccaacccagaaauuuuuuuuuaaaguuauuacuucugagcagaaaauugaaauguuuacaaucucuaaccuaugccaacucuccuuuuuuuuuugagacagaguuuugcucuuguugcccaggcuggagugcaauggcaaucuuggcucacugcaaccuccaccucccggguucgagcgauucuccugccucaggcucccaaguagcugggauuacaggugugcgccaccacgucuggcuaauuuuugcauucuuaguagagaugggguuucuccaucuuggucaggcuggucucgaacucccgaccucaggugauccaccugccucagccucccaaagugcugggauuauaggugugagccaccgugcccggccaugccaacucuccuuauagucucuauauucuccacccuacacuugcagauauuuguuucuauaugguuauaguuuuacuuuuccaucugaaauccuucucugaccccuacguuuuauuuauuauuuuuugaagaaaguuuggcucagagacaauggccccagaaugaguguggaaggccagaagcgauggcucacgccuguaaucccagcacuuugggaggccaaggugggcagaucacuugagccaaggaguucaagaccagccugggcaacaugaggaaaccccaucucaacuaaaaauacaaaaaaauuagccagguguggugguauaugccuguagucccagcuacuugggaggcugaggcaggaggaucacuugagcccaggaggucgaggcugcagugagcccugaucgugccacugcacuccagccugggugacagaauaaaacccucucucaaagaaaagaaaagaaaaaaaaagagcaagugggguacacucaccaguccugcacugcauugaaggauuccucguuggugaugucauacaugaggaugaagcccauagcgccccgguaguaugcgguggugaugguccgguaccgcucuugcccugcuguguccuagggaggaagagaugaaggucagagaggaccugcacauaaggcccucgaagaggaaaugagcucugauaucauccaguucagcccccugggagaagcaggagcuugcccaggggcacaaagugucaggaagagcagguugggucaccagugcucagaauauaugagugcuccauuauuccacagagucauucaccaaacguacugugccaggugcuguggcucacaccuguaaucccagcacuaugggaggcugaggugggcagguggcuugaacccaggaguuccagaccagccugagcaacauagcaagaccccaucucuacaaaaaguacaaaaauuaacagggugugguggcucacaccuguagucccaacuacucaggaggcucaggugagaggguugcuugagcccaggaggcagagguugcagugaggugagaucgcgccacugcaguucagccugggugacagagugaaacccugucucaaaaaacaaacagggggucggguguggugguggcucacgccuguaaucccagcacuuugggaggccaaggcagguggaucaccugaggucaggaguucgagaccagccuggccaacauggugaaacucugucucuacuaaaaauacaaaaauuagcucggcgugguggcaugcaccuguaaucccagcuacucaggaggcugaggcaggagaaucgcuugaacucaggagacagagguugcagugagccgagaucgcgccauugcacuccacccugggugacaagagcgagacuccgucucaaaacaauaacaacaaaaaaaaaaaaaaaaagaaagaaagaaagaaagaaagaaagaaaacagaggccaggcgugguggcucaugcuuguaaucccagcaccuugggaggccaagacagguggaucacuuguggucaggaguucaagacuagccuggccaacauggcgaaacccuaucucuacuaaaaauacaaaaaaaaauuagcugggcuugguggugagccccuguaaucccagcuacucaggaggcugaggcaggagaaucgcuugaacccgggaggcagagguuucagugagccaagauugcacuacugcacuccagccugggugacagagcaaaaacucugucucaaaaaacaaacaaacaaauaaacaaacauggacugggcacugaucuuuuccacacccugaacuggacacuggggacacaguuguuaacaagaugggcacuucccuugcuaagugacacucagugugggaaauagaaaauaacgguauaaauguauccuauauuggagagugacaaggaccaaggagaaaaaucaagccagaugaagauggagagaauuuaacuguagguuuaaaaauuaaaggaagcugacacuugccuguacucccagcuacuugggaagcugaggcgggaggauugcuugagcccacgaguucaaauccagccugggcaacagagugagacucugucucuuaaaacuaacaaggccaggugggguggcucaugccuguaaucuuagcacuuugagaggcugaggugggaggaucgcuugagcccaggaguucaagaccagccugggcagacauagcccgacccugucucuacaaaaaagaaaaaaaucagcaggcguggugguagaagcccgugguccuagcuacucaggaggcucagguggaagaaugguuugagccugggaagucgaggcugcagagagccgugaucacguaacugcauuccagccuaggggacagagcaagaccacccugucucaaaaaacaaacaaaaaaagagaauggggaccaagauccagcugaaaccucauacauggaagaacuugaagauggggaaacugagggaccaggauuaggugcuuaugggagaacacaggugcuguuucugccccgguacacagugggcaccuuacugauaaaugcccaguguguaagugaaugacuccagucaggaaagagauagacgagguuggggcugcuuuuccaaguacgggaauccaaccgagccgggcgggagcccuccagcugggacccacccagaucugcagcuugauccucuugucguugcgauagauggucuugaccuugaagucgaugcccacggugcugacgaaggcaggcgugaacgagucgucagcauagcggaagaggaaggacgucuugcccacgcugcuguugccgaugaugagaaucuugaacauguagucgaaguucugauccgaggacuccuucugcccauagcgcgagucuguggcggaugccaucuggggauaccggguguagcagagccgugaggggggcucucuccauccucaugugcccaagcccaggcagaagauggcaagggcuccagaaaacggccgguguauggaggacacccuuaucccaucaggagccccaguauuaauugguggugcccccagcagagggcagccugugaccuugaaauccugggcguuucagaggaggggcucagaggguugccgauggggacaccccagcagcccccuucaaggggcaggugccccagguggggcuguaacccuaaacccagggcugagcccggagggggugacugcggcuggcuccgccccccaucaaucuuucaugguccucagaacccggccgcgcggccccacgugcaccgcgugcauggucccucgaggacgcgcaucugcagcccccgcuccccgcaaaccuccaggccggagagcuccggccaaggccgcugcaucacaugauacaggaggggcaugcacacgcucacgugcacacagccucaaacacgcucauccguacauacaggagugugugaacgcacugaggugcacaggacaaagacacagacaccuguuugcacaccgacucgccuauagaaaugugcaaaccacccgugcgcacaggccccuccacccaugcaggcgugugcacaucacccacacggacacggauccccgugcuuguaugcacgggccauaccugcacaggcgguccacacgucuuucuccacgcgcgugcaacgcucacacacuuaggcccagacccccacggcgucacacgagcauauccagguacacaagcaagggugcacacagacccgcugacacaggcaggcgcgcacacgcgugugcacaccacgcgcacgcgcacgcaaaagccucccgcgcgcacagcuucccgcaaggagcucggcuccccucccccuccgccgcagagcagggggguuggggggguuaguggugaggaucaggcaggaguggggcgcccgggcccuacccauucccagccucgcgaccgccgcauccuuccccccauucaacccuagucaaccucgucccccaccuccaucagcccaucagucaaaugaagguuaugcaggugcucggagccugagcacacccggccgcccaggagcucaccuugcccugcaccgaugcaacggcgacccuagcggcggugacuuuuuuggcgguggcggugacaggaccccggugcguugauguggggcugcgcggcggcggcggcagcagcggcucaggccccugcaguccuccgugacguccugcaaagggaggggcggagccucacauguagaua

SEQ ID NO: 15640 - RNA, 24965 nt, Homo sapiens
gggcgggccaggccgcucggaaccguggcggcggcggaggcggggaucccgcggcugcggcgacgguggccgcgguggagccacggggcgggcuuggcuuggugugacggcggcugcggcggcgguggcggccgcgaccaggugaguccugacuggcccucguggcgggggcggcugggagugugcuuaaaugcggggcgcccgggggcagugccgggccccgguggaagccagaacgcaagcgccaggcugcgucgggccccgcgggaacugggggggccgcaggcaagggggggccucgggcucggcuccgcagcggugcagccuccuugggacggucggggcagaauggggagagacuccccgcguccaagauaccggacuggagccgaggccccaaaugaagggaggcccugccuggaauggggcuucgaauaguaccgaggggcgcccaggcauugugcggggcagaauggggugcgggagggccgggggucgaacccacuuccgguccccuagccggguggccggguccacgcagacccaagugcgcgucugugugagcgcucaggcccugccuucacccgcggagcccccagcccugccugccccgccccucccgccucccggauucggggagcgcugcucccggggcgcgcacaccggggcgugggggcgggcuggcaggcagauccaggcgguuuucugggcauccccucucggggccucaguuuccccaccuguagaaugaggguaacagaggccuaggaauggguaaauugggcacccgagaauguggcgccccuccgcccugcucggacaccucuugggguuccccgugacugaaggaugcucagagccuccaccugacacucgggccucuugguggauagcaccuauccuuauagccacccugaauccuugacaagcaacuuaacccacugccaaggcuuugcaugugccguuccgucugccugucgcgccuuccuauccgcugugaugauccauucucuagaacagcacguccaucccccgacccuagcccuguccaucacagggcgucugaacccgcagggcuaggcugggaaugugugccuaucuccgccuccccaggcugggacuccuggggaauaaucaaugcccugcugccggcagccuccccuccuccucagcugcaguacccccaccuucuccuggcucccugucccugccuggggcuaagguuccuucuaagcaccuccccaucugcauuuugugccuacucugggccccaggcuggagcuaccugccagcccacucacuccuccucugcagagacuggagguccauuugcuuggacucaccucgaggccuuugcuuguguagaggccucuuccuggacuuuguucccuaccucuuaguucagcuggccugaccccucuauggagcucccaaagcacccggaguggccuccauugcguccucccugcccuagguaucuggccaccuggcugcugcccccucauguccaacugggccaagucggcagaucuagguguaaguccuggcuuccuccuggccuacugcacggcccuagauaccucccugcucugagccucaguuuccccaucuguaacaggggugaugaaaagccuguuuacuggccgggcgcgguggcucacaccuguaaucccaacacuuuggaaggcagaggcaggaggacugcuucagcccaggaguuugcgaccaaccugggcaacauagcaagaccccaccucuauuggaaaaaaaaaaaaaaaggcugggcaagguggcucaugccuguaaucccagcacuuugggaggccaaggcgagcagaucacuugaggucaggaguucaagaccagccuggccaacauggugaaaccucgucucuacuaaaaauacaaaaauuagcugggugugguggccugcuacucgggaggcugaggcaggagaauugcuugaaccugggagacagguugcagugagcugagaucacaccacugcacuccagccugggugacagagcaagacucuaucucaaaaaaaaaaaaaaaaaaaacugauuuacugagcauguaguauaccuggggcagguucuugggaacucuacucccagcagcuccaagggaaggcugucaguauacccauuuuacagauagagaagcugaggcccugagagggaccggccccaaggucacccagugauucagggaauuccaaaucaggauuugggcccaucuccguguugggggugagaggaguuggccuggcuaacgcugcccuaucccugucucccuaggucggcguccucagcuggccgagcaugguggcagccugcacccuuggcucccuugucuggugcagccagcagagccgccagccuugggcgcccauggcccuccgugugagggcgugagcggccugccccagccucaccugcugauggaggacucaauggcccagugaccugacaccacaccaccaacucccucccaccagcugacgaaugguggacccagugacgaguggcccuuguaagggucauggaauaauuugaagcgaggcaugagcggccccuguggucgccugugacugcuggagauagaggucccagcaccccaagccaacccagcggacccucccagcccugcuucaaccaauggggccaguggggcuccaagcagccaccuaaccauccagaccccaccccacucacgcggccauggcgggcccugagggcuuccaguaccgcgcucuguacccguuccgccgggagcggccggaggaccuggagcugcugcccggcgacgugcugguagugagccgggcggccuugcaggcgcugggcguggccgaggguggcgagcgcugcccacagagcgugggcuggaugcccggccucaacgagcgcacacggcagcgaggugacuucccuggcaccuauguggaguuccuggggcccguggcccuggcccggcccggcccucgcccacggggcccccgcccacugcccgccaggccccgugauggggccccugagccaggugagcagcaagcaggggcccuggaaaggggggugguccccucagacccuuggucuccucuucuguccagugaggcaaugggaucuccaaggaaggaggaaaaaggacauuuggucauuugacaagugucuucagugcuaggcucagcaguggacacaaggccuguuccugcccucaugagcuucugguucaagaagggaugagaguggguucaggaggugacacaugccaugaggaagggggcuugcgugggaagaugcgaggguggaagcucaaggcagugggggcagcgagggcagaggcuguggaguagaacucuaauggcgggaacggccagcaggaggaccagagggaggaaggggagggcaaugugcgcuggcauggaggacuuagugggauugauuuugaggacaauggagaguguucaguaggauucagaggcucagccuagcuucauccugccuuuugcagacagggucccuugaagaaccccuuuggagacccugauuuccaaaaugaagccacaaggaggguaggaugugggcugcucagcugaggccacacagcacagugggauaugaggaccccacaucccucuucaaagacccuuggccaucaccacuugccaggggugugccagguguagagaaucgggggcaccgagcccacucagugacugcuguuugaugggcagggagugugggcucuggccggggaaacuguggcccagguugcaaggaggaggcuaagaggugcugcaugcucggcauggucugcuccgacccucccagcagcccagcaaaaggcccugugugcagaccgggaggccugagugcaaggccgucaaaugccguacuugaaaccaguuggucacccagggaggccaaagccccgggaggugccaggccugcuuugugccagggugacauugcccaaaggcaaaccagagucccccagcgcagggcggaauagggggugcugagguggugcgacgcuggccccagccuccaggcaucugguaucuccagggcccaggccugcguccugccucggccugaaggagcaggagguggccccgucugggcucccagccagaaucugccucucccccugguaacagccaccucccuccucugccuggccucuguccagccaccauacacggccccacguggggcggcugcccagccccacccucugaaucuuccaggguuaugugaccucggccagaacccgcccccucgaggccucaguuuccucaucuggaaacaacaggguuggucccuggggaugcugggacccaaccccucggaaaugugcugaagucaccugagccccaccuggcugugcacccacgggggagguugcagccccucugacccacaauuccucaccugcaaagucggggugaugcaguucugaugggaacccccuccccauucugcagauugaucccaggccacucucaggguugaguuucccaacccaccggccagagugucacccaccuccaccuccuccuuguccuuuuccuuuuuuuuuuuuuuuuuggcguuuucguugcagcugggccuuucuccagcuugaggcgccaccuggcccaucacucagggaggccccgcaggccccggcuugccccugcugugugccagggcguccccgccgagggccagagcagcguccaaugguggcagacagcgagcugcugaggcggggaugcugcacacaaaaggcccuguagugcugggaagccagggcugggagggggcugggcccaggaugccgccggcacccgcuaggagggguuucagcuuuuccaaaaggggagcaauaauuuucuuucuuuucuaaauuuuaauuuggggaagaaauaauuuuuuagaagcaaaaugauuaagaaaacgggucaugguccuuggaaggaagcuguucugacccaggccgggauauuuuucuuuucuuuccuuucaaccacuuuuuuguuugcaucaagaagggagaagcgggccgggcacagugguucaugccuguaaucccagcacuuugggaggccaaggcggguggaucacuugaggucaggaguucaagaccagccuggccaacaggguaaaaccccaucucuacuaaaauaauacaaaaauuagccaggcaugguggcacccaccuauaauuccagcuacuuaggaggcuaagucacgagaaucgcuugaacccgggagauggagguugcagugauccaagaucaugccacugcacaccagccugggugacagagcaagacuccaucucaaaaaaacaacaacaacaacaacaacaaaaaacgaggaggccaaggcaaguggaucguuaggggccaggaguuugaggcugcagugagcuaggauugcgccacugcacuccaaccugggugacaaagcaagaaccugucucaaaaaaaaugagaggcaaugucauuggcccauuuuucauuugaaggaacugaggcccagagagggcagguccuguggccaagauugcacagcagguuguggcagagcccaaaccugcuauaugacuuucaguggcugccgcaaaaauuaccaccaacuagguggcuucaaacaauggaaauguuauuuauuaauuaauguaucuuuuuguuuuguuuuguuuuguuuugagauggaguuucgcucuugucgcccaggcuggagugcaauggcgcaaucuuggcuccugcaaccucugccucucggguucaagcgauucuccugccucagccucccgaguagcugggauuacaggcacgugccaccacgccuggcuaauuuuuguauuucuaguagagacaggguuuuaccauguuggucaggcuggucucaaacuccugaccacaagugauaugcucaccucggccucccaaagugcugggauuauaggagugagccacugcgccuggccuccuuuuuuuuuuuuuuuuuuuaaauuauuuaagagauggggucucacucuguugcccaggcuggucuugaacuccuggacucaaaggauccuccugccuuggccucccaaaguguugagauuacagacgugagccuuugcaccccaccacaacagaaacuuauucugucauguuucuggaggcuggaaguccaaaaucagggucgugcccccucugaaguuuccuuccuugcagcuucuggugccuccaggcauucauuccucucaugcauggguugauuauuccagucucugccuuggcuuucucuucuuuuuuuugagacagagucucacucugucacccagacuggagugcuauggcaugaucucagcucacugcaaccuccgccuccuggguucaagcaauuccugccucagccuccugaguaguugggauuacaggugcgcaccaccacaccuggcucauuuuuuuuuuguauuuuuaguagagaugggguuucaccauguuggccaggcuggucuugaacucuuaaccucaagugaccugcuggucucagccucccaaaguacuaggauuacaggcaugagccaccgcacccggccuguugacuuauuuuugaaacggagucuugcucugucgcccaggcuggagugcaguggugcaaucuuggcucacugcaaccuccgccucccggguucaagcgauucuccugccucaaccucccgaguagcugggauuacaggcacccaccaccacgcccagcuaauuuuucugauuuuaguagagacagguucgccauguuggucaggcugguucgaauuccuggccucaggugauccacccaccucggucucccaaagugcugggauuccaggcuugagccgccauccuggccggcuuucucuuguuacaaggacaucagccaguggguuuaguguccacccuaaugccaggcuggucucauguacagauucuugcuuuccuuacaccugcaaagaccuauuuccaaauaaggucacagguaccagggaugaggacuuggacauaucuuuuuggggacuuuauucagcgcacuccaccuagucugugaaguugugugaacuccucauauucuaacccagaaaauugugucccaucaauucugcccuuucccagccccuccacccaaggucuugcagccuccugcggaugggagucaaggugccaagcacuugccugagcugggcccugccucaaacugccccagcugagguucagccagcaaagagaggggcugggcuccuuccaggaaccccaccaacaugcaaccccccuguuucccccaccaggccucacacuccccgacuugcccgagcaguucuccccaccugauguggcucccccucuucuggugaagcuuguggaggccauugaaaggacagguaaguuccagccuggcugcagccccuggauucugcuugcuuaccucuagugacaggcgacucauccucucacagggccuccaagcucaugcugcacggaaacaggcugagccuggaugcccugggccucuauguugaauagggcacagagugacuccuaagggaagaugggaaggugaacaugaccaggccacugcaugugcugugcccucucccaguucucccuccccaccccucccaugcccuuaucucugggcagcaaagggagacugcagggggguugagcggccaguccaggccucacgaggucggggcagcauuugagagcugacucgccuguccccuucacccccagggcuggacagcgaaucucacuaccgcccggagcugcccgcaccgcguacaggugaaggggagccucaaugggguugggaggaggcugggggccccaguacacaugaguuggacgugugccccccugcacccgcagacuggucccugagcgacguggaucagugggacacggcagcccuggcugacggcauuaagagcuuccugcuggcacugcccgcgccgcucgugacccccgaggccucggccgaggcgcgccgggcccugcggggugagccuggcggguagcccgggggaaggagggggcuguagcgggugggagggcccaggccuggcucacccugcccuggccaucuguccgcagaggccgcggggcccguggggccggcgcuggagccaccgacgcugccgcugcaccgcgcgcucacgcugcgcuuccugcuccagcaccugggccgcguggccagccgcgccccggcccugggucccgcgguccgggcccugggcgccaccuuugggccgcugcugcugcgcgcgccgccgccgccguccucgccgccgccagggggcgcucccgacgggugaggggcggggcggagccggagcgagcagggguggaguuugggguggggcgggcggggcauggccagagugagcggcgucuagacccuaagaagggaggggaugggguccagagugagaagcugcguucuugugaugacggagcggagaccugggcuccugagucgugggacagaaggugaaggggccuagucccgaagcauguggguggugccugcaccuucccuucugcucgucgcagcuccgguacuggucucucgcucgccuuugugugagaaucuauggagcacuuacugcauacagcuaugagggagcuggccucgcacaugugccuguaucaucuccuccuccgcccugcacauacugucucguauauacccccaggcgugcaagcgcacgcacaauccugugcacaugcgugggcggacaggcccuacccagcccucaccacacuccccuucccccuaaggagugagcccagcccugacuucccggcgcugcugguggagaagcugcuucaggaacacuuggaagagcaggagguugcgcccccaggugaguccccuguauugcugucauuucuucccguugggggccguaaauacugaucccugagugcugccggcaucagcaggcugguugcagugggaggcagccacaguauacagucggugcucaggaugcauuuguuuuccugucccccagcgcugccgccuaaaccccccaaggcaaagccggccuccacaguccuggccaauggagggagcccacccucccugcaggaugcugagugguacuggggggacauuucaagguagguugcuggcagggggccagggaccaaggaggugucacagggugagcggggucuccagguggcucggcagucccaauguuggauguucccacagggaggaggugaacgagaaacuccgggacacucccgauggcaccuuccuaguccgagaugcuucuagcaagauccagggcgaguacacgcugacccucaggugggggccugucccugcaaggauaaccgggggucacaggucacagagaccgggaguucagaggggauagaacaugugcgguuucaagaauggagggccaggcacgguggcuuacaccuguaaucccagcacuuugggaggcugaggcuggcagaacaccugaggucaggaguuuaaaaccagccuggccaacauggugaaaccccgucucuacuaaaaaauuaaaaaaaaaaauuagccaggcauggugauggaugccuguaaucccaacuacucgggaggcugaggcaggagaauugcuugaacccgggagguggagguugcagugagccgaaaucgcaccacugcacugcagccuggacaacagagcagcaagacucugucucaaaaaaaaaggggacagggauugagggucaggugcggggucccacugggugccgacaccccucuccucccccaggaaaggcgggaacaauaagcugaucaaggucuuccaccgagaugggcacuauggcuucucagagccacucaccuucugcuccguuguggaccucaucaaucacuaccgccacgagucucuggcccaguacaaugccaagcuggacacacggcuccucuacccuguguccaaauaccagcagguccgugcuggccugggagccagggaggguagcaccuggcuggccccaggccucaguuuccuagguagacccgaccaggcuaugcaucuccccucauuccgccacguaucuccaggaccagauugucaaggaggacagcguggaggcagugggcgcccagcuuaaggucuaucaccagcaguaccaggacaagagccgcgaguaugaccagcuuuaugaagaguacacacggaccucccagguacuccaggccccguacaugagggaaaccgagacauagaggggcaguggcaaggccgggagcaggaugaccaaccccagaggacuugaggaugaauauccaguugcaggucacagagcaggcacuuagcaccaagggcuguucuaaaaacauagaaauaaggccaggcacaguggcucccgucuguguacuugggaggcagagacaggaggaucacuugagcccaacaguucaagauccuucuaggcaacauagggagacccgucuacaaaaaaauuuaaaaauuaacugggugucguggugcaugcuucuacucccagcuacucaggaggcugaggugggaggaucccuugagccugggaguuugaggcugcauugaauugugaucaugcugcugcacuccagccugggugacagggcacgaccuugucucuaaaaacagaaauaagcguacgaggcugggugggguggcucacgccuguaaucccagcacuuugggaggccgagauggguggaucaccugaggucaggaguucgagaccaacuuggccaacauguugaaacccugucucuacuaaaaauacaaaaauuagcugggcaugguggcggacgccuguaaucccagcuacucagaggcugaggcaggagaaucgcuugagccugggaggcagagauugcaaugagccaagaucgugcuacuacacuccagccugggugacaagaguaaaacuccaucuaaaaaaauaauaauaauuaaaauaaaaaaauaaguguacaagcuuuuacaaaaccaaaaaaggacagaugagaagggcccaaccagccucacaggaguggcugagccaggaccuggggaguguccaggaugagccuaucuccggcuggcccucaguuuucccaucugcagaauggaaccaggcaccuugauuacuuauguccccuucaaccaagauguuauucaaaaugaaaucaugccaggugcagggcgcgcaccucuaaucccagcuacucggaaggcugaggcgggaggaucgcuugagcccaggaguucaagacuagccuggguaacauagcaagacuuugucucuuaaaaaaauaaaauaaaaauuaagugaaagguuuugucacucaaggacugugcuaauaagcuucuuuugcaaguuaagagggaauagauucagguggaacagcugggaauuccucagucgucccuaguacccuaaggguuuucuguccucuuuuuuuuguuuuguuuuuuuuuuuuugagacagugucuugcucugucauccaggcuagagugcuguggcaugaucucagcucacugcaaccuccgccucccugguucaagcgauucuccugccucagccucccaaguaacugggacuacaggcacgugccaccaugccuggcuaauuuuuguauuuuuaguagagaugggguuuugcuguguuggccaggcuggucucgaacuccuggccucaagugaucuggcugccucggccucccaaaguuaaaaaaaaaaaaagaaaaaaaaaauuuaauaaaauuaaaagguaggccgggcacagugacucaugccaguaaucccagcacuuugggaggccgaggcaggcagaucaucugaggucaggaguuugagaccagccuggccaacauggugaaaccccaucucuaccaaaaagauaaaaaaauuagccgagccaggcacaauggcucaagccuguaaucccagcacuuugggaggcugaggcagguggaucacgagguaaggaguucaagaccagucuggccaacauggugaaucccugucucuacuaaaaauacaaaaaauuaggcgucauggcaugcaccuguaaucgcagcuacucaagaggcugaggcaggagaauagcuugaaccugagagguggagguugcagugagccgagaucacaccauugcacuccauccugggacagagugagacuccgucucaaaaaaaaaaaaaaaaaaaaaauuagccgggcaugguggcucacaccuguaauaccagcuacuuggaaggcugaggcaggagaaucacuugaacccaagaggcagagguugcagugagccaagaucacgccacugcuccagccugggcgacaagagcaagacuccaucucaaacaaaaaaaauuuugaggugcugucucaccauguugcccaggcuggccucagacuccucaggguucaagagauccucccacuuuagccucccuacuagcugggauuacaggcauucgccaccaccccuggccucuguccccuuuuuacugauguguuagcugaggcucuaaauggacaagacaguuguccaggaucaguuaggagcacuguaaccucagaauugacuuuggcccugagccucaguuucucuguuaauaguuguuacuuuguuagggguuguuggaaggguccaugggacaaaguaaggaaagucguagugcggcaucucccccaagaagcccugugagcuguagcaacuagaucugucauucauucuuagcaguguuaacagguccagguguuuguggauaccuauaggaggauguaaagaagaagaggguuuggggggugggguuuugaaggcugaauaggaguucauuuggugcagcaggcguuagaagaaugacacucugauagagggaccagcuugagcagucuccguaucagaguugagaugugccuuuaccccucacgagggccuuuuggggagucccaggaggugcugagcugcgcccccuccuccaggagcugcagaugaagcguacugcaauugaggccuucaaugagacuaucaagaucuuugaagagcagggccagacucaagagaaaugcagcaaggaauaccuggagcgcuuccggcgugagggcaacgagaaagagaugcaaaggugagucuggcgccucugcccugccccaccccacccugaucuggugcaguacaagccagggagggaaggaagcagaaggaggccagccacuuggaggcaaagaguagucuguugaaauggacuuugggccuggugcgauggcucaggccuguaaucccagcacuuuaggaggccgaggcggguggaucuccugaggccaggaguuugaaaccagccuggccaacauggugaaacccugucucuauuaaaaauacaaaaauuagcuaggcaugauggugcgcaccuguagucccagcuacuugggaggcugaggcaggagaaucgcuugaaccuggaguuggagguugcagugagccgagauugcaccacugcacuccagcuugggugacagagaaagacugucucaaaaaaaaaaaaaaaaaagaaaugggcuuugaaggaugaauaggaguuugcuagaaagagaaaucagaggaaacagcauaugcacaggcucagaggcuggaagcacauagucuggugcaaaguagguccuugagaaaacccuggaggccgggugcaguggcucauuccugcaaccccaacacugugggaggcugaggcaggaggauugcuugaucccaggaguuugagaccagccugggcaacauggcaaaaucuaccucuacaaaaaauauuaaaauguuagccagacaugguggugcacaccuguggucccagcuacucgggaggcugagguaggagggucaccugagcccaggaguuugagggugcagugagccgagauaaaacccugaggucucugcgccaccccaccccucccacaggauccugcugaacuccgagcggcucaagucccgcauugccgagauccaugagagccgcacgaagcuggagcagcagcugcgggcccaggccucggacaacagagagaucgacaagcgcaugaacagccucaagccggaccucaugcagcugcgcaagauccgagaccaguaccucguguaaguggcggcuccauacuucccugcggcucccuggcgacugcugcggcacauggagaucucucuaggagucucagucucucucucuccaccaaguggcccuuccugggccccgagaccccuuaaacucgguuccucccgggccccuugaaaguuuucccauaggucagccucagcuuagucagaggugugugcaaugggagugucacuccuaucccauuccauuuuguggaaaguuggaagccuuccacaaaaauuccugcugggcugggcgcaauggcucacaccuguaaucccagcacuuugggaggcugaggcgggcagauggaucacuugaggccaggaguucaagaccagccuggccaacauggugaaaccccgucucuacuaaaaauaaaaaauacaaaacccggccaggcaugguggugggcgccuguaaucccaguuacucaagaggcugaggcaggagaaucacuugaacggggagguggaguuugcagugagcagagauuaugccaaugcaguucagccugggcaacagagcaacacucugccucagaaaagaaaagaaaaaaaaaaucgccugcugugcaaccuaccaugcuggguggcugcggcagcccuguccuggguucaaaucaguucaaauccugcccccacccaccaaccuccugaagaccucagccagagccuccaccucccucuugggccucagggagggcacugucgcgugccaggugcugugcuaagcaccgugcucguuaugaguucauuugguccuuuucaagcccuuuguaaaguuugcccuuuacagcuggggagacugaggcacagaaccgacagcugcccugugcaaaggccagcagugcuggagugagccucuggugaugaugaggggccugggcuggcaucuucuugggggacuccauaggcguuaacagaaacaaaaaaaugaggggugugggucaggguuccccagcagagcugggcgagccacccuggguucaggcugcccugagccaggucagcucugcccucuuguggcaaccggagauauuguacccagaacccucucuccucagccagacccugccucccaccggacaggcccacugugggcucagcacccacacaacugcacaagcccaccuuuccuguuccuucucagguggcucacccagaaaggcgcccggcagaagaaaaucaacgaguggcuggggauuaaaaaugagacugaggagugagugaccgucuggagggaggcagggagggcuucccagaggagggggccauuugggguggguuucgaagaaugaguaggaguucaccagggaggaaaaguuguccaggcagcuggggagccucggaggcuggcaggugagugaccagggcccuccccgccaccgccccccaccccagccaguacgcacucauggaggacgaggacgaucucccgcaccacgaggaacgcacuugguacgugggcaagaucaaccgcacgcaggcagaggagaugcugaguggcaagcgggauggcaccuuccucauccgcgagagcagccagcggggcugcuacgccugcuccguggugugaguggaccgcagcgguggggauucccgcgucccucccagagcucucauugaaugccugccgcgugccaggccuugggaaggagucccugguggggucauccgggacaggggagcacgcggcccuggaacggggaaagcuuggcggggaggccagccuuccgacucccccucucgucugcccccacagaguggacggcgacaccaagcacugcgucaucuaccgcacggccaccggcuucggcuucgcggagcccuacaaccuguacgggucgcugaaggagcuggugcugcacuaccagcacgccucgcuggugcagcacaacgacgcgcucaccgucacccuggcgcacccagugcgcgccccgggccccggcccgccgccugccgcccgcugagcaccgaggacccgccccaagcagagccgccccugggcccgucugcgccggaggcugcggcggcgggagccacggaccagaccagccacauccagggguccucauuucuccggcucuggcucuuguuugggguucucucacccucuuucucuuuccuucccucccccauucuccagaucucccucugucuccuuuucucugucuuucuuggccccugucucucuccauguuggggguccuaacucccccaccccauaucuacguguccuccgggcauugcccucuccauggcucuggucacccugacccucugcccugcccaccgcaggucccccggggucccggaagccccuucuggcugcaccugccauguuuacagagggccccugggcugcgcggccccagccugggcacccugauuuuuaagccauagaccuggggucagggcaggaaggaacuucacucugcugcuuccgagaaccucggccgugacauucggggccgggcgggacccgccccacagacuccaacuuccccuccaaaccccgaagugaaacccgccaccggguuacccccacaagggggccgcugcgagaaguucacccacccccgaaaaaauaauuaaacucgcaggccaggcacgguggcucaugccuguaaucccagcacuuugggaggccaagacgggcggaucuuuugaggucgggaguuggaggccagccuggccaaaauggcaaaaccccgcaucuacuaaaauacaaaaauuagccgggcgugguggcggccgccuguaaucccagcuacuugggaggcugaggcgugagaaucucuugaacccaggagauggagguugcagugagcagagaucgugccacugcacuccagccuggguaacagagggagacuccuccgucucaaaaaaauaaauaaauaaacuugugagcuggccccaaccccuccuaggaaucacagcuccccguacuggugccgccgcaguggccaaguugcgacacugcccacggccccucccucugaugcagauucagggcuucucuucgaucauguuggguuuugauucuguuuuuccuugacugcaaaacccucuuuccucuccucuuuugggacaagagcccugguuuucuacgcugcccuuggccaccacacugccugccccacgagcugggaggcagguuuuguacgguacguuguuauugauaugauauaaaacaucaaacgucgugggugauucuguugucagugacugggcuucaguaccaccucugcgugucggggacccuggugucuacgggggucacagcaggucggacccguggguuuaacuccaagccccucugagacccgacaaccccucccucccccaguuuagcugcucaagccuggagagguugaggcagugcccaaggucauacaggagagagauucgaauccugagcucccgacugcucaggggaccccagaccccauccagccccucaagugcuuccaagcugcuucccccgcccaccgcccccaaauuugaauccugucgcaaccaucagcuguguccuugggaaaguuguauccccucccugauccacagcuuccucauucauugccaaguggcgucaaaagucaaaacccucccaugccacagggaggagucucccgugucuuugauguucucaagucgucggcaccuccagccagcauuggaggcucuucucugaccucuccucacccacucccaugcacagcccgccgggucccaggagacgcugagcaaaagcccugugggguuuuuuguguuucuuuuuaaagagucaaggucucucacucugucacccaggcuggagugcaguugugcgaacacagcucgcggcucacagccucaagcuccugguucccagccucaagcaguccucucaucucagccuuuagagucacuggauuacgggugugugucaccauguccagcuaauuauuuuuaaauuuuuuuagaaacaagaucuugccgagugcaguggcucacaccuguaauuccagcacuuggggaagccaaggcaggcagaucacuugaggucaggaguuugagaccagccuggccaacaugguaaaaccuggucuccacuaaaaauacaaaaaaaaauuagccagacaugguggcgcaugccuguaaucccagcuacuugggaggcugagauaggaagaucagaugaaccugggaggucaacgcugcaccaagccaagaucgugccacuguucuccagccugggugacagagugagacucugucucaagaaaaaaaaaaaaaaaaagggucuugcccuuuuccaggugggucucaaacuccuggccucuagugauccucccaccucagccucccugagucgcguaagccaccacgcguggccucauggcgucuuugacuuggacuccuguuuaccacccuccccaucacacccagaauccacacccccacugcgacgucauugucccuucagcccuccccaacccuggggccucacuguccuugucuguuuuguacagccaccucucaaggcccaacaaggcugaaccuggggcaagugcagaaagaaaccuccacucugacccagucuacugcugggaccuugggacaggaccugccucccuuagccucagagcccccuagccuugccaggcacugucccugccauguguccugucuggagauaacccauaaauaacuccagcccagauugugccucucacugcauaggugcucacaggagaaagguugccaucuuuaugaucccagcuaugcugagcuggggguggaagagaauaucccguguggucucuaaaaacacucaaccacuggcuguguguccuuggcaaaauagccuucccucucugaucagccauuuauuuguuaccagcuggagucaguagcaccuacccccagccccaacuggaugcuucugaggguucaaugauaaaauggguuguaggcccacucuaugccuggcaccaagccagagagcaauacauuguaggguuacauuuaugauuucuuccaauagggcuggugccugguaacuacuggaaaaauuguagcaauuauauuuaugguuauuucuucaaucccacccggcauaggguaagcaccaaaguugggguggugagucuuggggagccuuugccaacgguuuggucgucugagggaugggcucggggaccauccagccacugggacuucagagaagcuccggcucccaaaccagcuacuguguguguggccagggucuuccccacaacuagaggggggcacagcuggggacucagguauaucuuccagcugggugugggacauuuucuucccuaggauccgaugugucuugcccugaauguaaggccuggcaggguuggaaugucucaguuauucccccaacacuccagccuccaucugggccuuuuuuccaggcuauucucucugccuucacuguuggggccacuguccuguguaggcaccaaggccugaccaugccauccagaagccccagccugggacaacucucccccaccugccucugagcccuccauggugacucuuguuccccaaaccuuauccuucuccccauuacacagaagggaaagcugaggcucugucacucaaauccaaagccagguggacuccaagccaccccaccccuaucccagacagcacaggcugccucucucccccaugggcgucccuugaaggccagguugccccccaccccccacaagccuugaacgaugaaaagaaggaaggccaguucucuucaccccaagccagaaguggggcuggguggguacccuagagaaaugacacgccacucccugcgccagcuucugcuuuccggcguggcuguggucaagccugagucagucccacgggaccacggugaggggucuggagcgucggggucaggaguuugaggggggaaggguugaggggcaggauguggggguugggugugagggaggucacgggcgagacuggagggaggagaccuggccacacaggccuugcccacucucgggggccugaauauuucaguuacucccccaaaaccccggccuccaucccauccccagccuccauccgacgucaccccuguuaggucacaggcccacucugagagugggucucgggccucaaguccccuagccgccccuagaaggucuaggggugcguggagacaccaccauuccucucagccugugucugucucaaaggccccaccucaccuccccuaaagguagucuugcgccagggcucacgugccugggcagggcugauugccaaggggcccaauggccucgugacuggggacccagcaccuggcaggggugggggugggacacucagaggaaggaguggaggagggagagacgcuggcccgggacccgaggggcgugggcaucgggaggcgggcccggguuaggggcgggaccgccgccugguuaaaggcgcuuauuucccaggcagccgcugcagucgccacaccuuugccccugcugcgaugacccugucgccacuucugcuguuccugccaccgcugcugcugcugcuggacguccccacggcggcggugcaggcguccccucugcaagcguuagacuucuuugggaaugggccaccaguuaacuacaagguagggacggcgacagggcgggcaggcuggagggaacaggcgcccugucggggcacgcggcuccuucuuucuccccagacuucacaggggaagaccagggccccgaggggacgcugucccugccggguuccuggaaaaacccuguucaguucccggcgcugcggccacacucccuccgugccguuucgcuuucgcaucccgcaucugagaggcgcagcugccuccacccgccuagucccgcccaaggguucaaugagcgccuacuguguacuuuuggggcaggagcuggggucuccuuuuguggcccagggcacaaguucagcagcuggccaagggccgccggcaugcauucuugcugcuacccuugaugcauucauuccagccagggcagggcucgcgugucuuugggaccuauuaggcagaugcccuagaggcugagcgacuugcucaccgcuccagcgacaugggccacccgccaccccucagcugaagccggaagucagcaccuauuaggugccgccucuauucagucggacuuggaaaggguucacguggaucccuugcucagcucagaggcaaggucuccaggugaagugacaagaaaugagcaugggccaaggccggaggcgguggcucaugccuguaaucccaacacuuuggaagucugaggcaggcagaucacgaggucaggaguucgagaccauucuggccuacauggagaaacccugucucuacuaaaaauacaaaaauuagcugggugugguggcaugugccuauaaucccagcuacucaggaggcugaggcaggacaauugcuugaaccagggagucggguguugcagugagccgagaucgugccgcagcacaccagccuagcgacagugagacuccaucucaaaaaaaaaaaaaaaagucucaaagucaagauuccaccuggcaaguucuggaaggcgugcaagaugaauugcguaucacagcccccuuucuacaagacuaccaagugggguugagagaaguggggaacugcccagggcuacaccugccucccacgccuuccuaauccacagacaggcaaucuauaccugcgggggccccugaagaaguccaaugcaccgcuugucaaugugacccucuacuaugaagcacugugcgguggcugccgagccuuccugauccgggagcucuucccaacauggcuguuggucauggagauccucaaugucacgcuggugcccuacggaaacgcacaggugugugggcgcuggggaaacugaggcacgugggcaggggagcaggggacccagccuaccagcaggcucucacccugcugccuugcaggaacaaaaugucaguggcaggugggaguucaagugccagcauggagaagaggagugcaaauucaacaagguggaggugagcggccccagggccccacacuggggugggggaaaacugucccacguacaggaggcaaauacgaggaugccagcucugucuucugccucgugugcucccauuuaaucacaucuuuauucccuaucuccuggguggguacuggugauuauuacgagagggugucaggguacccuaggcccucuucaugcccucuccugcccccucuccaaaccccaggccugcguguuggaugaacuugacauggagcuagccuuccugaccauugucugcauggaagaguuugaggacauggagagaagucugccacuagugagugacgccccucacuccacccaaggagggggacaugggugguaaccuucccugcauccaggcagacccaaauucaaguccuagcccugaccacugcugucugugcagcccaggaaaacaacuacccuucuuuauuuuauuuauuuuuuuauuuuuucuugagacagagucucgcucugucgcccaggcuggaaugcaguggcgcaaucccagcucacugcaaccuccaccuccaggguucaagugauucuccagccucagccuccugaguagcugggauuacaguugugugccaccaugcccagcuaauuuuuguguuuuuaguagagacaggguuucaccauguuggucaggcuugucuugaacuccugaccuugugauccgccugccuuggccucccaaagugcugggauuacaggcgugagccaccgcacccagcccuuuuuuuuuuuuuuuuuuuuuuuuuuuuuuugagacaggguuuugcucugucgcccaggcuggagugcaguggugcaaucuuggcugacugcaaccacugucuccucaguuuaagugauccuccugccucagcuuccccaguagcugggacuacaggugugcaccaccaugcccggcuaauuuuuguauuuuuaguagagacaguguucaccauguuggccaggcuggucucaaacuccugaccucaaguuauccgccugucccagccucccaaaggauuacagguguaagccaccacgcccggccccagccuccccucuugaagccuccaucucugaaucaggggaaugaaugcaggucucuuaggagcaugagugaucacagaggacuuacuggaggaggcauuucugagcugggcauggaaggaugagcaggaaugugcagagacacagaugaugggauguggagaugauaggacagaccccaccuacuuccccgggggauugugaagaaugacucccagagaagugacucauuggcuccaaucauuuauucauucaucaaacauccgggucacccaagaggccucaccuagugacacccuaguccugcaggguuagaucagggcugagagaguggcaaggagagggcacugaggagacacuguggaaggaggaugaaggguguuccuggcagagggaucagccuguguggagguccugaguaaagugagauacuaugggggucagaggcagugggucuggucuuagggaugaaaccaagggagcuaggaggcaggagcagcccaagcccugccuuaggggccuccacucaagcauguauugagcaccugcuguuugugggcuuugucgcaucacugugaagccaacuguacccucuucucagugacgaaacaggcuuggcucagggcuggugggcgggaccguugagauaacggggaggaagcugaggcaacccccugcuccccacccacccagugccugcagcucuacgccccagggcugucgccagacacuaucauggagugugcaaugggggaccgcggcaugcagcucaugcacgccaacgcccagcggacagaugcucuccagccaccacacgaguaugugcccugggucaccgucaaugggguaagaaucuuuuuagcccucagcuugacacucauagucccauggagucagggauggacaagacagagggaccagagauaaaggaacccaggcggagguugcagugagcugagaucaugccacugcacuccagccugggcaacaagagcaaaacuugauagcuuugcauagggaaagagggcauugaugcugggguuuugaaaggugaguaggaguccaucaggcaaaaaaaguauguauuaauucgaaguauuaaacaucccuagccacccccauugggaaagaugugccacugauuugcgaggcgggaggcgggggccagacuugggaauaugugcagcccuuucugggcuggaaccagggugcauggguugggguagcugcugggaauaugcgaccccugucuugcuuugugcagaaacccuuggaagaucagacccagcuccuuacccuugucugccaguuguaccagguaagcugggaggggagcagugggauucaggugguggggguagggucuccuuccaggaccccaacucauggccuucaccuccagggcaagaagccggaugucugcccuuccucaaccagcucccucaggaguguuugcuucaagugauggccggugagcugcggagagcucauggaaggcgagugggaacccggcugccugccuuuuuuucugauccagacccucggcaccugcuacuuaccaacuggaaaauuuuaugcaucccaugaagcccagauacacaaaauuccaccccaugaucaagaauccugcuccacuaagaauggugcuaaaguaaaacuaguuuaauaagcc

SEQ ID NO: 15641 - RNA, 5602 nt, Homo sapiens
agucuucaaaggcuggagcggcugccccugccacccacagacuccacauagcucugacaaccugcuuuccugaacgccucguuccuggguccuuucacccaccagaccucacuguguggccucaacucugaggcaccugcccucugaacccccaguucuacaauaaacgggguggauuccaaacgucacucagcucugaccuucucugaccuuuauuccucauucgucugccugcugagcuccuauucguacuccaaagccucagcuaaaaugcccuuuccgcaaggacgccuucucugcuuccugucuggacucucacaguugcaggucucuucuucugguucugugaugcuggaacugucuaugucuggcucuguuucucccagacugaaggcuccuaggggauuccagcaccaccaauuggcugggaagacagguuauuaaacagucucucggauacugcacugggcauucaaugccucacaaggacagcgguccagguaagucagauuccagccgggcucuuccucugucccaugugauauccgaaaggcccccgccucacucugagacuugguuccccaacuuugaugcagucggggaggucagcccuugguccagccacuccccacagucaugguggcugaaagcuggugugcaaccuuguuccucgaggggucccugugccguucagcaagucaugcagcgcggccucaugucccccaagaguggguuuggauccuccuaagagaaauguucccauuaagccucagagaacacuggaaacagaaauucagaaauaccgcuccccaucuagccaucucccaacucccgcccuugaccagggaugaggccaucaggagguggugucuagggcagacuggggugcaaggaggguuuuggagcugaguguauaccgucccuugguauccacaggggauugguuccaggaaccccguggauaccaaaauccacagaugcucaggucccugauauaaaauggcauaauauuugcggauaaucuaagcccauccuccuguguacuuuauuuuuauuucauuuuauuuuucgagacagagucucgcuuugucacccaggcuggaaugcaguggcgcaaucucggcucacugcaaccucuaccuccuggguucaagcgauucuccugccucagccucgugaguagcugggaucacagguggaugccaccacacccagcuaauuuuuguauuuuugguagagaccugguuucgccauguuggccaggcuggucucaaacuccugaccucaagugaucugcccaccucagccucccaaagugcugggauuacaggcaugagccacugcauccagcccucccguguacuuuaaaucucuucuagauuaccuauaauacuuuauggccaggugugguggcucacgccuguaaucccagcauucugggaggucaaggcaggcagaucaccugaggucaggaauucuagaccagccuggccaacauggcaaaaccccgucucuacuaaaaaauacaaaaauuagcugggcauggugguggaugccuguaaucccagcuacucgggaggcuaagacagggagaauugcuugaacccgggagguggagauugcagugagccgagauugugccacuucacuccagccuaggugacacagcaagacuccaucucaaaaaaaaaaaaaaaaaaaaaauauauauauauauauauacacauauacacacacaaaauauaaaugcuauuuaaucacuguuauacugcauuauuacuauuaguaguaguauugagaugaggucuuguuuugucucccagacuggaguauguaguagcacaaucauugcucacugcagccucaaacuccugggcucaagcgauccuccugccucagccucccaaucauagaugggcuccaccaagccuggguaauuuuguauuauuugcaguagagaugggggucuugcuauguuacccagguuggucuuauacuucuggccucaagcaguccucccaucuuggccucucaaagugcugggauuacaggcaugagccaccgcacccagccuaucauauuuuuaaucuguauuauccauguauguauuuauuuuucaaaugucucugacccauguuugguugaaucugcagauuccaaaccagcuaacgcagagggccgacuguauguagcgaaauucugucaacaauuaaaauccucugccagccgggcacaguggcugacgccuguaaucccagcacuuuggggaggccaagaugggaggaucauuugagcccaggaguucaagaccagccugggcaacacagugagaccacauuucuacaaaaaauacaaaaauuggccgggcgugguagcucacgcauauaaucccagcacuuugggaugccgaggcaggccaucaccugaggucaggaguucaagaccagccugaccaacauggugaaaccccgucucuacuaaaaauacaaaaauuagccacgugugguggcuaacaccuguaaucccagcuacucggaaggcugaggcaggagaaucgcucuaccagggaugcggaaguugaagugagcugagaucgcaccauugcacuccagccugggugacaagacugaaacuccaucucaaaaagcaaagcaaaacaaaacaaaacacaaaaauuagcaggaugugguggcgugugccuguagucccagcuacucaagaggcugaggcgaaaggauugcuugagcccgggaggucgaggcugcagugagcuaugauuaugccacugcacuccagccugggugacagagcaagacccugucuaaaaaaacaaaaaaacaaaaaaaacccaucuacuaugucugccaccccaucaaggcucccagggcccagagaggcaugggugguucucagaccccugagcucaccucagaguacagggguggcgggcgguagcggaacucuuggauguaggcgaagaacgggccuucaaggcucaugucgggguccugcggaagcgggaaggggcucugccccaaggcugccuccucagugucggcuaccaccuccgaguacucaggaggagcuggaagcgagagacagggugggugagguuggcaggagagagcccugcuccaagggaccaggggccaggagcuggcuugugccagcucuggggcugccaggcuguauguccuuugguugggauuccgggggacucguggugagagaguugacccggcauccaccucuccguguauccacccacccucugcaugcaagcagggugggagcuuacccucaggccgcuccggcaaggcccccagccuccaguccagcaggaagcuggcguggcugcccacgcuggaggaacggcugccaaaagggugcaagggaauggugccgaucaccaguggcagcuccagcagcagcuuggacguuccugggauauccacacagaccuggaggaaggaaccauaagggagggugcccaggcagccuccccaacccccaccucccuccuaugccuggggagacugaggccucagcuucccccagucugagggaauacagggugaauguaggcacugucccccagggccagcaggaugcccuaccuugagugcguaguccacguguagaacgcggcagugcaggauggaaggacccacuggggggauccgcagugcccggcccugccacagcgcccgcugcccggggcccaccggcucgcccgcgaggcuggccaccacugcccguuucugcuuucgggcgccucgggccaugaacgucugugucugcaccacggcugcccgaggcagcacaggacguguggagccguugucgaucucggcaaagacagggaugaccucuccugcagcaaggagcaguggggccucaguuuccccuccugcaaccccaacaccagcccccgucccaacccaguccgguccgccugcuaccugggguguagcccuugcggucgaucuuggccgaaagggagacuaggccacgguuacaguaccaggaucgggcaaccuuuucccgagcccccgcuugaggugccugucgguguagaggaaagugacauggaugagucacuuugugcaaaccacagucgcuguggagcuuccaaaccacccccagcugagggaggacuuugggcagggcuugguuucuuuuuaacaauccaggaacuauccguuaaauagagccaggaacacaacccaucuuauaaagccagaaaugaaauguauaagccaaguguuugguguguaauucacacuugguaagcccuagcucuggucuauuucacagaagaggcaucugaggcucagagagggcuucaagacacuugcccagagucacacggcaaaugggugcagaucccaguggauuccacacgcauucccacaccugccucccucccugccagggcccaccuaugaccuccaucuuauugguuggugucgcccagcagccaggcaggccccuuccuacaauacucccaaccuaccuccccaaggguggccacucaccagcagggcuggcguguugauguccacaggcucgaugacagugaacaccuuccuugcccggcgugcugggacccagggccggugcaggguggccuugauacaguagcggacacuaccguguuugcccucgaaggaugucaccaggguccuaggguggagggacgggacuucaggggacaagauacagagacaagcaggcagggagaaggagacacagacacuccgggggccucccagggggagagucuuggggcucagaggugcccagauauccaguauuggagguaccaaucuggaaggggcugcaggcuuagggcaacccugcaccccagaggacuuacgggggcagcuggaagcugaacaggaacucauggcgcccaggaggcagcgucguggucuccccgguaucugcagguaggagaaaaaggaggcgacugagcgguugcgcuggggucccagggcugacggagguaccgccguccagguggugggaggcacacaacugguguuggagcagggguccuccauccguaccuggcgccaggagcguggcgcgguggcucacgaccuccacgcguucacuguagcucugcguguaagccgugcucgagcccgcgcugcgcgacucgguccagugcacgugggcgcggccccgcgcgcgcagccucagggcacccacacgcgcggcgcuugacagcuccagcagcacccggcccgccacggccuggccgccgcuaaacacgggcucgacgcccgcggucgcgccguccaacugcaccgagaacgcuuucaccuugucgaauagcaucgcguccggggugcgaacccacgacaggcggaaccuggccucgaacucgcgaaccggcagcucaagaugccgacgcugcagccucagaacgcaaaaucgccgucaacgcgcaggcgcgcucaccaaccggagcagaaaauccccgcgccgugcgucggcgccgcuuuuauacggcagggcggggggggguggggucaccgucucuuccccgccccgggaagggacuccaccaauagcgcgacaaggggcguggcuc

SEQ ID NO: 15642 - RNA, 4959 nt, Homo sapiens
gaccgaccaggcggugcgcuucggacccagccagggcaugugcucggaggcccgccuggcucgcagguugcgggaugcgcugcgggaggaggagccguggugagggcggggccgggggcgggccaggagugggggucuuuggccgggguccacucugaccgcgguguuugcagggcaguagaggagcugcugcgcugcggcgcggacccuaauuuggugcuagaggacggcgcagcggcugugcacuuggcggccggagcccggcacccgcgcggccugcguugccucggggcccuacugcgccaaggcggggaccccaacgcucgguaagauagagccuggguccggggcggggucuccccaagccgaagucugggaauccgggaaggggcgccccaucaucccgggccaggccucggggcucgagggugggguuuaggggaucuuggggagggaacuuggggguccaagggcaggggcuagggcucgagggaggcgcuggggucccagaccgagggcguggaauggggcugcgcuaggaccaaaguggggaucaaggguucggauauuggaguggaggcaccagggucagacggcagagguuuggguccuggccugaggucauagcaucuagguuccaagggcaguguaccaggguggacggcggagauccgggaggccgagaacgaaggcuccagguccccagagcggagaucgggguuccugccgggaggcugaguccgcaaugaccccucuugcgcugccgccccagaucugucgaggcacugacgccgcugcauguggccgccgcguggggcugccgccgcggccuggagcugcugcugagccaaggagcggacccggcgcugcgcgaccagguugggaggcacugcgcgggcaaagaaaggcugggugagcccagagggagggaaggaagguaagagggccucgggcgcccccugcugaccgcgccccuguaggacggacuccggccgcuggaccuggcccugcagcagggacaccuggagugcgcgcgaguccugcaggaucucgacacgcggaccaggacccggacccggaucggggcagagacucaggagcccgagccugcaccuggcagugaguagggccugcagggcugcuggggcuugacuucuggaccagucccugacauccagggucuuccccaccccacccauugguucugaccgucucacauccacuauuuguggccagcucuuucggccucagacacucugaucuccuuuuucuguuugauccuauucucaucgcugucucaucccuccuccucuccucucuggcccccacucucaccugcagccccaggccucucuggaccuaccgaugagacgcuggacuccauagcacuccaaaagcagccaugcagaggugacaacagggacauuggcuuggaggcugacccaggaccccccagccucccuguuccccuugaaacuguggacaaacaugggagcucggcguccccuccagggcacugggauuacagcucagacgccucuuucgucacagcgguugaggucucuggagcugaggacccagccucggacacuccccccugggcugggucauugccaccgaccaggcagggacuucugcauguuguccaugccaaccagaggguaccuaggucucagggcacggaggcagaacugaaugcccgucugcaggcccugacucugaccccaccaaaugcugcuggcuuccaguccuccccuuccuccaugccucuccuggacaggaguccagcucauagccccccacggacaccaaccccuggagcuucugacugccacugccugugggagcaccagacauccauugauagugacauggccacgcucuggcugacagaggaugaggcaagcucuacagguggcagggaaccugucggcccuugccggcaccugccagucuccacugugucugacuuggaguugcugaagggacuccgagcacuuggugagaauccucaccccaucacacccuucaccaggcaguuguaccaccagcagcuggaagaagcccagauugcuccugguuagucuucccagggcacauggaguccagggagccuccaggaaucucccggagaaccccagcucucagccccacuuuccuccccaucucagaaucaucccuuccuccaucucccuugacuuccaggcccagaguuuucagggcacagccuagaacuggcugcagcccugcggacgggcuguauuccagauguccaggcagaugaagacgcgcuggcccagcaguuugagcagccagauccugccaggagguggcgggagggggucgugaagucuagcuucaccuaucugcugcuggaccccagguacucagggcaggaaagccccagaaauagaaacuagaaaauuuggggauugguuuuuauuugcugugugcccuuaagaaagggacuggcccuagaaucaucagcugcuucuucuucuuuuuuuuuauuuuuuuaagacggaguuucacucuuguugccaaggcaggaguacaauggugccgucucggcucacugcaaccuccaccucccagguucaaacaauccucuugucucagccucucaaguagcugggauuacaagcaccugccaccacgcccgacuaauuuuuguauuuuuaguagagacgagguuucaccauguuggccaggcuggucucgaacuccugaccucagguaauccacccacccuggccucccaaaaugcugggacuacaggugugagccaccgcaccggccucuuuuuuuuuuuuuuuuuuugaggcggagucucacuguuucgcccaggcuggaauguaguagcgcaaucuuggcucacugcaaccuccgccuccuggguucaagugauucuugugccucagccucccaaguaguugggauuacaggcaugugccaccaugccuggcuaauuuuuuuuguaauuuuaguagauauggaguuucaccauguuggccaggcuggucuugagcucccagccucaagugauccuccugccuuggccucccaaaguguuggcauuacaggcaugagccccggcuggccaugguggcucacgccuguaauaccagcacuuugggaggcugaggugggcggaucaccugaggucagcaguuagagaccagcguguucaacguggagaaaccccauuucuacuaaaaauacaaaauuagccagguguguuggugcaugccuguaaucccagcuauucaggaggcugaggcaggagaaucacuugaacccaggagguggagauugcagugaacugagauugugccauugcacuccagccuggggaacaagagugaaacucugucucaaaaaaaaaaaaaaagaaagcugcugaaugucuuuggggagccgcugacucucucugauccuguaaucaggagucacuagacauggguucaagauauguugugacuuuaaggacugccucuggggaccacuguauccacuuuucccugucugagcuauccccuucauccagggagacucaggaccugccagcccgagccuucucacugaccccagcugagcgccuucagacuuucauccgugccaucuucuacgugggcaaagggacgagggcccggccauauguccaccucugggaggcccuuggucaccaugggcggucaagaaaacaggugugaggacagggaucaggguucagcgagggcagucgggccaugggcaggggaggguauugggggugcugacuccugauucugcccuagccccaccaggccugccccaaggugcgucagaucuuggacaucugggccagugguugcgguguugugucccuacauugcuuccagcacguggucgcuguggaggcuuauacacgggaggcguguauuguggaagcccuaggugggugccugguaccuagaaugggggucauaugaaaggcauuuggcuucccaguucccucauuuuuuuccuucugagggguguucauuuguugacugagcaauuauugagcaccaacuuugaaccugcacaugcauguauuuugcuccauugguuuauccccacucaagggcaauacacauuggguuugcugucacauacuuuuuugugugugugugagacucugucgcccaggcuggagugugguggcgugaucccgacucacugcagccucugccucccagguucaagugauucuugugccucagccuccccaguagcugagauuacaggcacauaucaccauacugugccaagcuaauuuuuguauuuuuuaguaaagacaggguuucaccauguuggccaggcuggucucgaacuccuggcuucaugugaucuacccaaaguguugggauuacaggcgugagccaccauacccagccgccugcugucacacacuucugcuggauggggagguguccccauggcugccccugugaccccacauccaauuucuccagggauccagacgcucaccaaccagaagcaagggcacugcuauggagugguggcaggcuggccaccugcucgucgccggcgcuugggggugcaccugcugcaccgugcccuccuugucuuccuggcugaaggcgagcgacagcuucauccccaggacauccaggcccggggcugagugcuggggaguuggccauccagccuggggagaaauguuugaauguuccagcugccccaugcugacagcagcccccaucucugguuucagaagggguguguguguguguguguguguguguguguguguguguguguguuuguguguguguguguguguguagggagcacccaggcagaucucccccaggcugagagaggacuuuguuacagaugguacugcuggagagguaguaaguagugagcuccccaucgugggaggaggacaagaagggaagcagaaggugcuuu

SEQ ID NO: 15643 - RNA, 11300 nt, Homo sapiens
uuuauugaguuacaaguugagaugugcagguucgguggcgccagcccccccaucccccccccuugggcaaaaauagcucccagcgccgaggaaugggggguaggaagggucucggauaacgggauggggccucgagggucccuguggggcucgugggucccaggaucaagcacggcugacacggaagacagcgggguggggggccugccuuggccguggcguuggggggaaggugagggagagcuucuguacaaggucaucuuccgugagggucccggcugcggccccaaaacgccgaugggccccgcgggacggaagcggagagcggaauguccgcugggcucccucggaugccacgccccgcccaggcagccugggggcgucucccugaccuggccccgcccaccggagcgaacggcccgcccagguggucugcgcugcagaccuggcgcaggcucgggccuccuccugcugcggcugugcucaccaagcgaugccccgccggcccagcggcuacuucuugucuucuggaggcgccggcaguggcuccgguagagccuugggcgagggcucgggcucccagagcaggaauucguggagcagcguguugaccgucucagggcauuccagcaucaccauguggcugcccucgucgaugagcuucaggaaugccaggagcaggaucugcagaagacgcagggcucaagguaggcgggggcaagaggguggagagaggccaggcuucccugggacuccgccauacacacauggcccacagcauccaaaagucccuccucccaucuacccugcaucucuccacuuccacucaagggggagcuggaggauggccuguagcccugcuggaacccaacuaguauucaggcauccagcauuuauuaagugucuacaguaugccaggagaaggauuuucuucuuuuuuucuuuucuuucuuuuuuuuuuuuuuugagacagagucuugcucugucacccaggcuggagugcaguggcguaaucucggcucacuccaaccucugccucccggcuucaagcgauucucuugccucagccucccaaguagcugggauuacaggcacgcgccacuacacccggcuaauuuuuuguauuuuuaguagagacgggguuucgccauguuugucaggcugaucuccaacuccugaccucaggcgaucugcccgccucggucucccaaagugcugggauuacaggagugagccaccgcgcccggccuggaggaggauuuugucaacuucaacucuaccaacauuaggagcuggaucauucuuugcugggggggcgggggugggcggggaaggggcggguagcuggggugggggcugcuauccugugcauuuguaggguguugagcagcaucccuggccuccacccacuagaugccaguaguacccccucccccucagucgugacaccuaaaaaugucuccaugcauuuccacguguuccuugggggcagaauccuccuuaguuaagaaccaccaguccaguuauacuuuaaugguuuuuguuuuuuuuuuuuuuucuuuaagaaacggggucuugcucugucgcccaggcuggagugcaguggugcgagcauggcucaccacagccuugaacuccuggguucaagcgauccgccccacucagccucccaaguugcagcgauuauuggcgugaaccaccucgccgggcuaguauccagggcuauucuaagugcuaaggauccccagacccuuucuaaucugaacucgcuaauuagaguuucuaaucuaaagauccccuggugccggucuucuagaauuauauaggucaccggucucauacaaauccuccgcugugaggagagccuucuuacagcgguggggacagugcguaauugcuaacaccuguccagggcagcccugcuuucuagauucuacuucugaugcuagaccuaaugcuccuguuugccuggggucagaacaagauacagcaacuagaggccacgcccacccggcagccacgcccccucgggaagaaagcacgcccaccaagcgcuaccacgccccccgcagaggccacgccccucccgggcagcacccuggggauuuguagcuguggcgccccaggugcccgccucuaccucggccaugcgcuggucuuccuccaccggcacaaacuuaucgugcaugccguggacaagcaggacgggcacggugagcucggcgugguagaccucgucgcccucgggccaguacuggccgcucaucauggcccggaguacgaaggaugacacguugaaagcguugcccuccuuuaacagcugcuucuccuuggcuccuuggcgggcgaagccggcccugguggugguggaggcaccgcuagagccccuuaugccagcccgacugccguggggugcccccgaugccagcccuagucccagcgguacaguccccccucccauccaacucgagcagaugccuggguucgccagggccaggaucacggucuuugggguggggacacucacuugaggaagcuccaggccaggcagggcgacaagcagugcaggacgcaggugggcauguugaagauugagcagaagcugggcuccagcgccguagggcccccgccauugaucaugaucaccuugugcacuaggucuggguacucaugugccaggaaugugcagaaagagacacugcccggaacggguggggugauaggaggauugaagggaggcggucagcaggauacaagcagugaccauuuuguuuugcuuuguuuuuguuuuuguuugagacaguuuuacucugucccccaggcuggaaugcaguggcuccaucuuggcucacugcaaccucugccucccagguucaagcgauucuccugccucagucucccgaguagcugagauugcaggcgcacaccaccacacccagguaauuuuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagaugggguuucaccauguuggucgggcuggucucaaauuccugaccucaagugauccauccgccucggccucccaaagugcugggauuacaggccugagccacugcgccuggccugguuuguuuuuguuuuugagauggagucucauucuguugcccagguuggaguacagugaugcaaucucagcucacugcaaccucugccuccuggguucaacugauucuccuuccucagccucccgaguagcugggaguacaggcaugcaccaccacaccuggcuaauuuuuguauuuuuuaguagacacaggguuucagcauguugcucaggcuggucgagaacuccugaccucaagugauccacccaccuuggcuucccaaagugcggggauuacaggcaugagccacugggcuggccuguuuuguuuuuguuuuugagacaagguuucgcugucgccuaggcuggaguggugcgguggcguaaucauagcucccugcagccuugacuuccugggcucaagagauccucccaccucagccuucugaauagcugggacuacaggcaugugccaccaugcucagcuaauuuuuaaaaauuuuuuuauaaagacagggucuccuuauguugcccaggcuggucuugaacuccugggcucaagugauccucuggccuuaaccucccaaagugcugggauuauaggcgugagccgugacacccggccuggugaggggguucauguccucccccuacccagaaggcagguccuuggaagccaagauucuuccccugggguccauggacaccugaaggggugagggaugagugcggccucucaaauaccgugaaagugugaguuugaguguugaggauggaacuuauuuugaagagagaaucuggauccagaaguuucaccagacuuuuuauuuuaauuguuuaaaauuuuuguagagaugggggucucacuauguugcccaggcuggucuugaacuucugggcucaagugauccuuccaccuuggccuuccaaaguguuaagauuauagauaugagccacugugcccggcccucaucagauucuucaagccaccaugacccaaaagcgguaagaauuacucaucagcaagugguaggaaagcaaucugauuaaacaaaugcuuccggcugcccaggggaggucacuguuuccuacuaucccuucccuuucaggauguucugccaccugccucugggcaugacauaucugucuuccuuauacaagauggaaggccugagaagcccccaaagcugagcuccucauuccuacaaaagcaggggucaacaaacuauguacggccugugggcuagucauuugcuuuuuuaaauacaguuuacacuuuuggagauuugaaaaauguuuccuaaauaagguuuuuuuuuuuuuuuuugagauggaguccugcucuguugcccacgcuggagcacaguggcgcgaucucggcucacugcaaccuccgccucccggguucaagugauucuccugucucagccucccgaguagcugggauuacaggcaucugccauuaugcccggcuaauuuuuguauuuuuaguagagacgggguuucaccguguuagucaggcuggucuugaacucccgaccucaggugaucugcccaccuuggccucccaaagugcugggauuagaggcgugagccaccgugccuggccaaaaaauguuuccuaaauaaaguuuuaucagaaguuccaacagugacuguauggccugcaaaccuaaaauauucgcuauccgauccuuuaaggaaauguuugccagccccugcuguaaugaggaaaggauacagacaggagucaggcagaccugauugugucagggacuuccuguaugccuuugggcagguugcuucaccucucugagcuucagccuccacauuccugaaguuguaaaugugcugaccuaauagcacuguuauggggucaugggaacuauuguagguggguguuuuuuuuguuuuuuuguuuuuuucucgagacagagucuugcucugucacucaggcuggagugcaauggugcgaucucggcucacugcaacccccaccucauggguucgaaugauuauccugccucagccucccaaguagcugggauuauaggcaccugcaaccauacccagcuacuuuuuguauuuuuauuagagacgggguuucaccauuuuggccaggcuggucuugaacuccugaccuugugauccgccugccucggccuccaaaaguucugggauuacaggugugaaccacugugcccagcaggugggugcucauuuaauuagaggaaucauuucucauaagcaucaacuuuugaguauguuauauaaagaaauauaaacaaauaagagcuguuaccucucagucuagauuccuuucuuuuagauacuuauguaacuucuuuguuuucuuuucuuuuuuuuuuuuuuuuacuuuuuaguuuuuuguagagaugagaucuugcuuauguugcccagguuggucuugaacuccucagcuauagcaguccucccaccucagcuucccaaaguguugggauuauagguguaagccaccacaccuggccacuuauuuauuuuucuuuuuucuuuuuuuuuuuuuuugagauggagucucacucugucacccaggcuggagugcaguggcacaaucucggcucacugcaagcuccaccuccugggugcacgccauucuccugccucagccuccugaguagcugggacuacaggcgccugccaccaugccuggcuaauuuuuuuuuguauuuuuuaguagagacgggguuucaccguguuagccaggauggucuugaucuccugaccuccugauccgcccgccucggccucccaaauugcugggauuacaggugugagccaccacgccuggccuuuuuuucuugucuaauugcauaggcuagaaucucuaaaacaguggugcucaacuugccuggcuguucaaucuugccuuucuuccuggauaaaggagagaaugaggccacuugguaguggucaagcccuggggaccaagccuuccauggagggguucuugguaaguuuuagguuguauuaccugcccuuuaagcaggagugaauuacaguaacccaugccuuuguaaaugccuagaauuuacaggauuccgaugagcgcuuccugaaugcacaguguucuccagggcaguugauuuuuuaacuuagucuaaggcagugguucucagcuggggguaauucugcccaccagggcacgcuuggcaacuacugaagacauuuuugacugucaugaucaacacuagauuguguaguugcauccagugggcagaagccagggaugcuacuaaacauccuauagccccucacagaaaaaaaauaaccuggccaaacacgauagugcugggauugaacaacacugcuuuuuuuuuuuuuuuuuuuuuuuugggcagagucucacucuguugcucaggcuggagugcaguggugugaucuuggcucacugcaaccucugccucccagguucaagugauucuccugccucacacccccgaguagcugggauuacaggcacacaccaucaugccugguuaauuuuuuguacuuuuaguagagaugggguuucaccauguuggccaaacugguguugaacuccugaccucaagugaucugccugcuuuggcuuccuaaagugcuaggauuacaggcguaagccacugcaccuggccugagcaacacugcuuuagaacaaugugaaacaauaucagugaugacggaaaucccugucugauuacauaugcuaaugggaguuuucagccugguauagcggcucaugccuguuaccccaccacaucgggaggccaaggagggaggauggcuugagcccaggaguucaagaccagccugggcaacauaaugagaccccccccccauucucuauauaauuuuuuuuugaacuugaaaauuggccuggugcguuggcucacgccuguaaucccagcgcuuugggaggccgaggagggcgaaucacgaggucaggagaucgagaccauccuggcuaacacggugaaaccccgucuguacuaaaaagacaaaaaauuagccaggcaugguagcgggugccuguagucccagcuacuagggaggcugaggcaggagaauggcaugaaccugggagguggagcuugcagugagccaggaucacgccacugcacuccagccugggggacagagugagacuccaucucaaaaaaaaaaaaaaaaaaaaaaauuaaggcugagcacaaugacucacaccuguaguccuagcacuuugggaggcugaggugcaaggaucacuugagcccaguaguuaaagaacaucuugggcaacauagugagaugccaucucuauuuaaaagaaaaaaaaauuuuaaaaauguaaaaauuaaauugaaaaaugggauuuuuuucaaggagaaaaauuaggauuuuuguuugcuuuguuuuguuuuaggagauaagguuuugccauguuguccaaacucaucuccaaugauccauccacaaagugcugggauuacaaaugugcaccaccgcgcgugguggccccuuuuuuuuuuuucaugacggagucuccuucugucgcccaggcuggagugcaguggcacaauaugaucuuggcucacugcaagcuccgucucccgugcucaugccauucuccugccucagccucccgaguagcugggacuauaggugcccaccaccacacccagcuaauuuuuuguauuuuuaguagagacaggguuucaccguguuagccaggauggucucaaucuucugaccucgugauccgcccgccucagccucccaaagugcugggauuacaggcgugagccaccgcgcccggauuuuuuuuucuuuuuuaaagagcgacagguucuugccaugcugcccaggcuggagugcaguggugugaucacaguucacugcagccucgaccucccagacucaagcaaucuccugccucagcccuuaaguagguggaacuauaugcgugcaccuccucaccuagcuaauguuuguacuuuuuguagagcuaggggguucucccuauguugcccaggcuggucucaaacuccuugccucaagauauccucccgccuuggcccccgaaagcacugggauuacaggugucaguggcaucucagagucucccucugucgcccaggcuggagugcagugacacaaucucggcucacugcaaccuccaccuccucgguucaagugauuccucugccucagccucccgaguagcugggacuacaggcgcgugccaccacgucuggcuaauuuuuguauuuuugguagagacgggguuucaccaccuuggccagacuguucccgaacucccaaccucaggugauccgccugccucggccucccaaagugcugggauuacaggcgugagccacggggcucagccaaaaacucaguauuuugugacuguagucccugcugaccccaucccucacccccaccccacaugccaggguucacuuacccguaggaauggccaaugagcacauuucgcuucuuggcauagcgcuugaagauugcucgcauguccucagccagcgcauagaagguguaggcugcggccaccuggggcgcagagcuggccccguggccggccaggucaggagccaccaccucauagccuaggcgcacaaagaaguccagcugcuccuuccagauggccagggaaccgccgacaccauggaugaaaaagagcaccacgucggccugggcgccuuugcagcuagugaugcgcuucucacagucaauauggaugguccucuuggggcgccuggcucgccgccgccgcccaccacugccacugccgcugccgcugccugcgcugccgggggccaagcggccaucgcugcccgccggaucugccagcuccaccuccagggcggccggcggcuccccagagccauucugcccguguaggaggucggcucgaggggcucggcccagguuuuccaccagcaaccgcccauugcgguacacggugauccggcgcugacagcggaccaagccggagaggucccccugggcugcauccgaggaugcggaugaugguggagguggggcagcggcuggggcggguccugcaugcuucacccgcagcacgcggccgggcuugaccucuacaaagguguagccaucgcuggacucgacgcucuccaguggccccacggcguuggggggcgugcccagcaggcaacagaagauaccgucggucaccccggucagcaugguguguccugugagugaggacagcagccaguucaggugcugucucaaugagaacccugcaccgugcagcaggcacucccugagccuugggagaacuguuuuagacuccaguuuggggagcgccagaucaagugagccacggcacugagauuuuuuuguuuguguguguguguguguguguguguguguguguuuuugagacagucucgcuuugucauccaggcuggagggcaguggccggauuucggcuuacugcaaccucccccuccuggguucaagcgauucucuugccucagccuccugaguagcugggauuauaggcaggugccaccaugucuagcuaauuuuuguauuuuuuguagagaugggguuucaccauguuggccaggcuggucuugaacuccugaccucaaauuuuccuccugcuucggccucccaaagugcugggauuauaggugugagccaccgugcacugacauguuuugucugagcagugccuuugugguaguuacccuccugggucacccuagucuauccucagagagaaagacuuggcuauggcuuaccccacaggguguccacagggaaggugguggcgucuuguguggggauguuccuggagaaggggacauuguggcaaauguggaccagccggaagacacccccuccccccagcuggaguuuauaccauuuauggccuccuaacucauucauucagguauacacuaacucauccauucagguauacacuaacucauucauucagguauacacuaacucacuaacucauccagguaugcacucacuaacucacauauccccagggccuccuaaggcaucuaaaauaugcaaaucuuuggugagcccccagugaggcuccuggcucugaauuugacuccugaaaggugaggcccuaggagagggggauggggacugagccacagaaagccuugcucagcuccccuagaccggggugagccggggucuguuucauagagggccaagcugaggcccagacacucugagaggaagcuagacucugaacuuccuccuuggcacccuggauucuggggaucugcuauacaaguccccagagguggcgaagaggaugggagaggcagggcccuggcugggggccuccaagccuccaucccacuccuugggccacccccgcccccguguccauggcaaccacaggcgguuacauaaccuaagggggggauacccgagcagugcacccccauugucgaggugucuagggccuggagaugggaccagcugccugccugcccccuaccccagguugggcgccgcuaagguaacgcacgcccgagacugagccgcaguggccccagacauacuggaggggaagcaggccaugccccccaccucgaguggggcccuaaucccggauuguggagggcaacgcacaggcgccaccccagccccgcuuccccgcccccggcccccgccuuccagguguucgucaucccugcagcggggucgagcccacuggggcuccguggcuuccuacgagcccaaacgcgggguugguggacaccacuccuccgaaguggaggccccggggcuucgaucucuccuuuuggggcccguuccccgcucaccucaucgagggccgcggggcccgggucggggcggaggggucccaggcggagaagccagcguccgccugcuggcgccguuuacaugguggcgcggggucaggccgggugcgucuacgcgggcgggcaccugccccuggcggucagcgcaggggcaucccgcggccgccgaaacagccggcccuuuaaguuccucccccgaguaggcg

SEQ ID NO: 15644 - RNA, 11300 nt, Homo sapiens
cgccuacucgggggaggaacuuaaagggccggcuguuucggcggccgcgggaugccccugcgcugaccgccaggggcaggugcccgcccgcguagacgcacccggccugaccccgcgccaccauguaaacggcgccagcaggcggacgcuggcuucuccgccugggaccccuccgccccgacccgggccccgcggcccucgaugaggugagcggggaacgggccccaaaaggagagaucgaagccccggggccuccacuucggaggagugguguccaccaaccccgcguuugggcucguaggaagccacggagccccagugggcucgaccccgcugcagggaugacgaacaccuggaaggcgggggccgggggcggggaagcggggcugggguggcgccugugcguugcccuccacaauccgggauuagggccccacucgagguggggggcauggccugcuuccccuccaguaugucuggggccacugcggcucagucucgggcgugcguuaccuuagcggcgcccaaccugggguagggggcaggcaggcagcuggucccaucuccaggcccuagacaccucgacaaugggggugcacugcucggguaucccccccuuagguuauguaaccgccugugguugccauggacacgggggcggggguggcccaaggagugggauggaggcuuggaggcccccagccagggcccugccucucccauccucuucgccaccucuggggacuuguauagcagauccccagaauccagggugccaaggaggaaguucagagucuagcuuccucucagagugucugggccucagcuuggcccucuaugaaacagaccccggcucaccccggucuaggggagcugagcaaggcuuucuguggcucaguccccaucccccucuccuagggccucaccuuucaggagucaaauucagagccaggagccucacugggggcucaccaaagauuugcauauuuuagaugccuuaggaggcccuggggauaugugaguuagugagugcauaccuggaugaguuagugaguuaguguauaccugaaugaaugaguuaguguauaccugaauggaugaguuaguguauaccugaaugaaugaguuaggaggccauaaaugguauaaacuccagcuggggggagggggugucuuccggcugguccacauuugccacaauguccccuucuccaggaacauccccacacaagacgccaccaccuucccuguggacacccugugggguaagccauagccaagucuuucucucugaggauagacuagggugacccaggaggguaacuaccacaaaggcacugcucagacaaaacaugucagugcacgguggcucacaccuauaaucccagcacuuugggaggccgaagcaggaggaaaauuugaggucaggaguucaagaccagccuggccaacauggugaaaccccaucucuacaaaaaauacaaaaauuagcuagacaugguggcaccugccuauaaucccagcuacucaggaggcugaggcaagagaaucgcuugaacccaggagggggagguugcaguaagccgaaauccggccacugcccuccagccuggaugacaaagcgagacugucucaaaaacacacacacacacacacacacacacacacacaaacaaaaaaaucucagugccguggcucacuugaucuggcgcuccccaaacuggagucuaaaacaguucucccaaggcucagggagugccugcugcacggugcaggguucucauugagacagcaccugaacuggcugcuguccucacucacaggacacaccaugcugaccggggugaccgacgguaucuucuguugccugcugggcacgccccccaacgccguggggccacuggagagcgucgaguccagcgauggcuacaccuuuguagaggucaagcccggccgcgugcugcgggugaagcaugcaggacccgccccagccgcugccccaccuccaccaucauccgcauccucggaugcagcccagggggaccucuccggcuugguccgcugucagcgccggaucaccguguaccgcaaugggcgguugcugguggaaaaccugggccgagccccucgagccgaccuccuacacgggcagaauggcucuggggagccgccggccgcccuggagguggagcuggcagauccggcgggcagcgauggccgcuuggcccccggcagcgcaggcagcggcagcggcaguggcaguggugggcggcggcggcgagccaggcgccccaagaggaccauccauauugacugugagaagcgcaucacuagcugcaaaggcgcccaggccgacguggugcucuuuuucauccauggugucggcgguucccuggccaucuggaaggagcagcuggacuucuuugugcgccuaggcuaugaggugguggcuccugaccuggccggccacggggccagcucugcgccccagguggccgcagccuacaccuucuaugcgcuggcugaggacaugcgagcaaucuucaagcgcuaugccaagaagcgaaaugugcucauuggccauuccuacggguaagugaacccuggcauguggggugggggugagggauggggucagcagggacuacagucacaaaauacugaguuuuuggcugagccccguggcucacgccuguaaucccagcacuuugggaggccgaggcaggcggaucaccugagguugggaguucgggaacagucuggccaagguggugaaaccccgucucuaccaaaaauacaaaaauuagccagacgugguggcacgcgccuguagucccagcuacucgggaggcugaggcagaggaaucacuugaaccgaggagguggagguugcagugagccgagauugugucacugcacuccagccugggcgacagagggagacucugagaugccacugacaccuguaaucccagugcuuucgggggccaaggcgggaggauaucuugaggcaaggaguuugagaccagccugggcaacauagggagaacccccuagcucuacaaaaaguacaaacauuagcuaggugaggaggugcacgcauauaguuccaccuacuuaagggcugaggcaggagauugcuugagucugggaggucgaggcugcagugaacugugaucacaccacugcacuccagccugggcagcauggcaagaaccugucgcucuuuaaaaaagaaaaaaaaauccgggcgcgguggcucacgccuguaaucccagcacuuugggaggcugaggcgggcggaucacgaggucagaagauugagaccauccuggcuaacacggugaaacccugucucuacuaaaaauacaaaaaauuagcugggugugguggugggcaccuauagucccagcuacucgggaggcugaggcaggagaauggcaugagcacgggagacggagcuugcagugagccaagaucauauugugccacugcacuccagccugggcgacagaaggagacuccgucaugaaaaaaaaaaaaggggccaccacgcgcgguggugcacauuuguaaucccagcacuuuguggauggaucauuggagaugaguuuggacaacauggcaaaaccuuaucuccuaaaacaaaacaaagcaaacaaaaauccuaauuuuucuccuugaaaaaaaucccauuuuucaauuuaauuuuuacauuuuuaaaauuuuuuuuucuuuuaaauagagauggcaucucacuauguugcccaagauguucuuuaacuacugggcucaagugauccuugcaccucagccucccaaagugcuaggacuacaggugugagucauugugcucagccuuaauuuuuuuuuuuuuuuuuuuuuuugagauggagucucacucugucccccaggcuggagugcaguggcgugauccuggcucacugcaagcuccaccucccagguucaugccauucuccugccucagccucccuaguagcugggacuacaggcacccgcuaccaugccuggcuaauuuuuugucuuuuuaguacagacgggguuucaccguguuagccaggauggucucgaucuccugaccucgugauucgcccuccucggccucccaaagcgcugggauuacaggcgugagccaacgcaccaggccaauuuucaaguucaaaaaaaaauuauauagagaauggggggggggucucauuauguugcccaggcuggucuugaacuccugggcucaagccauccucccuccuuggccucccgauguggugggguaacaggcaugagccgcuauaccaggcugaaaacucccauuagcauauguaaucagacagggauuuccgucaucacugauauuguuucacauuguucuaaagcaguguugcucaggccaggugcaguggcuuacgccuguaauccuagcacuuuaggaagccaaagcaggcagaucacuugaggucaggaguucaacaccaguuuggccaacauggugaaaccccaucucuacuaaaaguacaaaaaauuaaccaggcaugauggugugugccuguaaucccagcuacucgggggugugaggcaggagaaucacuugaaccugggaggcagagguugcagugagccaagaucacaccacugcacuccagccugagcaacagagugagacucugcccaaaaaaaaaaaaaaaaaaaaaaaagcaguguuguucaaucccagcacuaucguguuuggccagguuauuuuuuuucugugaggggcuauaggauguuuaguagcaucccuggcuucugcccacuggaugcaacuacacaaucuaguguugaucaugacagucaaaaaugucuucaguaguugccaagcgugcccuggugggcagaauuacccccagcugagaaccacugccuuagacuaaguuaaaaaaucaacugcccuggagaacacugugcauucaggaagcgcucaucggaauccuguaaauucuaggcauuuacaaaggcauggguuacuguaauucacuccugcuuaaagggcagguaauacaaccuaaaacuuaccaagaaccccuccauggaaggcuugguccccagggcuugaccacuaccaaguggccucauucucuccuuuauccaggaagaaaggcaagauugaacagccaggcaaguugagcaccacuguuuuagagauucuagccuaugcaauuagacaagaaaaaaaggccaggcgugguggcucacaccuguaaucccagcaauuugggaggccgaggcgggcggaucaggaggucaggagaucaagaccauccuggcuaacacggugaaaccccgucucuacuaaaaaauacaaaaaaaaauuagccaggcaugguggcaggcgccuguagucccagcuacucaggaggcugaggcaggagaauggcgugcacccaggagguggagcuugcagugagccgagauugugccacugcacuccagccugggugacagagugagacuccaucucaaaaaaaaaaaaaaagaaaaaagaaaaauaaauaaguggccaggugugguggcuuacaccuauaaucccaacacuuugggaagcugaggugggaggacugcuauagcugaggaguucaagaccaaccugggcaacauaagcaagaucucaucucuacaaaaaacuaaaaaguaaaaaaaaaaaaaaaagaaaagaaaacaaagaaguuacauaaguaucuaaaagaaaggaaucuagacugagagguaacagcucuuauuuguuuauauuucuuuauauaacauacucaaaaguugaugcuuaugagaaaugauuccucuaauuaaaugagcacccaccugcugggcacagugguucacaccuguaaucccagaacuuuuggaggccgaggcaggcggaucacaaggucaggaguucaagaccagccuggccaaaauggugaaaccccgucucuaauaaaaauacaaaaaguagcuggguaugguugcaggugccuauaaucccagcuacuugggaggcugaggcaggauaaucauucgaacccaugagguggggguugcagugagccgagaucgcaccauugcacuccagccugagugacagagcaagacucugucucgagaaaaaaacaaaaaaacaaaaaaaacacccaccuacaauaguucccaugaccccauaacagugcuauuaggucagcacauuuacaacuucaggaauguggaggcugaagcucagagaggugaagcaaccugcccaaaggcauacaggaagucccugacacaaucaggucugccugacuccugucuguauccuuuccucauuacagcaggggcuggcaaacauuuccuuaaaggaucggauagcgaauauuuuagguuugcaggccauacagucacuguuggaacuucugauaaaacuuuauuuaggaaacauuuuuuggccaggcacgguggcucacgccucuaaucccagcacuuugggaggccaaggugggcagaucaccugaggucgggaguucaagaccagccugacuaacacggugaaaccccgucucuacuaaaaauacaaaaauuagccgggcauaauggcagaugccuguaaucccagcuacucgggaggcugagacaggagaaucacuugaacccgggaggcggagguugcagugagccgagaucgcgccacugugcuccagcgugggcaacagagcaggacuccaucucaaaaaaaaaaaaaaaaaccuuauuuaggaaacauuuuucaaaucuccaaaaguguaaacuguauuuaaaaaagcaaaugacuagcccacaggccguacauaguuuguugaccccugcuuuuguaggaaugaggagcucagcuuugggggcuucucaggccuuccaucuuguauaaggaagacagauaugucaugcccagaggcagguggcagaacauccugaaagggaagggauaguaggaaacagugaccuccccugggcagccggaagcauuuguuuaaucagauugcuuuccuaccacuugcugaugaguaauucuuaccgcuuuugggucaugguggcuugaagaaucugaugagggccgggcacaguggcucauaucuauaaucuuaacacuuuggaaggccaagguggaaggaucacuugagcccagaaguucaagaccagccugggcaacauagugagacccccaucucuacaaaaauuuuaaacaauuaaaauaaaaagucuggugaaacuucuggauccagauucucucuucaaaauaaguuccauccucaacacucaaacucacacuuucacgguauuugagaggccgcacucaucccucaccccuucagguguccauggaccccaggggaagaaucuuggcuuccaaggaccugccuucuggguagggggaggacaugaacccccucaccaggccgggugucacggcucacgccuauaaucccagcacuuugggagguuaaggccagaggaucacuugagcccaggaguucaagaccagccugggcaacauaaggagacccugucuuuauaaaaaaauuuuuaaaaauuagcugagcaugguggcacaugccuguagucccagcuauucagaaggcugaggugggaggaucucuugagcccaggaagucaaggcugcagggagcuaugauuacgccaccgcaccacuccagccuaggcgacagcgaaaccuugucucaaaaacaaaaacaaaacaggccagcccaguggcucaugccuguaauccccgcacuuugggaagccaagguggguggaucacuugaggucaggaguucucgaccagccugagcaacaugcugaaacccugugucuacuaaaaaauacaaaaauuagccaggugugguggugcaugccuguacucccagcuacucgggaggcugaggaaggagaaucaguugaacccaggaggcagagguugcagugagcugagauugcaucacuguacuccaaccugggcaacagaaugagacuccaucucaaaaacaaaaacaaaccaggccaggcgcaguggcucaggccuguaaucccagcacuuugggaggccgaggcggauggaucacuugaggucaggaauuugagaccagcccgaccaacauggugaaaccccaucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaaaaaauuaccugggugugguggugugcgccugcaaucucagcuacucgggagacugaggcaggagaaucgcuugaaccugggaggcagagguugcagugagccaagauggagccacugcauuccagccugggggacagaguaaaacugucucaaacaaaaacaaaaacaaagcaaaacaaaauggucacugcuuguauccugcugaccgccucccuucaauccuccuaucaccccacccguuccgggcagugucucuuucugcacauuccuggcacaugaguacccagaccuagugcacaaggugaucaugaucaauggcgggggcccuacggcgcuggagcccagcuucugcucaaucuucaacaugcccaccugcguccugcacugcuugucgcccugccuggccuggagcuuccucaagugaguguccccaccccaaagaccgugauccuggcccuggcgaacccaggcaucugcucgaguuggaugggaggggggacuguaccgcugggacuagggcuggcaucgggggcaccccacggcagucgggcuggcauaaggggcucuagcggugccuccaccaccaccagggccggcuucgcccgccaaggagccaaggagaagcagcuguuaaaggagggcaacgcuuucaacgugucauccuucguacuccgggccaugaugagcggccaguacuggcccgagggcgacgaggucuaccacgccgagcucaccgugcccguccugcuuguccacggcaugcacgauaaguuugugccgguggaggaagaccagcgcauggccgagguagaggcgggcaccuggggcgccacagcuacaaauccccagggugcugcccgggaggggcguggccucugcggggggcgugguagcgcuuggugggcgugcuuucuucccgagggggcguggcugccgggugggcguggccucuaguugcuguaucuuguucugaccccaggcaaacaggagcauuaggucuagcaucagaaguagaaucuagaaagcagggcugcccuggacagguguuagcaauuacgcacuguccccaccgcuguaagaaggcucuccucacagcggaggauuuguaugagaccggugaccuauauaauucuagaagaccggcaccaggggaucuuuagauuagaaacucuaauuagcgaguucagauuagaaagggucuggggauccuuagcacuuagaauagcccuggauacuagcccggcgaggugguucacgccaauaaucgcugcaacuugggaggcugaguggggcggaucgcuugaacccaggaguucaaggcuguggugagccaugcucgcaccacugcacuccagccugggcgacagagcaagaccccguuucuuaaagaaaaaaaaaaaaaaacaaaaaccauuaaaguauaacuggacuggugguucuuaacuaaggaggauucugcccccaaggaacacguggaaaugcauggagacauuuuuaggugucacgacugagggggaggggguacuacuggcaucuaguggguggaggccagggaugcugcucaacacccuacaaaugcacaggauagcagcccccaccccagcuacccgccccuuccccgcccacccccgcccccccagcaaagaaugauccagcuccuaauguugguagaguugaaguugacaaaauccuccuccaggccgggcgcgguggcucacuccuguaaucccagcacuuugggagaccgaggcgggcagaucgccugaggucaggaguuggagaucagccugacaaacauggcgaaaccccgucucuacuaaaaauacaaaaaauuagccggguguaguggcgcgugccuguaaucccagcuacuugggaggcugaggcaagagaaucgcuugaagccgggaggcagagguuggagugagccgagauuacgccacugcacuccagccugggugacagagcaagacucugucucaaaaaaaaaaaaaaagaaagaaaagaaaaaaagaagaaaauccuucuccuggcauacuguagacacuuaauaaaugcuggaugccugaauacuaguuggguuccagcagggcuacaggccauccuccagcucccccuugaguggaaguggagagaugcaggguagaugggaggagggacuuuuggaugcugugggccauguguguauggcggagucccagggaagccuggccucucuccacccucuugcccccgccuaccuugagcccugcgucuucugcagauccugcuccuggcauuccugaagcucaucgacgagggcagccacauggugaugcuggaaugcccugagacggucaacacgcugcuccacgaauuccugcucugggagcccgagcccucgcccaaggcucuaccggagccacugccggcgccuccagaagacaagaaguagccgcugggccggcggggcaucgcuuggugagcacagccgcagcaggaggaggcccgagccugcgccaggucugcagcgcagaccaccugggcgggccguucgcuccggugggcggggccaggucagggagacgcccccaggcugccugggcggggcguggcauccgagggagcccagcggacauuccgcucuccgcuuccgucccgcggggcccaucggcguuuuggggccgcagccgggacccucacggaagaugaccuuguacagaagcucucccucaccuuccccccaacgccacggccaaggcaggccccccaccccgcugucuuccgugucagccgugcuugauccugggacccacgagccccacagggacccucgaggccccaucccguuauccgagacccuuccuaccccccauuccucggcgcugggagcuauuuuugcccaagggggggggaugggggggcuggcgccaccgaaccugcacaucucaacuuguaacucaauaaa

SEQ ID NO: 15645 - RNA, 585 nt, Homo sapiens
cauaauccuuuguuccagggcuggagcggcucugggcuccggaaucgcccgcagccgguacugcgggacccacugcggauauggcugucuuggcuggaucccuguugggccccacgaguaggucggcagcguugcuggguggcagguaaguccucagggggacccuuccccaaaucagggaauaagggcggcuucggaggcuggcgccacucuucacugcccgcgugaccugccagugccuugcgcauuuugcagccaggcucugucuccgggagccgaggcucagagagguugagcgccaaggucacccagcgccccgucugaccuuucucgccgucccucuacccacgcagguggcuccagccccgggccuggcugggguucccagacgccuggggccuccccaccccgcagcaggcccggggcaaggcucgcgggaaugaguaucagccgagcaacaucaaacgcaagaacaagcacggcuggguccggcgccugagcacgccggccggcgugcaggucauccuucgccgaaugcucaagggccgcaagucgcugagccauugaggaucgcgacgcagucgg

SEQ ID NO: 15646 - RNA, 585 nt, Homo sapiens
ccgacugcgucgcgauccucaauggcucagcgacuugcggcccuugagcauucggcgaaggaugaccugcacgccggccggcgugcucaggcgccggacccagccgugcuuguucuugcguuugauguugcucggcugauacucauucccgcgagccuugccccgggccugcugcgggguggggaggccccaggcgucugggaaccccagccaggcccggggcuggagccaccugcguggguagagggacggcgagaaaggucagacggggcgcugggugaccuuggcgcucaaccucucugagccucggcucccggagacagagccuggcugcaaaaugcgcaaggcacuggcaggucacgcgggcagugaagaguggcgccagccuccgaagccgcccuuauucccugauuuggggaagggucccccugaggacuuaccugccacccagcaacgcugccgaccuacucguggggcccaacagggauccagccaagacagccauauccgcagugggucccgcaguaccggcugcgggcgauuccggagcccagagccgcuccagcccuggaacaaaggauuaug

SEQ ID NO: 15647 - RNA, 20867 nt, Homo sapiens
cgugcaucgggccgggaaggagaaucgagguucggcucgggcggggacgagaagcagcgcucgggcgagcgaggaccgaggccggcgcgggcgggcgcggccuuugucuccuccucccgcgcgcuccgcggcugcaccggccccaugagcccgcggcuccccgucgcccgggccguccguagccccugaccugaccuguccucgccauggccgaggccgccuccggcgccgggggcacgucccuggagggcgagcguggcaagaggcccccgccggagggcgagccugcagccccggcguccggaguucuggguaugugugcggcggcuggaccagacaggguugcaggugccuggggagcccgcgucaacuacacggggaggaggaucagggucaaacguaaccuggcguggugucuggacgaggggccggcuccucccggcacugcggcugcggcccggcgggcggggcugggacggugcuucgggcuggggucccggcgcggagacgcggacacgccccuccgagagccccaggcuugggcugcgcccugccacccccgggcugcgggaucgcggcgggccagggaugugcuugagagagccucuccgcgaagaauacagaaucauacgguccuggguucaaaucccagcuugacugugugaccuugggcgcgugacuuaaacgcucugggccucaguuuccucaccugugaaauggggguaagaaccgcaccuagucccuggggcugcugcaaggacggcgcugucauaauguggugaagcgcucagggcugcuagugagcgccccaucgauugugguuuuggaggcggagcugggccucaagaaugaguaagauuuguaagggaggaucuggggggaagggcauuucuggaggaaggccuggcugguacaaggacguggagggaggaaaauaagccaagcccagagcucccggggccuugaaugccagguggaguggugaggagcccuggcgggggcaggaggagccaagacuggaggccggguccggaucccagaguggccugacccgggccugcuacgccgcccccuagauaagcuuuucggaaagcggcuccugcaggcuggucgcuaccuggugucccacaaggcguggaugaagacggugccuacagagaacugcgacgugcugaugaccuucccagguacccaagcccgcccgcccgcccgcccagugcccagaugcggcucuccugagcucggcuucccagaacgggaauacguaggaggccuugggcccccucguggcaggagccaucggucccugugccccuuggcagacacgaccgaugaccacacgcugcuauggcugcugaaccacauccgcgugggcauucccgagcucaucgugcaaguccgccaccaccgccacacgcgugccuacgccuucuuugucaccgccacguaugagaggcgaguccccugucccuggccucucgcugagccugccacccgacuccccgcucuaccaagugccaaccaugcuauccagccgcccugcguuugucccaaaggcugccaggugcaccauccucagcuccaggauggugggccggggccucccugugagcccaccuccuccgccuucuucacagccuacuccgaggggccgacgagcugggucugcgcaaagcagugaaggccgaguuuggcgggggcacccgcggcuucuccugcgaggaggacuuuaucuaugagaauguggagagcgagcuacgcuucuucaccucccaggugaggccggcucugggcccccgcaugcauccugugccuaugaguucccugagcucacgcccucuuccucgcaggaacgccagagcaucauccgcuucuggcugcagaauuugcgugccaagcagggagaagcacuccacaacgugcgcuuccuggaggaccagccaaucagugagcagggcggggucaacaccaaucacaggcagagaguuggguggagcucuucaaagacagcuuauaggagcaggagggcggggcccagauccaaccagucagggguuggcaaagaguuaggaaaccaaugagcuaaagggguguggccuuagcaaaaggguggagcuuaucuccugaguuggguggagcucugagaggacagcuuaucaggacaggaggucagggcuuauguccaaccaguuagggguuggcaaaggguugggaaccaaugagcugagggggcgaggcuuuggccaaaggguggggcuuauuucugggagguggguccaggagaggcccuuuucuggguuugggauaaaguggaggcaggaaccauggacagcacuccacuuacagaguggugcggcucugggcguuggauuccccuccaggaaacuaggcacccaaguucaccuuccgacagcaaguuuuuaccauuccucagacguucggguccacaaacugagcuuuauuuaaagcaggggaacaggcgcaguggcucccaguacuuugggagguccaggcgguagcaucacuugagcccaggaguucgagguugcagugagccaugguagcgccacugcauucuguccagccugggugacagagcgagacccugucucaaacaaauaaauaaauaaaguaaaaaauaaggccgggcgcgguggcugacgccuguaaucucagcacuuugggaggcugaggcgggcguaucacgaggucaggagaucgagaccauccuggccaacauggugaaacccccaucucuacuaaaaauacaaaaauuagccaagugugguuggcgcgcgccuguagucccagcuacucgggaggcugaggcaggagaaucgcuugaacccgggaggcagagguugcagugagcugagaucgcacuacugcacuccagccuggugacacagcuagaccccgucuaaaaaaaaaaaaaaaaaaaaaaagccgggcgcgguggcucacaccuguaaucucagcacuuugagaggccgaggcagguggaucacuugaggucaggaguuugagaccagccuggccaacauggcgaaaccccgucucuacuaaaauacaaaaauuagcugggcgugguggugggcgccuauaaucccagcuacuccggaggcugaggcacgauaaucgcuugaagguugcggugagcggagaucacgccacugcacuccagccugggcgacagagugagacugucucaaaaaaaaaaaaaaacaugguuccucaccagaaccccacucucccaguuccuuuacauucuccccgccugccccugcaccuacaauuucugaaggagaaucagaucuucuauccgucuagaacuucuccccuggaaagagcucuagagguuuaagagcaggcaaaaagcugugacuuggguuucagacaaagaggggcuagccaggcuaggcacagguggaggggcggggaucaccugugcuccucccuccacagucccggagcuggcagcacgugggaucauccagcagguguucccuguccacgagcagcguauucugaaccgccucaugaagucaugggugcaggccgugugugaaaaccagccucuaggugcugccugggcuggggggugggagggagucccagcagacaggcagggggugacugagacccacuuguccccuggcagaugacaucugugauuacuuuggugugaaaauugccauguacuucgccuggcugggcuucuacacgucggcuaugguauacccagcugucuucgggucuguccuguacacauucacagaggcugaucagguacugggcagggacccugcaaggucugggggauccagaggcgcccuccuuucuggacuggcacaaacaaugacucaacucuucucugccacucacagacaagccgggauguuuccugcguggucuuugcccucuucaacgugaucuggucgacgcuguuccuagaggaauggaagcggagaggggcugagcuggcauauaagugggggacgcuggacucaccuggggaagccguggaggagccacgcccccaguucagggucaguugggggcugaguccagggucauggagacaggacaaagguaaaugguggggggcacugcaggagcaaaggcagagaggugugaaacaggauuguuucaucaaagaggguaugccaaaccgaggcgggcucugugugcuccccagggggagagguggaaguuggauuugagggacugggaacagugcccuaggugggugaccugagagggucaccuccgcaugauggagggaaauugaguucugaggauagggaggggugcagaaggcagagguggccccucugagcucaugcugggcccggucuuugcccaccaucagggcgugcgacguaucagccccaucacgcgggccgaggaguucuacuacccgcccuggaagcggcugcucuuccagcugcuugugagccucccccugugccuggcgugccucgucugugucuucuugcucaugcuuggcugcuuccagcugcaggugaccccccauacccucacccgcccuguccuugguaccuagcuccaccuugggcugagcccugcagcugggaugagcccugaacccccuucucccgcaggagcuggugcugagcgugaagggguugccccgucucgcccgauuccugccuaaggucaugcuggcccugcuugucagugugagugccgagggcuacaagaagcuagccaucuggcucaaugacauggguacgaccugccagggggucucugggaggaaggucuccacugccccuugggaucccugccacccuuggggggaccgcggcugcccccucacucccccccuuggccccuagaaaauuaccggcuggagagcgccuaugagaagcaccucaucaucaaaguuguccuggugagucaccaccaucggacaggcagggggacaacggggaagcugugccgucuguauggggcacaaggaaggcuccaaggagucgggugggggugcaggaugaccaccgccugccuccuuccugcaguuccaguuugucaacucguaccugagccucuucuacaucgguuucuaccucaaggacauggagcgcuugaaagaggugagacccccgccccagcggcaguccccccugcccccauggcggccagcgaggggccagacccggcacaagggguccaagggcucuccagccccucccuccccuccuccauccuucucuccugucuguccguccguuguccgucgucugugcguccucucucugccugucguccccccaucuguccguccaucuguccgucggucccuucacagcuccugcucguccugucccugucccagagccucgagcggcagcugcaggcggugcuggucccgcucgcggcccugcgguuccgccugcuccuccucucccuccggggccuccugcucgcggcccgggccaaaguacgggcagguggcgagcccguggguccucgccggggugggcagcguggcugugcugggggccuggcgcgccgagcugagggcgcaugcgcggagggaaucuggggucgggggcggccagcaagcaggugcaggcggcugggggcgcacgcggcccagugcaccgacagagcccgcggugggguggagacgcgcugggccugcccgugaggugggcgaggagcgcugcgcgugccaggcuguauuuuguggcugagcgcugggggccucgcgucgaggcgcguccaaagcagcggaguuaggaaccggauucggcgugugucugggcacggugcuccggcggggcgcccagggagggugagucccccgaucccggcgccccgcuugccccccacgcgccucucuccuuccccuuccugcccccagaugcuggccacgcugcugaucacccgccaguuccuccagaacgugcgcgagguccugcagccgcaccuguaccggcgccugggccgcggcgagcugggccugcgggccgucugggagcuggcccgagcccugcuuggccuccugagccuccggcgcccugcgccccgccgccucgaaccccaggcggaugagggcgggggcggcggcagcgggggcgggggccgcaggugccucagcgggggcugcggggcgccggaggaggaggaggaggcggcgcugguggagcggcggcgggcgggggaaggcggggaggagggggacgggccuccagggggcaaggaggaggacgaggacgacgaggaggaggaggacgaggaggaagaggaggacgaggaggagggcgaggaagggggccuccuggacugcgggcuccggcugaagaaggucagcuucgcugagcgcggcgcggggcggcgucggcccggcccaagcccggaggcccuccuggaggaagggagccccacuaugguggagaaggggcuggagccgggaguguucacccuggccgaggaggacgacgaggcggagggggcucccggcagcccugaacgggagcccccggccaucuuguuccgccgggccgggggcgagggccgagaccaggggcccgacgggggcccggacccggaacccggcuccaacagcgauucgacccguaggcagagacggcagaaccggucgucuuggauugacccgccggaggaggaacacucgccccagcucacccaggcagagcuggagagcuguaugaagaaguacgaggugaggagggggcggggccucgcagggggcggggccucgccggggacgggacacaccguccgagggugaaggccgugggggugggaguggugauaacagggccauugauguugggaugcugcaggagaggaaggccuagccagauacaggaagccucugggcuggcugaggauggggacaggcccuggguccacaugggauaaucugagggaggcgggcucaaugggagaaagauugucccagggaagaggcuuccaggucugaggcccgcccacucgcaggacacguuccaggacuaccaggagauguucgugcaguucggcuacguugugcucuucucguccgccuucccccuggcggcgcugugcgcccuggucaacaaccucauugagauccgcagcgacgccuucaagcugugcaccgggcugcagcggcccuucggccagcgcguggaaagcaucggccaguggcagguggggggaagccaagagauccgagcugaggcccagagggagcccaggugcagcugggaggagccuggggucuggggaggccggcuggaccccgccugagcccuccugccgcccugcagaaggugauggaggccauggguguccuagcgauuguggucaacugcuacuuaaucggccagugcgggcagcugcagcgccucuuccccuggcugagcccggaggcagccaucgugucggugguagugcucgagguggggccggcgacaggggcgggggcagcugggaggcgagagggcggccccagcgucugcagccugcagccuccucucugccaccccugcagcacuucgcucugcuccucaaguaccucauccacguggccauccccgauaucccgggcuggguggccgaggaaauggccaagcuggaguaccagcgccgcgaggccuuuaagguaggggggccaggcugggcucgguuuucucauugguggggcugcugguggaucucugaucuugguggccaauuccuuagcguaagggcaaaugcagagacugcacagagcuggguauaauaauuagugcucccuggcugggugcaguggcucacuccuaugaucccagcgcuuugggaggccaaagugggaggaucgcuugagcccaggaguuugaggcugcagcuagcuaugauugcgccacugcacuccagccugggugauggagcaagacccugucucuaaaaagaguaauaauaagcaauaauaacuaguguucacaacggguccagucgcuucuggaauccuggcagcauccagcacgaggcuggcccuucagaaccuucagccauccaccagcuugcccgauugcauccuguuagggggccagggacacagcggaggcuuccuagaagcgcagcuucuuccgcauuccucagaaagcuacagaaugggccaaggagcuccccagugccugcacagggaacauuccucgaggaugacaauguccuuugucugcacugucccugcagccuuuagcuacaggugauaagugagcacguugaagugcagcugcugcgaccgagaaacugaauuuuuauuuuauugaacagagccucgcguggcuaccuggguauagucugcugcagccauaguccuuuuuguuuuuguuuuuguuuuuucuuugagacagaaucucucucacucugucauccaggcuggagugcauggagugcaguggcacaaucucggcucaccgcaaucuccaccucccagguuuaagcaauucucaugccucccaaauagcugggauuacaggcaugucccaccacgccuggcuaauuuuucuauuuuuaauagagaugggguuucaccauguuggccaggcuggucuccaacuccuaaccucaagcaaucugcccaccucccaaagugcugggauuauaggcgugagccaccguacccagccugcagccacgguucugucucuugccuguucucugggaagcaggggaucgguugaggcucaggauugguuuccacuuuaccaauuccuaagacgcugucuggcacacagccggggacagaguugauggccagugaauguuuguuuucuuuucaauucccagaaaguaccggcguggguccagggauucauucaguugcacccaauaagccucggaaucucucuccaguuccccagagaaccucagugugggcccagagaugaagcuggcgcccaauacgcuuuuuuucuuuuucucuuuuuugagacagucucgcuuuguccccaggcuggagugcaauggcacaaucucagcucacugcaaccuccgucucccggguucaagcgauucuccugccucagccuuccgaguagcuggaauuacaggcgugugccaccaugcucagcuaauuuuuauauuuuugguagagacaggguuuugccauuuuguccaggcuggucucgaacuccuggccucaagugauccucccaucucagccucccaaagugcugggauuacaggcgcaagccacugcgcccagccccaauaagcauuuaagccucccucauuuccacagagaggcugaucauguaucugggaaugccguuugcacccaauaagugauuggcucucucccacuucugcagggagcccccauugugggugcagggauacaguuggagccuaauaagcauuuaagucucccccacuuuugcagagagcccuggcaugcaccagccucagcuggcacccgcuaacacccuuucuucuuaguccuguaacggcuuggcucuaccugcagagacacgagcgccaggcccagcaucgcuaccagcagcagcagcgcaggcggcgggaggaggaggagcgacagcgccaugcagagcaccaugcccggcgggagcaugauucugguggccgagaggaggcgagggccgagggcucugggcuggacccugccaccuccuccgagaaggccucugccaaggccaagggcagcacugcggguggccacgggccugaacggcccaagcgcccagggucccugcuggcacccaacaacgucaugaaguugaagcagaucaucccacugcagggcaaauuccucucgucaggggccacauccucacuggcugcugcaggggccggagccaccacccggccucccccugcccagucacccacaggcagcgacacccgccugccugccuuccucagcuucaaguuccucaagucacccgagacccggcgggacucugagcgcagccacucaccgcccaaagccuuccaugcuggcaagcucuuccccuuugguggcacccgggcugagccuggguccaacggggcgggcgggcaggcccggccagaugggacccccagcaguggcagcagccggguucagaggagugggccgguggacgaggcccuggcugaggagcuggaagccccccggcccgaagaggaaggcucaggucacaagcuuuaacucggggguggggacgccgggccggcuuuggggauaggguaggguggccaggccuggggagaggggcugaaggggacaggggaagcccggucuuagguccugguggggaccugggucagugguacguggagccucucaguuaaagccugcuuaguaucuccagggccuuuguuagccuggagccccgugccugacccuccccagggagggaugccaaagccccuugucccaggacugcacccagggacccccaccaugcuccggugccaggagagaugagggaggccuguuucccaaccagcccacccuucuccugcuccagcucacucuugggggggacuugaccccccaggccucuaugcaaauccacacccugcagcccagcuguucaggaaggccuuccucgagguggggcuggggcugcccacccagggagcucccacaugugcugagcagaggugcaggccucaccccuacccucccacccccaccaccuccccugccccaaucccagccugggcuccagcaaccccauucccagggagcccaacagguggcagcugcagcacaagggccauaggucagaagccagagggacuuccucaaacuguccucccccugugaccggcagggccgugcccagaggcaggguaugcaccggaagccgcccagggggccgccccaccucagucucugaucagaagcaauaaggccuuuaugugccuggaugcccgggagggagcgcgggcaggguugccagcccggcgggguccggcgggggcggcauccccccggaacggccccucucgccuccgcagggacagcgcuggcccccgugggcgccccugcccuccgcacccgccgcagccggagccccgcgccgccgccgccaaugccgcugccccggcccccgacaccgcccgcaggcugcuggcagugggacgggcccuggggcugcgggggcgagggugccgccccccgccaggcccuggccgcugccgagugcccacccugugccauggccgggcccccacccgccccccagccccugccgggagacgccagcuuuuacagccucccgcccccaccgcuaccgcccaccucggauccccucgagaccccagcgcccuccccuagccccagccccagcccccaggccgugugcuggcccagcggcuggcauuagcucuacccgcccugccuucucuucucauaugcaauaucagucauucacaggggcggccggucuccaaaaugcaaaaugcgcuucagcccccgagggcccccaguauuggucggugccccccaucugccguuuuccuuuccaaacgaaaggaaacccacaaauccaacagaaaacacacacacacacacacacacacacacacacagaacaggcgauuauuuauuuguuuuuaauuuauuuugucauauuuuuguaaaacggcagaaaugcaauaaaaacuauauuucaacagugcccgaggucagagcaguggaaaagggagugggggugggggagucuggguggcuggggccuagguugggaacccccuccccccauccugguacaggcuggcuugacccaugagggccuccucccaaaaacugggucuuggccacagauggaaaacuccaggcugcgccgccucugagacggcccagauuuggaggccaacuucagcccuggcuucagccacuagacaaaggaaggaaucucuaagugcugaaaagaggcgacaaugugugcacaggccccaguccugaguaagacuccuucucaaagaggacagcgcggugguuugcaagacguggccccuucuggcacacccgccuccuggaacaucgucuggggagccagagacagugggaagagcuuguggcaugaacaucagaaggcaccuggcaccugagccuccugcaguccccgacuugugauacugagagaauggcacauuuggguguccccaggacacgggguggcauugggaugcagcagggaugucccacugugggacagacaucagacccaagucacugggacucugucguaugacucaggaacaggaacguggccucucagacccucacauuuuucaggaagaggacaaauguguccacauccaaaggcuuaaggcucagagaccaacauggccaugcugcagggcugggccagugugagcaaggggcccuuugggaggcuguggagaagucagaguucacuggaggcaggagaacagccugugcaaaggcggagaagguggaaggcaguuugggggaacagugggguaaaggggaccccaaaggcaggagggguagacagaggccggcucaggggcccagcguccucccacaggcagugggagcuacacagggugugugugccagguggggcaugucccgacagacccagggguucuagggggaggccacagggaggcaagcuggggcacagcccucagaccccaaaggagggagcugagguaggggaggggaaggaggugcccgcccagcagcccugcagagcgacgggcagacagcacaggcaggagacagcccccagccacucaaagcagaaacugggagccagagaggucuagacaggccgaggggaaaggcgggagugcccccugcucccacucuggccccuggccuuggaagcugaagucccaccaucucagucauucacagauggacaccgcaggccugcccaggucacaccaacccuggggacugggacuccccagcuggccugggagccuccagggcauucagccggacccggcaccaucgaccgcagucaagugugcauuuccugaccaccuguccugugaccacauggccccuguagcaccaucacugugguguagacacugccgggagcugggagguacagcaggguggcugugcugugccugggccuggucagccacuccuuguguaggacgggagcccacccuggcacucuccguccuugggagagaugggccgccuaggcccgagggucugacacaggcagggcccuccacaguggaaucuggggcaggcggacccuccauagcccggagugucugcuagcucuguggcccaacccuacaccaucccaacgcccucagacucagcucucaaaacagagaccucugccaggcacggugguucacgucuguaaccccagcacuuugggaggcugaggaagguggaugacuugagcccaggaguuugagaccagccugggcaacauggugaaacccugucucuacaaaaaauuuuuaaaauauuagccaggcagccaggugcggucacagcacuuugggaggccgaggcaggcgaagcaccugaggucaggaguucgagaccagccuggccaacaugacaaaacgccgucuccacuaaaaauagaaaaauuagcuggguguaggggcgcacgcguguaaucccagcuacucaggaggcugagguaggagaaucacuugaaccugggaggcagagguuguagugagcugagaucuugccacugcacuccagccugggagacacagcgagacuccaucucaaaaaaaaaaaaaaauuagccaggcaugguggugggugccuguggucccagcggcuuggaaggcugaggugggaggaaggcuugaggucgaggcugcagugagcugugauuacgccacugcacuccagccugggaaagaguacaagaccccaacucaaacaaacaaacaaaacaaaacaaaagaaaacugagauccccaccaccaccagugggggcaauaaggggagaagcgguguucccccagccccaggcucaguggucagggccacaaaccuucugcccagagcccgaacaccccuacauacccaagcucagccccaaacccagcccagcuggcggaagagggguccccaugagcggccauggcacaugccaacugccaggugccaaccuucuguacagcuccucuaugacccagcaagggugaggccaccaccuaggacagcaagaccggccagaugccgucuguacugucaccaugccucaggggagcagcagaggccagagaccccaggcccccggaugaggccggccaucucugcggugucugacaggugcgcugcccugcuuggcgguaucccaggcagggggcugaccccgcuccauccuuggcaccauggaccgucucucaggaaugaccuguccuuggggucaccuugacaggagaggcagaggggaugguccaggcaggucuuggccuugaacaugguggccucagcaagcccacgagagaauccagccgguccuggggccccuggcguggggggcccuucucacuccucuuggugacaacagggaugacucccaggggcuccguccucugcagccaagguguguggagcaaagacgcgaggucaaguaggaaagacccuuuuauugggguggacacggagcacgcacuaguccaugauaaaaauaaaaugacucaagagaaagaucccaagggccgacuucuccccaacgugcgugcacgcugagugaggccugggcaugggaaaguuccgggcgaagcgugggacaagaccgagucucaauggccuggaccgguguugggggggagaaggccacucggcuguccugguaggucaggccaccccgggcccgccccugucgcccggccacaguaaagcccccgcuagagacucucacagacacacucugguucucuggagaacugggggcaggaaucggggaacuggcccgauggaaggcgggggucggggggacaauguuguuuuuuuuaaaaagcaucuaccaacaucacacuacugggucugauguccccuuuaaccaacgcuugauacagguuacagcauaaauaaaaacucaaggaaaauaaauacaucggcuccuaugagguuggaagugguguggacgcaggguguggaugggccggcagggaggcgggcgggcggggugcuuacacauggcgggcaggcgggugggcgaccgaggagcagaccuggcaggaggcgccuguggaguugagagucuuaaguguccucgugcaugucugggcugucgguccgcgccaccuugcggggaggugcggagcucucgccuuccagcuccacuugcuccuggucucucuucuuggcagcguucugggggacagggaaaagagaggggcugugagucuuuuuuuucggacagccucaaccuucugggcucaagcaauccucccagcucagccucuggaguagcuaggacuacaggcacauaccaccacgcuuaauauuuuuacuuuugguagacauggggguuucacuauguugcccagcuggaggcugugagucuucacgugggugaagcucccagagucauaaugccagcccaggccccugcagcagcaucacagagguaggccuggaguacaguggggggccccagggucccuggcuaggcagccccuccuaccaccaggaccugccccacuaagcccugcccagagcacuuucuggacccaugccuggugauagacagguguuuccuggcacccggagucacccccaccacaugcaaugacccacacagggcugguuucucaagcacucagaggagcaacccacccagccugggaauaaagggccuuuggaagccacuggggaugccgcacaucaacgcaagacagaagcacacgccuccuuccccgcuguggaaaccaaguccuggggggcaggagaaggggugggggugggcccagcagcuuggauuuucagaagcagucacuuugccacacagucccccgaccuuccaacuuugcgcaggguaggcagccacccacuguucaauguuagguaaaaaaaaaaaaaacaaacuugccaggcgcgguggcucaugccuguaaucccagcuacucuggaggcugaggcagaagaauugcuugaacccaagaggcggagguugcagugagcugagaucacgccacugcacucacuccagccugggcaacagagagacuccgucuccaaaaaaaaaaagaaggccaggcgcgguggcucacaccuguaaucccagcacuuugggaggccgagguggguggaucacuucaagucaggaguucgagacuagccuggccaacauggagaaacccugucucuacuaaaaauacaaaaauuaggccaggcaugguggcucacaccuguaaucccagcauuuugggaggccaaggcggguggaucaccugaggucgggaguucaagacaagucagacuaacaucgagaaaccccgccucuacuaaaaauacaaaauuaaucaggcaugguggcacaugccuguaaucccagcuacucgggaggcugaggcaggagaaucgcuugaacccaggaggcggagauuacagugagccaagaucgcgccacugcacgccagucugggcaacaagagcaaaccuccaucucaaaaaaauaaauaaauaaaauaaaauaaauuagcugggcaugguggcgcgugccuguaaucccaccuacucaggagucugaggcaggagaauugcuugaaccugggagguggagacugggaggaggagguuacagugagccgagaucacgccacugcacuccagccugggcgacuccagccugggugacagagcaagaccucaucuaggaaaggaaaaagggggaaaaaaaggggaaaagaggggaagggcagggcagggcagggcaaaagaaaaugaaaaacgaaaaagaaaaagaagaaaaauaucccgugugcagaggcagccucugggaagggagcuggggcaccagaagcgggaggcgggagaugacucuucgcugcaacuacacccucuuauuuuuauuuucuagagacagagucugguucuguugcccaggcuggagugcaauggcaugaucaugauucacugcagccucaaccuccugggcucaagcgauccucccaccucagccuccugaauagcugggauuacaggaacaugccacagccagcuaauuuguuuuuuuuuuuuuuuuuuuuagugauggaguuuugcuguguugccuagacuggucucaaacuccuggccucaagccaucugcuugcgucagccucucaggcaguuccgggugugaaucaccacacccagccacacccucacauguuaccuagauuucuuuuuuucuuuuuuugagauggagucuagcucugucgcccaggcuggagugcaguggugcaauuucagcucacugcaagcuccaccuccuggguucacaccauucucccgccucagccucccaaguagcugggacuacaggcacccgccgccacacccagcuacgcggcuaauuuuuuguauuuuuaguagagacgggguuucaccguguuagccaggauggucucgaucuccugaccucauggucugccugacucggccucccaaaguccugagauuacaggcaugagccaccgcgcccgguauagauuucuuuuuuucuugagaccgcccaggcugcagugcaguggcaugaucuuggcucacugcaaucucugccucccagguucaagccauucuucugccucagccuccggaguagcugggauuacaggcgugcgccaccaugcccagcuaauuuuuguauuauuaguagagaugggguuucaccaugcuggccaggcuggucucaaacuucugaccucgugauccgccugcguaggccucccaaagcgcggggauuacaggugugagccaccacgcccagcugagauuuuuaaucauguguacacauuucaccauucagaaaagauuuuuuguuuuuuuuguuuuuuuugagauggagucucgcucuguugcccaggcuggaaugcaguggcccuaucuaggcucacugcaagcuccgccucccagguucacaccauucuccugccucagccucccaagaagcugggacuacaggcgcccaccagcauaccuggcuaauuuuuuuuuguauuuuuuaguagagacaggguuuuacuauguuagccaggauggucucgaucuccugaccucaugaucugcccaccuuggccucccaaagugcugggauuacaggcgugagccaccucacccggccuuuuuuuauuuucuugagacagucuugcucugucaacaaggcuggagugcaguggugcaaucucggcucacugcaaccuccgccucccugguucaagcgauucuccugccucagccucccaaguagcugggauuacagucacgugccaccacgcccagcuaauuuuuguauuuuuaguagagacgggauuuccccauguuggccacgauggucucgaucuccugaccucgugauccgcccgccucagccucccaaagcgcugggacuacaggcaugcgucaccacacucggccucagaaaauauucuaucuaguucauaccaauacagucuaccuaaugccagagccauggaaaacugggccuggcggcuacuugggccuggccuccagccuccugagcacugguguccuguggccucugcacagcgguucccuccacuggaacgcucuucccucuccuggaucgcccagggcacuccuacccagcccucaaggcccugcuccaaucacuagaguccuuccugugcucagaagccccugccaggugcccagucucuguccacccacaaucccugcaccagagcccugugggccucaccuuuuugucccauugcugaugcagguagcgcaggaggauguuugucuuuucugucacgaugacuaaggaggaaagauagagaaagucgcagacgccuccccuccccaggcuccuccccugacacugcccugggaggucuuuuuggggcuggaacucaguacccccaacuccagagaucuccaaaagucccauguuuuugcuucugagcacacucgcagcuacucccagaggccugagccagcugcuuucagggucccggcucccugcaagggauuccacccuuggugggggaccaagccccgcaacugagacucucaugccuauguuucucccaggcugacuaggagcacauaccgcauaucugugcccagugaccacacagucccaccccacaggcuccagauggauaaaugcuuuaagagcagggucucacucuugucacccaggcuggaauaaucauagcucacugcagccuggagcuccugggcucaacugauuuucccaccugggacuauagaugcaugccaccacgcccggcuaauauauauauauauauauauauauaugcacacacacacacacacacguauguauauauauaguguguauauauauacguguguauauauauagcguauauauauagcguguauauauauacguguguauauauauagcguguauauauauacacguguguauauauauaguguguguauauacacguguguguauauacacguguguguauauacacguguguguguauacacguguguguauauacacguguguauacacguguguguauacacguguguguauauacacguguguauauauacguguguguauauauauguguguauauauacguguguguauauauauguguguauauauacguauauauaugguuuuuggugaaacagggucuaacuauguugcucaggcuggucucgaacuccuggccucaagcaauccuccugccucagccucccaaagugcugggauuacaggcgggagcuaccccaccugguguggagucuuuuugaacaguuaaacuaagacagcaagaccaaguccuccugugcugugggccccuuugccuggacccccuucccaucacugccacccaggcuuggcuggauccccagcccaagccccuguagcccucugcugccucucugcccgauagcacuugucuuagaaccagaguucucgcuugaccucaucugacagggaggggaaaggaccagugaguggcagaugagggacaacuugggggccccuuugggcuggcuguggaucccagugugucccaaucaagagacaccuggggaaagccagguuucuggcuguccccaggggcugggaguggacaggcauccacgugugcauccccaggcugaagcccccaaggucccccuccuguaccucccuggaggcccucccugacuuaacuggauucaguagacagcgugugaacccaagccaagucuauggccugggccgggguugaagauaaccuccgcgugccacgcugcagucaccaaaccccgccccucagcagccagaaugggacagacugacagcggccacuuacucuguucagacggguacucgcggguaggcagguagacugagggccgucgguucugcaggaggguugagaagggguggguuaggagagugcaugggccuggggucuccucaucccuccacucagcacccacccuucagugcagauuggaagacacucaaguauguggauggggcugggcuugaagaucagccucuguuccagccaagaccccaaucgggggacacaagcugcccccaggcccccuggaagugaccaauuccucccagucccaggaacacgcacucaccgaggcuuugcacacggaguccgcgugaaaucgacuaaaauugcuuuuguuguagacaggcaguccuuucaaaaaaucugccuagaagacaugg

SEQ ID NO: 15648 - RNA, 937 nt, Homo sapiens
aaaaacauguacuugcauguaggacaacucaguuagaaaaguauagugaauggauggaaucuacuguaugauaaaaaugcuacaaacaccauuuaguugccaucaauaagaaauuuacuuguuuuaaaaaaauccaaaugcuggcauuguccagaaaaauuuaacagguuuauuuauaauuauuauaaaguugaaccgcugaaacuuguucacugaaacauuuuaacuugcauuaaugcuuuacgucuccgcauuuauauuaaaaauucacacacaaaugaaaauggaaaaacugccaauaccugauuucuguccccuauuuuuccacucgcaaucauauacuuagguaccuuuugaccccauggaaaaaaaauaucuaacguucagaacuaccaauaacaggaagaagagaaauuuuuuuuuuuuuuuugagaaugaaauguuucccaucauaguggauucuuaagcacguucuccacguaugcggcgugcuagcuggaugucuuuuggcauaauuguuacacguuuggcauggauagcacacagguuggugucuucaaaaaggccaaccagauaggccucacuugccuccugcaaagcaccgauagcugcgcucuggaagcgcagaucuguuuuaaaguccugagcaauuucucgcaccagacgcuggaagggaaguuugcgaaucagaaguucaguggacuucugauaacgucuaauuucacggagcgccacaguaccaggccuguaacgaugagguuucuucaccccuccaguagagggcgcacucuugcgagcggcuuuuguagccaguugcuuccugggugcuuuaccaccggucgauuugcgggcagucugcuuuguacgagccaugguacagagaccuccuuacuuaccccccuucuccuucggcuggagcucggcgagcgagaggcgg

SEQ ID NO: 15649 - RNA, 41059 nt, Homo sapiens
ccgggggcggagcccgccggcagccgcgccgcagccgcggagggaggggcggggcgggcuccggugucagcgaccaagccgcagguggcggcgagcgcggggcucggcccgagcucaggaggugaguguugccccccggaacccccugggauacccuggcccgcgcagccucccacgcgcaccgugcccugcagccccggcggcugcggagggcaaaggcgcggcgggacgcgagggauggagagcaggggguuggggcuacgcggugggcgccccggcuucccccuccaagugguaauuggggguccgcaggcgaaaauggggaccgcuccccaaaucccccgucuccuggccuagaaccgagcgugcacgggggcggcgacgacgcgagaccccuccccaaauucuuuuauucuaagccuaggucuggguucuggggcugcaaagaugggggcgccgcuccccuuccagccuggaacccugggcgguggcugagauggggaccacccgcagauucccucuucccagcuccggccugcagaccaccggggaccgagacgagggaccccuucccuuuuccuccacugugaaccccuauccaggccugguggcuggaggagcuggggugucaccuggccccuccucuaaucugccccaucccaguccuccaccuuaaggaugggguggggggcguuucacuggcaucuucuguggggaccccaagguuggaauuuuggggaggaggucacugugggguccccugccuggcacgguuuauccaggccaggccuugaagggccuggagccuggacuuggggggggggucccucuuuuacugaggggcgggguguacagcuagcaucuguuucuggggauuaaaauaaaucgagguaaauuaggaucuugccagaggcuggcugugaguggggugcggaggaggcuuggggggugggggaccccuccaucugccuuggaucccccgagucaccugccccagcugcacuggggaccaggaggcagugucgaauggaccugcuucacuggugaccuugggcaggugacagcaccuuucugaaccucgguuuccucuuuugaaaauugagguugggagcuucggacccugcauuuuacagauucugaacucacccagcccacauuuuguccaauggugauucacucuuuugcuuaacaugugggugguuuggggucaagacagcauuggguuuggagacccucccacagugccuugcuauccucucagccucaguuuacugcacugcaaaauggguugaugaugacacucugauauuggggcugagggcauggggacagggaguaaaacauaggaccaagcugcaauggcugggauggggcaucgccacccuggucucaccauuggggccacuuagggcacacccugacccacauaccaucacccacgccaggggugaaccuguucucgggcgagguccugggcaggagggggugggaguugccaggccagcucauucccugucccuuggagcgcccucccaguggugggcauggggcugggagucugacacccccagguuugaauuugccucuaccuguguguguguuuuucccuuggugccuuuguuuguucuucugugaaaugggcugaauuccucugggaagaugggaggagucugugggaggaggaagcucuguaaauacagacaugauuauuauaauauuaaugacaguauuagugcucuuuaaaucgggucacagcugaccaggaggagggaggggaagggggagucuaucaaaggcauugccugaggagacuccagcaccugggaaaguuggguacacaguaggcauucaauagauguuugccaaaugaagugaggaagagggaggggacccauggggaggacagaaaauuucugagaaucccuggcucagauucccacuugguggcccgagucacugugugaccuggggcacgugucucaguuuccccaucguggugcugguugagauaagauacugccuugagguguggugacgagaaucaagccagauugucugugaucgcagcccagguggcgaggccaagaggggagacaugacauagugggucauugaaacagcaugguaccugcuugaaccaagugacugguccgugggaaggaugagaaaacccuugcuacuggcccuacuguacauacacugggguccaagagagagggaaaugugagauccuguuucccaggauccuggaagccagaucguggaaggucaggaguggcccaaggucaucaggcaagacgucagcggcuccggacacccagccaggcaccacucgauucccaggaugggagcucgggucuugccuuuguugcugaugugguuccugcuuuguuuuaucuguucuggggcugcucacaugucucagccccagguuugcaagacuuggugccgggaaggcaggauggggaccucugagucagcuggcaaugugcuguguaaccuugggcaagucuccggccaucucugggcuuugugcugguacuguacaggcugggagacuuggguucuagcagggcugacuucuccaucagacccaaaaugcccagugucucaggcucacagugcuuuuaggggucccuagguugauguuuucacuucuuuuaaaauccaaagggaaaaaaaugaacucuuggguugaaggaaacauuuuuguguauaauauuaauauauuugucuuuaugucaauguaguuguaaaauacaguuuuguuuuguuuuguuuuugagacagagucucucucugucacccaggcuggagugcaguggcucgaucuccgcucacugcaaccuccaucuccuggguucaagcgauucuccugccucagccucccgaguagcugggauuacaggcauaugccaccccacccagcuaacuuuuguauuuuuaguagagacgggguuuuaccauguugcccaggcuguucucgcacuccugggcucaagcaauccaccugccucggccucccaaagugcugggauuccaggcaucagccaccaccuaaaauauaauuuuaaauuucuuuuguagugaaggaaagcgcucaugaaugcaaaaaugucuuccccuuucuuuucuuuuuuuuuuuuuuuugagauggagucucgcucugucgccaggcuggagugcaguggcgcaaucucggcucacugcaaccucuggcucacugcaaccuccaccucccggguucaagugauucuccugccucagccuccugaguagcugggacuacaggcaugggccaccacgcccagcuaauuuuuguauuuuuaguagagacgggguuucaccguguuggccaggauagugucaaccucuugaccucgugauccacccaccuuggccucucaaagugcugggauuacaggcgugagccaccgcgccuggccaugucuuccccuuucugagcgcauuucccucucugagccucaguuugcccagucugugaaguggguaucggccuaccucaggauggcaagauguugaaugccugggccaggguuggugcucaguuauuucccaauugccaugauuaauauuuguucgguaagaacagcuccagguucaggccggggggcuccagguucaagcgccucuuguuuacucacccauggccugugugguuccagggaggucccaugggugcugaucgggcgggggaggaaagguggcgguuggaugguaggcggggcggggugagcuuccugucccccccccaacccaugcacacaagccuccaacuuggugcugacggaaguggccucguggcugucuccuggcgccugccccgucagacaggggccccaucccacucgcuacccuguccggugaguuugagcccuggccaguagauacccaucaucucgccuuggccccccucaggaacagaggggaggccccccugcccggagccuggguuucaggagaaguagcaggugucacuuccugggcuggccaaagccugcauggggccacccguugcccugccccccgucccccauuccagcugugaguggugguuuggguuaggggggcggcaaggggagcuuggaaacccagagagccacgcgugaugguuucaaacaggaggucauuggcagacagaccaggggcaaaaucacagucagccgggaccaaugauugaucucucugugccucgguuuccuucauaaaguugggguugccucugagggcauggcaugaagauuggaugagcagaugcgugugaauaguuggguacagggucgcacacauacuggugcuccauguguaucugucugccagagguggggugaggcaaucuaauugaaacugugaaaacaguagugagauucuugguuucuggggaacuugggcuccuugguuccugggaucuucuagaacaauguuggccauccaauacagcagccaucagccccauguagcuacugagccuuggaagagaggcuggcacagcugaggagcugggcauauaauuguauguauguauguauguauguauguauguauuuaauuauuauuuuuuuaagacagaaucucacucuuucaaccagguuggagugcaguggggcaaucuuggcucacuacaaccuccgccucccagguucaagugauucuccugccucauccucccaaguagcugggacuacaggugugugccaccacgcccugcugauuuuuauauuuuuugguagagaugggguuucaccauguuggccaggcaggucucgaacuccugaccucaagugauccacccaccucggccucccaaagugcugggauuacaggcgugagccacugcgcccagccaauuguauuuaauuuuacuugguuuaacauuaauacaaaaauuaauacaaaaauuaaggccagggguuguggcucauggcuguaaucccagcacuuugggggucccaggcaggaggauggcuugagcucaggaguucgagacuggccugggccacacuagugagaccuagucucuacaaaaaaaaaaaaaaaaauuuauuuuuaauuaguuagacauguagucccagcuacucggguggcugagaugggaggaucacuugagccugggaagucgaggcugccaugagcugugaucaugccacugcacacuccagccugggugacagagcaagaaccugucuccagaaaaaauaaaaaaauaaaaaaaacuuaauacaaaaauuauucaggcgugagccuguagucucagcuacucgggaggcuacuauucaaggcucccuugagccugggagguggaggcugcagugagcuaugaucgcaccacugcacuccagccugggcaacagagcgagacccugucuccaaaaaaaaaaaaaauuaagucaccacauggggcuagugguucccaugccagucagcacagcucuaagagauuuggagaugcuuaggguccuggucauggacagaagcuaagaaaugauauggaaauuuagggcuuuuccccuagggaugucaguguagcaugcucaccacccuaccccugccaccaaacuagguuuccuaagggggugugguggggacugaaguuuuucaggggcccugucauuaaccagugcaggguugggaauguuuguugaaacaaauaauuccuugcccagugaacuccuauucaugcuuuaaaaccccaacucccaugagcccuccuuuaguccagguucuuuuggaccuugucccuccaucuggcccagcccugaccaugcaggacggugauaucuguguccagcucugucucucuagacuggggacuccugcagggccaggcccgaggcugaaucaacucagggacccugacauuguucuagucugggugagcaaguaggaggucuugggugacucacagaagucccgggauuggaggcucaaugauaauggguccaauuaaacuaacuaacuuucuuucuuuuugagacagggucuuacucugucgcccaggcuggagugcaguggcgccaucucagcucacugcaaccuccgccucccagguucaagcgauucuccugucucagccucccaaguagcugggauuacaggugcccgccaccacaccuggcuaauuuuuguauuuuuaauagagacaggguuucaccacuuuggccaggcuggucucaaacuccugaccucaagugaucugcccgccucggucccccaaagugcugggauuacaggcgugagccaccacuucuagccuaaacuaacuuucaagauuagguaaacugaggcacagagaggggcagccuugcccaaggucuugcucaguccuuuccuggggaggccccgggagcuuccccauccuguggucacgggucccugucacuccugccacuguuccuacgaggcucccagcugcuaccgagcugccuguggggucaugaauuaugcaugaggccugcaggcuccagugacaagccuggccucuagaacaugccaaggacacugccuguccguccccugccgggcggccugacccagccucuugugcagagacaccuggggcuccccggcaagaucccuucuaagcauuccuucuuauuuugcagauggggaaacugaggcacggagcuggacagugacucagacaccaggugaacacuggcuuuugagggcaggguugggacucgugggggcagcaaugccagcugggucaucacagugaggagugagcucugacucccaggaggguacauaaggugaggacuguccuagaggaaucagaagaucccaggggacccucagggauacuucagggaccccaacccccauguggcugaucacagccccugcaucuauuucucuucaaacccuuuuccugcaggagcugccuggaguggagcugagagcucaggucugggcucagccaguccagagugcaaaucuacugucccuuccuagcugugugaucuuggcaagugacuuccccucugggggaggggagggcucaguuuucccaucugugaaguggaucagagcuuuccugucaagguuaggggucauccagcacugcuccuacccacugcuaugaacucuuauacaugccuaaaaaccccacauuccaugcccccuccuccaaucuagacucccucagcucuugucccuccaccuaguccaguucugacucuguggaauugggggcaucugugucuuguucugucccccucuacuggagcuacuugggaccagcacuggggcugaauuaucucagggguccuggcaugcucuuagcauuggagcuuucaguuccuccuucauccuuucucuccuuccucuacagggagggacuuuccccccaccaagcccacacuggcaaugacucuguagcucaaacuugccucucucuucagacaggcacuggacggggccugcaggggucuccacagagaccaucaggaugucguauuuuggggagcauuuuuggguaagacccacucuuauuuaggcgggggaugcuggcagggcuguggggacuuuuauggagaugggaggacugggugaguugcgguuacagccuuggacagguagaggaucugcaagggauggaaguuaaagugggaagagucaggcuggguuugaauccacacccaccccagaccucacaggccuuacaaccuugggcaagucauagcuugugucauagggagaccaagggccagagugggaacgucuaggcaaccugaaguugccccaugaaaaagugcagagucagugcucaaacccagggccaaacugaacuuccaggacccagggucauuccagccagggaacuuccacccccuucccauccuggagaauugggggguuuuccugaccuggcgucucauggccugugcaccccuccacuguccaggcuggagaucaccuccuguagcccaagggcugcugagugagacagaguuguuuuuauucauucauuuccucucucccugccacugugaccucauccccagccagcccuaggagaugcuggggucuccaagagaauccaucccagccccagccccaagggaggaguccccagucugggggacccagagccagcuuagacaccuucagcccugcaggaccagggcugaacccagccuuggggguccuagaguaggaaccaggacacagaaucguguuugcugugagaaagccugggcaaaagaccagagaugugacauugaguggcaaguucagggaacagggacuccuccugcagagccaggcuaacagggugccacagaggaugggugaacaggggagggcccaggagucagggaaggaccaggucagaaagccccuuccccaguugcaggcccugagcuugcagugaggaagccuguugcuaggcgacugguugccccuggcaacaagccccacuccugcccuugcucccuccccagcuggggcuccucuugaaagcacuugcuuucuuaaaggggccgcacucccuugccaccugcaggggugugaccuccgcccucucuccaaaggucagacuccccgauuugccccugaaaggcugugugacuccagugaggggcuaccccuuucugagcuccuuuuaguacugccguguaauggaggugaccauuugaggaucaaaagucaccugcauuuuggaaccccgacaguggcaccuacauuuauuuuaaauccuuuuuaauugugugaggcgugcaggcucgcugcagaaaauucagaucagcaaagagaaaauagaaaccacccccgacuuccccaccucacccaaagauauccugguagagaaugguuaagagcuuugaguucaggauucgaauugacucugcuggaagcccuugagcaaaugacuuugccugcccgaaccucuguuuccccaucugggaaaaagggaugaaauuccugcaccgccacucccaccccaugcaccccacacacccccagacucagggaggccuccugugacaucugucaucaguugcuaguauugaagccgccauagaagccugguucuuugcuggguggugcuggggagauuaagccaaacagggaugccccagucucauugcgccagggcagggccgaagcaugaaguguacuagggagccaugggggaagugugagcaggagagggacauaaacaagcucuguuacaaagaccacacucuuggcugggcgcaguggcucaugccuguaaucccagcacuuugggaggccgagggaggcggaucaccugaggucaggaauuggagaccagccuggccaacauggcaagaccccaucucuacuaaaaauacaaaaauuagccgggcauaguagcaugagccuguagucccagcuacucgagaggcuaaggcaggagaauugcuugaacccgggagguggaagucgcagugagaucgcgccacugcacuccagccugggugauggagugagacuccgucuaaaaaaaaaaaaaaaaaaaaaagaccacauuuuggcuggcacagaggccaagucugaagucuagaaguucuggugggagagacagaccugagacagccccuccuaggacccucggcugccagcccaguccaagagaggcagacgcugcuggggguuugccaggucugggaaacgggccagcaguuggcucugagucagacccagaugcugcucugggcgguggugccuggugcagccucacccgaggaucuccuggggccagcacugugccagccucaucccagcaagacccuugggaguugggugcuguuguuguccccauuugucacacaaggaaggaaacugaggccagagagacgaagucaccaacccaaagugacccuguacguauaaggagauuggacacuugaacuuugaaaauauaauuccaaacacaagaagagaaaauauagguggagcgugguagcucacgucuguaauccaaacacuuugagaagcugagauggcggaucgccugagcccaggacuuugagaccagccugggcaacauagcaagaccccgucucuacuaaaaauacaaaaaauuagcugggugugguggcgcgcaccuguggucccagcuacuugggaggcugaggugggaggaucgcuugagccugggaggcagagguuucagugagccaagaucauaccacuggacuccagccugggcgacagagcaagacccugucucaaaaaaaaaaaaaaaaaaaagccgggugcgguggcucacaccuguaaucccagcauuugggaggccgaggcaggcggaucacaaggucaggagaucgagaccauccuggcuaacacagugaaaccccgucucuacuaaaaauacaaaaaauuagccggguaugguggcgggcaccuguagucccagcuauugaggaggcugaggcaggagaauggcgugaacccaggagacagagcuugcagugagccaagaucgcaucacugcacuccaaccugggugacagagugagacuccgucucaaaaaaaaaaaagagaaaacguauuccuggcgagcuggagggagcaacagugaagugggggaggggguugagcaggguuagggaaguuucuagagcagguggcaaugauccuugggaaguggaaggauguggauggguggaaggagaugcaagcuggagagcugauggcgggaauagccuggacaaaauguggugguggaaaggcacugccugucuuugcuauuugcuguuuugugggugaggcuaggaagaagcuaggagaugaggcuggagcagcaauuccaggccauggacuuggacuucagcaucuggugggcaauagggacccauugaugauucuagaaugaagugugaccauugggagauuugggcuugaggcugaccugggucugccccagucuuggcuucggugucuccauuggugcagcaggaaacguuaccuagcagugacuucuggcuuuaaccuucaggcuucuggccaaguguggugacucacgccuguaaucucagcacuuugggaggcugagaugggaggauugcuugaguccaggaguucgagaccaaccuugguaacauaguaaggccguaucucuacuaaaaauaaaaaaaacuagccaggccuggugucacauggcugugguuccagcuacuugggaggcuggggugggaggaucucuugagcccaggaauuugaggcugcagugagccaugauugugccgcugcacuccagcuggggagacagagcgagacccugucucaaacauagaaaaauauguauaacauucaagcuuccggguaccugggagggugaaccugguagguuggaggagggcacaggaaacuaccauuuauggaaaacccgccaaaugcugccagagggauggcuucacugauguguguugggacuuaaauggcaucagaucccuccacaagccuucucuuccaguguuauuauaagaccugauuuggugcuaaaauguccccaguucccucagaccccagcugauuaccuuuuuuuuuuuuuugagacagagucuugcucugucagccaggcuggagugcaguggcgggaucucagcucacugcaaccucugccucccugcuucaagcaauucucccgccucagccucccgaguacuugggacuacaggcgcccacugccacgucuggcuaauuuuuguaucuuuaguagagacgggguuucaccauguuggccagucuggucuugaacucuugaccucgagugauuugcccgccucagccuccugaagugcugggauuacacgcaugagacaccacacccaucuagucauugauuuuaaaguuguaauggugaguuuuaaguccaaaucuaaagguguccaauuccaacagcgggcgcagaggaccaggucuccaagggguggagagaagcgggaucagaagguguguaugaggccgggcguggugguucacgccuguaaucccagcacuuugggaggccgaggcaggcagaucaguugaggucaggaguucaagaccagcuugaccaacauggugaaacccugucuauacuaaaaauacaaaaaucagccaggugugguggcacacgccuguuaaaaaaaaaauccucauguuuaaucuauauuggucuugcuuuuagccuuuuccucaguucuauucauauuguuuauuauuuuuuguuuucuguagauggucauauaaucuggucucaauuauuuuucuuaccuuacugcauuugccaacaccucuacaucagcauuaaauauuagccaugauuugaggcauuccugccucauccugaaauauguugugucuccuguuuugccaucuuuuuuuuuuuuuuugcauugggggacagagucuugcuaugucacccaggcuggagugcaauggcacgaucucagcucacuacaaccucugccucccggguucaagcgauucuccugccucagccuccgaauagcugggguuauaggcaugugccaccacgccuggcuaauuuuuguauuuuuaguagagacgggguuucaccauguuggccagucuggucucgaacuccugaccucagauaaucugccugccucggcuucccaaagugcugggacuacaggugugaggcaccgcgcccggccugauuaccauuuuuaauggacagcuuaguaguguucaggcaugaugcccuucccaggugacagaaucuggccggcguuaagauauaguuguugccucauuuuuuccuacuccuuucaugcggcagagggucccaauuuuccauugagaguggcagaaaaaguugcccuuuaacauaaaugucuuuggggaagaagcauaagcaaauuuaaaacaaaugcuaacuauuaauaacuaauguuacgaauuagcaaaaacuagaguggccuuuggggcuuuggggagcauugacauggauuaucuugcugcuuguaucaucuccauguaagaggcagaugucucccaggcuguaguguagugacaugauuuuggcucauuguaaccuccgccucccggguucaagugauucuccugccucagcuuccugaguagcugggauuacaggcaccugccaccaugcuuggcuaauuuugcauuuuuaguaaacacgggguuucaccauuuuggccaggcuggucucgaacucaagaccucaagugaucugccugccucagccucccaaagugcugggauuacaggggugagccaccgcgccuaaccucccugccccaucuuaaugaggagcuccuaaaagcucagagggggcagugacuugccugggucacacagugcagcccuggccucccccaccaugacaaccccagaaauuggaguaaagagauuuugugaaggcauucgcaggcaccaggguagaaauacucaguucccaguggcacuaacagguaacagcagaaucauuuguuuauuuauucaacgaacucaaaugcccuuucugucucucauucugugcugggcuuugguggguccugggagagaacucaaaccuggacccuaauuuggguucucauaggcggaauuuccauguugacaagaacagaaaacacaacuacagugacuuaagcaacggggacuguauuggcuuauaagaucaaaugauuaugggggaauguggcuuucaggguugguuugauccagcaacucaauuuaacacacuuuuuuuuuuuuguagcuaguauaaaugggaucacuuucuugauuucuuuucagcuauauuuuauuaaugguguauagaaacgcuacugauuuucauguugauauuuguauuuugcaauuuaacugaauuuguuuaucaguucuaggaguuuuuuggugguguguuuaggccuuccuauacauaaguucauguugcaaagagagacaauuugacuucuuuucauguauauacauauauauauauauauauauacacacacacuucccccccgcccugagacggagucuuccucuguugcccagagcuggagugcaauggcgugaucucggcucacugcaaccucugccucccacguucaagcaauucuccugccucggccucccaaguagcugggauuacaggggugcgccaccaugccuggcuaauuuuuguauuuuuaguagagacaggguuucuccaugcuggccaggcugaucccaaacuccugaccucaugguccgcccgccucagccucccaaggugcuaggauuacaggcgugacccacuccaauuuauuuuuauuuuuauuucauucauucauucauucauucauucauuuauuuugagacagucuugcucugauacccaggcuggagugcagugguaggaucucagcucacugcaaccucugccuccugggcucaagcaauccuccugccucagucucccaaguagcugggauuacaggcacgcgccaccacgccuggcuaauuuuuguauuuuuaguagagacggaguuuugccauguuggccaggcuggucucgaacuccugaccucaagugaaccacccaccuuggcuucucaaaguguugggauuacgggcgugagccaccgugcccagcucaacacacuuuuuuuuuuuuuuaaauauaaaagcccucugguucagcuucuuucuaagguucacgguuuccauuugacuuccaguauccccuguggccacauaauuccucauuuauggaaagacacaaagagaaaaggggaggagacugagacagaaacggcagagagacucagaaaaacggagagaaagacagagacacaaagacagaaggagacaaagacacagaacaaaugagauuccuccccagcaacuauaggacaaaaagaaaaucccaggcuucucucugauuggacaaauuuaagguccauagacaaucccuauggcccaggggaaaugcagcaagcugauucgcucaggcccgaacaagucccuacagccaaggggauggacuucugcuccuuggccacgcccccguugcuaagcaacuaugauguucucuccauccuuucucaaucucuauucccauccccugcagggcgagaaaaaucauggcuuugagguccuguaccacagcgugaagcaggggcccaucuccaccaaggagcuggcggacuucauccgggagaggugagguccccaagccccauccaccagaggccacgcccaccauccuguagucacgcccaccuaauggcuacgcccugcauggucaggggcuagaacccuggggauuccaggaaccagaggggcucgaaaauccuggaaaugaccgauucucaacccggucaggcccauaucuccuuuuaaacaacaaucaccugauuucgaaagcuccccuccucaaaagaggaugauauaaccuacucaagguuggaauuuuuuuuuuuggagacaagaucuugcuuuguugcccaggcuagagugcagugacccaaucauagcucacugcagccucgaacuccugaguucaagagauccuccuaccucagcucccgaguagcugggacuauaggcauguaccaccacaucuggcuuuuuuuuuuuuuuuuuuuuuuaaacagaguuuugcucuuguugcccaggcuagagugcaauggugcagucucggcucacuguaaccucugccucccggguuccagcaauucuccugccucagccucccaaguagcugagacuacaggugccugccaccacgucuggcuaauuuuuuuauuuuuaguagagacgagguuucacuauguuggccaggcgggucucaaacuccugaccucaggcgauccgcccgccucagccuccaaaagugguggaauuacagauguaagccacugcacucugccuuuuuuuuuuuuuuucuuuuuggagacagagucucacuuuguugcccagggugaucugaucauagcucacugcagccucgaccuaccgggcccaagcgauccucccaccucaggauccugaguagcugggacuacaggcaugcaccaccacaccuaucuaaguuaaaaaaaauuuuuuuuguagagaaggagucucauuauauugcccaggguggucucgaaccccuggguuccagugauccuccugccucggccucccaaagugcugggauuacaggcaugagucaccaugcccagccuacuacuguuguuaauaaaauauauuacguaagaaaaaaucuucuaugaauuuucaaaacaucccucagaguguugugucauccccccauuauggaaagccacugcuaagguguuugagauggggaaacugaggcccagaggagcagugccucucucaagggugucugaaagcuucuucaucuuuuuuuuuuuuugcgauggagucuugcuuugucacccaagcuggagugcaguggcacgaucucagcucaccgcaaccuccaccuccuagguucaagcgauuuucaugccucaacuuccccaguagcugggaauuacaggcaugcaccaccacaccuggcuaauuuuuguauuuuuaguagagacaggguuucaccaaguuggccaggcuggucuugaacuccuaaccucaggugauccguccgccucggccucccagagugcugggauuacaggcgugaaccacugcgcccgggcaguuucuccaucuuuaccucauucuccuccccagggccaccaucgaggagaccuacucgaaggcgauggcgaaacucuccaagcuggccagcaacgggacccccauggggugagugggguaggggucaccaacauggggacauugggagccuccuccuugguggacaucucuucacacucggugcauguagaauagagugucauccaccucgauuauggggcuauuuggauagagggauguauaucauucauucacacacuagcucauucauucauuccacaaauauuuuuugagugccuucugugugccaagcaccagcagcaacccagacagauaaaaccccagccaccuucaugcaauguacaucugggcugugugagaagagagauguuaaauacaaacaaaaacauuuuuuuucugaggugaaaagugcugggaagggggccaggugcgguggcucaugccuguacucccagcacuuugggaggcugaagugggcggaucaccggaggucaggaguucaagaccagccugggcaacauggugaaacuccucucuacuaaaaauacaaaauuagucgagugugguggcgggugccuguaaucccagcuacucaggaggcugagucaggagaaucgcuugaacccaggaggcggagguugcagugagccgagauugugccacugcacuccagccugggcaauaagagcgaaaacucuguuuugaaaaaaaaaaaaaaaaaagugcugggaagggaaugagauaggagugugagagaucgggcacuuucucuggggugggcccgaccucccugaacugagaccuuaauagaaaggggcaggccauggggaugucugagggacagagacccgggcaaguggcucagccagugcgaaggcccugaguugacaggcguggcauguuuacggaagagugaggaggcuggccuggcugcagggcuugggcaacguggaaaggaaguaggaggggagauggcagggugaggccucaggggccugacacacaaaugacuuugcaugaaccuugugcccgggcgcgguggcucaagccuuuaaucccagcauuuugggaagcugaggugggaggaucacuugaggccaaaaguucgagaccagccugggcaacauggagaaaccccugucucuacuaaaaaugcaaaaauuagccgggcaugguggcaugugccugcagucccagcuauuuaggaggcugaggcaggaggauggcuugaacccaggugauggaggcugcagugagccaugauuguaccacugcacuucagccugggugacagagccagaccaugccucaaaaaaaaacaaaaauaaaaacaaaacacauaauguggucccccgauggcauuugcaguuuucuuuguggcugcuaugaggcaaaaguucuguggggcaggcagaaguggaggcagcaggaggagaagguggagggaggcuggauggggcuucugcugaguggggcaggccaaauugacucgauuggggcauguggugucuuagucacucuuuuuuuuuuuuuuuuuuuuuuuugagacagagucucacucugucgcccaggcuggagugcaguggcgcgaucuuggcucacugcaagcuccgccuccuggguucacgccauucuccugccucagccucccgaguagcugggacuacaggugcccaccaccacgcccggcuaauuuuuuguauuuuuaguagagacgggguuucaccauguuagccaggaugcucucucaaucuccugaccuugugaucugcccaccucagccucccaaagugcugggauuacaggcgugaaccauuuuuuuuuuuuuuuuugagauggagucucgcugugucacccaggcuggagugcaguggugugaucucggcucgcugcaagcuccaccucccggguucaagcgauucuucugccacacccagcuaauuuuuguauuuuaaguacagacggggguuucaccauguugcucaggcuggucuggaacuccugaccucaagugaccugcucgacucggucucccaaagugcugggauuaccagggccugcguuuaaauuccagcucuaauguugauuuguugaggggccuugggaggagcuauagagcucccuaugccucaguuuccccaucugucacaggcccgccucuuacagcugccauggagauuauaugaauuaguauucauucauguuuagcagggcucagcgugcagcacauaccugagccagugccagcgcugucccgggguggggugagccugaugaacccugggugugaccuugcccgcccccaggaccuucgccccgcucugggaggucuuccgcgucuccucggacaagcuggcgcugugccaccuggaacugacacggaaguuacaggaucucaucaaggacguucuccgcuacggcgaggaacagcucaagacccacaagaaggugugugucgugggcgccgcccagcggcuggguggguguggaacaccggcagcucacaggaccccagaucuucuggggcuuuauaaccugcggauguccgccuccgagaauuccguuaauuccacaacgucaagcccagggucuuacggaccugagcguuguugaauuucaaacuugcaaaauuccagaccaggaguuagcacacuguggcccacgggccaaaucccgcccaccccccaccaauguuuguacagcuaagaaggguuuuuuuuuuuucugcuuguuuguuuuuaagagacagggucucacucugucacccacaugcaguggcgugaucagagcucccugcagccucaaacacuugggcucaagcgaaccuccugccucagcccccacagaauagcugggacuacguugcacgccaccaugccuggcuaauuuuuaaaaaauguuugggccuggcguagugacucaugccuauaaucccagcacuuugggaggcugaggcaggaggauggcuggagcccaggauccuacaggaguuugagaccagccugggcaacauagggagaccccaucuuuaccaaaaaaaaaaaaacacccaaaacuacccaggcaugauggcacaugccgguagucccagcuacucaggaggcugaggugggaggaucacuugagcaugggaggucgaggcugcagugagccaugaucaugccacugcacuccagccuaggcaacagagaaagacugucuaaaaaaaaaaaaaaaaaaaacaagagagagagauggguuaucacugguuuuuacauuauuaaaggguuagaaaaaaaucuaaagaaaaauaaaauuucaccacaugugaaaauuguaugacagucacauaucagugccaguaaauaaaguuuuauuggcacagagccaugcccauugaugugccugucaucuguggcuguuuggcacugcagcgacagauucaaguguuuguaucaagccaaacacauuugcuaucugucccuuuacagaaaacauuugccaacagcuguucuaaagcauuggaaguuacagauauucauauuuacuauuuuuacacucuuauaaaccuagaaucagaagaaccaucuuagacucuuagaauuccacaauauccaaagcuuauaauuguagaaucauagaugcauugucuuuacagaguuccaaaaucugcauguuuuuaugucuuguuuaaaaaggggguugguaauacuuuguuuuuguuuuguuuuguuuuguuuuuuugagauggagacuugcucuguugcccaggcuggagugcagugugcacaaucucagcucacugcaaucuccaucucuuggguucaagcaauucuccugccucagccucccagguaguugggauuacaggugugcuggugcacgccuggcuaauuuuuuguauuuuuaguagagacaguguuucaccauguuggccaggcuggucuugaauuccugaccucaggugaucugcccgccucagccuuccaaaguguugggauuacaggugugagccaccgcgccuggcuuugcugauuuuuaaauuuuuuguauagaagggaucuugcuagccaggagcgauggcucaugccuguaaucccagcacuuugggaaguugaggcaggcauaucacuugaagucaggaguuccagaccagccuggccaacauggugaaacccugucuauacuaaaaacacaaaaauuagccagacgugguggcacacacaccuguaaucccagcuacucaggaggcugagacaggagaaugacuugagccugggagguggagguugcagucaguugagaucgcgacacaccacuccagcccgggcaacagagugagacucugucucaaaaacaaaacaaggcaaaaaaaaaaaaaaggagagagagaagggguccugcuguguugcccaggcuggucaaacaucuaacauaucugccucagccuuccaaaauguuggcauuacaggcaugggucacugugccuggccaggagugaauuuuuaagugguaaaagcaggccaggcguggugugcaugccuguagucccagcuacuugggaggcugagcugaggugugagaauugcuugagccuaagaguuagagaccaguuugggcaacacagugagaccccaucucuuaaaaaaaaaagcugggcacagugacuuaugucuguaaucccagcacuuugggaggcugaggcgggcagaucaccugaagucgggaguucaagaccagccuggccaaaauggugaaacccugucucuacuaaaaauacaaaauuagccgggcaugguggugcaugcuuguaaucccagcuacuugggaggcugaggcaggagaaucgcuuaaacccgggaggcggagguugcagggagcugagauugugccacugcacuccagccugggugaaagagcaagacuccgccucaaaaaaaaaaaaaaaaaaaaggccuggcacgguggcucaagccuguaaucccagcacuuugggaguccgaggcaggcagaucacgaggucaggagaucgagaccauccugacuaacacggugaaaccccgucucuacuaaaaauacaaaagaaaaauuagccgggcgugguggcggcgccuguagucucagcuacucaggaggcugaggcaggagaauggcgugaacccgggaggcggagcuugcagugagccaagaucgcgccacugcacuccagccugggugacacagcgagacuucgucucaaacacacacacacacacacacacacacacacacacacacacacacacacacacaaaacggugaguuaagcaacacagucugccacuguuugucauaaaacuuggguuagaacaagcaucuuuauccauaugcggauuauuucuagagaaguaucacaguaauaauuggggacuucuaggcuggagggcccauauaugggaggcuuuuuccuggcuuaccucuuacaacuuucugaaauaugaaccauguguaaauaguacuuuuuuuuaaaguuaaaaauguuuugaaaugaaaaacguacaggccgggcguaguggcucacaccuguaaucccaacacuuugggaggcugaggcagguggauugcuugaguguaggaguuugagaccagccugggcaacauagcaagaccccauugcuauuaaaacacacacacagaggccgggcgugguggcucacaccuguaaugccagcacuuugggaggccaaggugggcagaucaccugaggucaggaguuagagaccagccuggccaacauggugaaaccccgucuccacuaaaaauacaaaaaauuaucugggugugauggugagcaccuguaaucucagcuacuugggaggcugaggcaggagaauugcuugaaaccgggaggcagagauugcagugagucgagaucgugccacugcacuccagccuggacaacaagagcgaaacucugucuaaaaaaaaccaaaccaaaacacacacacacacauagaaaaagacuguggagcugacaucacguggaguguuugggaggucaggaauuucacagucuacccaugaaauccccuccuaccccgcagugcaaggaggaaguggugagcaccuuggaugcugugcagguacucucgggcgucagccagcuccugcccaagucccgcgagaacuaccugaaccguugcauggaccaggagcggcugcggagggagaguaccagccagaaggagauggacaaggugggcucacaguggggggguucugaggaauuugccgcggggcggaggggcugccugaucagagaguggaaacacaucccagagcgacgguccuggaaccugugggugaucacacccuggguaccccgaggaguucaccugccaggugauggggccugggggaggcccccugaguaucgcccucccauccccguuuccucccugugcuuuguaggcggagacuaaaaccaagaaggcggcagagagccugcggcgcucaguggaaaaauacaacucagcccgagcugacuuugagcagaagaugcuggacucagcccugguaagaaccaggcaucuguaccuuuaagacccacacaugccuuugcccuggagguuauggacugcagaaaucccaggcagggugugguggcucacaccuguaaucccagcacuuugggaggccgaggcgggaggaucaccugaggucaggaguuugagaccagccuggccaacauggcgaaagccugucucuacuaaaaauacaaaauuagccgggcguaguggcaggugccuguaaucccagcuacucaggaggcugaggcgggagaaucacuugaaccagaaggcggagguugcagugagccaagaucgagccauuguacuccagguuaggugauagaguggaacccugucucgaaaaaauaaaauaaauucaagcagauuggaaucugaggauuaggaaucagaacuuuuuucaaguuacaagugauagaagccuucauucaaaccgacagguguauauaaaaaaaaaaaagaaaagaaaagaaaaaggcugggcgcgguggcucaugccuguaaucccagcacuuugggaggccgaggcagguggaucacgaggucaggagaucgagacuauccuggcuaacacggugaaacccccucucuacuaaaaauacaaaaaaauuagccgggcgugguggugggugccuguagucccagcugcucaggaggcugaggccggagaauggcgagaacccaggaggcggagcuugcagugagccgagauugcgccacugcacuccagccugggcgacagagcgagacucugucucaaaaaaauaaaaaauaaaauaaaaaauaaaauuuaaaaaaacugacaagcucagggaacuguaaaguuuuauuuuugaguuguggagguuucagucauagcugaauccaugugcucaaauagugcuggcaggaaauugugaauuucugcuucuuuuauuuuuuugagaugggaucucucugucacucaggcuggagugcaguggcgugaucucagcucacugcaaccuccgccuccugggcucaagugauucuccugccucagccucccuaguaguugggauuacaggcacgugccaccacacccagcuaauuuuuguauuuuuaguagaaacgguuucaccauguugcccagacuggucuugaauuccugaccucagaugauccaccugccuuggccucccaaagugcugggauuacaggcaugauacaccacagcugaccacuauuucugcuucuuaagucuguuuuucucucuggggacaucacucccacacagacauccccuugugugugugugugugugcaugugugugcaagcaugcacaugugugcaucaaacugggcaccagcaacccccacuuacaucccaucagcacauuggcucaggaauggaagugccuuuuccuguagagucaaugaaaguccuagggcagacucucauuggcccuuccccaaaucaaucacugagccaagggcuuaggguauucugauuggucaggcugagucauauggccacuucuucuuggcccugaccuccuuuccaccugccucugcccuccugcuucagcgcuuccaagccauggaggagacacaccugaggcacaugaaggcacugcugggcucauaugcucacucgguggaggacacgcacgugcagauugggcaggugaguugggcaggugugaggaaugaggcuggggucacugcugggcaaaggggccuugaccaguuacacaccccgcccacccggcacaggugcaugaggaauuuaagcagaacaucgagaacgucagcguggagaugcuacucaggaaguuugcagagaguaagggcacaggccgggagaagccuggugagucagggcagccauugggggucgggcuucggggccacagcugcagacaggcaugugccaccaugcccagcuaauuuuuuuuuuauuuuuuuauuuuuaauagagacgagguuucaccauguuggccaggcuggucucgaacucuugaccucaggugaucugccugccucggccucccaaagugcugggauuacaggcgugagccacugcacauggccaggccuugguuucuucaugggaaaaaugggcugcugacaaguccagcucuccagccugaucuuauguguaaaugucuuugaaccagaucccagaggagccuugaaugccaggcuuggcugaucagacuucacccccagggccuaagggagccauugaggguuguugagcaaaagaacaauuugggaaugcgcagaugcaggacugggaaggaguuaagagcaaaaguuuuagagugagacguggguuugagucuuuucuucaucgcuugcugugugaccuaggaccugugcuuugacuucucugagccucaguuuccucaucuguaaagugaggauguaauaauguugcaacauucagugauuucaugcagguaaagggcaaagggugugccaggcacacaguaggcacucacuaaaugcugguauacaguuacguccucaagucuuguuaacuagcaaaaccuguucuuucucccuccugucgcucuggcucaggccuggcucaggucuccccucccugcauggggccccacucuugcccuucacaggccccagaucuguuuuguccuccuccugcucacacaccuuccauggcuccccauuguucuugggagagaguucccacuccuuauccugucacucaaagcccagcccacugcacagacgcaugguccauuccccgacccaacccaaguuccagccacaaaugcuggaaguauguagaaguagcucaugucacccccugcgguggcacugcccugcuggaaccagaccagccccuugguccaucccacuucugaugauguggggcugguucuuguccgggaaccugauggaccuugaguucagauccaggugccauuuuguggccaaaaguguacuacccuuuccaagcgcagucuccccacccucaauuuaguuucuuucucucucucucucucuuuuuuuuuuuuuuuuaauuuuuuugaggcagagucuugcucugucacccaggcuggagugcaguggugcagucucggcucacugcaaccuccgccuccuggguucaagcgauucuccugccucagccuccccaguagcugggauuacaggcgccugccaccauguccggcuuuuuuguaauuuuagcagagacaggguuucaccaugguggccaggcuggucuugaacuccugaccucaggugauccgcccgccuuagccucccaaagugcugggauuacaggcaugggccaccgugcccagccccucaauugaguuuccgucuccugucucaggaccucuggacuucgaggcauacagugcggcugcccugcaggaaggcaaguacgucugggccuggaugcccaggcuggaccaugggggugagggaggcugaucugaaugugaaaggaggcucacagugcucaggugccccccaaucuauccucagcgaugaaacguuugcggggagccaaggccuuucgccuuccaggacuaagccggcgggagcgggagccagagccaccugcagcugugugaggaagcaccccugcccggucuggcccaggcuagaccgagauccccuccccugcccaggcuaucccagaaguccccuccuaggauagcccaggaguauccauauuccaggcuggaccaggauucccucuaccugagcuagaccaggaguaccucugcccccggcuagcucaauauuaccgcugcccaagcuaguccagaauucuuccuuuugcuagguuaggccaggaauugccugucccagaguaacguagcaucuucccugcccaagcuggcccaggauuguucuguuugccaaggcuagccccgacuuucccuaucuucacaaggcagcccuucaaaugaguuccaggauuccuucccucccaggcuguuugagaacacucucuacucagcuaacuucagauucaacccccuccccaagcaagccccauggucccaccgccucuagggcuagcucagggcaguaucacagucugggagcugccccagcuuccauguccaguguugggggcugacagggggcaccagaugggcugcggaagcugacaccaacaucucuuccuccauccccagagauuuccuggagcccgauucaggggugagugaugugggaggggucaggcugggcuacaaguggaaggaguuugaucccacucuuggcuccuagagucccgaucccuacuggaaacuaaagagccgagauugaggggcgggcuggagccugggggcuggguucauaucccaccucagcugcaaagucccauggacuacgugggugugaauaaugucccugccgaagcucaguuugucccaggaaccugcccacacacccagggaagacagucguugccaucaggguugguuuugaggucugagucaaggccugggggcagggcggggggcgguuggcagggugagauggaagguucgauaguggggcgccugacucacugcugcccccugacuccccuagacauguccagagguggaugaagaagguuucacuguccggccugaugugacccagaacaauauccuucuggcacccccugggggcaguuguuggcacagcaaggacaaaauucuccguaauaaccaguccaccuucagcaguccucucuguguacauccuggagagagucuccuuuguggaugaagccaaccuaaauguaaacacccacucuauggggucagcacugggcaagagggagagagaaaaggagaucuagcagggcuuccuggaggagggggcaccaguguugggguuuugcagccgaauaggaguuugccaguuaguucugggcaugcuugugcaaaggcuucucggggggggugggagugcuggugggacauggugucaggacugaagguggcgcguggugagcgaugggauugggcaggaccucgaaggguuugagcagggagggacgaggcuggauuggagagcugacugggggaaagcuuguguugggauuggcuuggaccuugacugcagcccacgcacggccgagcccucccguuucucguccagcgacuccgacuucgacgaugaagagccccgcaaguucuaugugcacaucaagccugccccggcccgggcuccagccugcagccccgaggcagcagcggcacagcucagggccaccgcgggcagccucauccuuccuccuggcccaggggugaggcgugggaggggugcccuggguguugcuagagaggcuggcuggaugcauucgugugugauguugcccacuuuguccacagggcaccaugaaacgccauucuucacgugaguagccuuuggucuucagaguggggaggauccuaaggaagggaggcuauggguuugggcuugaaucauaacuccguuuuguaacuuugggcaggcugcuuaaccacacugaccuucagucuccuuuucuguaaaaugaggucauuaugaaauuaagugagagcugaaagggguagcuggggccaggagaagcuagcaucuggagacaggcucgcuuaggcuugaauccaugucugccugauuugcugaucaccuugggcaacuggcuggacacccccgagccucggucccuuggucuguggaguggggagcauugcaggcagggugacaagaaggcugaaggaggugcaucucuuguaggggacgcugcugggaaaccccagagaccucggucugcccccagaaccagcagguggguuccacacgagugggcaggugggggcuguccccaccuccucccuccaccuccccaugucuccgccugguguucucuugucccggcugggaguugacgucaugcugggguuuuuuuguuuuuguuuuuguuuugagacagagucucacucugucacccaggcuggagugcgauuucagcucacugcaaccuccaccuccugaguucaagcgauuuucaugccucagccuccuaaguagcugagauuacaggcacccaccaccacgcccagcuaacuuuuguauuuuuaguagagacaggguuucaccauguuggcccggcuggucucgaacuccugaccucaagugaucugcccaccucggcuugccaaagugcugggauuacaggcaugagcccuugugccuggcccaugcuggcuuuugagggaccauuuagucauucauuugaugaacauuuauugagugccugcuguguaccugugcuguucuagggucuggguucugagacaggucucccuucucagagucacauucuagugacuccagauuuuaagaauagcaaauagggccaggcguggcggcucacgccuguaauuccagcacuuugggaggccaaggcaggcggaucaccugaggucgagaguucgagaccagccugaccaacauaaagaaaccccaucucuacuaaaaauacagcauuagccaggcaugguggcacaugccuguaaucccagcuauucgagagggugaggcaggagaaucgcuugaaccugggaggcggagcuugcaguaagccacuguugugccauugcauuccagccugggcagcaagaggaaacuccgucucaaaaaaaaaaaaaaaaaaaaaaaaaaagcaaauaaguuagagcauauucgauacuucuaagugcuacgaagaaacuaaagcagaugacgcgaagacaggaggaggugacuucccuugaggugggguugggaaccucccugagggggugacuuggagcuaagccccaaagaggagcuaggaggugacugugaagagagcuggggaaauggaacuccagacugggaacaggcugcacacaguggcucacaccugcaaucccagcacuggccaaagcagccagaucacuugaggucaggaguuugggaucaggcuggccagcaugguaaaaccccgucucugcuaaaaauacaaaaauuagccgggcaugguggcaggugccuguaaucccagcuacucuggaggcugaggcaggagaaucgcuugaacgcaggaagcggagguugcagcaagcugagaucgugccacugcacugcagccuggccgacagagcaagacuccgucucaaaaaaaaaaaagacugggaacagcaugugcaaaggccccagggugggaugaggcuugggaaaaauagaagcagcccucuuggccucacccucucuagcugugcagagagauugcagucagaggagcagguguccaagaaccucuuugggccgccccuggagucagccuuugaccacgaagauuuuacaggugauggggauaagggauuggagggcauggguguggccggagggagguuggguggggccauugcagaguuaggccaaugagguccccuggaagccaggcuggagggaggacuaguccguguaggggugggcggggccagagugcgcgugggaggggccauagauaggguggggccuuggccagugggcggugacugaguggaugggccggacauuuguggagagggaagucaccagaagguguagccuugggggcgugcacaaggacuuugaaugggggccccccugaccuucccucgacguggccguggccugcaggaggaugggcagggacucugagugggcgagggucggagcugaccgcccgcuucccuccccaaggcucuagcagccugggcuucaccuccagccccuccccuuucuccuccucgucgcccgaaaacguggaggauuccggccuggacucuccgucccacgcggcaccuggccccuccccagauuccugggucccccgcccaggcaccccgcagagcccgcccagcuguagggcgccacccccagaggccagggguauccgggcaccgccucugccagacucgccgcagccccucgccucgucuccaggccccugggggcuggaggccuuggccggaggaggugaguccagcgggccugggccugagaguugcuggaacccugggcgggggauugagcgccugcuuugggcagggccugaucaggcugcuggagacacagccaggaccaggcaggcagaaccucccaccguugcagggacaacaaugagauggacauuuagcaaggcaggcgguagcgggugccaggugggggcccucccugaggaagggacaucugagcugagauuugagggaggugaggacagaaccacguggacaugaggggaaaggcgugcugggcagagggcacagccccugcaaagguccuggggcaggagcgcgcuaggccugucugaagaacagcaaggaggucugccugcuggaacggggugaucacggaaggaggaagaagagaaggcagggaccaggaagggccugaugggcccagggagggcuugugaauguuacccugaguaacgcugagggccaugagcaggggaggggcgggaccugacucaggggucacaggcucccucuggcagcuucgggagugagggcagaaaccagagacuggggaggcaaccagggaggcaaguaggcgauggggguaaggguggcagugggagaagcagguggaaaggucgcugcaggggagaguucggaggaguaaggauggggaaggagcggagucaagggagggaggaggauggggaaggagcggagucaagggaaggaggaggauggggaaggagcggagucaagggagggaggaggauggggaaggggcggagucaagggagggaggaggauggggaagggacagucaagggagggaggaggauggggaaggggcggagacaagggagggaggaggauggggaagggguggagucagggaggggugggggacgucgaggcugugccuuuaggugucaggugcacaguggacccugaguguggggaaggucaggucagagcacccccuccuugaagacgucaucaaaacaggaggagcagccgcccagggagagcagaggagaggacagccggggagcccagagggguuggagacaggaggacagcaggagauggggggagagcggcgggaugggcuccugggggcugucugaggagaaugggaagcccccgagucagagggacugugggcugugaccacccgagguccccaguagugucaacaagggcuccuggcacccuccauaggaaagggccaggcuggagcccguucaagggagagcugaguggguggagaccacagagugggggcagaagaagcucuuuuuuuuuuuuuuuuuuuugagagggaguuuugcucuuguugcccgggcuggagugcaguggugugaucuuggcucacugcaaccucugccucccagguucaaacaguuuucugccucagccucccaaguagcugggacuacaggugcguaccgccacacguggcuaauuuuuguauuuuuaguagagaugggguuucaccauguuggacaggcuggucucgaacuccugaccucaggugaucugccugccucggccucccaaaguguugagauuacaggcgugagccaccgcacccggccugaguagaggcucuuauccaacccugcaaauucugcccccccaggggacauugucagugucuggagacauuuuugguugucaccaccaggcaggaguggugcuccuggcauucaguggguggaggccuggguugcugcucagcacccuacagugcacagggcagcccccgcccccgagaaugguccagcccccaaauauccacagugcugaggcugagaaagucggguagagcggggagcacagcuugggguacaggugagaggggagguaggugggaggggagguuggcaagcaagggagcacguucauagauggaacagaaccaggacccugaggaagcaggagagggaggggagcuuggguguuaaaggcaugagacucagacacagaccacaguagguggcugcagucagguucucggaaaggguagaggucacaaaauggcugaauguuggcuaaaaauccucugcugaaccccccuuacagcaugccugcgucuuaagccuucagugcuugcuugcauacccccagugauggggagcucaccccuuauugggccaccauucuggugucugggaggguuggggguguggacaguaucugcaguccugucuggcaccuuuucugcaacaccaggacuucagacccauugggggucucugcagaaaagcccaccuccuaagauuuuggcugaguuugugccccuggggaggccccagaggccccgggcagcaucucagcagugccucuuuguacucgcuccuagaccugaugccugcaccugcugaccccacagccagggagggccuggcagccccacccaggagacuucgcucuaggaagguguccugcccucucacacguagcaauggggaccugguaggugagggggcguggcaggagcuggacugggggucgcgucugggguccgcuuuugggcacugguccuggggcacucacagccaagauugucucuuucccuuccagucucguucccugagccccuccccacugggcucuucagccgccagcacugccuuggaacggcccagcuucuuaucccagacaggacacgguaugugagggcgguccugggccuggcuuugggccucagugucaccuucucuggucuggguggguggcuucucuguuggcagaggugugguugggcggagggagucucgagccuggagccuauauucacacugucuauccguuguuccccauucccucuccaccacccccaggagucucccgggguccgagcccugugguccugggcucccaggaugcccugcccauagccacagccuucacagaguauguccacgccuacuuccguggccacagccccagguacccagugaugggcagacagggcccgugggaagucuguguugggggaguccagcagggacagcuuucagaugugcuucauggucugucuuauagugaaagggccuugaacacugagccaagugaccaggccccuguccugagggcaguggagccauaggagggccuuuuuuuuuuuuuuuuuuuuuuuuuuuuugagacagaguuucgcucuugcugcccaggcuggagugugcaguggugcaaucucgcaaucucagcucacugcaaccucugccucccggguucaagcaauucuccugucucagccucccgaguagcuggaacuacagaugcgugccacugcacccgacuaaauuauugugcuuuuuguuuguuuauuuguuuguuuguuuguuuugagacagggucucacucuguugcccaggcuggaguguaguggcgugaucucaguucacugccaccucugccuccuggguucaagagauucuccugccucagccucccgaguaauucugggauuacaggcacaugccaccacacccugcugauuuugugucuuuaguagagacaggguuucaccauguuggccaggcuggucucgaacuccuggccucaaguaauccagcugccucagccucccaaggugcugggaggauagacaugagccacugugcccagccauaggagagcauuuaagcagggcuaugcauugcuguagacgccaaggcugccgugggcauuaagaugaagggaguaauacuagaaguuaggcccaguaaguggguaagggcguggguuagggacaagcggagugcagggauauauauugggguggccuucagcagaaaagaucugaaagucaaaccaugaagaagaggagagugucagaucaaaaacccaagcaaaggauagcuaaaaaacugaacauuuuaauuugagcuuccugguggccuaggagaaaagagaacuagggauggagauguuccugccuccuucagcccaggguggauucuuccuguccaggcaggaaugaaagaggagguugggggaaaggauacgggggaucaucagggccauccuccuagauccgaggagucuggggagccacaggcaccagugaaaccaagagaaggggaaggaugaggcaccaggcagagcccuaagccaacacccaguccccucauccucccuagcugccuggcucgaguaacuggggagcugaccaugaccuucccugcuggcaucgugcguguguucagcgggaccccaccaccaccuguccucagcuuccggcuuguacacacaaccgcuauugagcacuuccagcccaacgccgaucugcuguucagguacuauggaggggcagugggagagggccucggaggcugcuggggaucaggcuuccggacucugaguucccucucugcuuccugggauuuuuucuuuucuuuuuuuuuuguagagacggagucuugcucugucgcccaggcuggagugcaauggcgucaucucggcucacugcaacuccgccucccggguucaagcaauucuccugccucagccucccaaguagcugggauuacaggcacgugccacuacacccagcuaauuucuuucguauuuuaguagagacaggguuucaucauguugcccaggcuggucucaaacuccugagcucaggcaauccgcccgccuuggccucccaaagugcuaggauuacaggcgugagcuaccacacccggcuugauuuuuuuuuuuuaauuauuauuuuuuugagauggaguuuugcucuuguugcccaggcuggagugcaguggcgugaucucggcucacugcaagcuccgccuuccggauucaagugauucucuugccucagccaccugaguagcugggauuacaggcaugugccaccaugccuggcugauuuuuguauuuuuaguagagaugggguugcaccauguuggucaagcuggucuuaaacuccugaccucaggugauccacccgucucagccucccaaagugcugggauuacaagcaugagccaccacacccagccaccuccugggauuugcuguguggcguggggcaaguaacuugcccucucugacccuuguuuuccaucccuccuuuacugcccgcaccacaaccacccagguagggcuuugcugggcccagggugggccaggaaauugcaucuuuaggaagggguagauugaaugcugggagcccugggagggcaugucccgaggauuggggugaucaguccgggucucugcagugaccccucccagagugacccugagaccaaagacuucuggcucaacauggcagcucugaccgaagcccugcagcgccaggcagagcagaaccccacugccuccuacuacaacguggugcugcugcgauaccaggugcgccacccgcauggggccgggaggaggugguggagugggggacacggugagccggcagcagacauggaggcgccugcguguuggccaggcuggucucgaauuccugaccucaagagauccaaucugugagagccgaugagcuggagggaguaggcagugugggucgggaaugaacgguggaggaguaggcaguguggaagagcgugcauccccuguugcagauaguauguuuaugugaacuagaagcagcccagccccggaaccuuacacuugaacuucccugggagacuuuguuagaaugaggcgcucuccugcccccugcuggaaaccugguguaauacagccucucauccaucaaaucucccugugacuggacccccuuggggcggugcgugcaucgcagggucaaggugguugaauagcgcaugguguggcaagacaggauggcccaagcuguguccucucucucauucucauucuuccuaguucucccgcccggguccccagucugugccucugcagcucagugcccacuggcaguguggagccacccucacccaggucucaguggaguacggcuaccggcccggugccacggcugugcccacaccacucacgaacguccagauccugcugccugugggggagccugugaccaacguccgcuugcagccggcugccaccuggugagggcuugcgggaggccaaggaaaacucagcaguuucccccauaaccccagaccuucucccugaugcauugauuaaagggugcacccucggccugaccguuaacugugagcccacccugcuuagcacuaagggugauguuaugagugccaggugcaguggcucaugccuguaauugcagugcuuugggaggcugaggugggaggaucacuuaaggccaggaguuugagaccagccugggcaauauggugagaucucaucucuacaaaaaauauuuuguuuauuuauuuauuuauuuaauuuauuuacuuugagaugaagucucgcucugucgugcagguuggagugcaguggcacgaucucagcucacugcaaucuccgccucccggguucaagcgauuuucucugccucagccucccggauagcugggauuacaggugccugcuaccacacccagcugauuuuuguguuuuuuuaguagacaugagguuucaccauguuggucaggcuugucucgaacugcugaccucaggugauccacccgccucggccucccaaaggacugcgauuauaggcaugaaccacugcacccagccuuacaaaaaaauauuuuaaaaaguagucaggccgggugcgguggcucacaccugcaaucccagcacuuugggaggccgagaugggcagaucacgaggucaggagaucgagaccauccugguuaauauggugaaaccccgucucuacuaaaaauacaaaaaaaaaauccgggcaugguggcgggugccuguagucccagcuacuugggaggcugaggugggagaauggcgugaacccgggagguggagguugcagugagcugagaucaugccacugcacuccagccugggcaacagagugagacuccgucucaaaaaaaaaaaaaaauaguagugguagugugcucuuguagucccagcuacucgggaggcugagacagaaggaucacuugagcccaggaguugaggcuucaaggaguuacccugggugacaacugucucuuaaaaaacaaaaauuuaaaaaaaaaaaagucuguugugaagaagccagacuuauaggacagaaugcgucaucuaaaagugcugcaaggaagccgggcaugguggcuuaugccuguaaucccaacacuuuggaaggccaaggcagguggaucaccugaggucagcaguuugagaccagccuggccaauauggugaaaccccgucucuacuaaauuacaaaaauuagccaggcgugguggcgggcgccuguaaucccagcuacucaggaggcugagggaggagaaucgcuugaacccaggaggcauaggcugcagugagcagagaucgcaccaaugcacaccagccggggcgacagagggagacaccaucucaaaaaaacacacaaaaaaacacaaaacaaacacacacacacacacacacacagaaguguugcaaggcuguguggcuccacggcuguuccauaucucacccucauuucacagaugaggaaauugaggugaagugggggagaagguuuguuggggucacacagccaggaggcagcugaggcaggacccugggcucucagcauccucucuggggaagcccugauuaagauucuuucucugccaggaaccuggaggagaagcggcucacuuggaggcuuccagauguguccgaggcaggcggugagcugugguuguguaugagggcugggugggagggacuggggucaggugggaggcacuuauuuauguuggggaagaauuggggacauacugagggcgggcaaguaugggcauugaggaagucuuuaaaagcuggaggagggccgggcugaguggcauaggucuguaaucccagugcuuugggaggcccagaaugcaggaucacuugaguccagcaguuggaggcugcagugacccgugaucguaccacugcacucuagccugggcaauagagccagacucugacucaaaaacaaacaaacaaacaaaaaaggccaggugugguggcucacgccuguaaucccagcacuuugggaggccgagguggguagaucacuugaggucaggaguucaagaccaaccuggccagcauggugaaacccugucucuacuaaaaauauaaaaauuagccgcgugugguggcacgcaccugugaucccagcuacuugggaggcugaggcaggagaaucgcuugaacccaguaggugaagguuguagugagccgagaucgugccacugcacuccagccagggugacagagcgagacucugucucaaaaaaaaaaaaaaaaaaaaaaaaaaaaaagcuggaggagggccaaggacaguggcauaggucuguaaucccagugcuuugggaggcccaggugggaggaucacuugagcccaggaguuagaggcugcagugaccuaugauugcaccacuauacuccagccagggcaacagagccagacccugucucuaaaaaaaaaaaaaaaaagcugaaggagagggcgucccagggccagauggccagacacagcaggugcaaaggcccugaggcaggacucccuugcuagccauacaaagcccagugaugccaggagagacagaugcaggggaucaaagggaggucugauggggcacauaaaggccacagaacagagggcuucaggugugggccaaagaugagccugguucacagcugggacgggggcuggugccagggcgcagcugacugcaggucuccccagguucuggccgccucucugccagcugggagccgcucucagggcccagcacacccagccccguggcugcacaguucaccagcgaggggaccacucugucgggcguggacuuggaacuggugggcagcgguuaccgcaugucgcuggugaagaggagguuugccacagguacuccccaacccugcugcugggugaccucaggagccgagaucuuacaggggcaagccccgggguguggggagggauugggguguggggauccuugggaaagauagguggguguuggggccaggagaccccagauggggggcacaggugggcaaggaggcagggcccuguguaucuggggcuggcccuuggaggacguccuuggaaggaccccagccagggagcccgaaguccccccugccacccccuccuccagccccacccuguucuccugcccccaacaaggggcuccuggggcccaguggcaacagggacuaugaguuacagggguguuuugaagaggacaaggaugauugaagcaucccagggucagagccggggaaccccucccguaccccuccuccccaccccucccccucacagcugcacccccacagggauguaccuggugagcugcugaacccgcaaaugcugcugccccagcucuacacugcgcccuggugcuggcugaccacccccugcccuccugccggacccuggggccucccaccccagccucccugaggcccauacuccacggagaggagccccaugcccagccuggcugagcccgagauucgcuccucccccucaugccaaccccacacaggucccggccuuuuaauguucuuugaauaaacacuuuauuuucuaauaaaauaaaaaaggaaaccuuuuccugcuccaggaaguauccuuugcguugccagagaggggaggaagagaagguggauggauacgagagaccuaauguaccucccucccugcacugcgcucaaccgguacagggccauucugggagagaaagaacaacacagauaccccagccccaugggcucagaggugggcuauagggagggaggagga

SEQ ID NO: 15650 - RNA, 547 nt, Homo sapiens
accuuucuucuuuuuuuauggugaaaagauauauauauauauuuagccagcuagacucaguuuagaugaucucgauuuuguuggcaacauccaaagcauuguaaucaggagccagucaaacauaugccuucuucucuccaucaggccgaaucaggguguugaccuuggccacauuggugucauagagcuucuucacagccuguuuaaucuggugcuuguuggcuuuaacauccacaaugaacacaaguguauuguugucuucuaucuucuucauggcagacucaguggucagcggaaacuugaugauagcauaguggucaaguuuguuucuccugggggcgcucuuccgaggauauuugggcugccuccggagucgcagugucuugggccgccggaaggugggugacgugcggaucuucuuuuuuuuguggcuguggacaccuuucaacauugccuuuuuggccuuuaaagccuucgcuuugucuucggcuuuagaaggggcaggagcuuccuucuucgcuuucggcgccaucuugugaaaagcccu

SEQ ID NO: 15651 - RNA, 547 nt, Homo sapiens
agggcuuuucacaagauggcgccgaaagcgaagaaggaagcuccugccccuucuaaagccgaagacaaagcgaaggcuuuaaaggccaaaaaggcaauguugaaagguguccacagccacaaaaaaaagaagauccgcacgucacccaccuuccggcggcccaagacacugcgacuccggaggcagcccaaauauccucggaagagcgcccccaggagaaacaaacuugaccacuaugcuaucaucaaguuuccgcugaccacugagucugccaugaagaagauagaagacaacaauacacuuguguucauuguggauguuaaagccaacaagcaccagauuaaacaggcugugaagaagcucuaugacaccaauguggccaaggucaacacccugauucggccugauggagagaagaaggcauauguuugacuggcuccugauuacaaugcuuuggauguugccaacaaaaucgagaucaucuaaacugagucuagcuggcuaaauauauauauauaucuuuucaccauaaaaaaagaagaaaggu

SEQ ID NO: 15652 - RNA, 3082 nt, Homo sapiens
cuauaaggcuugggcgggcccggccgcggcccacagagccguccccgcccgcccgcgccccgaccagcccggccucgggcagccacucaccgguguccccguccgcguccuuucuccccgggucccggccauggcgcugagugaacccauccugccguccuucuccacuuucgccagcccgugccgcgagcgcggccugcaggaggugagggcggcggggacggcggggcggccgggaccgugggcggcgggcucgggguaguagaacgugggcugcggggugacaggacgcgaaggcggggacugcagacucaggagaggaggaugcgggccacggggaucgcggacuuagggugguaaaaggcaagcagcgccccccgagccccgccgcccgcucacgcccauugcccugucgcccgcagcgcuggccgcgcgccgaacccgaguccggcggcaccgacgacgaccucaacagcgugcuggacuucauccuguccauggggcuggauggccugggcgccgaggccgccccggagccgccgccgccgcccccgccgccugcguucuauuaccccgaacccggcgcgcccccgcccuacagcgcccccgcggguggccuggugucugagcugcugcgacccgagcuggaugcgccgcuggggcccgcacugcacggccgcuuucugcuggcgccgcccggccgccuggucaaggccgagcccccugaagcggacggcggcggcggcuacggcugcgcccccgggcugacccguggaccgcgcggccucaagcgcgagggcgccccgggcccggcggcuucgugcaugcgaggucccgggggccgccccccgccgccgcccgacacaccgccgcucagccccgacggccccgcgcgccugcccgcgcccgguccgcgcgccuccuucccgccgccuuucgguggcccugguuucggcgcgcccgggcccggccugcauuacgcgccgccugcgcccccagccuucggucucuucgacgacgcggccgccgccgcggcagcccugggccuggcgccccccgccgcccgcggucuccucacgccgccugcguccccgcuggagcugcuggaggccaagccaaagcgcggccgccgcucuuggccccgcaaacgcaccgccacucacaccugcagcuacgcgggcugcggcaagaccuacaccaagaguucgcaucugaaggcgcaucugcgcacgcacacaggugggcggcacgcacgagccaggagcgcaggcggggggacgcgggaggagaggucggauucccagcgcgcgccagaaaaugaauuuaggaccucccuuggggcguggcucagggggaucuggcagguggugcacgcuuaggacuccccaggaggcguggcucgggagguugguugggggggcacacaggaacacucccuaaggaagugugauccgagagguuggggugggggcuugcacgcuuaggacgaggggggccuccggagguugggaagagcacuuagaaaaccuccuggaggcguggcuagggagacagucucagaaaguuggggagggggagcagguuuaggagccgcugggcacuuggcucagaauccccggggcugaggcucagguaguuggggaguaggugcgcguuuaggaaccccggggagaugcugcgucucaggaaguuggggagggcgcucaggcuugggacuccucuggggacaaggcucaggaccuuggggagggaguguucgcugggaaaccuugagagauuccgugucuuagaaugcuggagagagggugcaugcuuaggacccgucggggagcguggcugacaacaguggggaguggaccuugcgcuccuccgacccccugggggugaggauccggauuguggggggaguuggggauguagggcaaggaucccucaggggcgcaacacuaccgcggggagcgcgucaaggcccugguuagggauagguugcgcucgccgggguagccauacgugcccuguccugggaggggaacugacgcuuacucucgcccccucccugcaggugagaagcccuaccacugcaacugggacggcugcggcuggaaguuugcgcgcucagacgagcucacgcgccacuaccgaaagcacacgggccaccggccauuccagugccaucugugcgaucgugccuucucgcgcuccgaucaccuggcgcugcacaugaaacggcacauguagccgggacgcccccgcccaccugcgcgcggccguggcgggucccacgcgccgggcgcggcccccucccaaacugugacugguauuuauuggacccagagaaccgggccgggcacagcguggcuacagagggucucccucgaugacgacgacgacgacgccaccaccccagcccccgucugugacugaaggcccggugggaaaagaccacgauccuccuugacgaguuuuguuuuucaaaauggugcaauaauuuaaguggcaucuucucucccaccgggucuacacuagaggaucgaggcuugugaugccuugugagaaauaagggccuuaauuuguacugucugcggcauuuuuuauaauauuguauauagugacugacaaauauuguauuacuguacauagagagacaggugggcauuuuugggcuaccugguucguuuuuauaagauuuugcuggguugguuuuuuuuuuaauuaaaaaguuuugcaucuuuuaaaaaaaaucacagcacuggucugguugcuuggaacuggggccuuggggcacuugggaggaggggggagcggagaguuugauggagggcagccccacuaaagcaucgugugcaguggguccugcgucugccagcaccgggacugccagcugcugugccugccugccaggaaccuguggguuuuucuguaaauuuagacacugcauuuuaggacugagggaggguuauuuuaagguuguucuuugagccauaaauugccucuuugccccacagcuggggaaagugcuggucccacugacguggccuccucuacguugaaaaaaauaaaacuacuuaccucuuccuggaag

SEQ ID NO: 15653 - RNA, 17451 nt, Homo sapiens
gagcacccgaucccuggaaucauguucuggaaaccaccgcgacgugcgcaguucucgggcguggcccugguaucaucccacugaauccuaggaacgcggugcgguagguaucacuguccgcauuucacagaccgaaguccagaauggggaagcgacuugucuuaggcuuccuggccacacuggggaccguggucaugguagcguccuuggacaccugucuccaaggcucugcagaagggggaggugccgggcccugacggcugauguccaaggaccagccgggauggaccagccccaggaggccccaguggaggaaaacaggacgagguuuucaguaagaugaucuuauacuaauucaagggcuauaauuuguucuccacaucgugugccuccaacuuuuucggggaaaggguguuaaaauuccguuacaguguuuuuacuugucaaauuagaagcagcaaccggcugggugcagugagucaagcuuggaaucccagcacuuugggaggccaaggugggcggauugcuugagcucaggaguuggagaucguggcaucgauaacauggcagaaccucaucuuugcaaaaaauacaaaaauuagccaggcgugguggcgcacgccugugguacccacuacuagggagacugagguggguggaucggcuugagcccaggucaagguuccagugagcuaugauggcgccacugcacugcagccugggugacagagcgagacccagucucaaagaaaaguagaaagcagcaacccaacuuggcuccccaaauguuggaagguaucuuagcuuauccuugcauucucaaaggcccuaggcccuucuggauacauggacacaggcaugguagucccugcaggcagggguaguggggagcugcaaccuaucccaaaacucuagagaugcugauaggaggccaagcucugcacccuaauauccuccagcuguacccucuguggaucagaguaaagucacauccuugggacaccaugucucagcagagcuguuaaacauaggcacagugaaauuaggaaaguauaacuauaggcacccuacagcacagcugagugucagauacuuccacugacacacugacaugcuuuguguuuuaguucucacaacucugggguauucucaccccccaaauggggacaugugcacaggagugaagagaugagcucagagccacacagcuggugggugguaggccuggguucaaccucauccugccuucaaagccacuuugcccauggccuuuuguuggggaggggaguguguucugcaccaagcuuuugccaggaaucccugcuagcucucaaacuggcucuggacugacuguagucuuacaggcuggaaggaaccuuugguuugcccugugagacugcaugucuuaagguguagcuguuucuucauuugugaaauuaagcagauauggguaagaugaccuauuccaaagugaaaaacuggaaaaccaaagucuuagccuacaguuucagggacgagggggaacuaaaagaugagcacuuuauagucaagggagaaaaauuuuuuuggagucagcaccaaccagcuaauaaggcagcugggggccagggccaugggguggccuuucagacacacacacacagcucugagccucugggccauaccuuguaagaacuagguauuuuguugagguggggguagucacugagaccugugcuaugggagccuccuacagagggcugcucucuaggccagguaaagucugggugagacaagaaaacauuccuuaauguggcccugaaugaauaaaauguggagguccucccaaaugcagcagcaggcuaacagguggacugcaaggcugugcccugcccugucucccugcauugcagcuguuggggucuggguguuccuggcuaauaauccacaauccaggaaagggcugauuugguugugaagguccaaaugagaaaagauucucagacugguuugugcaaaugguuuuuuuuuuuuuuuuauuuccacauuuauaucacaagguguccacuuacuggaccaaauagcaaaguugcucccuucugcguccugagaacacagaagucuagguacuguacauucacuaaggcuccuuguuuuugcaaaucgcguuuaugacaaauaaccauaaggcaaacgaaucuaaaggaaugguuaugaguguuuccagcguacagacaggucuucccccucgccccacaguacagcauaaaaccaguagcacccacaauaacuuuuguguuguuuuggggggacucuagaaaggugaaguuuucuagauguguacaggaagggaaaaaagaaaagggaggaagaaaggaaagguuuuuuugucugguggucugauggaagaggaauuguuuaaaauaaacaugagaaaacuuaaauuuuugcagcauuucuuuaaaaacuggguuauaacugaaaccagauauaaacagguggcugcccauggagugugggucacacuggcuggccagcuggcccgccugcccaaugccaguggcucaccacagcugagaagcuucuggcacaugacagacaacacuggccugacaguggcuggguagggagcaaacagaggcaguggcauggcccacugucucaagacacucagggccaaauuaaagaacagaaaaugcaagagagaugagaugcgugcuucuguugcuguguuaaaggugaccucucccacagguuuucugugccugccugcaacugaggccccagcuuucaggugcuggaaaguguccgcaccucuuugggggugagggacuaacgcuuuuuauagcugguuugcuauagaguucugaacucacuuugccguccuuccuuccacgcgguccuucuucgcaauuuuguuaguaaacugguagcagcauuucacaaaaagaguuuugagggaagagcgcagagagaccgcgugacucccgcccccucccucccgccugggccggacuccccgaguucccagcgcaggaggcagcugggccccggccaccugcccaccugccugcccgcccacccggcuucugcaagaugggaaugcacuuuguggcugacaggccggucaguccaagcagacauaaggcagaauguucaagcgcccgucgucgccgugcggaucgagcgauaugcacugcguccagucauaccaguuacccuguguguccugacacccguucacccccggccacuggcuggccuggauucugucgagaucguccugugugaccucccgggucagaccagggagguccgugggcgggcuuugaggcaccagcacaugcagcugccuggccccuugccgggugcucuccuccugcuucagguacucagacaugaaguggugagccccuggggucugcgcgcccgaugaugagagcaggcugcucugccggcucagguaggacuggaugaucucguugcgugacagcuccuuccaguucgucuguucgaaggggcucuggaggcuggccuuggccuccugcuuguccagcucuguccuggacugcugcuccaugugcacagggcugucugcccgcacuggcucuuucugggucagagguuugaucugucucgucauggggucaaaggugagcuuccgcucuuuuaaccggacaggcuugacgcccgccucagccaccugcccguccaaguuaaccguauagucucgaggucgguaccucuucuucuuuuuacuguccgagcccccugaggaggcagcaucacuguccgccuuggaggagucuggggaaaagccugcccgggacaggaggggcucggcuggggacagcccugccuugcagcccggccccgccagccgcugguggcucucaggcugcucaagccagcacacugggcuuuccgcacugggcagcagcucgagccgccguacgggggguguggacggcugugccaguggaagcggugacggcaccuguguggcaucgagugccuggggccgcggugaggggcugggcacggagcccuugggugcauacaagcucugcugccgggcaaaggagcccucaugccgugaguuccgaggacugaaagagcagcgagggggucccuugggauggggaggccccggagucucguccacccuguccagcugcugcagcaccgaagccuuuggcugcaagcaggguccagggggcuugcccaggcccggggagcuggugugcggucgcacggcguugacggggaucuugccacugugcuugucauucucgucacgcuccaggcggcugcccucugggccugcaugcccacugccauccagggagcuggcgaagcucucuggacucccacugaucccguugguggggaggggggaugaguuggggaccagggggucguggcuagcuuuggagaccuuggguggcggcccuggguggccgaggucacgcuggucaccccggcgcuugcggcugcccagccuguccagccgcugcccgggcagccucuggaggucauugcggcucuucaggucauggaugcuccugggugggccagccgcccccaccuccggccggcaguugugugcgcccccguuggcagagccgguggcccccgccagcccccgcagcgccgccucaugcuggugugccggcucgaugagcuucugccagcuccgcagcagcuucuuggcccgcuuggcgagcuccucguucuugguuuucuugcggacgucguugaugagcuucccaagucguguuuccuacaaccagagggagaugaugacauacuuucgggacaggaacuucuccaugagcugagccagaaauggugggaaguggcccugacagugaaaugacccgguucccacugagcccuaaacugccagcuucccugacacaaaacuucuggggauuuccgguccuuugugacaauauaaauucucaaaccuaguucccagaccuucagggucccagguggcuucucagcagugcugucacccaggcuccuggugucagggggcuguggaccaucaaggccacuguaaggacacugccagagaggcuuccugggugagagggugcuguggccgaggcgacagcacagaggguccgcuucaaguggaggguuggggauggugccucucacuggagccuccuccaagcacaccucuccugauguccccacgugcccacgaagugugcugggcauguaggaugggaguaacaccacuuggucucugcagugcccgugggagagcaagaucgcgaggcacgagcugugagggcacaccgccucucuugguccuccgaagcaaagacacugaugcucccagaagcugcggaaggaccugguugguaccauccccugccccccguucugcccucccaaaugcuggggucugggauacucaccucaagugccucuuugguaauaggguauuucuccaggcuggagaugacuuccagcaccgccaccauguuccggaucuguggaaauaaaaagccauuugucaggucccuguccuucuccacugggaggcuggaacacccugccccagccugcuccagucucuccccaaccccagagcaagaggagccagcagcacugaagcccccacuccaugucgucuccuaccugcucccugggccaaccuggcacccagugcucauccucaccugccgucugaccuccuccaguguguggugugcgggcugccccaagcccuccaguguacaugguacauacccacccaccugcugaaacccaggaugccuguggaacaagagcugcuccugauacuuaagaugaccucuacucugccaucugaugggagugggagaggagacacggaagaauucaucgaauaaaauccacaaagcuuaaaagaucaauacacaggccaggcgcgguggcugacaccuguaaucccagcacuuugggaggcugacgaaggcggaucagaaggucaggaguuugagaccagccuggccaacacagugaaaccccaucucuauuaaaaauacaaaaauuaguugggugugcuggcaugcgccuguaguuccagcuacuugggaggcugaggcacgagaaccacuugaacccgggaggcggaggguguagugagcugagaccacaccacugcacuccagccugggugacagagcaagacuccguguaaaaaauaauaauaauaauaauaaugauaaaccagucaaucugaauccaaagacaccauaaagagagcagaaagucacaaagugggagaaggcauaggccacaggcccccaaggagcuguaucuggaacacagaaugccuguacagcaguacagcugaccaggagcccggcguagacuggccacaagacaggaacaggcacacggcaaugaaaugucagugcugaugcucagccucucagcuuuaucgauaaucaggaaaacucaaacugaacccacaaauggauacaugauacacgugccccacugacaacacuagguacuucgggggauacagcugacuuuggggacugcugggcuuugucuggcagagugaagcaugaacacaucccaugaccaaguaaucccucccuuuuaggaucuugcuaggagccacaccuuguucuaagcacuucccacacauuacugacucccuuaauuguuacaacaagaauuccuaccacucaaccaccaccuccagcaacuacagguuucuggugggcuggcuagcgggugggagcccaggggcccugaggaaaccacagugaguagauuacucaacucccccccaccccaacaugauaaaggaguuaagcgggcacaugauacaaauuaaaacagcauaaaagggcacacaaggaaaugggcaucucugacccagccacuguagcauuuccuugcauuuuuuuccaaaaauaucccuuguguauauaggcguauacauccacacuuaucacauauuucaaaaccaaacugacagugguucuugccuuuucugacuuaaugucagcaauguccagccucaaacagagccccucauuuggcucaccaucccuuccagaguggggaaggcccgacuugaaugcugugggacacuuaggcacuuuccguccgccauuacaaaauaaggcugcaaccgacggcagugacagaccugacucugagcuagugcacagacagccauggaggagcuggggcuccacauccaugcaggguggucaccucacccccagggaggcugcucuauuccauucccaccaggccacauccuugccaagacugcguggcaagaguuuccguaacacaugauuguaaacuuagcaucuuacacagcacacauuuaucaucuuaggcucuagggcucagaaaucaggucugagucucacugggcugggauccucucuagaggauccauuuccugcuccuucagguguuagcagaguucagcucuuauuuuguuuuuuuuuuugagaugaaguuucacucuugucgcccaggcuggagugcaauggcacgaucucggcucacugcaaccuccgucuccuggguucaagcaauucuccugccucagccucccgaguagcugagauuauaggcacccgccaccacgcccagcuaauuuuuguauuuuuuuuuaguagggacaggguuucaccauguugaaggcuggucuugaacuccugaccucaggugaucugcccuccucggccucccaaagugcugggauuacaagcgugagccacugcacccggcccagaguucagcucuuuacacuacaggaaugaggcccauuuucuugcugguugucauccgaagccauucccagcuucuggagggcacugcauccagcucacacccccuccccuuaugcucaaagccagcuacaggcugaguccucacccggcaucucucugacccagccaggauaggugccaucucuaaggacucccugacuaggcagggccugcccagaugaucucggaucaccuccccaucuccaggcuguucccuuagucacaucugucauguacgguaccaugugcccaggcuccaggacuagaauguggacguccuugagggcuguuaauucugcuggccucauggauucuggcuuuucuacucuucugccccacuuccagugggaggcagccacugccacucccucccuucccguguugucuccucuggguguaaaguugcagagccacgacagcaguccccgcagaacucccacaaagcugcccugccaaugggcccauuugcucuuuggcaacaacggccuugccuugcaauguucuccauucagggcuccaaaugacccugaaaacccugcuucaagcugugucaugguggggguggacgggugauaugaggggagauacaguccuguccgcacuccucgugcaaugggcagggaucagugcaggggaagacugugcgaugaggaggccagucccagacagacagcaaggccaaccacucccugccccaggcacuccagcaccgacucagucccugggcuugccacauggcuucaccuccacccugcugaccucacccugguauauuuggagcccugguuccccacauacuccugaagcagcaguccuugcagagcagaacacugcccagacccagcuagccugguggcacaaaguguccuuguccuugggcagacaccauccugcugccagacaagagggaggagacagaacaccugggcaaccccagggucugguacugagcuggugccccagaaaucaccgcugaacuaacagccagucccaagagucuccuggaaacugugugggagcuggggacaccaggcgaaggugugagggcccugugacuguguauccuuacccuuggccccuccccugccuuaugagccacgcuuaagcgugugcagagaggccuucagccucuaggagccccaagggaaaugcuacagccuuggcaguccccuuucuguccccaccgugugagcugcucaccugaggaguagaggagcccgccugcucuaccuguaaggugcuagaaacccacaguccuacgccguaaacagaugaacucugccaacaccugaaggggcagaaaauggauccuccagagaggagcgcagcucgcugcuuccuggaucccagcccggugagacuggagcugacuucugagcccuagagccugagaugauaaauguguguuguguaagacacagagagagggugaguguccagugcggccacucccuggagccagcagaaggcagucagugaugucagcagagcuaaggaugggggcaaggugagacugcccugcccugcgaccucuggggcauugaugucaagcagucugaacacuguguggggagcaccaccugggcauccagacacaggccucccaggcccaggaggcagacacugagcaaugcagcgaggaaucccugcaaagggccuggccccgaccccaggcacacugagccagaaggcuccacagagccucuuuauagauggccacagucugucccaaagaacacuuagcacccaauuggugcuggucccauaggagcaaaauaggagcuggcuucugacccuggcccuggggacccugccuuaacaaccaacugaccccccacccaggaguggcaggucucccacucucauggagguggcccucugugagugacagagacaccaggacucguauguggcugaggggaggcucccgcucugacuccaggccugcuaaguccagcaugaacccucagggcagggaggcaggccacagggggagggcagcaccuaagguggccucccagggaggucaaaaaaggauguggcagaacgagcuguguccaccugggcuggagaccgacuuccaugcuggaaagcagaaaagagcuggagaaggaugggcagggagcuggccagacagcaccaaagcccugcggcaggggagaggccauggguaaggacaccgggaggaaaaacagacccaaaagacccaagguggcuccuucacaaccugucuucuaucccccuuagcgacugcccccacagaccaccugcccuugcccuguuucugggaugcccuuggcaccuguccaucuaucuggggaaguacacuagauccuaaucucagcacagacacaguuugacuccacauggggagccgcuccaggcgauggccucaaaagauggcuuuaaggcagcucuucaggcuugccagggccaugucuguggcccgauggccaauugcagccucuugcugucaggaauagccuggcacaucugaggcccccuccuccuuuggauucucccuugggauuuguucccaguccaaaaaaaccucucaaaacaccugccaaguugcuuucccaaaggggcaggaaucccgucaggaacuguagccucucacuucuccacuagggaccccucaauagaugcagaugggucugaacuuccuuaaccaucaacgaagacaggcguugccuccccuuucuaccaacacugaccgccccugcccacuuaauuugcuucaguuuggccucuucauugcugcgggaagugccugugaagggcaaggguguuggguggggguggggggugucgacagcagaaccuccaugcagcuacuaggagaagcagggguaaaugcagcaaggagcacucuggaagcaggugggaccucccuggggugccugcuccaaaggcaggcagggcaggaaguuagcaggugggaccagguguggcacagguauacaugcagguccagcccagccgccugguacaugaauguugauggaacugacuccacugucacaccgaacacuuucaggucuuagaauggaaauccaugaggcaugaucagguacacaugggccaauaggaaugugaacauuaaucucguccuucuggaaucucagaaaaaccaagcagggaggccuggucucaggucauaggcaucacagcuagcauagauacugaggaagaacaguuugcauccaggcagagggugaacuggggccaccagcacaacccucagcacacaggugccccacacuucagggaugccccaggaacacacgcaugggggcauggaggggacaacuucucgcccaagaccacaagaggucuggcugucccagggcucuuuuguggucauccuuccacaugagaacuuaaaaaggcuuccacgggcgcgguggugugcaccuguaaucccagcuacucgggaggcugaggcaggagaaucgcucaaaccugggaggcggagguugcaaugagcugagaucacgccacugcacuccagccucggugacagagcaagacuccgucucaaaaaaaagaaaaagaaaaaaaaaaccgaaacccaaacacugcccccccccgccccgccaaaaaaaaacaaaaaacaaaacaaaaaaaagaaaggcuuccggaaaggcuggcaccuuuguccccagagagccccauagccugugcuaagccacaauuccagccagccuaacuggugacaugugcuguucagcucacaggaaaugugaggaaggaggcggggcuggacacgcacagagacagccugagggaggggccagcaccccucagaagcagccugggucaggcgccuggagcugcgugagacaccucauucucccacacccugggagcaguggggaacccuguaugcgacuucacagcacaccacgcuccgugugagcuauuaaagacccaccacgcauccucgucuuucagugacacuuuccugaagaaauaauacaaucuggaauuugcuacagaaucauccccuagggugagugacaggagggggaugggugaaacaaagucacauggcuguaagcagcuaucuacugaagcaggaugguuaccuuucucuacuuuuaugcuugaaauuucucacaaauaaagaugagaaaauacaucuauuuccuagcauuuguuugggagaguucacugaucuagaaggacuggcagccaucuaaaggggaagugagcaaauagcuguuuccaacuccucauaguggcuucacuguccaccaucuggccccugaguggggcagcaagggccgagggcuggguaggaugccaccucccuccacgugagccugucucaagucucaggccuccuaacugauuugaacugcacaacaccaucuaucuggugagaccccaggagccccucaccaagcuccccuacucugguacugggcugcugcuuaacagaccuggugcagaaacagcaggcaccccuggggcuggagaggggagcucugaguacccaugccagcuguccaucccgguccgacucucagguguccucacgccucucuucuaaaggaaaccacagagagcccgaaccaggggcacacgcuaggucgacaguuccuuccugcagggagaggccugaccuguaccaggaaggagcccaggacagccaccaccacagagaggacaggcccucaaguggcccagaccaggagggaggacuuggcaagaaggggugggggcuaggucacucucuuccagaaggggagaaacauaacaaugagccagcaguaacccagggaagggacagccgucacuccaggaccugcccagccccagucagcaccaccucccucccaucugcgauccacauccuauggcucugggcacagcugagccacaggacacagccacucagaacuuucuuuccagguuucccucaaaggccagccagcagcacuccucuguggcccugugaaacccagugacaccucugaccccuccggaguccggaagacuagacucuucugaaaacccaccuacgacagggugcguggaaucaccuuucaaaccaaacuccugucggcaaauauuuuaauugggccacggcauguguccgaguuuuucuucugugaagaggaucacugggucugagugcaaagcuggggccuguucaguggaguggacccgcuacuggccaaccucuuccucgcuuuauuacagggguguguaaguaaaacccucaggcccugaguaauuacugcuggggauuuccagcccuggucugaaacaaggaacugagacugaguuuugagucccagcagccccuuggcuugccucuccauuuucuccacaucugaacuguucccaccccgccugagauccccagccucuugggaaugcagcugugguagcaaaggggaaacccugugcugcccaaggucugaccaaccaauagucccaagggugcugagccugggcaggcccaaccgggcacaacucgcacaggaccaucacugguggguugcccuugugccaaguucuuucacgucauccucacaagcgcacucuacagauaagguaacugagggccaggaagguaauggaggucccggguagaccacacagcuagaagauggugaggccuggccuuccacuagccugacauggcuaccaaacacacagggcccaucuggugcuuugaguagguggggugaaggguaccaggugccaccagccuguggugaugucggcacucuguaaagacucuccugacgugcuccugcagugaaaugcacagguuacaaacaguuccuugaacccacacagggccaccuccacggucuccguguugucuaugccuuguccccaggaugccugagaggcaggaccagggugacccaggcaugcacgggccaccacagcagggcuucagauggcacuggagcccacuccccaccgggcuggcccugggaacagugcacauggagcacagacugcaguucugcacucccccaccucgguguccggccagccuuccugaccacccuggacggugggcggcacugcccuggcagccugugggcccgcaccugugccccacagcccacauaaccugcuccuugggcucaaaacagccccugcugaggccucaguggcaaagcaccuguaaaaaccgguucacuuuaaaaacaacaauggggauguugucggguuuuuuuuuuuuuuuuaaugcagaauggucuagacaguaauuuacaaaaacuacuuagcucaaaagacuguggaaguguucaucagcaagcaagcuguccuuccaaacccaaacaugccacagauggcacccagaaacagacagucugccuucaaugugcuaagcauucuaaugccguccgcggcugagucaccucgcccaccccccaacccccaacacacagucgugucugcugaggacacacgggugaaucaaacagggcuuugcugggagagugugugucugugauuugguucccgccacaccaagucuuccugcuucugacaaacuccgcacguguucccaggcagcugggagccaaacugccucuggugcaagucaguacaagaggcggcaccugcauccccaccccaccuccaccccaagaccccagcucugcccucccucucagcucuggaaagcgcagcccugaggggugcugcugugcuuacccucaggcgggccccacccugcacucuccgcucagccucauggggcuggugcagguccaccaggcucugcccagugaaggcaccuuccucugaggggaccucaugggagccucaaaccccaggggcaaagccucaaguucacagcuucucagaggaagaaugacacugggaggaacaaugacgggaaggugcaugucucggccacagccaccaagcucaccacuugaaaagcacuuccugcuggggcccuccugcuacucccaggagcagccggccaccugaguggucugucauguccauguggcccucccuguccugcagccacagcuccuguaaugcuugggcaaguaugcaauugcaugcuacaacucagcccgggggacgggaaaugccaccugaguacaggcagcacgcggagcccugacugaaccccaugagcaacucagaaagaggaagcccagggcuuggggcagaaguaggagcuccaucaguaggcaugccugacuucugcagcgagggaaacuugcagaugaagccaggaggcaggcagcgcugcucuccacagccacugcccccacagcguccuucccucccacuuucuguuuuuagcagcucuucccaaccaaacuaccaaccuagacucuccugaccucugcuucaggucugcagaacuuacgauucuuacugccauuuggcccuuugugaaggcacaagagcucucaaagcucaucuguaaauugacucguugcuacgcggauagaacuggagcagugggaagccaagcggaguccuggugauagcacgcugggugggggcuucucccucucagccucucucuucuaggagcagcugauaagaaugccagcugcagaagacuggaaaugacccaacauccucgggggaaacacacacacagugcucggcccauauauguuccgccaaagacagagcccaaauaagaacgagccagcuuuucaggaaucaacagggaacaaccuucaagagacugccaagcacagagaugcacacaacagcgcacccugugccgccgccuggaagauccuagcugaggcugggcagacaaggaccugaugguugagccgcgcauagcuguagcaggggaccgcaccuggccuccagcacugacgcaagcaagaccuaucacugacuggagcccaguuccuccucugagagcaugagaaaaccacaagauggugucuguagagcaugaauggugugcuggagaccacgcccccaggggccaggccacgaggacccgcacacugcacuuucugcugggcugcucuguggucuguaagauccauucaggcagggcagugcccagcacggugccuggaggcagccucagaggcccauugagagaggaagccgaaggagagcagccccccgccugccuguccaauugggcugcuguaagauccugagaacuagugaccuucuagaauuccccgagacaagucaucaaaugcucucugagcaccgacugcacacaggugcucuaccaaacucugggcccgcuggaugcugggagggggcguuaggaucccuguguacugacccggaggaguagacagagacagccaaggucaagaacagaagcaacagauaaaaugccaccacugaggcucucacccaggcugccaggaaaccccaggggaggacuacacuuggcucagguccagggccaccccuucccccacagcuccugggcucuguguggagcuggagggacaggagugggcacaggggccuucucauugggcauuccugcaacgagggccacggugcagagaaccaaggacacugucacccaagaaagagucuggugacucuguggaucccaugguaaccaccauuuaaggauggacacucacgcuaugauccagcaauuccacuccaagcagcaccuacagaaaugcacucagagcagcuguaucagaacagccccaacugaaaacagcccacgcagccaccaacagaacaccgaauaaauaaaucauggucuguccauucaauguuggaugaacaaacugcugcuacacauaaccucaaagacaaaucucaaaacaacguugagucaaagagccaaacacaaaaaaacacauuuuuuuuuuguccuggauuaaaaggucaaaagcaggcaagacuucuagauggugagagcagucaggguaguggcaggcagagaaugacuaggagaggacguugaagauggcuucaggggaaaggcucuguuccuuaaccuggguggacugggguucucagauguguucauaaauguucauucagcuguaaaacuugggacuuguacacuuuucuagauguauauuuucuagacuauauuuacaaagguuguuaaaaauaaccuacugugugugaauuccaugaucuuagaggccaccucauccuacagaaacagauggugaagcugucaggguuguggaggagggggagguguuggcaaagcagccccucguuccccacggcccagacccucugagagccccacagaacaaggucugaaaacagcuucaacacaagcccuggccaccucuacaacacacagugaugcaaugugcacugcacuucacugcucacugagaaacgugucugcacucuccugcccuggaugggacugaggaggacaagggcacucugaagcuuccccggcaggaguacucaacagaugaguguccccaggaagaagugagcacuaaugcuacuggaaagaggcaggcaggcagcacccacugggcauggugccagcacccugcagggcacuggggucuugccacaccauggucuccccugagaccacagauacgcccccuccacccccaacagguauuaagccacuuucccauccaagaagccagggugccagcuggccacagauucguuacuaaccuaaccugcuaccccaugcagccagcacacaccugccucc

SEQ ID NO: 15654 - RNA, 638 nt, Homo sapiens
cccgccucugccuugagauucuguaaaacugagaugcucauucucuuaaccaaacacgucacagaggaggaaacggaggcccaaggucaccuagacuucgggguuaagcccagaaccgcagaugucaaguuuaagggcgccccuccucccuccacccuguuuauugccuugguaauugcuccccucucucugggagcucuguuggaaaugcucuugugagacgggauggaaaggcaagcucggcggccucgggagaaaucuuuuuuuucccacuguuacaggaagaccuagauuuaaaacaggaggaagacagcugaugagaaccacaugugugccuuggagcugcccgacaccuguuagucuuguauuuguugugcuucugggaaauauuuucauuugcaaaaacggcugcuucugcacguggcuaugguugcgugcuucugcacaugugaaaaguuuuacaucacacuuggaggagaaaagaaacacgggcaaaacacuugucauuuacugcucccaaccucgccccucccagaaugcggugcauuguguacaugguguacaugguccaaguuggaaacuggcccauucggagauaauucucucauuucugauaagcaaaauaagcaaagccuucc

SEQ ID NO: 15655 - RNA, 9135 nt, Homo sapiens
aguaaguugcaaacaacagagaugguaaauaugggcagucccuggggaugagccucagugguugggguggugggagcugggugugaggggagaagagcccagagccugaagacugagcccuggaggggaaaagugaaaaagucagagagagcugucuuugaauccacaaaagccaagccgggggagccacaggaaggaaucacagaagugagagaccacuucaggcccuugggggccaguuggggaaugaugggcuggaaaguggacacuuaagcgauguugaggagacaccaggcugggaggcgggacaccugguuccagcucugguucugcuccuaacuaugucacggucccucuccauugcccaucuccccuauuggcaacacagaggugcugucauucucccucugcuucccagaggauugguaaggaacgacagaggucauauauagggacagggaaggguugaugccagagggaagaaagaaacugauggcgggccaggcacgguggcucacgccuguaaucccagcacguugggaggccgaggcggguggaucacgaggucaagaaauugagaccauccuggccaacauggugaaacccugucucuacuaaaaauacaaaaauuagcuggacgugguggcacacgccuguagucccagcaacuugggaggcugaggcaggaaaauuacuugaaccugggaggcgaagguugcagugagccaagaucacgccgcugcacucuagccuggugacagagugagacucaaucucaaaaaaaaaaaaaaaacugaugggugcuggggaggacugauagaacugaaugugcagggcuccaagggcauggugugugguuacaggaauaagcaguucgguuucaguauaaauagcuauccccagagccuugcaaagauggaacuggcugccuuguucaguagugagcuccccaccacuggagcugugaaggcagaagccgggguggggagggcgacuauaaagaggauuccuguguugguuagcagacuagaccagggucagugagcuuuuucuauaaagggccagauaguaaauacuuguggcuucgugaaccagauggucucugcugcaacuacccaguucugccauuauagcacaaaagcagcuacauaggccauagguaaaugaaugagaaugacugugcauaaauaaaaauauuuaugggcaaugaaauuugaauuucacguaauuuucacauaucaugaaauauuauucuucuucagcuuuuuuuuuucccaacuauuuaaaaauauaaagaccaucuguagcucgaguaccauacaaaacagacugaauuuggcauauggguucauaguuugcugacuucugaaucggagcagcuggccagaggcagaaugauggagcacacuguuccucaaagugggguaccagagcacccacacuggggaugcuugagggugcuuauccccacagugugcccaugugagcccuaauaucuugaagcuucuguuuccugauccguaaguacaggacccacauuagauccccaaguuucugucuugaggaugacagagcuuugucuagaaagggcuuuguaucagcuguacacauauuaguagagcccagggugagcuugagucagacugaauggucugaguccugguucaguccucaacagcuuuguuaccaggagcaaguuacuuaaccucucuguucuucaauguccucgucuguacaaugaggauaauaauagcaccuaucagauagggcugucguguuguugugcuauaaagcacuuccugccagacaggaagucucuguaauuauuagcuguugugauuuuucacugguguuaucauuccugggacccagucuaaguuaguagccaagcuaagugccagcccaagauucugacuccagugcagccuuugugauggucuuugugucccuggcaaaugagcggucacuggcuggguggccaccacauucacagacaggucagguuucaggcuguggggaggagcagauucuuacuuggaaauuaaggccuuugccuuccccuauggauagaacuggugaauagguuuuauucccuuagugagcucaaagaaauaagaguauagucccagacuuccacucuucugguuuuagaaaaaaaaaaacccaaacccucagugucuccuaauuagcuugaggccaucaccccaugagaagcagggggauucaggacaguuuaacucuuuacugccuuacuaaggagaucuugaucuaggccagugcccuccaaacuucugucuuucauguagcucauuugugauuugugucuacccccaugccaccuucauuauuauuuucguaggguuuucuuuucauuagcuuaucuguuaaaauuugaccucauccuauauaauuauauccaugaaaucauggcuuugauguucguguuuuuuuccuauccugcauuaaaguaaauaaugcaggagaggaaaaauuuaaugucccucuaaaaaugucuuuaaguuugcccaugagcccaccuggcaugaucccagguagcucauuuugaucacugggacguaagcagccugaaauggggucacagcuuagucuccgcaucagaagagcuggguucaggugccagcuccgccccuucccggcugugucccccaggucuccuccucaagggacacgggaaacuuagaaguugauagagcacugcaaagugcgguggagaaccacugugcaagcccugaggaggggaacugggccucgcuccugcuggggaagguagagaagggaaggacggagccuggagucuucccagaagggaaggacggagccaggggagaagggagggggagagaagaaccagccagaccacaggggcugagacagacagagaauuuagggacagacagaggggucuacuguuugaacuuguuuguguuggugcaguauaaacccuguagugguuaacuuuaugugucaacuuggcuaggccaggggagaaagauaguuggucaaacauuauuuuagauguuucugugaacguaugccuuagaugagauuaacauuuaaaucaccagacccgcguaaagcguauugcccucaauaacaugggugggccucguccaaucaguugaaggccugaauaggaaaaagacugaccuccccagaacaagagggaacuuggccagcaggcuccccuuguccuugcacuuggacagcaucuguuuccuggaucuccagccugccagcucacccuacagauuuucaacuugcuaagccuucacaccugcauaagccaauuccuuaagcgcucgcucuuucuccugugugugugugugugucugucucucucucucucucuuucuuucugcuaguuccuuuucucuuuuuuuuuuuuuuucuuuuuuuuuugagacggagucucacucuguuucccaggcuggagugcaguggggcagucuuggcucacuguaaccuccaccucccagguuuaagcaauucuccugccucagccuccugaguagcugggacuacaggcgcgugccaccacaccuggcuaauuuuuauauuuuuuguagaggcagaguuucaccauguuggccaggcuggucuugaacuccugaccucgugauccucccgccuuggccucucaaagugcuaggauuacgggcaugagcuaccacagccagccuaguuccuuuucucuagagaucccugacuaauacaaagcccacuccaccccugaccauccagauugucagcaauaccuuuuacacucccaaguggggagugaaaacaaaugccaucuguaccucagccagccacuucaagccucugccuucacagccucacuucuuaccuggggaguuuuagaaaaccuuucuuuaucucacugacauuuccuuuuguuagguacuauaguuaguuacaucgacuuuaacauuguggguugcggaagcaauacccucuguaagguauuuuaggguuucucuugugguuuaugguuaaaaaaaauacaggggagaggcagccaggguuuugaggaaggguggcucagcaaauuaggagauggauggaacuuuccacgcugggucuggaaagaguuauuccuuuggaaaauaguuuucaagacaaguuucuggcugaaaaaaaaauagcuucugcauauuugugauuuaaaaaucucuuauggggugcuugaaauucucaaucauguugugguugauauguuuguagaggauagcauuuauuuuggugcuugaaauguauacacuccuccucacacaucccuggaaggugagugcuuuggucaucuuuauucuguagaggaggaacugaggcacagagaggccgaggaguuacccaggcucacacagcugguaggugcuggagucugggcaggauuugucugugucugcaucccauccucccaacuuuuccaucucaccgauucccccuuagaacugaaagaggccaggcgcaguggcucacaccuguaaucccagcacuuugggaggccaagacaggcagaucgccugaggucaggaguucaagaccagccuggccaacaugguaaaaccccaucuuuacuaaaaauacaaacauuagcuggaugugguggugggcgccuguaaucccagcuacccuggaggcugagacaggagaaucgcuugaaccggugaggcggaaguugcagugagccaagaucgugccacagcacuccagccugggcaacagagugagacuccaucucaaaaaaaaaaaaaaaaagagagagaacugagagaccugcuggguuucccuuugagugacaacaucuguguccaucuagaaugaauucguucaguaguggcuucuucuguauuucugccuaaccuucuugaccacauugguuucauccucgugcuugcauucucacgguaggaagcacaggugaaaguaccaacugucugugucucuguuaccaagaaagcaaaaccuuccccaggagccgcccaagagacacccgcuuccaucucuguggccagaagucccagggcuacuucuggcugcaagggggucuagaaaagcuaaaugcugugagcccagggggagcaucuuccacaacuauuggagucagcuccacaugguaggguuaauaaaaauuucacauagucacugaguacaguaauagaaauacaguaucuagcaaggacagguaaauguggcguguggguucccacacugcauuuccagauggacagcauggcuggccuauauccagaggggucggucagaauagggugaaggcucuggagaucauuaucagaguggaguggucacagguccugaggauguuggaggacagauuaaggagggacgugguacuuuuuaaaaguauucaaagggucacgguggcucacgccuguaaucccagcacuuugggaggccaagacggguggaucacgaggucaagagaucgagaccauccuggccaauguggugaaacccugucucuacuaaaaauacaaaaauuagcugggcaugguggcacacgccuguagucccagcuacucgggaggccgagugaggcaggugaacuucaacccaguaguuggagguugcagugagccgagaucgugccacugcacuccagccugggcaacagugagacucugucucaaaaaaaaaauguauucagaggauugcaaguuggaagaaggauuaggauuuccacacaauagcuaguaagggaucaaugagugcccaaguguggagguguuucauuuacacuguuauaaagguuuauugugcuggugaauacagccucaucuuucauucagucauucagcaaacagguacugcagguuuaucauggcccaggucccaucugggguagacaguuaguccauuugugagcuauaaccgccacccuuaaagagcucacagacuccugggagagagagauguagaaacaaagagaucgcccaacagaguuauuuuaaucacuccacuaagcagugcuuagaguuguggucuguggaaaaugcuacuggcugcuagcuggaaggaauaggcccuggcgggguggggggugucagggcagacuccaccaggagaccugaccuuugaucugggcuuaggagcacgaguugagguggggaggagcacauuucuuccuggaagaagggcaguguguucagaagcacagaagccugaggagggugaugggguggcugcgggcgaucagcugagcuggugagugggagugggaggaaggacugggccaggucucagugccggcucccgagggcuucaguggagcccggugccuucagguccaugccguaguuguccaccgcggagcagucccgugggaaggccagggcagcuggaccucacuccuuaaagaggaauauuaaucacgaauacuuugagcugcagguaacaggaaacgcaaccagcagagucugaaaccaccacaacaacgcacuuuguuuaccuagcaagaagccugaagguuggcaguuucaggguggguuugacagcuccacgaugucucaaaacagccagacucuuucuuguucuguccuuagccugguggcuaaucagugaaauacagugauuguuguucugggaaggcaggguaggcaggggcagucagcaucgaacugagcaccuaggcagugcagagccucagucggucauuccaaaaguauguaaugccccccucugcucuguugcaccagaaggugggccccagaaggucugccccaggcaggcagaggcagucuucacagggacagagcagaguggagagcacacaaguuuggagcacgcaggccuggcuuugcaucuagcaagucacaaaccucugcacauuggcugcccccacgacaguuggggauguggggaggugacacaaauggagguccuccgagcauccugcacaggcugacacuucuucacugaaugauggcugucauuguucuccaugauguuguuauugucauggugcaggaugaggagugacacggucuacccagaaggaggcaccacugaggagccaacccuggguggggcuuagaagaugaggggaguucggcugggcacgguggcucacgccuguaaucccagcacuuugggaggccgaggcggguggaucacaaggucaggaguucaagaccagccuggccaagguggugaaaccucaucucuacuaaaaauacaaaaaaaaauuaggcgggcgccuguaaucccagcuacuuugggggcugaggcagagaauugcuuaaacccaggagacggaaguugcagugagccgagaucgcaccacuguacuccagccugggcgacagaacaagacuccgucucaaaaaaaaaaaaaaaagacaaggggaguucaggaguucagcugacucauuccuccucuucaucagcacaccuggcacugucucagcaccuggucuuuccugccauggaaacgaccuuuuggaauugucaguuguggccucccacuggacuguaaaccaccacuggggcaggaccuugcuggauuugcucacugacgucucccuguagccuggacagguguugagaauguuugagaagcacauagcaucgugguuaugaauauggacuugagaaccagacuucucuggcuuugaaucugcugugcaucucacaaacugugugacugcaggcaaauugcugccuucuccaugccccugaguuuauucauccucugucuuaaagguuguggugacgggugacugagggugugacgugcuuauuagucccaugccuggugcaugcugagugccagaugagcaugugaacuggaugagccugacugaaugaggaauggcauugcagacagaagcucagaggcgugagagggcaagccacauagaggaaggggguacagcugacuguggcugacgccagccccuggagaguucaggcuuuugauccucaggcagugagggugauggacaauguuuaaacagaggaaguugugcuuggaguuauguuugaguagagcguggaggugacagugcaggccuggggagguggcagcuugagccagagcugucucagugaucaugagacuguuggaaugugcaggaugggagcgagcgggcuccaggcugcuucccagaaggcugguguggaaaggggugauacuggccggacacagugggcaguggcucacaccuguaaucccagcacuuugggaggccaaggcggguggaucacuugaggucaggaguucgagaccagccugaccaacauggugaagccccaucucuacuaaaaauacaaaacuuagccagguguguuggcagguaccuguaaucccagcuacucgggaggcugaggcaggagaaucgcuuaaacccgggaggcagagguugcagugagccaagaucgugccacuguacuccaaccugggugacagaacgagacugucucaaaaaaaaaaaagaaagaaaggggugauaccauaccauggcccccaucucugauccugcccgugguguggcgugucuuuggugacuacucauucuuucucuuggcccaagucauagucauuguagcucgguuacucauugcuagccuuuccugaugucauacugacauugucuggcugcaaggucacaacauccugugaggcaggcagucuuauccugauuuuacgggugcaaaaacagagacucagaggggcuggaucuuugcccacauucuaugaguuaggucaggccagacucgucccacuccacccucaucuccaugaggggcaggugggucuugccaucaugccaggcagauuaucuggagcccuccagggaggugguaucugcaccagacccaauagggagaggacagacugcuguaaggacgcacaggugcccagugauccgaagccacaggcuugccagccauaaacaacugcaaagccgccugaugacagguggaggauugcagggcccgguucugucaggagcuggaagacaagagcacagcugcuacccggaggcccuugaagguuacagcuccgaggucggggaaucaguugucauucucuugguaacuggcaaccacuguccguguuuuuauucccccuucuuaaaauagcaagcugaa

SEQ ID NO: 15656 - RNA, 13154 nt, Homo sapiens
ucaagcuacuaucagacaauguuguuuauuauuucacacaaaaguuagaccaaggccacagugccguuaaacaccucccuccccacccacgcauggcucaaaaaccaccccaacccugcuauaaaaacaacagaacacaacaaaaauacugcauuugaggcugagccaggaacagaguggcuccaacaaaaauaagacaaaaacacaagacacaacaucuuuucagguuuguguaaaaauugccauggcccacggggaaaguggucauggccgugucaacaaggauacuugaaacucagggcuuuuggagguuugagacagcugccacauuagggugucuuccaggcucugcugcaggaacugaggaugcugaagggcagggcugaucccuucgcccccucugaaguuuaggccauugccuggaugugcuuuucguuggggaagaugccauaggcuccuuccuccuuuccagagagagggacacagugagagggcuggaggcccugaaagccuucagugcccacgguaaggaagccagccaagagaauucccucucuagaaagaaggccuuccaccggacaaaguucauggcccugggagccagcaugccugcauucacauggcauaaagcccuacagcaacugucgccaccagaaagcugaguguaaggacccaucggagaagcggagccugggagcggguguugagugggggcuucccucugggagucuccacgggggcagaaucugaaagagaaaauggggcaaggucauuaacaggugggcgugcaucagggugucugaugucauaggaaagcaaagcagagcggccucagggucugugguacagucacugcccaacgccaggauucugcaagaccacagacaggugucccucuagccacugcuugaauaccuucaaagacgggcagcucacuacuucuucaagcugucuguucuucccugugcagccaggccacauugugaaaacauucuugggcccaggcgugguuuucagacuucugccugcucccuguccucuccuuaaacuuugccagcaauuaggucugagcuguaaaucuuccucucaaacucacacguuugcuaagcauggugaugauggggcaggagcuagaaagcaggagcucugaggucaaaauucaaguucagucccaucccugguuauuaaaaugugauagggccgggcgcaguggcucacgccuguaaucccagcacuuugggaggccaaggcagguggaucacgaggucaggaguucaagaccagccuggccaauauggugaaaccccgucucuacuaaaaauacaaaaaauuagccggguaugguugcgagugccaguaaucccagcuacucgggaggcugaggcagagaauugcuugaacccaggaggcagagguugcagugagccaagauugcgccacuguacuccagccugggcaacagagugagacuccauuucaaaaaaaaaaaaaaaaaagauuuaaaacaugauaggccagagccaaccaugcaaccuggguagaugugccaccugccuccucaggcacagagugggugcucccuaggucuuuagaagcaggacagaguccagggcaggucucuggagccagaccagcuggguuucaauccuagccccgcccugggcuaugagaagggcuuccccagagaaaacagggccuuaggucugguggcccagggcugcggucacaggaaguacaagcaagcaagcaagcaagcagguacacugugacauuuacauguguguuguucauauuaaaggcuccugcuccuucugaugcauuaggggugcaguucucaaauguuuugguuccaaaacuccuuuauacucaaaugcaaccaaggauccaaaagagcuuuuguuugugugaguauagcuaucacuauuuacaaaauuagauauuaaaacugagaaauucuuuuucuuuucuuuucuuucuuuuuuuuuuuuuuuugagauggagucucgcugucgcccaggauggaguacaguggugcaaucucggcucacugcaaccucugccucccggacuuaggagauucuccugccucagccucccgaguagcugggauuacaggugugcaccaucacacccagcuaauuuuuauauuuuaguagagauggggucucaccacauuggccagguuggucucaaacuccuuaccucaagugauccccgugccucagccucccaaagugcugggauuacaggcaugagccaucgugcccggccaaaacugagaaauucuuaacauacaagaacauacaggcacacauuccaugagccaucaaauccaugagagagcaucacaugucacauaaccuuuggaaaaugccaacacacauucaugagaaagugaaacucuaauuuucucauuuauuuuuggcuuuuuuaaaaaaagccaaaaaaaaaaaaaaucugggugugguggcacgugccuauagucccaguuacucaggaggcugaggugggagaaucccuugaaccugggagguugaagcugcagugagcugugauugugccacuacacuccagacugggugaaagagcgagacccugucucaaaaaaaaaaaaaaaaaaaaaaaaaggccgggcgcgguggcucacaccuguaauuacagcacuuugggaggccgaggcgggcggaucacaaggucaggagaucgagaccauccuggcuaacacagugaaaccccgucucuacuaaaaauacaaaaaauuagccaggcaugguggcgggcaccuguagucccagcuacucgggaggcugaggcaggagaauggcgugaaccugggaggcggagcuugcagugagccgagaucaugccacugcacuccagccugggugacagcaagacugucucaaacgaaaaaaaaaaaaccaaaaaaauaguaguaguguuauaaaaaugcuuuguccucacagaccccguugaggggauacuaggauuaccaccucccacagccaggguaccacacuuugagaacugcuucauuagggugacgucucccuaccccaccaaauagccaagcccuccgggguuacaaaccccuagcagagggguccguguggucuggcacaagugagaaagccacaagccagguagguuaggguggcacaggaggggaggccuaauauaaccugccaggagguagcuaagccuuaccucuuuauugcuacccaucccaaagccacacucccucccucaguguuuuaggcuuagugaggguacauuuuguggagcacuuuggucuuuuuggaaguuuccaagauguuucaguacagccagccuugaucguucuuaggcacaugagggaggggcucacacacaacaagacucagaagggacaucuuccugugguggguucauagcuggauacagguccccaacucccuggcccacaucaggggaccaaaggccuaaaaaggagucuaaauuaaggaggcaggaguuucccaugauuucugagggguucuugugcacuucugagccaauaagcuagaaguagcugaaccucacuggauuuuacggguggggaaacugagguagggagaagucucauggcuugcccagagccacacgcugaagguugaccccagguccuuuugccugcacuccacuucucauacaaaaacacgcagguggccgggcacagugacucacgccuguaaucucagcacuuugggaggccaaggugggcggaucaccugaggucaggaguucgagaccagccuggccaacauggugaaaccccaucucuacuaaacauacaaaaaaaaaauuagccaggcaugguggugggcgccuguaaucccagcuacucggggggcugaggcaggauaauugcuugaacccgggaggcagagguugcagugagcugagaucgcgccacugcacuccagccugggugagacuccaucucaaacaacaacaacaacaaacauucaggcuggcaugguggcucgcgccuguaacugcagcauguggggaggcagaggcaagaggauugcuugaagucagguguucaagacuggccugggcaauauagcgagaaccuguccuuacaggggcagugggguggggcagcaggaaacaacacccaccaccaccaaacauucagaaaacagaggaauagagauacuacagucagacagccaagucccuccauguguagcccagaggaagugccccuuccuggaugcucucaccuugcacuuuguugcuggcccgcuggcgaagcccuggugcccgugaggggcucugguccuuggugucaugggucagcagcuccugcaacuccucaaagagcuaaaagacaaaagacacacaugccuaucucagugagagaugcuaccaggucccagcugaagguaggaccuuaaguuguguuaggaaauacuuuggaaauaacaagaugguaagaaaaauauuggccggacacgguggugcgccccuguaaucccagcacuuugggaggccaagaugggcacaucacgggucagaaguuugagaccagccuagccaacauagugaaaccccaucucuaguaaagauacaaaaaauuagccgggcgugguggugcaugccuguaaucccagcuacucgggaggcugaggcaggagaaaugcuugaaccugggaagcugagguugcagugagccaagaucgccccauugcacuccagcccgggugacagggcgagacucugcaagaaagaaagaaaagaaagaaagaaagaaagauagaaagaaagaaagaaagaaagaaagaaagaaaggaaggaaggaaggaaggaaggaaggaaggaaggaaggaaggaaggaaggaaggagaagaaagaaagaaagaaagaagaaagaaagaaagaaagaaagaagaaagaagagagagagagagaggagagagagagagagagagagagaaaagaaagaaaaagaaagaaagaaagaaagaaagagagaaagaaagaaagaaagaaagaaaauucauaucccuuucauccaccuuaagagauaagauguuccaagcccaauuggcuccccugccugcucuugcccucccaaccgauaacaaugauccuggauuuagaguucacuguggccgcccauguccuuagccugugucuccaugcaaaaggcugcguugcuuguuuugaaauaauauuaagugguauccuaguacaugcacucuucugccgcugcuuucuucucuugaguuuagauuugugaaauucagccuuggugaggugugcugaaugguauuuguuagccuugcagaugaggaaacuguagcuccuacagguuaagugcuuugcccaaggacugauccagaggucaggcacuaagagccguuuuuuuuuguuuguuuuuuguuuuuaauacggagucucacucugucucccaggcuggagugcaguggcgcgaucucugcucacugcaagcuccgccucccggguucacgccauucuccugccucagccuccugaguagcugggacuacaggugcccaccaccaugcccagcuaauuuuuuuuguauuuucuuuuuuuuaguagagaugggguuucaccguguuagucaggauggucucgaucuccugacuucgugauccacccgccucggccucccaaagugcuggaauuacaggcgugacccaccacgcccggccagccaagagccguuuuuuuuuguuuuuguuuuuguuuuuuugguuuuugagacagagucuugcucuguugccguugcccaggcuggagugcaguagcauaaucauggcuuacugcagccuugaccuccugggcucaagcaauccucccaccucagccucccaaguagcugggacuacaggugcacgcuacuaugucuggcuaauuuuuucauguuuuuguagagauggggucucacuguguugccagggcuggucucaaacuccugggcucaagccauuuuccugcuuuggccucccaaaguguugguauuauaggcacgagccugagagccaguucugauuccaaaucccuuuucuuuuaaaaacauuuuuuuccuuuaaauuuuuuuuuauuuuuuauuuuugauagagacagggucucaccauguugcucaggcuggucugaaacuccugagcucaagcaauccgcccaccucggcuucccaaagugcugggauuacaggcgcgagccacugcaccuggcccuuuucuuuugccuacacuucucugaaagacacagauuuucuuccuccaagacggacuggauuuucugaagggggaggguggaagggaaaggccuuguuccguaacaggggccaggaccagaaucuucugcaauccacggcugggaguagggagccaggagggcaugaccccgagccccaggccccauggcaccuccaggggguggcagagagagaaggcucuaugacaucugguuagaaggagccccucaccccuccaccucugcccaagaauucauccuuccaggcuuugcgcaaaccccaccuucccccuggauuugagacacuuguagaaagagguaaaccucucuggcuaggcugagagucccuggaaggcagaggccaccuguaacccugggagugccaaccuggcuauacacuagugcacacacaacuuauacauugccacagacuguugucacagagagcuacaacugauucucaugucccauuaugacaguagugaauguuugagggcuuccucugugccagacacugcuguggggacuuuacugcuguaaauucacucaagccuuauaagucuaagauauagguaccauuauuaucccuauuuuacagauagggaaacugagguacagagagaugaaggcauuugcccaagaucacccagcuaguaaguggcagugcuggaacucugguucccuguguuaaccaugaccuauagcacccuccccuacaaugagaagggucccuuggaggaacaacggggggaggcagaggcugccccaggcugcccgacccucaccuggauguugagcaggaacgcagucuuggccucuucuaucacccucugccugacugcgggagucaucuccagggaguucaugcgggagcgguagagcugcuugaacuugguggcacuggcaauguuggggaaggugaagaaggccaggcccucgccagagcugggcagguccagggcuuucugggcaaucuuuuugagcaccuggcccccagacaggucacccagguagcggguguaggcgugggccaccagcagcucgggcucugugcgccccaccucguggagccgcuucacauagcgcugcauggcugguguguaggggaugaccuccugccagcggggcccguaccagaaggccagguccugcuccagggcagccuugcggugcagcucuucugggaaguagacaggggcgaagacugggcucuccuuguugcgcucaaucuccuccuccagggccacauagaugugguacagggaggccaucaccagcugaaagcagagugagcaggucaggccgccagccacauagaagacccccaccucuguccgucccguccacuacugccuuuggaaaggcccuccucacuucgcagcugggcucugacuccuucugccaccccucgcuacaauccucuucacacagcagccagagggguuuuuacaagaggaaaagacgaucaugcacuuucucagccuaaaaaccuuuuaccccacugggcaaaacaagcagccuaauugaauccuuauauaaagaucuaacaaacuggcccagugugguggcucaaaccccuguaaucccugcacuuugggaggcuaaggcuggaggauugcuuaaagccaggagucugagaccagccugggcaacauagcccaaaacccaccucuacaaaaaauuauuuuaaaaaacuagcuggcuggggccaggugcgguggcucacgccuguaaucccagcacuuugggaggccgaggcgggaggaucacaaggucaggacaucaagaccauccuggcuaacaaggugaaaccccgucucuauuaaaaauacaaaaaaauuagccgggcgugguggcgggcgccuguaguuccagcuacucaggaggcugaggcaggagaauggcgugaacccgggagguggagcuugcagugagcugagaucucgccacugcacuccagccugggcaacacagcgaaauucugucucaaaaaaauaaauaaaaauaaauaaauaaauaaauaaacuagccagcuggacgcgguggcucacgccuguaaucccagcacuuugggaggcugaggcaggcggaucacgagaucaggaguucgagaccagccuggccaagagaccagccugggcaauauggugaaacccuaucucuacuaaaaacacaaaaauuggccaggcaugguggcaggcaccuauaaucccagcuacucgggaggcugagucaggagaauugcuugaacccaggaggcagugguugcagugagccgagaucacgccauugcgcuccagccugggcgacagagcaagacuuugacucagaaaaaaaaaaaaaaaaaaaaaagccagguauggcugugggggugcaugccuauagucccagcuacuccagaggcggaggcagggguaucacuugagcccaggauuucaagguugcagugagcugugaucauaucacuguacuccagcuuggggaacagagugagcaagacccugucucagaaaaaaaaaaaaaaaaaauccaacaaaggaauugcuauucccauuuuacagaaaaggaaacuaaggcucagagaggguaugagacauggagguugcacagcuaguaagaaaugaaacuagauugaagaccgggcauugccagggacccaccauggcucaggagaggggaacagcugaaaugaaagugcuuaaaggagauuggccaugugcuucuggcuuuugaccucugcguaaccaacuacagggcacaauucuccuuccuggaggccuauucugaaccccaccaccucugcaugcugggcugaggcaacaggucuugaguguaccuuggcuuggggcacuaacucccguuacacauuaauacgcccguuuaaauuugaaggagaacaaaguuaagacauuuagguuggaguuucugaguuauuucugagccacaaacauucaaagcagcucuauuccuugaggggacagaaagccaggcagucugguacaaaagagccuggguuuuugagugugacggaccugguucuuacccaacucugccaguccuuaacugugugaccaugggugagccacuugcuuucucuggucccagcuuccuauccuauccuagagcagaugaucugagguccgugugacugugcuagccaacugugcuagucaguucccucaccugccacauacuagauggggcuggugugaggauuaagugagaggaucugggccagcacagagggcagccuggcacuuagcgcucacaugagaagggcugugauaagugccacguccaccagcuuaauguaagugagcacuggauucucucauggaucuuggcgccuccuuagaacccugugacuuagaggcaaaauccaaagucuaagcuggcuggggaugggauauuccagcauucaccucccugcacccacugucuccagucacacugcagcaacuggguguaccucaucuuuuuaagggagaggggaggaggaugaggaagacccauuacaggcccaaggaccccacccagccuggaaccacagauuaaaucucuccucauuaaagcaugucucggccgggugguggcucacaccucuaaucccagcacuuugggagaccaagacggguggaucaucugaggucaggaguucgagaccagccuggccaacaugguaaaacccugucucuacuaaaaaaauacaaaaauuggccaggugugguggugggcaccuguagucccagcuacuugggaggcugaggcaggagaaucgcuugaacuuaggaugcggagguuucagggcaccgagaucuugccauugcacuccagcccggacaacagagugagacucugucucagauaaaauaaaauaaauaaagcaugucucauguuggaaguaggggguggcagagggugcagauugcaaaagggacugggaugaagguggugggauauagcucccuacuccccacccccacacccucuguucaaccugaacaagcucuuccccacgcugauguuuuaacacccaguaucuucccgguucuucaucaagugcuuuccuucuauuugcaugaauuucacaacagugcugggaaacagcaaaaucaguaccuggcauauagugggugcuuaagaaaacccugcuguugaaauacucuuuuacagauggggaaaacguggcuuagggagauuagaugaggcacccucagucucacuguuagaaaaggguucuguuaagacuccaaccuauauuauuccuuaucuucagaggcaaauucgaguuagaucaggaguacaagcucugaaauacaaggaguacaaggcugaaaucggucuugguugauuucagccuuuuccacuuacuggcugugugaccuucuguuagucacugaaccucucugagccuuccaguccucaucuuucucgucaggguugaagcacagauuagaaaccacguguacaaaaugcccaacauggaaccggugcucagucaacggcacugcugccccagccccuccacaacauuacagagcaggcugaacuugcugugugaccuuggguaacucaccuucccucucugagccucagugucaucauuuuuaagaugauucuauuggacaugcccaucuggucccucagcauccccacuuaaaccacuggucugagccuuggguccacccacaccugccacacccuccaccagggcuagucccaccaagccacauaccuugaagccgucucgggucaccuggcccuucugaaaguuccucaugaacucagcauucucugccugggugugcaccuccuugguggccuccuucagggccucugacaaauccuggggcaugcugaggaggaaaugggaaaggugaacacaaagcuggcugggggugggguccuucccaacugcugagccucccaccugugggcaggccuucaagagacucccauccucauucaggccacguucucaaucgcuuuaagaugcagccuuguggcugggcacgguggcucacgccuguaaucccagcgcuuugggaggccaaggcagguggaucaccugaggucaggaguucgagaccagccuggcaaacauggugaaaccccgucucuacuaaaaauacaaaaauuagccgggcaugguggcaggugccuguaaucccagcaauuaugccuguaauugcuugaaucccggaggcagagguugcagugagcugagaucacaccacugcacuccagacuuggugacagagagacuccaucucaaaaaaagaaaaaaaaagaaaaaaagggccaggcaugguggcucacgccuguaauccuagcacuuugggaggcugaggcgggcagaucaccugaggccaggaguuugagcccagccuggccaacauggugaaacccuaucucuacuaaaaauacaaaaaaaaaaaaaaaaauagccgggcaugguagugggcgccuguaaucccaacuacuugggaggcugaggcaggagaaucgcuugaacccaggaggcagagguugcagugagccgagaucgcgccacugcacuccagccugggcaacagagcaacacuccaucucaaaaaaagaaaagcaaaaaagcaaaaaaacaaaaaaacaaaaaacaaaaaacaaauucaggcugggcaugguggcucucgcagcuuuguaaacacucuucagucauuaaaacacuaaauaauacagucccccaaaccaagggggaaauccugguacagguaguucgcaguggagaggaggaggagguacagcauaacccaggaagaagcagcagccccaugaaccggcaucuccaaguuuguaauugcuuugauuggcuuuuagacccaauauuuaauucaguuauuuuguuaaaguuccagaugcaaaucucaugacccccuaucauguuaugcucaucaugaaggcgucaggguuaaaaagccugagaaagucugcuuuagucaaagaaaaagucuuucugggaguauuucugucauggguccguaucccugccuccccacagaauugucauuuuucccuuuucuccugcccugcuucccuguucuacaacacagcuggucaaagucucaggagaaauggcacaugucuguaagucccagcuacucuggaggcugaggugggaggaugcuuaagcccaggaguuaaaaaaaaaaauacuaacaaauuauugaaagaagggaaugagugagaccuggaggugggcagaccaagguucaaggcccaguucugacaccagcuaacugagcacucuugggcaugucgccucccugaacugggcuaucugugagacauggaacaccgcagccagggugaugucuggcucagguccuccguagcuagugagggacagaugccaccaagagaaccaagcaugcucccccaggcuggcagagccccagagaucuagauucagcagagagcaacuccaaacacaccucgaaaguaggauuaaaaaaaaaauuggcuaccucaaagacuggauacucuagggacacucccaucuuggucaccaaccgcauaccagggugccaggcauguaaauuaccguuccucccuccaacuacccuacgggcacaggcaggaucagaaccccgcaccuccugacuccagagcccaaguuucuggcuccugggcucugucgcuguguggcagugucccgggguggggcuaggacgcaagcaggguugggagagaaaggcgcccgucccgcgucccgcgccccgcgcuugccugucggguugcggacgcuccauccggccggugcugggcucguucgugcuggcuccgcgggcggcggcugcgcugaggacgcucgagaggaggcaggcguugacugccggagccgcggccggucacauuuaugcucg

SEQ ID NO: 15657 - RNA, 25216 nt, Homo sapiens
ccggcgaaccaaugggagcgcagcggcugcggcguccgaacaccgccucuuguuuuucccgcgaaacucggcggcugagcguggagguucuugucuccccugguuugugaagugcggaaaaccagaggugaggcuagugggagugggacugggacugggagccagcaggcaucuggauuuccggguguaguuggagugggacaggaguuucucgggaacugggguuggaguccgggagcgcggccgggggucccccugcuccggacucagggcagggacccaggcgucggaggggaggaggugccaggcgcugcccccagccuguucuggccguuuguucccaccccaggcgcagucaugucgggauucgacgauccuggcauuuucuacagcgacagcuucgggggcgacgcccaggccgacgaggggcaggcccgcaaaucgcagcugcagaggcgcuucaaggaguuccugcggcaguaccgagugggcaccgaccgcacgggcuucaccuucaaauacaggugcggcuccugcggggccgggggcucgaguuccaguguggccgcucacacgccucuaccagccugcuagaguccuggacagucagggcacagaugggcccagacgggggaaagagccgguccugggucacagggcucaucccggcagccucacgccuugguauaaggcuuuguguauuuuguuuuacuuuauuuuauuuuauuuuauuauuaacguauuuguuuauuauuuugagacggagucucgcucugucgccaggcuggagugcaguggcacgaucucggcucacugcaaccuccgcuucccggguucaagcgauucuugugccucagccucccgaguaggugggacuacccccgccaucaccacgcccggauaauuuuuuguaauuuuaguagagaugggguuucgccauguucgccaggcugcucucgaacuccugaccucaagugauccacccgccucagucucccaaagugcugggauuacaggcgugagccaccgugcccggccugcuuuguguauuuuaucuguaccuggaguuaacuucugggugagucaccuguugagugggccaccagcaaccagcuagcgccacuuggaccguuuaguucuuuauccagaucuuguuccuguucaucugcuuccuaucauccuuccaugucaugucugagaccuuacaaacucaaguucccuguagguguaaaaggugaagauggcaguuaggauucacuucacuucgcucauucauuuauuuauaccagucuugcaccuucauugauugagcaccugcugccugccagauacuguucugggugcugggcugcagcacugaagcuggaccuggcuccugcuucuaggugauuguacgaccugugacaucaugagaauucucauaggcccggccucuaucccugaaauguuaaaaugcagagaacaugagguugcagguucagcacuggcccauuauuagcugagugacuuccaggugucagugucucugggccucaccaggccagaaauggguaaagccauuccugcuuucacuuacucaugcagcagcugauauugcccaccugugugccaggcacugcgcuacaaagaugaaaagacgugcuucuuguccuagagaagcuccuaagucagaggagugagucgugaagaccaacagauaacuuccacgguggucauuuccuccacagaggaaggugaaaggacuuagggaaguuuuccggggggcugaaguuugaggggaccuuugagcuaaggucagaguugcagguguagaaagcuuucugucuagguaggagcaauugcuuguguagaggugugggguguccucacagcaaguggcuuucaguagcagucuggccauuuuacuggcuccuggacauaagggagacggggcucaggccugugauacugcgaggcuggggaacagccugugcguuggucagugguccccaaauauguucuugccacagcagucacaugggaugcucugcuaagcaucugggcuggacgcaguggcucaugcuuguaauuccgacgcuuugggaggcugaugccaauggaucauuugaccccaggaguucaagaccuggcugggcaacauagugaaacccaggcucuauuuaaaaaaaaacagucugacuagagguugauaaggcagauguguuuucugcugccuuggugccuccaguuuuuuuguuguuuuguuuuuuguuuuuuuuuuuuugagauggagucucgcucugucacccagguuugaguacaguggcgugaucuuggcucacugcaacugcugccugccggguucaagugauucuccugccucagucccccaaguagcuaggauuacaggcauccgccaccacacccggcuagguuuuuuuuuuuguauuuuuaguagagaugggguuucuccauguuggugaggcugguaccuuuuugguuuuuuuuuuugagacagagucucagucugucgcccaggcuggagugcccuggcgagaucucuggucacugcagccuccaccucugggguucaggcauucucaugccucaguagcugggacuacaggcguaugcuaccaugcccggcuaaucuucguauuuuuaguagagacuggguguugccauguggcccaggcugguguugaacuccuggccucaaguaauccacccuccucagcuuccuaaaguguugggauuacaggcaugagccaccucacugggccccaaguuugagcugugugcauuguucuuuuccaagagaaguuaaaggcucugcggaguccuucagugacagaacugguuuguuguuuugugcacgcuggccuggguguugaaacauccuuugacugucuuguggaccccuuccauggagcuuucuuuagggcaugccugugccagcagugaguagccucugcaggguuaaauaauggaaugaucuggaauuagauguguguuugggaagaggaauggugaggucaugguggcuguggugugggcagauucaggggugcaggcacaccucagccaguguugguuuccucuucuuugcacccuuccugccccacccugcuaugugcccacuccagggaugaacucaagcggcauuacaaccugggggaguacuggauugagguggagauggaggaucuggccagcuuugaugaggaccuggccgacuacuuguacaagcagccagccgagcaccugcagcuggugagugggaccccaucccugagcuucccagggcugcucugccccaguuacuaauagccugugcccuucccuuucuccagcuggaggaagcugccaaggagguagcugaugaggugacccggccccggccuucuggggaggaggugcuccaggacauccaggucaugcucaagucggacgccagcccuuccagcauucguagccugaaggugggucggagggcaguggcugcugcauggugcagagggcuuuggaugcagccagaccugagugcuagcuguguggccuugagugaggcacuugaccuuucugaaccugucuccuccuggagacaaaaggaucguuuguuguuuuuugcuuuuuguuaugaaaaauuacacacccaaaagcagagaguaguauaaugaaucccauaaagcuucacccagauuuaauaauuaacauuuuguguuguuuccuauuuuguccuuuuucuuuuuugcuaaagaauuuuaaaguaaauucaugcacaguggcucaugccucuaaucuuagcacuuugggaggccgagggaggaagauugcuugauaccgggaguuugagacccuggcucuccaaaaaacaaaacaaaaaaaaaacaaaaaaaacaaagcuagguaugcuggcauaugccuauaguccaggcuacuuggaaggcugaagugggaggaucaaggggccuaggaauuugagguuacagugagcucugauugugccucucagcacuuuagccugggugacagagcaagacccugucucuaaaaauaaaaaauaaauuacagacaugacacuuuaucccgaaaaaaaaaaguuuucuuacauagucucauuagcaccucaacugaaacaucaaagaucucuuaguaucauugaauauacagucuagauucagauugaccaaauuaccucacaugacucuuacagcucgugugucucagccaggaccaggcauuguacuggauuguuguuuaaaucucuuuuaauccaggacagcuuccuuuacucuggguguaaguucuuucacagauacauuauugauuugcuaaagaagcaggagccauuauccuguagaaugugcugccuuuuagauuuaucugaaggccuccuuggggugguuacaacauaccccuucccccccgugauuuuuggaagcuggaaguuagaugcaaaggccugacuguguuucgauuucacauaccgggcaagaacgcuuaugggugguauuggaucccucauugcaucccuccauccacuaugcugagacugaccaggugcuagguugagguggugauggucacuuuauuguaaugaugcaggcauggagucuugaauuccgccuccccagccucgcuucugcuucccacagccucuuccugcuuucuuugagagccccagcaaaacuucugcucaugucugguucucucguucagccggaggagggcauugagaaacggagacaagguggagagagauugucccaguccuguacacuaguggcucaggagcuuugugaagggcaagggcuggccauaggaaggaguggaucggcugagaauuuauguuuuacuuuuuauuauggauaauucaaacauuagaauauaaagagaaucguauaacgaauccucuuguacucaucacccagcuuaauaauuagcaacuagaggccaauuuuuuuuuuuuuuuuuuuuugagauggaguuuuugcucuuguugcccaggcuggagugcaguggcacgaucucagcucacugcaacuuccgccucauggguucaagugauucuccugccucagccccccaagugguuggaauuacaggcacacaccaccacgcccggcuaauuuuuaguagagaugggguuucaccauguuggccaggcuggucucgaacuccugaccucaggugauccauagaugccaaaucuuguuucaucuguggcccuggaguucuuuugaaacaagucccauacaucauauaauuugaucuggaacuauuucuccauguaucucuaaaagaugaaucucuuuuuuuuugagacggaguuugacucugucgcccaggauggagugcaguggcaugaucucagcucacuguaaccccugcuuccccgguucaagcaauucuccggccucagccucccgaguagcugggauuacaggcauaugccaucacaccuggcuaauuuuuguauuuuuaguagagacggggauucaccauguuggccaggcuggucucgaacucccgaucucaagugauccguccgccucggccuuccaaagugucgguauuacaggcgugauccacugcacccagccuuugaagagucauuuuuaaaggcauagcuacaauaacaucacacuuaaaaauuaacauuacggccgggcgcgguggcucaugccuguaaucccagcauuuugggaggccgaggccagugaauugccugaggucaagaguucgagaccagccuggccaacauagugaaaccccgucucuacuaaaaauacaaaaaguuagcuggacaugguggcaguuaccuguaaucccagcuacuugggaggcugaggcaggagaaucgcuugaacccgggaggcggagguugcaguaagccgagauccugccauugcacuccagccuuggcgacacagcaagacucugucucaaaaaaaaaaaaagaaaaaagaaaaaauauuacugccuuauuguccggugugggaauagucauuaagauggggaaacugaggcucaaagagaagugacccagacagaagaccacacagcagguuuugacagaacuugaacuagaaugugggccccugccucccagguuuguucuguguuguacucuacagguccaaggaugucgccaucagagcuggggucaggucucucuccuggcaccugccacuuuguagugaaaugugcuuaguguaucucuugcccugccaccuccccccccaauugugcugcgaggucuuuaaaagcaggagcugugccugaggcuccucugaaccccaggguccagauagccuggcacuggguggaugcucuggaagcauuuuuugagcggaacagaagagcuguggcccucccugcagcucugugcccaccuccuccaggcuccugcccaggauauuuacuggcauaucucagaugcguccuggcuccccuuaaccaacaagcuucccgauggcucuauuacagucggacaugaugucacaccuggugaagaucccuggcaucaucaucgcggccucugcgguccgugccaaggccacccgcaucucuauccagugccgcagcugccgcaacacccucaccaacauugccaugcgcccuggccucgagggcuaugcccugcccaggaagugcaacacgugagucuguggcccagagggacugugggaggugaccugagugaagaucagaaaggaugagaacaaguagcaagcacugccugcagcugcuucuagagauccacugggaugggcugggcaggggugugcccuuaggauuggcacagaucugaugcccuguggcucugagacaccaugaacagggucccucuacauuggugacuucugucucaccaggauacccagacagcguuguagggaacccaggguugggagggaaaagcaguccaggguaaugagucuacuuggaaucuucugaagcaaacuaugguuugcucacuaggccagaucuagccugcugacccuauggcccaggaacacguucguucauuuaaguauugcccacagcugguuucgcacuacaaaggcaggguauguggccucuuggcuggcagaaccuggaaugcacauccuccggcccuuucuagaaaauguuugcugcccccagucugaaggaaccccacccucuucacuggcugcucuuucuuggcuccuucgcuggugccuccucagcuucccauccaccuguggcacagcugccucauuccaugcuguugacaucucucacuuggagaggcacgcuaccuccucccugaucccccgcguccacccuccacccccucagucuguuuuccacccagcagccaggugucccuugacacucaggugguccagucauuuacuucuuagucaaguccugcacagcccaccacgaucugcuccuggcuuccccaggccucgcugccccuccucucuccaggcccggccucacugccuccuuccuguuucuggaauacacugacuacccccagucucacugccuuugaccuugcuguuuccucuacugggagugcuguuccucaagcuaccauagucuguguccucacuucuucaggcuucucuucacauguccccuuaccaggggcaucuugcccaacccuucaucuucaguuuggugugcacguaccucgucucucccacaccugccuacuuuuuuacuuuucuucacagcauguagcugucacucuuuaauaugauuguuugcuuguaugucuuuucagccucccuugauaggaacuuaggcuccacaagagcagggaccuuuuuguucagugcugugcccccugcaccuggaauagugucagacacauaguagguuuugcuaugauguuuacuucuuuauguugcuauaauaucuauugaauaaugacauaauuaccuagggauacguagaggcuuagacccucagaauggucuagaacugccuagaaucccacuggaaaagaucuugggauuugaguggggcuuuaguaagagaauugaugaacuagcucuucacccaugaggacaccaugauccugcaagaagaccgagugugaccugucugccuccucucagcaaguuaauggaaggacccagccucaagcaguucccuugacucuuaauccagugcuagguccgucaguguugccuuccuuucuuaccuccaggcagcguugccugccuggcuuaucuccagcuuauucuggagacccccauaaauugccgcuggcaacgucuccuugcuggcuccugggaugaaugagcccugccuuuggauucuccagguagcuuuggugacucuuuucccuuaccuuguacagagaucaggcugggcgccccaaaugcccauuggacccguacuucaucaugcccgacaaaugcaaaugcguggacuuccagacccugaagcugcaggagcugccugaugcagucccccacggggagaugcccagacacaugcagcucuacugcgacaggugaggcagacgggcugggaggugggcaucuacgacgguggaugucccagcuguggcccuaacccgaguguugggagugggucaucuggagcagggugaguaggguggagaagguggccaguugcagagcaccugcucugugccuaaugcuuccauaaguuccucucaucucgucuuuccauaaucugcaggggcaugucagccccauuuugcagaugaggaaauguaacuuggagagauuaaaugacuuccuguguggaggagagccgggcuuucagccuaugugcauugcuuuccaaagucuguguucuucuuaggauaagaggcccaggaugcacagcuagauaaccaauagcuggcaaagccucuucccagccugacaccccaccuccuaccccaggcuuucuuuuuuuuuuugagacggagucuggcucuguagcccaggcuggagugcaguggcgcgaucucggcucacugcaagcuccaccuccuggguuaaugccauucuccggccucagccucccgaguagcugggacuacaggcgcccuccaccaugcccagcuaauuuuuuguauuuuuuaguagagaugagguuucaccuuguuagccaggauggucucgaucuccugaccucaugauccgcccgccuuggccucccagagugcguggauuacaggcgugagcuacugcgcccagcguaccccaggcuuucuguuaagauccugcugaacagccacgguggcucaugccuguaaucccagcacuuggagcggcugagacaggaggauugcuugaggccaggaguucaagaccagccugggcaacauacugagacccuguaucuaaaaaaaaaaaauuuauuagcuggguguuggggcagacaccuauaaucccagcuacuugggaggcugaggugggagaaucacuugaccccagaagguugagguugcagugagcugugauuacaccacuccacucuagccugggugacagagcgagacccugucucaaaaaggaaaacaaaaaagauucuacugagggggagaggguacugagcuugggccccucauaguaaccuggguggaagguuuugagaucuuugauuaggguucuaaccugggcuugcauauccugaaauugcaugcagauguucugaggagagcggaucuguagcuucuguuaacuucauuaguggcaacagaguauguaggggucaggcucuugcucccugggcaaguuaugugacuuugucaagcuucaguuuccucaucaguaaaauggggauaaggacaguccuuaaucucucagagggcugcuugaaaaugcaugugguguuuagcacaauuccuucaugcagauuacguaaucaggauguaugauuuuccaagcaguucaugaauccugaaaacuuacgaaguggguaugggaagaggggaguuggaggcucauggagugacggugauggucuuuucuggagcugugaugccugaugguauaaagcacuucuaugucugcugccucaccugacuccacaacaugagaggcaggccacuucgucaucccccuaggcucagaggugcaaugacuucguugaggucacacagcgacuaagugucccuccacaccacccugucucugacugggggacuuggagacuucccuguuucaacaucucauuuugaaaacaggaaaugaaaacccagaggcaaaaugagcucacagagccaugaagaggcaaaaagggcgaguggccccucaaggaggcuggggggcgugaagaggaagucuugcccugagaggcuaaagggcaccacacagugagcugacagcagacacguggagauggggcuuuuggagggcucugugggcuggcacuaagccuccuaaaccagcguacaaaugaguuagcgaguucagcgagagucaggccaccaccugccuuucuguuuggcugucacugugggcaacaccauccuccaagcagcugagcaugggcugagugacguggggagagaggccguucucugggcuccguggggcuggagccagcucagcauguggugccuguggcaaaaaugcugcaguggacccugcguguccugggcauggguggaaucagagacuugcuguccaagucagaaucucagcuuuucuccuuucuccucuacccuccucucagguaccugugugacaaggucgucccugggaacaggguuaccaucaugggcaucuacuccaucaagaaguuuggccugacuaccagcaggggccgugacagggugggcgugggcauccgaagcuccuacauccguguccugggcauccagguggacacagauggcucuggugaguuggcuuugggguccuggcuuagcccugcuaaaaggcugugcuugcauacuucugguaacaggcagcucguuacuucaugagguagcccaggauguccuuguguugcucauaucauuagaacguucauuuuuauauuaagugaucccuggaacuuccacacauugguccuagcuguggcuccugggcugaggguguuugccuaagugcaggauuaaggcagaaggacugaggucaaaucacuggggaauuacugaaagccaagucuucacuucugugacaggaaauacaagagaagugaaacgcaggguuccaggcaggcagccgccuagugucuaguuggagaaauaagaaaacugugagaccgcuggggacauguggguaaagugguggcuguugugggucacgcaguuccaaggaggugcuaaaggaggucugagaaggaggaggucggggcugggccuuggggaagguuuucugggaggagguuaaucugagcugggcuuugaagagugguggauguggaagaacuuccaggcgggaggggauggcaggagcaggugaaaaccccggccugggcaagguacugaguggcuggagggccgagugggagucuaggggaugaggggccaggugguguaagaggccuugagugccgagauggggagcuccugcuuacaccugagggcagcaggggccacugaggguuuucagguuuguuucagcccucuggcugcagugaauugauucagagggguggcuuccccagggcucaguccauggcccaccccacauuuacacaaacuaccuagauuauuacaacuuuaaaaccacugacagguaaguagcucucacauuuccauuucuagccugggcuucuccccacguuccagacuuuaauaaccaacugcugauuugacauguucacuuacauaucugaaaggcaucucgaacuuuacauggcugaagcuaagcuccccuuuccccacccucagacuggcuccucucagucuucccaucuucacccuuucaguugcucagacaaaaacccccaagucacccuuggugcucuuuucucucaucccccacaucuaaucacucaggaacucuggccagcuccaccuuuaaaacguguccaggaucugaccacuucucauccuccccaccugcucugagcccuugucagcccucccuggaucaccguugauccuccccaguguucgucuccaccuugcccuaccuucucuguucugcagcagccagugagcgaugcugucaugaccaagacacuauaucacuccucggcugaaaggggagaccuuccagugguuuccaagguccuaugccaucuggcccucuguuugcucagaacccuucuccccacuuccccucacccuuuggacccuggaacacaccaggcccauuccugagggcuugagagcugggaucucuguuuacucagauagguugugcuguccuggcccuaagggcccuaagggcucugccuucugggaggucccugagcuggugccaggaugggcagugggcuggaagagcucccuuguacucacucaugcgccugcuuugccuaccaaggccgcagcuuugcuggggccgugagcccccaggaggaggaggaguuccgucgccuggcugcccucccaaaugucuaugaggucaucuccaagagcaucgcccccuccaucuuugggggcacagacaugaagaaggccauugccugccugcucuuugggggcucccgaaagagguaggggcuugaguucccuuggguuuggggaggcggcugaugauggggcucacaguaggauaauuacuggauaaucaggacugggcacucuuuuuuguauuuccugggccccucagucugccaggcaccuuugccagcccccaagcuugccaucagcuggcuaguggcugaucugcgcaccugucucagcgaugcccugacccuggcaagggggagacugggggccuggcaagugcagugggagagcacugagcuuagggucguguagguaccaggacuuaaaucucagcacugagcuuggggucaguagcagggauauuauuagcagcugccauuuacuguguucuuccuaugcacagccauucuuuguuuuuuuuuuuugagacagucucacucuguugcccaggcuggagugcaguggugugaucucggcucacugcaagcuccgccucuuggguucacaccauucuccugccucagccucccgaguagcugggacuacaggcgccugccaccaugcccagcuaauuuuuuuuguauuuuuaguagagacaggguuucaccguguuagccaggauggucucgaucuccugaccucgugauccgcccgccucggccucccaaagugcugggauuacaggcgugagccaccgcacccggccgcacaggcauucuucuaagugcuuuaugugucugaagcccagucauuccucacaguaaccuguuaacgcagcuguugugcccauuuuauagaugagggaauugaggcauagagaguuaaagggacuugcuccccagcacaugcaggggagccaggagccugcugucauggugcuuguucugccgcaccgugcacagcccacaggcagcucucuguccuuuucuuucaagcugggaggaacguugcucagaugcuggguguacccgagcacagccauaagagccauuuccuuuaacccuccucuucugggaggcaagcucuguccucauugcuaggcaagaccuaccaugguuugggaacuacagagcuggguaggaacaugggucucaggccacagccacuaccuucuuaccaacucugaggcccaugauaguugggggagucaacugccagcccaccaaucuggugacuggaugucacaugcgaugcccucauggauucucaccuuguccaucuacccuucgucccccaggcucccugauggacuuacucgccgaggagacaucaaccugcugaugcuaggggacccugggacagccaagucccagcuucugaaguuuguggagaaguguucucccauuggggugaguggccugggauaccuuugccaccuuggcuugcagggaggaaggcugcagggcagggccucuggguccucaggacaccuguggugggcuggcucacccggaaucucuuccuccuuucucuuggcugcggucaggauggccgaggagaugggaggaagaagggagccaacagguguauguagguuuggggcagggggcgaguacacuguacugagagucaggaugggguuugggucucacccuggccagaaauuggcugugggcuuugaguaagucacccaaucucccugagcgucaguuuauccauuugcuaaauaaugauauuguuaucauuaauagcuaaaaucuggcugggcauggugguucaucccuguaauaccagcgcuuugggaggccgaggugggcggauugcuugagcucaggaguuugagaccagccuggacaacauggugaaacccugucuuuaccaaaaauacaaaauaacuagccaggcgugauaugcaccuguggucccagcugcuugggaggcugaggugggaggaucacuuaagcccagaacggggagguugcagugagccaagauugugccacugcacuccagccugggugacagagugagaccauguuucaaauaauaauaauaaauaauaauaauaauaauaauagcuaaaaugaagggccagacacugcuugaaguacuuugcauauauuuacuuagucuucaccucaacuguguggcagguacuauuaccccuguguuaggggugagaaaacucagguacagaauggguaagugucuuggcccaggucucacugcugguaagcauuagagcaggaugugauugaacccaagugucugaugagcuggguccucugcugcguuguugaaugggucugcggggaucagagccagagaaggucugacaugauccgaguggcgggguuguauagggcgagaugguggucuuuggauagauaggaagugugccaaauuugccacacuggcacuguccaguagaaauagugaacugcacaugcgacccauguaugucuucucagauugucuaacagccacauuaaaaaguagcugggugcgguugugugcauaccuguagucccagcuacuugggaggcugaggugggaggaucacuugagcccaggaguuugagaccagcuugggcaacauagcaagaccccguuucaauuuaaaaggaagaaggggaaagaaaaaaggaaaaacaggugaaguuacuucuguuuaacucgcuauaucuaaaaucucauuucaacauguuguuugauauguagauuauugagauacuuuacauucuuaggagcucugagucuuugaaaucgugcguauuuugcacgauuaaggacaucucaguuaggacuuucccaauuucaggggcucuauggcaguauguggcguguaggucuauauagagacgacaagggacucacgaugggggcaggcuuucccugggagucaggaguccucauccuagcccugaggcuaacuccucuucucugggccucaguuugcucaucugugaguugggccucacaagacugugucacagggcuguggugaggcuuaggugagccauggaugugaugcccucagcggggagaacaucugggcacaccgaggcccagggcagcauccccuuccagagggagacgcacugaguuggagccuugaguccuauucuguacccugcagccagcuuugaugugugaccuugggcaaaucacaaccucagugggucuuuuugucuuaugggggucaaagcauggaguuguuauugggcccugacaccaccccacugccccagguauacacgucugggaaaggcagcagcgcagcuggacugacagccucggugaugagggacccuucgucccggaauuucaucauggagggcggagccaugguccuggccgaugguggggucgucuguauugacgaguuugacaaggugagucugaugagguggguaguagccaaaagguggguggcaccaggguaugugacuuccugugcucagccagcagaaaucaccucugacuugggagacauguuuucaaucccugggccggucacucuaguaacugugggaagcugcuuaaccucuucaagccucaguucccauaucugaagaguggggagaagaaaggcaagcccacacaguuguucccaugauuagaggugaccugguugcugccauuggccuugcguggagcugguauucaggagugagggcugcuguuaguuuuccuguuucuacugcucccugcucccucacuucaguaggucugaugauauuucucucuuccccacuuagaugcgagaagaugaccguguggcaauccacgaagccauggagcagcagaccaucucuaucgccaaggugaguggcccuccauggagagcccagccugcagcagcccagcguggcccaaccguccucaggcugcccugauugggaccaaguucucuuugcccaggccuagaaucuguguguguguguguguguguguguguguguguguguguguguguguguguguguguguguaaacguguauauaagaaggcaucuuugccaucuccucccccuuuucgucgucugucgccuguuaggcugggaucaccaccacccugaacucccgcugcuccguccuggcugcugccaacucaguguucggccgcugggaugagacgaagggggaggacaacauugacuucaugcccaccaucuugucgcgcuucgacaugaucuucaucgucaaggaugagcacaaugaggagagggaugugguacguccaggggcagggcugguggccaugggaccugccuccaggcaggcuugugauugugugggaaggagaauggagaacaagggccuuggcuggcaaaguccugacugucaggcugugaaauuggggagcacgugagagggcgguuguuguggacugcagaggauugaagcagggucuggaguccuguggccugcucugccucugccgugagugauaagcugugugauuugggcuaaaucaguuucucccugggccucagucccuuauauaugaaacagaggaguugacauuggguuaugaguaauagaaccucaguucugguuaguaaauuuuucaaagaaaaaaacauagugguuuauagaauugguaaguccggcggcuuaaggcccagguagaucuggauucucaaacaacugucucugccuuucuguucugcuucccuugguggaaucuuuguacuugggcagcuguuccucuugugguggcaaagacaaaauaagauuuuguccuguuagcuuguagcuuaacagcccccaggaaagaggaggccccgucuuuuccaguacuucuaucaaaagucccaggauagacuccuauuggcuuggguagauccuauguccaugcccaaguugggguggacaagauacaugccccaagucgggguggacaagcugaacccaccccuuuauggaccagggcagaggagcaaggagcauuaaguucucucuaaaggagaauccagaugcucccaucagaacgagggccuggugcugagcaaacaggcugagcacgccugagaucucagcacccuuuccggcuccuugaugccagggccccaucagcucuuucuggcuguuccaccucagugcugggacucaggcuugggacggccugugggaugacccauuauccccucugcucuccagaugcuggccaagcaugucaucacucugcacgugagcgcacugacacagacacaggcuguggagggcgagauugaccuggccaagcugaagaaguuuauugccuacugccgagugugaguccuggacgcaggcccacgggggugagguugcccagcuucccugggugggagagaacccaguccccugguccugcuccuccucaugaagaacagcccagauguugcuguucugagguucucagcucuacugaaucugcucugcucccuucuaaccuugcguagcucacuggcucuuggcuucaguuuucccaccuccacaccaaggaggugggauuuagauggucuugaagaccuccucgagucugacaugcagggaggcagugaaguguagacaugguagacaugggcucugggucauaccugccuucacucuaugacuuugggcaaguugguuggccucucugagccuugauuuccccaggccuaucgauguuugcuaggauuuuuguaaggauugcacaagaugaugaguaagugcuuggcauagcccugcccuggguaaauacucagugagucgcagcugcaauuugauuguucucacagauuuucaauaauaauaauuauauacauaguacuggcugguugcaguggcucacgcuguaaucccagcacuuugggaggcggaggcagguggaucacuugaggucaggagugcgagaccagccuggccaacguggcgaaaccccaugucuacuaaaaauacaaaaauuagccgggugugguggugcacaccuauagucccagcuacucaggaggcugaggcaggagaauugcuugaacccaggaggcagagauugcagugagcugagaucgugccauugcacuucagccugggcaacagagugagacucugucucaaaaaaaaaaaauauauauauauguguacacacacacacacacacacacacucacucuuacacacuacuuucuuugugccaggcauucugaauuacuauucaguauuuucuauaugaauaaauuauaacccucccccaaaaccuaccagguaaggugugcuauuauucccuucccuuuauggauggggaagcugaggcaaaggaaguuaaguaacuugcccaaggucacaugccagagguaguggagccaggaugugaacccagcugcuugccuccagaggcugugcucuuaaccacagugcuucgauucuugucguacagcgcuuuggugaucuuuugaaggagcuaaaacccagggguugagggcucuuugaaugcacuaccaguggggggcuggugggucccugauucagcaccucugccagggugaguggguagucccugggucuucauccaagucugagcucuguguggcccagucuugagaggcuugggcccacagcugugagucagggagcccuggauucuaaucuucccucugcacuaaguccccagguagccuuggggaguucccucccucccucugggucucagucuccacauccuuaggaugguugagcuaaggcuuucccuacaucagugacugucaguuggccugggggcuagaggggaggggaugggauaggguagaugcugaucagacuuccccacaccuaccgucccaggagagucugaggugcucccagccccuggacugcagucaccgccaagccuccugugggugucaucagcuugucgugucuucagauguguuggguggaggaguuugagacugcugcaaagcccaccacccagugggccuccaugccgcugugauugugccauuguucauuacauguaugggggaccuuguggcaagacaccacacagcgucuaacaguggggaagaggcgguuuucacccugcagacgugccuggcuuuucuucaccuguuuuuuaagagaggcacccauauuucuccccaguguugauguuuguggcagcugcccacagccagauuucacuuaaaucuuuuccgauuguugucccccagcccauaugagugggcagcugugguguggugggaaagugcaugucuguaagcuggcagggggcugggggaaaggguaggugcccuaagagucccuccuggccucacaccagccucuccccacuguccugcaggaaguguggcccccggcugucagcagaggcugcagagaaacugaagaaccgcuacaucaucaugcggagcggggcccgucagcacgagagggacagugaccgccgcuccagcauccccaucacugugcggugagcaggcgggcagggcugggccauggcagauggggcuugcuuuacacagcagggugugcuuggcaaccaggggcagugguccaggcuuuucacuuggcacaggcccauaguagcucugggcaggaagagucccuuuggagcauaaacuauggccuccuugaucucaaugaugauccauguuucuugauuuaaggccgggcaaaccuagaccccucuugucugaauuuggccuggcuucucccauuguaggaagcccgaagggagggaaggacccaggccugggagucaagagucuugggucccagccucuagcccacugugugacuguagggaaauuacauuccuucucuggcccucagugcuuuuagcuccuaacucuguucauucuugugacuuuguagacaauacaguggguaagaguugggauuuaccugguuugaauccugucuccagcacugacugguuggaaauggauuuggcuauaaguaaugguaaauccagauaaaguagcuuaaagaaauaggaaguucauuucucuuuucuguagcacugucuggaggaagaugguauggggacuggugugaggacuccucaagcucccccuuacucuuaguccgagauggccgcuagaacuucagccaucaccuccaggcagcaggacaggaaggaaagagagcuucccuuuuaaaggacacuucaugaagucccacacaaugcuuggacuuacaacuuacugccauagauuggucacacaaauacaaccugguacaaaagaugucugggauguguuuuaguggaucgcugugugccagacuaaaaacugggguuccaagcuaggugcaguggccuacauugugauccuagcacuuugggaggcugaggcaggaggauuacuugaggccaggaguuugagaccagccugggcaacauagcaagacucccauuucuacaaaaaauaaaaaauuagccaggcauuguggugcaugccuguagacccagcuccucagguggcugagguggaaggaucacuggagcccaggaguucgaggcugcagugagcuaugaucaugccacuacauuccagccugguccacagagcgagacuuugucucaaaaaaaaaaaaaaaaaaaaaaaauugcaguucuaugacuaagaucaaaagggagauggauuauggggacaccuagcagucuccaccacagucuuaccacuuugggcaagcaccucccugguaacgggcuggcuggggaggaagggaauagcggaccgaggcuacccugagcacgcuguugcccccacaggcagcuggaggccauugugcgcaucgcggaagcccucagcaagaugaagcugcagcccuucgccacagaggcagauguggaggaggcccugcggcucuuccaaguguccacguuggaugcugccuuguccgguacccugucaggugagcagaugcaggggccauggucucaauugaucuggguucccuggcucggagcucugugggcagggcucuggccugcugggggccugcagugugugucuugcuucucugaguuugcugagcuucucugaguuucuuuuugccauaagaccccucuccuccuuucuccccaccgcuguuuccuccaagaugggaagaagcagcuucucuccagacccuugaacacaauccucuugacccaggucauugaugauaacccuucucacuggcuaggaacaacaguugaugcucugcuuccuagagcuugucagcauuuucagugcuuccagaguuauuucuugcauuuugccuuacagcugcccccuggaagccaggugagcagucaguccugcccauguuagaaaugagacagcugacacucgaaggggccuuucccuggugcccaagaucacagucgcuuggcuggaaugcaagucuccuggccccuaggccagcguuuuccacaccauaagccauacugucugguuucggucagccuuucaacagacugucccaggcaccgaucaugagccaggcuaccuacgcuggggaaaaucuguuccuucacccagcagauacuucauuaguguuacuguuugccaggcacuguucuaggugcugggaguauaagagcaaucaaucacagggucccggcccuccuggguucucauucucguucuaguuggggagagauagacaguagagaaacaaaugcagguaguguagguagugaaaaaggcagugagggagaugauggcagggccagguguguuggaaaaggaggacgugcucuuucccauggagugagugggcauggccucugcaaggaggugaugccaagcagggagcugcaugaaggggacaguguggcuccuugggggaagagcugcucagguggaggcagcgcuaagugucaguuuccccaggagggagcagguuuggugcauuugaauggggaggcacuugggugaggaaugggguggguggggccuguuccuccugucccccuuggugaagacucagccucuacccuggagacacuugcugucacaugagacauugcagguggaggccucugggaugcugcaggcacagagggcaggggugauauggaguggugauaauuugaguugggucuuaugggcuauguaggaguuugccucacagacuccccucucaaugacuucuugaccaugagcccaccaucuccuuagcugaaacaccaaggccucuguggcaguaauuggaagucacgagccuccugguugccgagggcuccucagggcaccucguagauguguccagggcaggcuggcuucccuccugggucacugaugggccccuuccaacucucucucuaaucuaucugcuccagcaacaaaaggaguccugcuguggccuccaagggcccgcaggacuuggucccuagugacacucuggccaugucucugcugcgcugggccccgggcugcuuuuugaaugagacagguguguuccugccucugugacuuugugcuuggccuggaguguccccacaugugccauauccugucuccucaaucaggccugcaccacccuggcacacucggugcccuuuucugacuuacucuucggggccuggcucaggcuguucuuccuugggcuagaggcugucucuguccaagaacucccauugucccagcuccccggcugccucacuucuccaugcccacagggguggagggcuucaccagccaggaggaccaggagaugcugagccgcaucgagaagcagcucaagcgccgcuuugccauuggcucccaggugucugagcacagcaucaucaaggacuucaccaagcaggugagccugccuuggagugggggugugagccggcacggggugcaggucuucugcugguucccacccacucagcacuggcaucuuacucagcagacaggcccugaacggggguaggauggacaacugucccuuucucagaccuuuucuagccaucauuccuucccuagggacaucuucaucaggagcagggauggggguauuuuuucugucccacgaaggggaggggagagcagaggugguuggauucuggugaaaccccauacaaguuccccgcagcccuucccgucugugccuuuccccguuggcgggcguuucauggagugggaaggggcagagccaugagagugagcuuucuggcucacugaggaggguacuguuggccccauagagagaagaugggauuucccagaugcucuggaaaaccugucaccuuuaaaaucucaggauuaauccuaguuucuggucuccgcuccuuguacaucaucucauuuugauucagggcaguuuaaugggugguaucgugucuauucuauaggugcgcagacugaggcuuagagaaagguuuagagcuucgguucuagagucagaugggacuuaagucccagcucuaccucuuaauugcugugaccuugagcaaguggcuuagccuccgugugccucagugucugguacacagugggcacucaggaagugugggcccuuuaggucaaaggagccugaguacaaaguuccccgugagccuggggaugucugggcucugucggaguccccucgggcagcacgugccguuagccagccaugugcucccacagaaauacccggagcacgccauccacaaggugcugcagcucaugcugcggcgcggcgagauccagcaucgcaugcagcgcaagguucucuaccgccucaagugagucgcgccgccucacuggacucauggacucgcccacgccucgccccuccugccgcugccugccauugacaauguugcugggaccucugccuccccacugcagcccucgaacuucccaggcacccuccuuucugccccagaggaaggagcuguaguguccugcugccucugggcgcccgccucuagcgcgguucugggaagugugcuuuuggcauccguuaauaauaaagccacgguguguucagguaucuguggguuugugcacucggugaccugucaccuccaucgugcccucauggcaggguaagugugagggaacagggucuggaggcagacuggccaggguuucugacuuggaucugccacucagacuucuggguaagucacgugacuugagugcuccgguuucuucaucuguuuagcggggcucauaaagccacucccuugaugcugggaauccagugagaccagggaguggggaagcgcuucucaaagugugugauuuugauccgccucaccuguuccccaguaacuuauuggggggcugcgagccguggugcggcggucagacugccuggauucauggacccucuccaugccuuaguuuccuuaucuguaagcaggcugauacuagaaccugcuucacaggguugugcuuagggucagugagcagcuguuagugaggggaauguaguggccaccaggcaggaacuaggacuccagccaguucuuuccuggugggccacguguaacuguguggccuugggcgagacauuucacuuuucugugccugaguuuaucaguaaacuggagauggggggauuccucacccugaguugugaggauugaaugacagaaggcacuagugacagugaugcuggaggaaggaguguugccaagugccucggucacuuugccuaauuucagaaagucacucugaguugguauguuuuguguuuuuaaaaaagcuaggauucauaaaauuaaauagaaaucagugaaauaaaauauuugauauuuaaaauacauuuagaaauacaaag

SEQ ID NO: 15658 - RNA, 13550 nt, Homo sapiens
ggacacggcuuuguaacaaacccacuuuuauugauaguguacacggagauccaugguggcggggcugugccugggugagagcgggccacacaccggugcagccaagguaccuggucugcucagaaggcucaggcaguggguggggaaggggacagaggcaggguuggagcugcugcuuugagcacagacgcaggcaggggccaaggcuggggugcaggugcagguaugcagagcuggggcuggagcauguguacaucuguguguacaucuguguguacuuguauauacaugggcaugguguacacaauaucuacagggacccucacagacugaucuagggagaggguugaggacaagaugucccaaagcccugaaggccccaggggccaagcaucaagagagggagcacaucgugguauguacugaaugcccagcgcuagcuugcuucugccacccacagacuugcugugugaccuggaggaaguuacuuacccucucugaaccucagaaagacccaauagaagaucacuaagguuccuuagggcccuaaaacuucaauauguuuagagagauuaaaauacaaaauauacuuguuaagagcugaugacaagggccuuugguuuauggguucaaaacccaccaugccugaguacauggugguacccagcauagcccaaucccgggcacaaggagaagacccgcccugagcuuuucugucggaucccucccaggcucaguucugggucccagcugcuccuccccgccuccccaccgcugugugugcagaaggugguggggcagcaggggcgggcagaggccaggacuggggacccucuugguuuccuaggacacagugaacccagcacccaguaggugcuuaauaaaugcuugaggaacgagcacaguagagggcagccugguucuagguggagcuguacccugaauuugcuaggggacaaagguggggccuggugcucaucguguccccuccgagucucggugguauccucugugaaaugggagcauuaaaaaaaagcaguccuggccugcccaccccacgcuugugcaauugucuguaaaccguggagcucaauggcggaggucaaugucuagcugcaaacaggccacggaaacccuguuugggagcagaggaggaaggcgucccggguggaggccguggaucugaacugggugagggccuggccaaggagggagucacuaggcuuuuacaguacaaugauuuccauuucuacuacuauacaugacacgaaaacagcugcaaccacaacaaagcacaacugucgggcggagggaccuaggagaggaggcugaggaacgcggucaggaggugggcguggucuaaguggugggcguggucuaggagguguggccacgcccccuucagacacagaguccacuggcucaaugucaggcgcagcugggggccaacuugugugugugcugggggugggagggggugcagaggcagcugaaccagagcguaagaguugcagggcugggagagaaguucucccagcugccacccaaaccaagcuggguguuaugccaggagagaggagaccuuucucaucuggccuucuguguccuuuucauccugaggcuugucccaggaggcuccauaugacgcagcaauccucaccccucuggcaucaacauuucuuccaaccccaggagaggaagguguaacuugagucucugccuaacucuugaggcugcagagauguguccucccacagaggagaugaaaccaccaaggagcuguggacaagcggacucaggaaagcugugagaaggcagacgaaugugcggaggccagcgcccgggggccuccagucuggugccuaaggucugugaacaagacugcugccggggccucgguggggagaugcgcacagugggcaucuggggccaccucccugaaggcacuggccaagccccgccccagcaucccucgcucacuggauggugcacuugucccucucacgggccuggccuucccgaaggaccuuggccuugauguacuugaggucacuguugacgcuggggcggcgggcgaagggcgagaccaugccauaggcguccaucuccuugacgcggcgcaugcagaagggccugggguggaaggcgucaccguacugcacggagaucuugcgaugcagggcggggcucaucucguguggcagcuuggccaugcugaagagcacguagaacaucucguccacguugguguucuucuuggccgacaccucgaaguaggcgcaguucucgucgcccgacaccagcagcucggccucgguggugggcaccuggcggcacagcucgccguggucguucuuguugccacagaugaccaugggcagcuccgccgccuccuuggucuuguucuucaggcaggacuugaccuccaggaucugcuucugaaggcgcuugaccucaucgaaggacucccgguuauccaggcugaacaccaggaugaagacauccccugcagggagagagcccagguagugaguucaccggccagcugcaaccccugcccuccucuggccacagaacaucagcccuaagagcugggagucacaggugcccugaagcaguuaugcggcauaacugcuuuaaccuacacagcgacucuucgggguagcugcgauuauucucccugcgauuauuuuccaggacaggaaacugaggcugaggggguugaagccccuguucacagucgcauagcuaacacguggaccacuugguucaaauacaguuaacucacuucacauuucuuugcagggcuggagagggguaggucacuuguguggacuguguucagauaauaauaaaaaucauuucuaugagagcagggguccugccugucuugcucaaugccuaguuugcaucuggccucauccgcuuagcugccagcagacuugggcagaucacgaaaccucuguaaccucaguuucucugucuguuucaugaagaugaaauauuaccuugcaggaugauuuugggaguuaugcaagauaaugaauggacaguggcacaugcucagugaccucaggugucaguaaugaugagagugagggccuacugggggcuaagcacuggguguaugcuccaggcccguuguucucuugauuccucacuaugccucugucaagauuuuguuaccuuugcauuacaggugagcaaacugaggcucagaaaggguaugcagccugcccaagaucacacagcuuccguguggcuaggcugagauuucuaccugauucuguucucaccuagcucgugccuggcacccgguaggugcucucugcuucucaaauaaaucauaggaugaaaaagugagugcuggccuccaaggcccacacugccuccaggauaacucacugcaucacucaaggcaggcuugugaaucugaaacaggggcugcuguggagacgguggggugguggggaggcugucuggacugguaccuccauccugauuuccagcuuuuaauaagcaccuuccucacuuuugcuuaaacuuuuuuuuuuuuuuuuuuuuuuuugagauggagucuuucucuguggcccaggcuggagugcaguggugugaucuuggcucacugcaacuuccaccuccuggguuuaagcgauucuccugccucagccucuggagcagcugggauuacaggcgccugucaccaugccuagcuauuuuuuauuuauuuauuuauuuauuuucugagacagaguuucacucuuguugcccagccuggaaugcaauggcaagaucucagcucacugcaaccuccaccuccuggguucaagagauucuccugccucagccucccgaguaacugggauuacaggugcccaucaccacaccuggcuaauuuuuuguauuuuuuaguagagacgguguuucacuguguuagccaggcuggucuugaacuccugaccucaagagaucugcccaccucggccucccaaagagcugggauuacaggcaugagccacugcguccaaccacuuuugcucaaacucuugauagccuuguggugugacaagaucccugucucacagaugaggaaacugaggcccagaggaaucagcaauuggcccaaauucuugagaagagaagcaaccaguuccagcuucuggcagaauggcugccaccuuccucugcacccccagagcacaucauuuacccccauuuaauggcacauggcacauucagaaugguguccagaucaaaggugugcuccaaacagcucgggcacagagaaggguuccaucacccacucguccuggucuccccagggccuggcacacagucaguguuaaccaaggaagccugaauggaugggaggugauggagggaacugcagugugggcucuucugaaaggcacuugcgaggcagcgucagcuuggcaacucuuccugcuugggcugccaaaccccaucccguuaggcuaauccggggccccugaggacucguggccuugacauauucaaaugcgagacugcgaugccaagcaucagagaucggcccgucuggcagcuggaagaagagcuggcaguggaauuaauggcuuucagaauuuccugagcagcaggaaaaugagguugaaaaaaugagguuccaccagguuggaaaaugaggcacggguuggugugugaaaaaaaaacaagcaucagacagcugugcucagaaugauaugcgccauaaaaaagagacagacaaaaauacucuccauuguggggauacaaauacgaaugccgguguagucacggaggcccggaaggcuccaugccagacugccaggguggccaccuccggggcaggggcaggagccugggauuggggacaugggucaaaggggcauuagcuuuaucuguagcguuugcaggaggguguguuuggguauuacuugugucacugaaaauuaaugcugaaaauaugcaugugcuuccucucuacaucuccccucuccuucccucugucauuagccuuauucauugcagcggguacccaguccccuccccaaggcugggggagcugacaccaaugcaauacccgucacgugcuggaagcucccgccacaagccuucuugcaguccucacagccucccugcgggguaugagguuaagcccacuguguggcuggggaggcugagacucagacaggaugcaugugccucuggucacacauuuaagccaagaggcccagcaaggauucgaacacaggucgacccagggcucuccuaucuacaugccccuucuccaaaacucgggguggagcggagaacuugacugcugucugggucagaugcucggaaaagccagccuggaagagaaagcacucaaggaggggccaccccgcagccucagucuuggccucaaggcggcagcagggcugggaguggcauggguuucucuguauagaaguaccucaguugggggguuaucugaaugaugccuagagaguugccugcucacuccuucccuuaucccugcucagcaacuucaggggcgugacuugggaaaugaucguguaacccguagcaggcccacuugcaaaugcugacucaacagaagacuuggggauuuauugugcauuuacuaucugcucaccaagcgccuuacauauauucauucauuuaagucucacagucccuuuaggaugaguguugauguggugcagucuuacagaugagagugcugagacacaaggagauaaaaucccuugccucgagguacaaagccaggaagcagcggaaccagggcucacacccaggugcugggucccgggcuuguccucuuagcuaccaugcuaaugcaguguaaacaagggcacagccccucagcuccacucaccccuucuuccccccaaccucccugucccuccucacccuucccagcagggcugagaggcugugguauggcuuugucugaaagcacaaaagcagacugccuuuacgagcugugcuaccacuggagugaguuacuuaaccucucugggcuucaguuuccccacuuguaaaaagggaaugaauaacuauuuacuaugaggguuaaauaacuacaugcuggcuggccgcgguggcugacgccuguaaucucagcacuuugggaggcugagguaggcagaucacgaggucaggagaucgagaccauccuggcuaacauggugaaaucccgucucuaguaaaaauacaaaaaauuagccgggcaugguggcacaugccuguagucccagcuacuugggggacugaggcaggagaaucgcuugaacccgggaggcagagguugcagugagccgagaucgcgccacugcacuccagccugggugacagagcgagacucuguuucaaaaaaaacuacaugccaagcucuaagaacagggccaggcccauagcuucugauaagugucagcuagugccaucaccaucacuaugaccaugaccaagcccccuucccuuuggugaucacugccuggguccugcccuuaccucucuaggagguggcaaaggccuggggugugggagaccugagccccguggacugaccuugggcccuggagcucuggugggucaucuuccggagaaggaaagcagcagccagggcaucauucuguucccuagaaaggaauaucccuggggcaugcugguaucagcuccugaucuggaaggcggccccgacagccaugaguaaucgaucuggagucuaacagaauggaaucggggcccccgacuucaucacuauuuccagcacauggcaaaaccucucugagccucauugugcagggaugacgccugucucagacgauggcuaugcaagucuaugcaaacugccaagugcccagcacacuccgcacccaugcccuggcccugccgccccagcccaggcaccagugggccucaccugugaggauggacagccugcgcauggcggggaaggggugguugccagagguauccaggaugucgagcugguacaugucgccgcggauguuguauaccuuacgguggaaguccucgaugguggguguguacugguccucaaagcggccauugaggaagcgagacacgauggagcucuugcccacccgagaggcacccagcaccaccaugcgguaugaguuuuuggcgggcacacugagcgugcaguucccgcuggacaaagucuucaucauggcucggggcugcaacaaagcgagagaagcaggcaucagggcccccccgaccuggccccaccaccucuuggccuccucuaggccucugucuaggacucaguuuucugucuguaaaaugggaacaucagacgagguucuaaggggucuuggaguucuacccucucauucauucaugcccucuccuuuacuccuuccuucauccacucacucacucaauauccguucauucauccuuucauuuaugcaagcaccggacuccugggauuugaauccuugccuugccucuagcuacugaucuugggcuaguagcuuaaccucucuagaagucacuuuucucaucugcaaaaugagcccaauucauagaguuguugcaaagggcucagcacauggugaaaucucaaaaaugguaucuauggugagaauccguucuuucccugguucauccaucuggcuuucccggagccugugauucuaggauaagacauggggaaggcacuagcaugcauuucuuaagccuggggcagggggugguucuguggccauucagcccuccugggaagaagggaaggcuauguccacaccgcaugcuccaagcccaaugccugggguugcuccugcagccaccucaggaggacccaccuuuagaccugugcucugcaucuggcgggcucccuccgcuccaugaccugcccggauauuuuugccucccaggcccuagguguuuacuugccuccaggagacccagaggcccggaguagaggauguggaauggggaacgacccauggcuggcucaagcuucccucccaacuccaaggguuaugguucuggggcaaacccagagcuuucuaugggagccucuugaccucaugaaagaggccgacauggauccaagcucuuguauaagcaaacccgcaggcuccaccaggcucaccccaaaggcucuucacagcccagcccucccuccuuuccuaccuuagcgcccaccagaauccccgccccagaaccccugaccccagucacccucgucaguuugagcucugcugagaucagccuccacuccuuugcucaugccaccccucugcagaacacccucuuccccuuauguuucagggucuggcucaagugccaccugcucucugaaggccucucugaucuccucacccuugcaggaaucccuccccucuccagaggagagcuuuccagccccugaacugcaaaugggcacaggccugcugaaauaucaauccccuaggucuuccacaggcugccacagguugugcagguuggauacugcacaaggcgcauggcugggugggcaagugggggcugcaucccagaggugggggcuguaucccagacgaaagggcaucuuguguagaggaaaaggcacuguuuuuaaauucacacaaagggcuguaugugcccaaacucgguccccaccccaggaugccccaagucgguuuccuugagugccucgcccauugacccaaggcgcuuuccaacaccaucgcuuccuggcuaucaugaagcuaaggucugagauggccacuggagguggagagauugccugcgugcgagucccuggcacacaucuggaucugcucacccugcccaacuaccagccucugugcaggaaaccggcucucaaaaauaccuuuguuaaaagcccuauugccaauuuccauggcguaaaugcucccacuacggucacuucuaagcuacuaaugugacuucgaugaaugaaucacaaagggacgugcacaauaagccagcucagcacacggcggaccccaggccuggagccacaaggacgacaacugcugccacuugagcccaugcagugugccaagccccgcacuaaguauagaaauaaucauagcuggcauucauuuugcagcuaaaauaugccagaguguucuaagugcugcacacauguuaaccuauuucucccuucauaaccccagaaagcaggugguguuauucuccaauuuacagaugaggaaacugaggcacagagagguuaaauuacuugcuuacaguugcacagccaguaaccagcagaggagagguuugaucccagguggucugccccgagcucagaaggcuacgugacuagcuacuugguuaacaaaggaggcuggguaguaguucaagccuaagacccccacaucccccacccagcucccaccuaaagcugucuuugaauuuaucccacaaaacugccaugccaugaacagagcaggggcucaauaaagggucugugcauucaucaaauggcaaagggcucugucuuuggguuugccugaagccccacucugggaccuucucuccucagccucaaccaccugacuggcccaggggcugugccaaggagggcccuccccuagggcagcccugaugaggugcccagggcauacgugugggaggcaggaaaugagagagaggaggguggagagggggcugccagaccacagcagggagcccuucucagucucugccggggcugucucagccagccugggccuucagcagagauggggggaaagaagcccuaccccaugacagcccccuccccaaguccuucugcagacagcuugacucugcuggcggucacuucugucuaaacaggaugggaaaggggccagaagcucccagggacaguauuugucuccaucauugcccugcccagccuccagccuagagcuugguacagacgaguugauagcaaugacugaaugagcuucagggagucagagagaggaggcagggagucaaagacgcagagaaucggagagaggaggcagggagucaaagagaggaggcagagggucaaagaggcagggaaucagagagaggaggcagggagucagagagaggaggcagagagucagagagaggaggcagugagacagagaggggaggcagggagucagacagaggaggcagggagacagagagaggaggcagggagucagagaggaggcaaagagucagagagaggaggcaaggugacagauagaggaggcaaggagucagaaauaagagacagggaaucaggguggggaaaaagagaaaaaaaauccucugugguuuuuaucucugagagaagacugauucuucacauggccugagccacguggggcugugugagacaucuggacaccuggacgccaggggacagugccucugugggcuccgccuccugccuccacaucuuucuucccucucuucccccagagguggcaccaugggcacccucguaggcacaucucuccucugcagccuguucucccuucuccauccucagccaggcugaccucauacagcgaggagcagacagggaugaguuugaagagcccuuugggaauuuagaguccaauaucagugacugaauggauuucaggaagucagagagaggaggcagggaaucagagaggggaaguaaggaaucagagagaggaggcucagagaggcaggaaauucaacggagacccccuagcggcacagguaucugaaugcacauacugugacuacugaccccaucacagggccauucugaggacagguggaagccagaaaguucccagagcagagaugaggggacgccauccugggggcacaguaaccacagccaggaaggcauccaucagcccacuugacugauggggacacugaugcucagagagguuaagucacuugccccaguucacacagcagaugacuagcugggcugggaucagaaccaggcuguuuggcuucaaagucugggcucuuaacucuaugaaaacccacccccagccaaaacuggucuuuuccaaaacacugucugucucagugaagccucagcuggcaucaggcggggggaugacgccgagacauacuauauucucacucccucucucccugcaggcagcggagcggaaagggggcaggcaccucccaggauucuccccuaacccugccagccaccucugagcaagugcaccuguggauucaccacuucucccuugagccucucucccagggccugccugaaagaugaaggggucacacgggcacaggcagcaggacaagagucuggacguguccucccgguguaugccccagagccuguuucacugcacugccccuccuccacacccccaugccuccuccaucagugcacacucagccucuuuggacacgcacauugccaucacuggcuuccagcugccacucugagaguccgggagcuuggcaaagccaaccccaccacccuuggcagcucaggugguagaagguaggcaggcauccacuucuggcaggccaacucugccucucaccagcccggcagcccugggcaaaugacuuggcuuccuggggcucagguuauuccucuguuaaugguaagacauaaacccccuguguggcccuggguuuccaauaagucuggaggcugacccagcucuugacccgcagcaaaccugaacacaugcuggguucuuuucuucguggcacuuuaucuuggcagucguggggcugccuagagcagccuggugaggcuggacuggaaugcaggcgcaggucuugcagggaccccaucuugucucugacaccacaggaggcuugauucacuggcuccugaccuggcugcucccucccagccuggcuucccaccuuccaugaggucuuggacaacauccccugucauccuccuggugcuggggacaaggggaggggagggcacagagaggccuccagagcugccuuccgggcccuccaagacagcuaaguuacaggaaaccccuccugggaagggaaucauccaggaaacucacucugcaccaacccagaaaaagcucaagaacucuggauaacgaaggagcuucuuaaucuuccuuccccaccuccagguaaugcaggcugcagccagcuccagaagagggacaggaguguuugugguaguugacucgucuucccugagcccccguuuccuccuauuuaaaugggcuauuacucuagcucuuuaaaugcaaagccuguggcaccaaaacuagcacauaguagaagcucaauaaaucuuucuuuccugggauuaagucaaggguauagcacucaguuugacacauacaguaggugcucaacgaauuuaauucucucuagguaugcaaaguugccagacgaucccggcacauaguaggugcucaaucaauuucacuuucucuggucaucuaaggaaucacugagcuuuccuccuccaagccucuacccuuucuucccggcugcuccacuucccccagaugcccagcucuguuggggcgucuccuaccugggaauggcgggccgggccucuggcacggcucagagagcugccuggaagcgccgggagcugcggggagcugccugcugcuccagccgccgagccucccagagucugugguggcucccgggucacugcgcggggauccuccccugcgcugcucgggacgccgggcugggcgcggccgggcaaggaggcgcaaggggcaggugccccaugggugggcuccgagggcucggcggggcccgggcagggggcgggcuccggcucgccgccgccggcccugcccugccccgagccgggggccuccugcugagccaggugcccggaggcuuggggacguccgauccggggguccccgccuggggcucucgggcugggggcagagagguaggggcgacuccagugaugaaggagcagcuccuagagacuuggggaggggggguccuuuggaggugacugugggugcgugucccaggugggcgaacccuccuggucgccuaugccaccuucuccgccugccccaaagggggucgcucggaugggggguaucgggcugccgggcucggccgcggccuccuucucugcccgcggcucugcagcucucccagcgccggagggacggcuucuuucuccccgcgcggcgacgccagcagcugaaggaggagcagggcgcucugcucugcgcgcgugugggagggggccuugaacgccgccccaagguuucgcagcuccaaguuagcaucaacccggcuccuccuccuucaccuccuccuguccccagaugaggagaacuuuguguguggcccuggguucucccuccuucccccucucgcaggcagaugccccacugucacccgcagggcgaagaggucgcugaucccuccgaaagguggcagaaccccaggcuccugaugacggucccagcggcacccucccgcgccccugcgagcgucgcccaccugcuccuucggccccccgcgagccgcgccucccgccgcccagcgccagcgucugccccccagagcccgcucgccccgccccaccccgg

SEQ ID NO: 15659 - RNA, 3593 nt, Homo sapiens
ucacauuuuaaaagccauuuaauuuuaauagcauauuuuaaugaaaaagcagcauacguugccaauaaaacauuaaaauuaucucuucaaugaaagacaaucgaacaacaccaaaaauaaauuaauacauuaccauaguaaauaaaccaucuauuaauaaaaacaagaaaccaggccauauacagaacucaagacuuuggagagccucaaagagaacagcaauacagcaaaauuuguaagaauauaucuaugugugcaucauuuuuaaugaaauauuuacaguagauaagguaccaguuaucauguaccuaauuuuuuguuccaaaagaauuuuuccaaacaaugugaauuuacaagcagugcacugucuuucuuauaguucaaauuaguuuuucuacaaacaaaccuccaaaaggaaaaacugaaguauuccuauaaauauuaacauguagccaacaaagcaauugaaaacuggaagacugaaauaccuuggugaaaucuaaaaucugaagggcaaacaccaaguggcaaaugcaccuaaaacuagaaaauggugcaucggucaugcuuccaacugcuucuucccuucuguuagagguguguguguguguguguguguguguaaggguaagugagagcgcucaugugucauggggacaaugugggaauccccauuaaauauguaacgaaguaaacaauacuucagacagugaaucaggucuacacgauuaagacauccauuacugagugucgacucacaaaucagaacacuaccaguaaaaacaaagaaaaaaacaaucuucauucaagugagaauauacaaaugggucaaaaggaacacaguauaggaggaaagcuguaaaaauucgguaaacucaucaaacaaaauuuuuugaacguuacuagcuauacauuucccccacuuuuuuuagacggaagaaguuuaauuaauuagaaugugcacaaaauuaaguugcuagagagauaaauuaauaauuuacagaggguuguucugcaauaaucuaauaauagcuuucaagaucagugaacacagcaggcgcaacucuuuucuuaagcauuaacacuucagagaaggaaaaggggguaagaaccacaauaaaaauauauauauaauauacaguguaaaugcagaaaaucugccaucuuuuuuuaaaauucaaaauacuuuagagaugucucuaucacauuaagcaucaacucuaguuuaaaguuuuaguccugaaucaauuucuauuucugaaaaauaguugcaaaguguacuuuuaaacuugaacacgggugaugucuguaagaauaaaaacaaaucuuacuugaucauucuuguggacuuuuuaaacacugucucgucugccuuccugcaaacagccaucuccacacuuccucugaagaagccgaggugggguucaaagggacaacuuugcuacaacagacaaauaccaucuuuuguuauucuuuccuuugagaaacuguuucacauucucaccggcuugggcucaguuguucgcucguucgcucccucuucaguccucgauuugucgagauucacauuuacuggaauuguuucuagucgccaaaagugaaaagaggcagaagagaggagagaaaagagcggacgaggaaaggggcgucucuggagaggccaagagucuucuaaaugccggcggaauauuucauucuuuucuguuucugccucugguugcagaaccagacgcgcaccacguuuuucuucagguccagcuucuccgcgauggcggcgaucuuuucagaggagggccgaggcugaauggcaaaguaggcuucgagcgagcgcuucucuggcgcagcgauggacgugcgcuugcgcuucuucuccgcgccauugaagaguucaggcuuggugagcuucucgcggugggacuucucggccuccucgagccaugccugcaggauggguuugagcgcgaucauauuauugugggacagugugagggacucgaaccugcagauggugcucuggcuaagcgagcccacgccggggaucuugagguuggccagcgcggagcccacaucugccugggucacccccagcuugaugcgucgcugcuugaagcgcucggcgaaugccuccaggucccgcgggucggcguccacgucgcucaugcagcccaugugcgacggcagcccgugcgcgugggccaugcugagcgcugcuuggugcaugggguucaugguggccaugugcggcgcgugagccggcguggacaccacagcgccgucggggcccgccauagcgcccagggccagcccgggacucaggugcuccagcagcucgcccuccagcgccuggugcgguugguggugguggugguggugauggugguggugguggugcgugcccgccaacgcggaagggugcgagaugggcaccgaugaagaagaggcggccgacgugcacgggaugguauucauagugugguagguggcguccgguuugaaggggcuguggugggguggaugguggugguggcucuugcucugggagacgauguccacggcugccagagccucggcgcgggccagcagacucucauccagcccgccgaauauauugcucugcaauuguaaguagaaggcacacauuacgcucagcagggaauuguacgcccucucuccggaagccccggcccagggcucgacaccgucgccgcgccuacaacauucccagaucguuaaaauaauaauaauaauaauccugaaaacagaggugaagagaaaaagagggaagccacagaaagaagccgagagugcaggaggaggaggaaagugagccuguagacacaacgaaacacaacacaacacgcgcacaggcaacaucccaggucauaaaaauuaauaugaaaggcaagaccugcugaauacuuaagagagagagaggggaaaauugguuggagguguggggugauuugcugugcagacaugaaaaaaacaucaagcagauaaagggggcugucaaaaugugccuuuaagcggugauuaugcagaaauacgcaccggugggguuggaagacaggcucuccgcauagccuccgagcccccgccgccgcugcugccacugcugcuggagcugcugcuucggccuccgccgccgccgccgccgccgccgccgccgccgccaccaccagcguugcucgagcugcugggggagcuggccgagggcgcgaugggagccgaggagcccggcgaggugcugugcagugccgaguacuugggcuccacgugcaggcugccgccgugcggcaugcuaaacgccugcuugcuguucagggacaucaucaucaucuucccgcccgccggggcgcugguccguagaggcacucacuggucccggcugccgggacccuccgagaagugccgggccagccggggcuggagcugggaagggcugugcgaaguugagcucacccgccgccgccuccggacucuguacgccugaucucggcuacgcgcuccuucgccgccucugcugucagucugaacggaugccugacuccgcuugccgcuagcugcagaccucggcacccgaaacugccccc

SEQ ID NO: 15660 - RNA, 3593 nt, Homo sapiens
gggggcaguuucgggugccgaggucugcagcuagcggcaagcggagucaggcauccguucagacugacagcagaggcggcgaaggagcgcguagccgagaucaggcguacagaguccggaggcggcggcgggugagcucaacuucgcacagcccuucccagcuccagccccggcuggcccggcacuucucggagggucccggcagccgggaccagugagugccucuacggaccagcgccccggcgggcgggaagaugaugaugaugucccugaacagcaagcaggcguuuagcaugccgcacggcggcagccugcacguggagcccaaguacucggcacugcacagcaccucgccgggcuccucggcucccaucgcgcccucggccagcucccccagcagcucgagcaacgcuggugguggcggcggcggcggcggcggcggcggcggcggcggaggccgaagcagcagcuccagcagcaguggcagcagcggcggcgggggcucggaggcuaugcggagagccugucuuccaaccccaccggugcguauuucugcauaaucaccgcuuaaaggcacauuuugacagcccccuuuaucugcuugauguuuuuuucaugucugcacagcaaaucaccccacaccuccaaccaauuuuccccucucucucucuuaaguauucagcaggucuugccuuucauauuaauuuuuaugaccugggauguugccugugcgcguguuguguuguguuucguugugucuacaggcucacuuuccuccuccuccugcacucucggcuucuuucuguggcuucccucuuuuucucuucaccucuguuuucaggauuauuauuauuauuauuuuaacgaucugggaauguuguaggcgcggcgacggugucgagcccugggccggggcuuccggagagagggcguacaauucccugcugagcguaaugugugccuucuacuuacaauugcagagcaauauauucggcgggcuggaugagagucugcuggcccgcgccgaggcucuggcagccguggacaucgucucccagagcaagagccaccaccaccauccaccccaccacagccccuucaaaccggacgccaccuaccacacuaugaauaccaucccgugcacgucggccgccucuucuucaucggugcccaucucgcacccuuccgcguuggcgggcacgcaccaccaccaccaccaucaccaccaccaccaccaccaaccgcaccaggcgcuggagggcgagcugcuggagcaccugagucccgggcuggcccugggcgcuauggcgggccccgacggcgcugugguguccacgccggcucacgcgccgcacauggccaccaugaaccccaugcaccaagcagcgcucagcauggcccacgcgcacgggcugccgucgcacaugggcugcaugagcgacguggacgccgacccgcgggaccuggaggcauucgccgagcgcuucaagcagcgacgcaucaagcugggggugacccaggcagaugugggcuccgcgcuggccaaccucaagauccccggcgugggcucgcuuagccagagcaccaucugcagguucgagucccucacacugucccacaauaauaugaucgcgcucaaacccauccugcaggcauggcucgaggaggccgagaagucccaccgcgagaagcucaccaagccugaacucuucaauggcgcggagaagaagcgcaagcgcacguccaucgcugcgccagagaagcgcucgcucgaagccuacuuugccauucagccucggcccuccucugaaaagaucgccgccaucgcggagaagcuggaccugaagaaaaacguggugcgcgucugguucugcaaccagaggcagaaacagaaaagaaugaaauauuccgccggcauuuagaagacucuuggccucuccagagacgccccuuuccucguccgcucuuuucucuccucucuucugccucuuuucacuuuuggcgacuagaaacaauuccaguaaaugugaaucucgacaaaucgaggacugaagagggagcgaacgagcgaacaacugagcccaagccggugagaaugugaaacaguuucucaaaggaaagaauaacaaaagaugguauuugucuguuguagcaaaguugucccuuugaaccccaccucggcuucuucagaggaaguguggagauggcuguuugcaggaaggcagacgagacaguguuuaaaaaguccacaagaaugaucaaguaagauuuguuuuuauucuuacagacaucacccguguucaaguuuaaaaguacacuuugcaacuauuuuucagaaauagaaauugauucaggacuaaaacuuuaaacuagaguugaugcuuaaugugauagagacaucucuaaaguauuuugaauuuuaaaaaaagauggcagauuuucugcauuuacacuguauauuauauauauauuuuuauugugguucuuacccccuuuuccuucucugaaguguuaaugcuuaagaaaagaguugcgccugcuguguucacugaucuugaaagcuauuauuagauuauugcagaacaacccucuguaaauuauuaauuuaucucucuagcaacuuaauuuugugcacauucuaauuaauuaaacuucuuccgucuaaaaaaagugggggaaauguauagcuaguaacguucaaaaaauuuuguuugaugaguuuaccgaauuuuuacagcuuuccuccuauacuguguuccuuuugacccauuuguauauucucacuugaaugaagauuguuuuuuucuuuguuuuuacugguaguguucugauuugugagucgacacucaguaauggaugucuuaaucguguagaccugauucacugucugaaguauuguuuacuucguuacauauuuaauggggauucccacauuguccccaugacacaugagcgcucucacuuacccuuacacacacacacacacacacacacaccucuaacagaagggaagaagcaguuggaagcaugaccgaugcaccauuuucuaguuuuaggugcauuugccacuugguguuugcccuucagauuuuagauuucaccaagguauuucagucuuccaguuuucaauugcuuuguuggcuacauguuaauauuuauaggaauacuucaguuuuuccuuuuggagguuuguuuguagaaaaacuaauuugaacuauaagaaagacagugcacugcuuguaaauucacauuguuuggaaaaauucuuuuggaacaaaaaauuagguacaugauaacugguaccuuaucuacuguaaauauuucauuaaaaaugaugcacacauagauauauucuuacaaauuuugcuguauugcuguucucuuugaggcucuccaaagucuugaguucuguauauggccugguuucuuguuuuuauuaauagaugguuuauuuacuaugguaauguauuaauuuauuuuugguguuguucgauugucuuucauugaagagauaauuuuaauguuuuauuggcaacguaugcugcuuuuucauuaaaauaugcuauuaaaauuaaauggcuuuuaaaauguga

SEQ ID NO: 15661 - RNA, 40252 nt, Homo sapiens
cugcgugggaggauccggcggaaggggcggggucagguggcacuuccguggcuucgggcgggugaguauggggagugcgcgcggcguccaggagucgggacugggcucccgccuacggccgcccucccgccggggggccagcgcgguccuccggggcgcccccuggaggauuuggggugggggaaggaaaaggagaguauuaucgaauauucuccuaauauugauguucggggugcggauauguguggacaggcaggagucggcaaauggguucaaauggaagcuuuaacaaagaaaggcccuguacguaaacaguguuuuaaaauucucaucuugguuagguuucucagguuaucucugagccacagcaaggcagcuuuguuaagguggcucuucccuugucgcugccaaacccgguaaaugguuaaccugaggccgcgucagagaaagccacuaugacuccuaccaaagagugaaauugaaacucuuuucugggaaaucaaauccaggauauaaaaguuggauucaaacuaaaaguuacaaacaguaucuagguuccgucacauggcgugccgggcagggucuaaaucucuuucagcagagggcaugcugucuucauauguauuucucauuagaaaaugaaagacgaccuaaaccaaaauaauauaaaaauuuuuuauuaucugucuuaagaguuguacccuaauccauauguuuagaaaacauaaacuaauaaaacuuuuccaacuugguagaaagccaaaaguuuccagaaaaacuguguggauuauucagcauuuugcuguugucuacaauguucagaauauucuuuuacaauaauuuugcacuaaauaccgguuuguguucaggguaacaagagguuuuuaaaaagucaaagacaaggacagguuuuuuaagggcuguauucuauuaggagagacaaaacaagcaugaaaaguuacauauccauaagaaauguaaaucaccauuugagauauuugaagaugucaaaagaaaaccuuuauuuagaauggaaagagcuggugaaugcucgaaacauuuaccauuuagcugauuguugccaugugggaaugggggucucucaaacgcagauccgauuuucuccaacacaggccaaagaucuguauuuuuacguauuuuuucuugauuuuuaauguuacuugcaaccaauuuaguuaacacacaccuucugugggugggccaggugcaacuaguuugugaccucugcagauuuucaccuuaguacaguccuacacuuacacaaugguucaguuaaagauuuuuugacuuuacaguggguuuauccagacacagacccgauuguaagaugaagacucuuuguauucagaaauaauuggaauuagaggucagaaaaaguccuagagacugggauggucaggaaagauuuuaagcuggguaguauaggagagauaucauagagggggaaggauguaaaagaugaguuaaaucuugggguugggagaguuggcagguuuggaagauaguaaacucuccuuagaggaauuuuggaaaggcaagcgcaagaggugcugcuggccuggggacuacacuuugagaaccacuguccuaggguacggugaacuuuuggaggaauuugaguaggaggcuaaggagaucacauucaccuuucagaaugagucuugcugugaagucugaaaggaggacugaggagggagagagaaaagaggaaaguuucuuagaggugauuagcaccugcuugaugccaggcccugugccaggcucucucaugcauacucauuuauacucaccaugauccugauacguagaucuuaauguuuucauuuuguaagugaaggaacuuugagaauaugagaaauuacccagguuccauaguuggucucagagcuuccuaguucaagccuggauuugaaauagggugguagcagugggaaucaaaacauuuaauggugauggaauuuagaaaaauagagacuucucaagcacauuuaagccuaaaaguaggaauugggaaaucugaaucuuacuggaaaagugauaaaaaguaaaguggacagagaacuuuagagaaucccuucaugaauuugguauuuguucuuuauuacucuuaacucaugaugaccuauuuaaaaccuauuuaaaaguugcuuauuuaagaagucauccugcucuacaaaaguuuccugaaauuauuugaaaaagagaaaauaaagccuucugugguugggggggguggaauaugguaaacagauuaauggcauuugacagcuuaucuucaaaucaaaagugauuagcauugagaaauggaaacacuugguacaacacugcauugccuguacgaauugugcugugcugcagacacugaucuacuguauugauuuaggaaauucuguaugcuuuuucuugccagaguaguuauugaaauugagaauauucauuggaucaauuucaagauaaauaucccaagucagacuggcugcugcugagcaaauuuuuaaugaaggaaaauauccauauauugaaaucaguuuaaaaagaaaguccuuaaaauauauuacuguaaaaucuagaaaaaaauguacauuuuagaaacaucaauuaacugaguaaucaguguaguggaguuauugacccaugcagaauuaugguguacauucauuaauucugugagcaaauaauugugcuauaaauacaaagauaacugauaugguuuggcugugucccuacccaaaucacaucuugaauuguaacucccacaauccccaugugucaugggaggagccuggugagaggugauugaauuauggggacaggucuuuccugugcuguucucaugauagugaaugagucucaugggaucugaugguuuuaaaaaugggaguuucccuacacaagcucucucuuuccuugcugccauccauguaagacaugacuugcuccuccuugccuucagccaugauugugaggcuuccucagccacauagaacuguaaguccauuaaacccuuuuuccuguauaaauuacccagucucggguaugucuuuaucagcagccugaaaucagacuaauauacuagauauggccuacuuuugagauaucuuacugaaucuuguaaagcuggggaauuucucuuguauuuugauagugcuuagcuuacaaauuguaggaugaagccauauucucgggaaucaugaaaauuaguugaaacauuuugauuugauuauuauuauuuuauggcuguuaugcuuuugauggaggcagauacaaaauucaucaaugcaaaauaauguuuuacauacucauuaacauagugauuaauguaaacuauauuuugacaauguaaaauacaguguguuuggccucaaaaaagaaacuacagaguuagcugcaacuuaagauaacuggaaaggcuccuuacauuguuuuuugcccaccaccuuuauuauaauaguucuauaugaugucuggggagggaauuaaaaaauaauacaaagcucuuucagcugugguucagagaacucuagugaagcuguauggcaaugacacugugaguccaugaaguuuccccagaaguauuucaauaagaggcaguuaagaagcuuaauaguuucaaagucuggaaagcagcaaauauaucuuagagaauuuaaaaacauuauaaauauaaaacccacuucucucuuacagagacauuuuaaagcauggacauaacuuuaaggagauugagaaaacaucaguaguuuucauaaagcuucaaugaacaccccaaggcacaaguguugaaaauggccuguucacuaaaaugucacuuuuggagguacagguauacuguacuuacagugagaggaugacuuuaucccugguuaaaagcaccaggugucaagcuccacuuccauuacccaggaugcaccaauaaucccuaugauagugaaugguucaaguacuauacuacauuuccaacaugucuuuugccuauuugcuuaguugguacuaggguucuuuugaaccccacagguguguagaauauuuuaaaaggcuagaacuaccucaaaaauagucuugaaauaauaccgagcccuucuaaaagagcucacuggauauuuuaauaacauuuacagaaagaaagaaagacaaaauuugcaguagcugaguuucuuucaagugaagaauaauaauguagaacauguagucuaaaauguuugguaauuaaugucaaaaguuccaagauuauuaauauauauuuugguaaucacuauuggccagguuaauuuuuugugcaaaauacacuguauauuaauagacuaggaaaaucauuauuucagaccaguaacagaagaaaacccacagcuagagaagcaucuauagggcaauuaaacguuagggaaguuuacuagcuuuagaauacauuaauacacuucgauuacagaaauauuucauuuuuaaaacuugaguguuuuaauguacuuuuaguaacgaccugaucuaaggagccuuggaggcuugugaaaaagacauacccacaaagaugcugcauuucuggugugggggugaauuaacacuucuguaagaaggaaggaacugaaucagcucagcaucaauacacaacauuuuucuuuuaaacaguaacuuauaaucugaugacucacuucacuuuacuaguucaaaauuaggcaggagaagaacuaagcuaacuggucagacccagaaacacaaugauuuggcaagccacagucacucagcucaugaugugugauaaucagcagaaaggcugcucaacucuuguccacuccuucacaucuguagaggaguuugauauaaccacuucuuuuuaucaacuuuaagcugcauacaggcaaagagaucacaaacugcagggaggccauaauggucuggggggaaguuauauuccuccuguagaggugaauuaaguaauacuucuaggucuucuuucgaagcagucacuugucuucuccagaggauagcuggcugagguugcccaucuucuuucccagcaggagccagucagcuguguuaaaggaacaccaggaagugcucauggggcuuuuuagcuuuuguuugccagcuuugucuucaguauuaggcccuuucuuaggacuuccuucuuuguaugggggccugauaagccacucugacaaggugcuguucuuuaugacuuggaaggaaucagcaauucuagaaggaaccagcaauucuagaaggaaccauugacuuuggugcuuuaguucuauuacuucuuuacuagaaggacagagccacauauucagggaaucuuuauguuucucaggcucagguuuggguuccaugggcaucccauuuuuauccuuuccuucuuuguucagaagccacuuauacagagccuucuccucacaauucucaucauacacgcacucugcaaagcuuaugcagggcucauuggcucugcacaccuccucuaccuuacauggguccugaugguucuggacaagccaauccucuguaaccaugcuggggguguacaaugguuucuuggcccccaaguggucaugcaggcacuuagauugcccacguuuuccaacuccauaccuuugggcugguuucccugacaguugguacaggagucagucuugacaagccaaucauucauauuauaggacuggaacaagagcucaaacuucucaccgguuucaugacugccauucucgggcuuccccagcuuaugggauuccuggagagucacuagccaaucugauagguucaucucaucucgaucaggaagcucuagaucuucaaccuuuuccauuucaauggagaaagaacuaguaguggaauggcuguuacacuuuugauaacuugguuuuucaggaacuuccuguugcugacucuugaggagcaaguuuucuaagcccuuuagguuuccccagacauuaguaaagaaauugcaggcucuggaagaagucugucuauucuccaaggucugcuuuuuggugagccaguccuggggguuggugcuggguauguaaggagccuaaugaccacuggcagguuugcuuccaaggagccauuugcugagagggauagcugcaauacuggaugcugacuucugcucuggcauagggauauagccucuucuccaggaagggcccaauauuugaugaacuagcauaagccaucaagugcucagaaauuugaauuguuuugagagaccuaaauauggugauggucuggcacagagcaguugugucagcuucaaagaguaggacauuugaaucuucauacuuaagggucaaacugcccagucucucuaggcacacagagacuugauuggcuagaucuuuguuuuggguacacuccaguugaugaauaagacaauugaacuggccugauaaccaguagagcugcugagccugcuguugaauugucuccucuuuaagcugauagaugagguccaccuguucauuuagucacaccucauggcuucuaagacguuccagaugacggguuaugcaacugugaaucugagcuuugaccucucgcaaguuaucuuuaauuugcuguucagccuggagaacuccaccaauagcaagcuccaagucccuccgugcaucacuaccccucaaaagggguucucuauuacuggagcugccacucuggucuuggaagguauucauucugcucacagcuccaggucccagugccucucuggggcagucggaggggaccuuggguggacugagacacggccccacacaaaccuagggcccaaagcugauucgauuauugaucuaguucuuugauuucuucccaugagaaagcaggaaaagaugcugaguuacaugagcagguaggaaauaauccuucucucuacuuacauaauuuugccauuuuaguggaauuagucuguucugccugugacaguauauaaagguagaaagcugcucauacaaggcugaguuauauuggcucuuaaaaaauuuaugggcugcuuuaaaaucugguuaauuagauaaauucaugggguuaaauauguuaugaacuuaguuaucaggagugaauuauuguccguggagcaaaaaacauuuuaaaauguggucuguucugucaccuaacacaucgagaucuacugauaaaaacuuagcacucgaaauagaaacuaauuuuucauuuuggccuaagcaaaaaauaaauaaauaaaaagauaaauagccagccauaaucaggcauauucagauauacaggauuauuuuauuuucucuagaguugacaccauauaaaucuggauuugugaaauccauaguuuuuuccaaguucugccacuaguucugaggccuuggugaaucagccuuaugccgcugagccucaccuuuaaaauaggaugucauccacuguaggauuguugugaggauuagcugaaaaaaugcaugcacgaugccucacacaugauaaacacucaguagaagguagcagcugcugcuugccauucagaugcuccaaagaguuggggggaagcaagaaaauuaguccccugggaagaaguuugaggauaucaaauccagaauuacauacaucuggauagcuuuuugguuuuggcaaaagaacuggaguaagaugguaucauccuuuuucucguucuuucuuuucacuuaaaguccuuuuaagauuuguauuggcaucagaaggcagagaacugcaaucccaauugugauaaaaccugcaguauaaaucauaagcuuaucagacgguguggauuuucugagaaagauugcaauuaaauuguuguaagaaaccacuauuuuaaauguuaaagcaaucuagaauauuuauuuagagaauauuugcuuacauuauuauaaauggacauaauuucauguaguaaagcuuuuguuacuaaguuuugauuccuugcaaacuuaucuuaccauuuuucuguuuggaagguugguugcaugucaaaggugucuugauucaaaacaggaaacuuagaaggcaaaauguuuuaguaaauguccuucagucacacagguuaagauuguuacccaaacuuuucuuuauaguuuaguagauuaacauagaguagauggaguauauauucaugaaccuaaaaaaaaaauuggaagguuacugugugccaggcacugugauaguuucugaggaaauaugcccuuuuucugggagaaucaguugaguugagcaaugagaauugguaaggagcggucuauaaguagauaaauuagaaaacaagaagacaaauacuauuuuugaggugggaacaaaagacuguggagcauugaauagaacacuuaacugccuggagaaggugggggaagauguaucucugaggaggugcuauuugaacugaguaggcauuugucagcaaaaaugugaacgauaugcacuacagacaccuaauuuuuauuauaguauauauauaguuuuaaaaaaucuaccaugcucaaaaaugguuacuaucucauauauaucauguuauuucagacuacuuuugaacuucaaauuuaacaugauucugauaaaauaucugugcauggaagaaaugguaaaaugugauuauugcuuauuucaccuugcacauaauucuuuuuacuaaauuuuuuuaguauauaugcuggcuuuaugucuaauuuagaaacugacguauaaaugcauugaauguaacacugauagucacaauaacugguaaaauuaaggauucaucaaauuugacucugauguuaggaagaaaucuaaaugcaaaaggaagcaaguuacagguuauggcaaagauaauaauuaaaucaugaguaguuauuaggcauuucuuauuaaauuuuaaaaauucugaauuuuaucuuuuaaaaaagauuuuuuugguuacuuuuucuuaccauagaacuguauuaguuuccuauagcucugguaacagauuaccacaaacuuagugucuuaacacaaauuuauuaucuuacaguucuauuggucagaagucugacacgggucucacuaggguaaaaucaaggugucaguagaucuuuguuccauccuggaggaucuagaagagaaucaguuuccuugccuuuaccaucuucuauagguuguccucauuccuugguucauggcccuuuuacuucaucuucaaagaccugaagaguggauugaauccucacaugaugucacucugcuauucauuucuaccucccacuuucauauuaaaggacauuggugauuacauuggguccaccuggauaaucuaagauaaucuuuuuaccuugucagcugauuagcaacuuuaguuccaucugcaacuuuaauucccuauuugccauauaacauaacauauucauaggauccagggauucggacguggacauguuuggggagccauuauucugccuaucauaguaacauaugcuguuuuuaaaaaagcagaaauauguggucagccaaaaaacaacauaaaagcaccauaauaccacuccucuguagaugaaguuauauacacaucaauauauauauaguuauucuauguguguguguguauauggggagggugucaauguguguuuaacauuuuugaaaaaggugucacacuuccucuuaaucuugaauccuuuuuuuaguaaucuggucucguggauuuaaaugacauauaaacaucgaaggaauguugaauuuuaucagaugcuuuuucagcaucaauugaaaugcucauaugguuuuugccuuccauuccguugauaugauauaucacauugauugauuuguauauauauauuuuuuguuuuguuuuuugagacagagucucgcugucgcccaggcuggagugcaguggcacgaucucagcucacugcaagcucugccuccugcguucacgccauucuccugccucagccucccguguagcugggacuacaggcacccaccaccacgccuggcuaauuuuuuguauuuuuaguagagacaggguuucaccauguuagccaggaugggauuuguauauguugaaccacccuuguaccccagggauaaaucccacuuggucaugauuaaugaucuuuuuaauguauuguugaauucaguuugcuaguauuuuauugaggacuuuugccucaauaguuaucaaaauucauucuauaaggccaguauuauucugauaccaaaacuaaugacauaccuaaaaaaagaguacuagagguauucuuuuuuauuuaguauucaaaagaauacuagccuuguauuaguucauuuucauguugcugacaaagacauaccugagacugagcaauuuaaaaaagaaagguuuaauuggacuuacaguuccacauggcuggggaggcuucacagucauggcggaaggcaagaaggagcaagucccaucuuacguggauggcggcaggcagaaagagaacuugugcagggagacuccuguuuuuaaaaccaucagaucuugugagacucauucacuaucaggagaacggcacaggaaagacccacccccauaauucagucauuucccacugggugccucccauaauaugugggaauuaugggagcuacaaggugagauuuggguggggacacagagccacaccauaucaagccucuagguauuuuuuuuuggaaugucuuugguuuggguaucagaguaauacuggccucauauaaugaauuuggaaauacucccuuuuccucuguuuuucagaauaauuucaguaagauugguauuaguucuuuaaauguuugauagaauucagcagugaagccaucaggucccaggcuuuucucuauuagacuuuuuauuacagcuucaauuucauuacuuguuauugguauauucagguuuuggauuucuucauuguucaauguugguagguuauauaugucuaggaauuuauccauuucuucuagauguuuucaauuuauugacauauacuugcucauaauaagcacuaaggagacuuuggauuucugcagugccaguuguaaugucuccuuuuucaucucugcauuuauuuauuuggaucaucucucuuuuuuccuuaguuuagcuugcucuugauuuucuagcucuuuaagaugcauuguuuaggccgggugcgguggcuaacaccuguaaucccagcacuuugggaggcugagguggguggaucaccugagguugggaguuugacaccagacugaccaacauggagaaaccccaucucuacuaaaaaaacaaaauuagccgggcauggcggcacaugccuguaaucccagcuacuuggggggcugaggcaggagaaucgcuugaacccaggaggcggagguuguggugagccgagaucgcaccauugcacuccagccugggcaacaagagcaaaacuccaucucaaaaaaaaaagaugcauuguuuauuugaaguuuuucuucuuuuuuaauguaggcacguauagcuauaaacuucccucuuaguacugcuuuugcuguaucccauagguuuugguaugauguguuuccauuauuauuuguuucaagacauuuuucaauguccuuaauuucuucauugacccaguguucauucaggaacauguuguuuaauuuccauauauuuguauaguuaccacaauuccucuuguuauugauuucuaguuuuauuccaaugugguuagagaagauguuugaucuuauuucaauuuuuugaauguuucaggacuuguuuugugagcuaacauguagucuauucuugagaaugauccauguaccaaagagaagaauguguuuuccacagccauuggaugaaauguucuguaaauaccuauuagguccauuuggucuguagugcagauuaaguccaauguuuuguuauuaauuuuuugucuggaagauauguccaauacugaaagugggguguugaagucuccagcuauuauuguauuggggucuaucucucuaucuccaauaauauuugcucuguauaucugggugcuccaagguugggugcauguagauuuaaaauuguuauauccucuugcugaauugacugcuuuaucacuaucuagugaccuuccuugucucuucuuacaguuuuugucuugaaaucuauuugucugauacaauuuuaauuacuccuguucuuuuuugguuuccauuggcauggaauaacuuuuuccaugccuuuauuuucagucuguguuugucuuuauaagugaagugggcuuccuauaggcaacagaucauugggucuuuuauuuuuuuuauccauuccaccacucuauguuuuuuuaccagagaguuuaguccauuuacauugaauguuauuauuaauaaguaaacacuuauucuugccauuuuguuauuuguuuucuggucuucccuucuuucuuuccugucuucauuuuagugaaggugauuuucugugcugauaugauuuaguuucuugcuuuuuauuuuuuguguaucuguuguauguuuuuugguuugagauuacuguaagacuugcuaucuuaucuuacuaucuugucacccauuauuuuaagcugauaacaacacuguuuauauaaacaaaugaauagaaaacuaaugaagacucugccuuaccgugaucccuggcuuuucaauuuuuuguuguuucuguucauauauuacugucuugaaaaguuauuguaguuauuuuugauugguucauuguuuagucuuuauacuuaacaguaguuuauacaccacagguacaauauucuuuugcuuacuuucuauuaccagugaguuuguaccuucagaugauuucuuauugcucacuaauguccuuuucuuucuugcugaaguguccucuuuagcauuucuuguaggaaagguuugguguugagaaauuucucugcuuuuguuugucugagaaaguauuucuccuucauguuuggauauuuucacuggauauacuauucuaguguacauuuguuuuuuucccuucagcacuuuaaguagguuaugccauucucuccuagccuauaaaguuuccacugaaaagccugcuuccagucauauuggagcuccauuguauguuguuuguuucuuuuucuugugcugcuuuuaggauucauucuuuauccuugaccuuugggaguuugauuauuaagugccuugagguagucuuuggauuaaaucugcuuggugaucuguaaacuucuuguacuugacuauugauaucuuucccuauguuugggaaguucucuguuaucccuuugaauaaacauuuuacccaucucuuuuucuacuuccucuuuuccucuuuaaggccaauagcucuuagauuugcccuuuugaggcuauuuucuaaauccuggaggcaugcuucauuguuuuuuauucuuuucucuuuugucuucccucacuguguauuuucaaauagccugucuucagcucacuaauucuuuuuuuuuuuuugagacaggggucuugcucugucacccaggcuggaguguaguggugugaucaggacuugcugcagccccuaccucccaagcucaagcaauccugucaccucggccuccugaguaacugggacuacagccaucacacccagcuaauuuuuuuguuuuuuguagaaaugggguuuugccauguugcccagcuggucucgaacuggguucaagggaucuguaugccuuggccucccaaagugcugagauuacagguaugggccaucaugccuggcccaagcucacuaauucuuucuucugcuugaucaauucugucuuaggagacucugaugcauucuucaguaugccaguugcauuuaaucuccuuguuaaauuuauuugauagaauucugaauccuuucuugugguaucuugaauuucuuuuucuuuuuuuuuuuuuuuuuuuuugagauggaguuuguucuguuacccaggcuggaaugcagugaugcgaucucggcucaccacaacuucugccucccagguucaagugauucuuuuguaucagccucccaaguagcugggauuacaguacccaccaccacaccuggcuaauuuuuguauuuuuaguagagacgggguuucaccauguuggccaggcuggucucaaacuccugaccucaggugaucugcccagcucggccucccaaagugcugggauuacauaugugagcuaccacauucagucgugucuugaauuucuugaguuuccucaaaacagcuauuuugaauucucugucugaaagaucacauaucucuauuucuccaggauuggugccuggugccuuauuuaguuuauuuggugaggucauguuuuccuggguggucuugauacuuacagauguuugucuguaucuggacauuaaggacuuagguauuuauuggagucuuuauagucugggcuuguuuguaccuguccuucuugggaaugcuuuccaaauauuugaaagggcuuggguguucugaucuaagccauaucugcauuuuggggcaccccaagcccaguaacacugugguacuaccuuggugaucuuggauaagauccugaagaauucucuggauuaucaggcagagacucuuguucucuucccauacuuucucccaaacagaaucucugucuguuuugagccaccuggagcuggggauaggguuauacaagcaacccuguggucaccaccacuguaacuguacugggucagaccugaguccaacacagcacuggguuucaccaaaggcccacuguaacuaccugacuaucacuuauguucacucagauuccuagggcuauacagucagcgaguggcaaagccagacaggcuuauguccuucauuugagggugguaaguucccccaggcuccagguaaguccagagaugccauccaggaguaaaagccuggagucaaaaacucuggaaaucuacgugaugcuguguucuacuguggcuaagcugguguucaaaccacaaggcagcauccuucccauucuuuccucccuuuuccaaaggcagaggagccucaccccaugacugccacugccacaggcccaugaagagugcuaccagacuacugcugaugcucccuuaagauccaggggcucuuuggucaguuuguggugaugcuggcugaucagggacuuacccuucagggcagugggcuccccucuggcccagggcagguccagaaaugccauccaagagccaaggccuggaacuggggacccgaagagcccauuuguuucucuaccccacuguggccaggcuaguaccuaacaugccagacaaauuccucuuuacuuuucccuuugcuuuucucaagcagaaggagucucgcccuguaucuagugcagcugggaaugcgcugagucuuaccugaagcuagcaaguuugagagucucacccaaggcccucuauguaguaccuugguauugcugcugggcccaagggcucuucagucagcaggugaugaauccugccaggacuggcuccuuuucuuuaacgcagcaaguucccuucuggcccagggugucuagaaaugucguucaggagcuagggccuggaagggggaccucaugacucuaacuggugccccauccugcugugacugaggauauccaagaugcaagauaaaguccuccccgcucuucccuuuccuuuccucaagcagaaagaaggugucucuuuugcagccaugagcuaugcagccugggauuagggaaggagugaugccaacacuccuuuugcugcuccagcuggugucucacuggguuguguucccccucccugaaacccccuaguccacuggcucugggcucaguucaacacuaggacuugccuaggaguugcaguccuuguggccuagacugccauuaaaguuuaauugagacacuagagcacuuuaacccacaguggcuaggcuucugugagcucaggaaacucaaguuucaagcucugggaacagccaggccucucuggcugguuuagugguuaauaguuccuucuguguguggugccagcugaguuuuucagguuugcuuucugcuauaacagggcggcacugaguucagugccucagaauugcuaucccucuccccaucucacagaaaugcucucugcaucaugccacugcugccagggcaugggagaggggugguguuggggauucaaaacaguuuuuccuaccucuucugugccucuuugagugauacaaaguuaaaaccagguagaaaaugauuggugaagccuuguauucugcuaucgugcucugacccugaccaccucugucacucuuuguuugaacacagcuuguuugguaauaggagguagucaugguaaggacuuguuaauuaaggagcauauuuuaaauaguucuaauuugcucuuagacuacauaugacaacaucuucccuaugggacaauaggacuagauuugguaauaagaauguuuucuauccugcagauuuccucucucuguucuuuggcuccuccucaugccaccagcaucacugcaacugaaaagacuucuuacucacuucagaaguugggcagaguuacuaauaucuacuucccuuuuagccaaaggacuucuuuguuauuuuaauauaauuuauuaaguaaugccugccauagagagucaaacaaccuggguuugaaucuuggcccugccacuggcuaugacugugaucacucagcucucucaguguucuuucccccuucuguuaaaugaaaauaauaacuguuguacuguccucauggaauuaacuggagaauaaaaugaaauaaaauaucugaaaguggcugguagacucuaaugugccaggcauuuggggaaugaaauaaguucagaucagcagcagcucuuuuuuucuuuuuauuuaagcaauugcagugugccaggcuccaugucaaacucugaggauucuaauaaaauaggauaggucaagaaggucuuaaaucaggcuuuuccuuuccauuccuuaauaccuugccucagucuagguccucaucaucuccuuugguuccuugcuaggcuuccugaacugggcucuguuuaaaagucucaucacucuugacuucgugucacugcuucuagaguuaucucuucaaaagcaaaguugauuaugucaccuccaaaaaggucucugucauuuguccacugcccacaagacaaaauuuaauuucuugaccucaguuuaccuccgguccagccucaucuccuaucaguaguuccauauacccuaggcuucugccuuacugaauuucuuaauuuucucugagaugacagggaagagaccaagucccaacucugauuuugcacauuuaaguccucagacuggaaagccugccucaaccuucuucaacauuuuuguuauuucagacucggucuugacuucaacuccucugugacuugaauuccccaaggagagugagcuccuguaaucuugucugugcccauggcacuuuguucuuucuuugaugucacguauuuuauucugugagcucuugaagugcuaggauuagguuauuuaagauaagauaaugaacgaggcauuguaccuaagaaaguguagcaggucgaaagauggccuucaaaaagauauguccacauccuaaucccuggaaccugugaauguggcccuauuuggaaaaagagucuuugcaauguaauuaaguaacuaauucuguuacaguaauuaugguaauuuguuacagcagccauagggaacuaauauauuaauagaagguuaugguauaauggcuggaacauaaucaaauacuauugucaucaccaucaguaccauugcuauagucaccauuacucuuaucaccuaucaugggaccugaaaaguaguauguucuuagaaaauagugguugaauaaaaauacaguucuugccugugggauuccagucuauugguagugguagugcugcugaugagaauugugcuuaaaggugguauugaaagagagcuuccaaaguagacucccucuuaaaguuuuguuuuaaaugucuuuuuguguguuugugugaaaggugacauuagaucuuuuaaaauuguuuuuuagaaacacuuuuauacauuuuuaauuguccuuuuagaauaaggcuaauuuuguacaaauagacauuauaaugcaccccccaccccaccgccccauagagaaaaaguuguuguuuuuggaaaacugaugagcacuuauaguucuaccaguuuaaaaaaucuuaaacuauucuuuuuucccuaauagaauguuaagaagcuaaaauuaauuucauguucaucggccuugaagugccauuuacagguauaccuuggagcaauaauuuauuccaccaugccacaaggugcuugaaaaucaaccaaaauuuacaaauacucauaaacccaaacugggugaguuauauauaacuguaaauuuuaguuugcuacuggaagaauuauuaccaguguuucauaacuugguguaauuaaaauaaaagcuaagguuaauugagcucuuacugcaugguagacacuguucuaagcuuuuuacaagaauugucauuuugcucucacaaccacucugcuuucuuaccuauucucuuuacucaagaggaagcugaggcacagaguggucaaguaacuugccuaagguuauuuuggcuuaaguggcagagauucauagugaccgcggcucauaaccucugcacugcccugacucggcauaccaugucaacuuucauuuuuuaauacaauuugaaguagagaauaucaguauaucaucauaaaaaagauccuuauggccgggcgugggggcucaugccuguaaucccagcacuuugggaggccgaggcgggcggcucacgaggucaggagaucgagagcguccuggcuaacacagugaaacccugucucuacuaaaaauacaaaaaauuagccgggcgugguugcaggugccuguagucccagcuacucgggagacugaggcaggagaauggcgugaacccgggaggcggagcuugcagugagccgagaugacgccacugcacuccagcaugagcgagagagugagacuccgucucaaaaaaaaaagauccuuaucuaauuucguagugguucaaacuuuagugugaaucuacagggauucugauuaguggggcugggaaugugcauuuuaaauaagcacccagguggcucugacuaugcuuugagauacaccuacaguucacuuauggcuuguuugugugcuuuaaguuaggcuacucuuugcauacaucuguguucaaggaugagucuacugaauacaaacauguaucuaaacuuacaccugaagugcccaccguaguaaucacauuucuuuuuguagagagugaauacaaggccagcaucagagagauucauuuuuuuuuuuaaccuuuuguaugagcuucagaaucugguguauugaccugaggaaacuguuaagacgaauuuaagagaaagcauaacauaaaguuucuacccuagugguauuuuauauauuguuuuuauuagaagaaaaaguguaaauuccacuucgcaguagaguaguaguuccauuauucggguuacucugaauauuaacuguggccauggagggagucuucucuuuuaaguuuauuuaguaagaaaacuuucacccauuuguacuaccaaaaacucugauuaugugugguuuagaauaugggggaaacacuaggcuuucaaauuuuacuacuucaguauuuuaguuauauaucgaacuggcuaacauguuuuucuuucuucuagggaggucacaaucacauugagccaaaacgcauccaguguuuucuccaguuacaaauaaaacgaauaugcccaugcugcuaccacauccucaccagcauuuccuaaaaggccuuuuaagagcaccuuuccgauguuaccacuucaucuuucacucaaguacucaucucggaucaggaaucccaugugcucagccguuuaauucucuuggacuccauuguacaaaguggaugcugcugucagauggcuuaaagagaaaauuauguguacaaacaaccuuaaaggaccacacagaaggacuuucugauaaagagcaaagauuuguggauaaacuuuauacugguuuaauccaagggcaaagggccuguuuagcagaggccauaacucuuguagaaucaacucacagcaggaaaaaggaguuagcccaggugcuucuucagaaaguauuacuuuaccacagagaacaagaacaaucaaauaaaggaaaaccacuagcauuucgaguaggucagucuuuuuuguguguuuucucaguaaauauuuuuacaaauucucuguauucuguuuuuuaaaaaaaagucuaaauaguuugcaaucgaauggcgacuuuuuucacaauauuuggaugaauuuuaaaugaguuuuccuggcaaauauuaguuuuguuaaguugaaaaaauugccaugacauuugaaccaaggcuauguauuuuaagaaaauaauauaagauuuuuacuuuggcaagaaucuugcucuggaucccaggacagaaauauucauaggaagaacuacuagugaguuuacuccuuuuucuuuuaguaguccuucugcuuaaauaguuuaaagugaauucccuguuuuguugucguaucaacuauaauuaucacguuugaaaauucugccucuuagguauuucauuagucuuucuauaggcaagucucacuuccuucagguacuuuuuauugaguuucucggagugacuguaaacccagccuucucaauaccaaaauguauuuuauuuauuuuuauuuuuuauuuuuguacuuuauuuuuugagacagucuugcucugucgcccaggcuggagugcaguggcgcgaucucggcucacugcaaccucugccuccuggguucagguucaugcaguucuccugccucagccucccgaguagcuaggauuacaggcaugcacuaccaugcccagcuaauuuuuguauuuuuaauagagacaggguuucaccauguuggccaggcuggucuugaacuccugaccucaagugauccacccgucuuggccucccaaagugcugggauuacaggcaugaacuacugugcucagcuauuuuuagucucacucuaucacccaggcuggaaugcaguggugaucauagcucugacaucaugcuuggcuccaauaucaugccuccaacaucauccuuggcuaauuuuuuuuagaaguuuuuuguagagauggggucucauuauguugcccaggcugguaucaaacuccugggcucaagcaguccucccaccuuggccuaccaaagugcugggacuacaggcaugggcuaccaugcccagccuaucaaaauguacuuuaagaaagagaucauauuuauuuauugucuguauauuagauguucauuugauuucuugaacaauuugacuugguucugaaauuguuuuugaaauugugcauuguaaaacaauuuagauauguuugaccagcaggaauuaaacaagccaguuuagguggaaugagaaugucccacgguggugaacuaggugauuugaaccaacccucgugcuaaaaacaacuugucuuggugguuaaagugcaaaaauuuuguggagaaugaguaaauacuuuuaaaauuucauguuacauuacaccuuugucucacaguuuauuggcaaugcagacacaaaagccuccuaguuuuuagguuaaugggcauagaugcuuuaagauaauuucaaaauagcucaccaaccaauauuuauaccaguccccauuuuucagacuucuuaaucuucugcccuuacugagggauucucauuuugagaguacuaccuuggauguuaauaaucuuuauguaugguaaacaaagauaauagcaaacucccgcagagaaauucuagguaugacaaagugccuacuuacuaagauuuuagagaaucugugaaaaaaugucucagaaauguguggaauuaacuagcaguucacagauaacuuuguagugcuauuccaguucuuccaucuugaucuuaugaggccagauaaaccugucuuuauugcaguuauuuuuuucaccaccauaaguaaaagcaacaaauguuuauucagcaccuaaaaagguguuuaagauaguauuggaucugccccaagaauugugguaaagagucaggcaucccauacacuauacauauuuugaguguaguuaguuaaaugucuauguuuuauauauuucauuuaacauacacuuauaugucucuuaugccaugcacuguucuaaacauauugcagacauuaacucaucuaauucuuaaaacaaccugaagagagagguacuauuacuauaucuauuuuauugcaguggacacugaggcauagaaagagguuaaguaauuuacccaagaucacauagcucgugggaggcagagcuagaaugagaacuggcugcguggcuucaggguuugugcucuuaccggccgugcacugccaacucuccaagugggggaguuuucugcuuuucuuaacauaaauuauuuuuuucagaauucaguuuauauucuuugaguuaugagugagaugaagaaaaaagaugaucccuuauaaauagaaaauugcuuucucaaucacugggaauuucuagaauaaugaguuguuuuuccagugggaagaaguauacagaacugagguagguagaauaauuacugaucaugaugagaggugggcagauguagaaacugagcacauuaacaauggagacaaugaagucuguccagaaagaucuacuuuauaguacaaaggcaaagcauguuuuguaguuuuuaaaagugaauuuugugaacauuuggaacccaggguguuuccuuccuauagccccauuacucaggaauuaaagaaacagauuuuuauuugccauuuuaggacauguugaaauauauuaauugugguuuuaauacauuaggggaaauagaagguagucuaauauuuuacucaguaaaacugaucguaguucugauuucauuuguuucauugaauuagaagaucucuuuccaccguaggauugucugggcccccuggugcuggaaaaucaacauuuauagaauauuuuggaaaaaugcuuacugagagagggcacaaauuaucugugcuagcuguggacccuucuucuuguacuaguggugguaaguauggcugauucuuuuucaauugcagaggucugggggcuuucuguuacaauuuaguaggaauuggcacaguugggugaccucuaacugcuagcuaaguuuggucucgcuaaaggaagggaguucugcagaguuagguggaagcugagagaaguaguuugggaguguuguacuccucagaggaggccagcuuguggauagcucagugggcacucagaaaacugcgacaacaggugccagaaguugaagaugaucaaaugcaaauuucaguccuucagcuuccaugcauaaggccaggccccucuuugcuccuguuguguuuccuggcugcauuagcaccugugcaauucagaaaauagguccuuacucaugugucauuuuccucauaauguuuuaacaucucuuaagcuuuagaaaaaccuuacugcuguuuauaauugucaacuguuuauauaauauguucaguuaaacagaaagcucuuagaggggcacuguaauauacugccauuccccuuacaguauuuagcauaguacauuguacguugcacagaauguuaagcaguuacuuucugauuugaugucaugaagucacucaaaguuuaauuugcagcucaucagcgauaaaaugaauauaaacuuaguuccccaaaggaucauuuaaagaaaacagaaagcauaccauauaaacaggaaagguuuuuucuucccuuaccccucuuuaugauuuaagcuuuucauauuacaguuacucacuuagcaaguauuugagugccuacuauaggugaggcauuguacauggaagguucuuaaacuguguuauauaauggugaacaagauacaguccuggcuuuagugagguuuacaucuuaugcaggaaacacaaacacaggccauuacaauacaauguguguugugaagggguaaauacaagaugcuuuauggaaguauuugguuuuugcauacuguguuauaauguggguuuaauacuaaguauucagaaugaugauguaaucauauuuuagggacuuagguuaauauagacguggacaauuccuauuaucaccccauuccuauuaucaucccauugagaaaucuagcucagaacauucaaaauuuuugagucacuauaauaaaaaaaguuaacuguaaaauaaaauuuuugcucacaagguucaaaauuaaauccaugucaauauguugucucauuuacagcuuuagaacuuuguuaaaaguaaguacuuaaugaaggauuuuuuaguaaguggcccucauuuauauauaggugagaaggccauucccccauuuucacaauauucuagaauacuuaacaauagaaaaaaauaauagcuugagauaauaauagacaaaaauaaugucauaaaauagccugugauuaaaguuacauagcuauguguuuccuaaccuuucucaaaaaauaguggucccuuucucaggcaaaaaauuauauagacuuugaaagaaaaaaauacaaggauagacaaaacacuaugaauauaaauuucuaccuuauuguaucagugcauacacuugaaaaacagcauuacauuaaaguuugagaagcauuaguuuuuuggucuauagucaaucuuuuuugugcuuuaaauucacagacccccugugauagcuuugagaccuucgugagagucuacaauuaacaguuuuggaauuucuggcuaagacauaggaaaguaauuuccuaauguuuacuucagugugaugggaucuauaggauaguaauuuaaaguauagcuuuggcagauuguuuacuuacacagagauuauuucaugcagaaaauuaccuuagaaaaagguuguaugugaaguaaauaaggaaguugauguaugggguacauguguggucuagaauuagaaccuaugagaagacucugaacuggcauuuagugguaaaagagcauaucuuuaagaaacuuuucaaucuuuaacauuauguggaaagauauguggaaacauuauguggaaagagggaaaaugaauauucagauuagaacagcaguacaccuacaaauguugguauaugacuaaagcaaaguaguaaaacauaauagucccaggacuuucagucuucuagaauuuguaaguauugauguuugucaaaauauuauacuacaaugaaaacaaaaacauaaccaguuuuauuccacaguuauugagugccuacucuuaacacuuuguuaagcauuuaguguacaaccuauguaagacgugguccuguaggcaaagacuuauuuaaagcaugguuucucaaguuuggcgguagugacauuuuaugucaaaucauucuuuguuguggguggcuguccugugcauugaaggaugcuuauuuagcagcauaucuggccucuacccaguagaugccaguagcacccuaccccucacuugugacaaguaaauaugucucuagacauugccagauugcccccaguugagaaccacugugugaaagagauaagaauuaaaaauaugaaaccaaaaaauguguuguaugaauaguuuuccauccauuaacucagcuuacauugcauucagugagagcuccaaauuuucuaaguaguaggcgauuagaagcaacagacugggcagaaggggcagcuugaagauauauuuguguagcauuuacguaagguugagaaaaugucauuugcaaaaauaaaagaaugaggaguggagggugcucauggagauaauagaaaggggagggacacuaaaguucucuuaugcccuccaggaugcuggcauacauugcagagcuguuguaccuuagaaaaucacagagaugggcaugggcugaaaagguuccaggcagacuauaugaaggagcaaggacuuuuacugaucuuuauaagguggauaaguucuguguuuuuguuauuaacgguuuuugaagcacauuccuguauauaauuacauuugcuucucccaguagcauauuacccuugugauguagcugaggaaagaggauucaggaagguaaagugaccucucaaaauugaauagugugaaaugguggagccagaauacagacccugggcuugacacauuguaacuuagcagugaggaagcaggagagauacuucuggcaugagagcacaaacaaaaaagaugggacgaagcaaacacagugauguuaagaugacaguaaaguaaccacccugguuggaacagaggauugguguggggacuaguagaagccagaguuggacagguaaggugcggcugaagaaucuagauuggaaccuuuggucagggggaagcuauaaauuauagauuuugaggggcuugaaauguuaagauuaaucugacaucauuguauacaaugaguuggagagaagcucaguaauaugaaaugcaguuugagauuuagggagaaauggcauaaagcacuucccucuaggaacuggcugauaauugacccguaaaacuguuccaugauuauaaaauguaacuguauguuuuaggaucacucuuaggugauaaaacccgaaugacugaguuaucaagagauaugaaugcauacaucaggccaucuccuacuagaggaacuuuaggaggcgugacaaggaccacaaaugaagcuauucuguugugugaaggagcgggauaugacauaauucuuauugaaaccguuggugagugugauauucuauuucauaacaauguacuauuuuaugaaugcuauauaaagaugagugacaacuuauuuuuguucauucagcagauauuugcuaaauguauaauuaaauacaagauaucccauacucccuagaagauaugaauguauagguuauaaucuuuacccuccaagaucuuauuuuaaaaaguaaaaauaagccaucuaucuggauaacuguuauacaggugguauauuauacaugccagaggagaacuguaaacauuaggaugaucuguguaaaugaugcuuuggcacaacaccuauuuuaaguacauuucauaugucuacuguguucaucaagaaaauuaauguaguugggugccuuuugaaaaugcaaauauguuuuauuucauuguuuuauauccuuagcauauaguuacaugugaugaagacacugaaaugaaaacccuaauaaauucuuucuuguggagagacagucuauuauauuacugugggauaaauguuugugauacagccuaacucagauguggggguccagugaagacuuccuagaggaggucacagcugaacucaguuucgaaggaagaauuggagauaaacaaaguaugcgauaaagggcauuugcaaagauacacgggagugagaaaacauggcccauccagagaaguacaguuugcucaggauacuuagagcaaagagugugaaggcagggaaugaagggaggucaguuggagcaguaggccagggccagauugucagggaccuuacaugccaugccaaggagucuucuggaguuuacccugaaaggagcaggaagauccugcuggauaagcaggagagugagaaaaccagauagguauuuuggagagaucccuggcagcagaguauagaaugauuagaaggagggcuagaauagaaucaggagaccacuguacuaaucccagaaggagaugguggaggucugaaccaagcaaaggaaguaggaauggcgaugagauagaucaacaaaacacugaagauaaaugggcaggauuuuauccaugauaagaugugagauaaggaaggaaggggaauugcagauaauagagaauacuguagaaaaaguagauuugcagagaggaaaacaaugaguucaguugugaauauauuaaguguuaaaugcuuauuagguauccgagugacugugugucucaagagaaaaggacugaaugagaaauacagauuuaacaguuaccagcaugguucauaguuucauaguuuaaguuaaaaauuugguucagaucaacuggggaaaauaugggacaaaaauggaagauauuuauauuaaucugcuagggcugccauagcaaaauaccacagacuggguggcuuaaacaacagaaauguauuuucucacaguucuggugacuggaaguucaacaucaaggugcccauaggguugguuuuuccuaagaccccggaccuuugucuuguagauagauggcugccuucuugcugcaucuucacucucccuugucucuuccuguucacuucacucuccuagugucucuuccuguccuuuugagggcacuaguccuauuggauuaaggcccuacccuuaugaccucauuuaauugcuucuuucaaggcgcuaucuccagauaaagucaccuugagguuuagaacuuuaacauaggaaugugguuuguuuguuuguuuguuuguuuguuuuuugagacagagucuugcugugucucccaggcuggagugcaguugcggggucucggcucacugcaaccuccgccucccggguucacgccauucuccuaccucagccuccccaguagcugggacuacaggcgccugccaccaugcccagcuaauuuuuuuuuuuuuuuuuaguagagacaggguuucaccguguuagccaggauggucucgaacuccugaccuugugauccgccugccucagccucccauuacaggugugauccaccgugccuggccuuuuuuuuuuuuuuuuuaaagacagagucucgcucuguuguccaggcuggaguguaguggugcaaucuuggcucacugcaaccuccgccuccuggguucaaaugauucuccugccucagccccccgaguagcugggaauacagaugcacgccaccacacccggcuaauuuuuguauuuuuaguagagacgggguuucaccauauuggccaggcuggucuccagugccugaccuugugauccgcccgccucggccugccaaaguauugggauuacaggugugagcuaccgcacccggccuaacuuaggaauguuucuagaugaggggaacacagcucaguuuauaacaauagccaugacagggcuuuagaaacuccaccauuaaaaaguagaugaaugaagaguuaguugccugaguaguaguaggagaaucaaaggagaagagcaccuuaaaaaccaaauauauuaccugguuauauuuagcuaccuuucccagaaacucaaaauaacagugacucaaacaagaaagagguuauuuucuauauaaaagagaccuagagcgggcauuguggccccagccuguaaucccagcacuuugggaggccaaggcaggcaggcugcuugaacccaggaguuccaaaccucccugggcaagaugguaaaaccccgucucuacagaaaaauaaaaaaauuagcugggcaugguggcaugcaccuguaguccuagcuacuugguaggcugaggugggaggaucaccugagccuggggagucugaggcugcagugagcugugauggcaccacugcacuccagcuggggugacagagugagacucugucucaaaaaauaaaagaacccugaggucaggcaugguggcuuacaccuguagucccagcaguucaggaggccaagguggaaggauugcuugagcccaggaguuugagaccagccugggcaacauagcaagccuugguucuaucaaaaaaaaaaaaaaaaaaaaaaauuagccaggcauuguguuacacaccuguaguuccaucuauucaggaggcugaggugaaagaauggcuugagcccaggaguucaaggcugcagugagccacgaucgugccauugcacucuagccugggcaacagagcaagacccaaucucucuuuaaaauacaaaggagccugaggcaggcaguccacagcagguauggugcuuugacagugcccucggugucacagguuucuuuugucugccugcuuaccauucuuagcacucaguuuccauccuccaguuugcucaugguuaaaagauggcugaugaagcucugacugacacuuccauguuccacauagauggaagaaggaaagggaaauaaggaagcagagagggguggcauaagagguauagcugaauuagccaucuuuaaaaaacuuuucugggaaccccaucuaaugacuguugcuuugacucauucaucauaucucgcugaaaggagaucuugugaauguggucuuucaucugauacacugauacuccuaauaacauuggaauaagaaaauagggaagaauaaauauuaaauaggcaacuagaaguccaucacaccgagaaagggagagaguuuccagaguuuugguggaaguagauuuuuuuuugaggugggguaucaccauguugcccaggugggagcacagcaguacaaucacagcucacugcagccucaaccucccaggcucagguucaagcuguccuuccaccucagcuucccaaguagcugggacuacagguauaccaccaugcccagcuaauuuuuguauuuuuuguagagacagggucucacuacaucacccgggcuggaagacaguuuuaaguggggugagaugaacaugaagugaaguggaaggagucagcauaaauuaccuuuuuccagaaacgaguauuuuaauaaaagugagaaacguggugauaguuggaggaguuugugaguuuuugucuuguuauuuuguuguuguuguuuuuguuuuauguggcuuuaagaugagaaagauuugagcacaauuuauguauugugccggggggcaagagccuguagauaaaugagagguuaaagauaauaaucagcaaggacccagaggaaguggaaaggaaugagagauuccuuuucagucaaauaguucuuauuacacugagacugcagaggaggcaguaaggcugaguuuguauuugugucuuguuaccuguggaguacgggagagggagaagccuaggaaguucuugccuuuauuuccucugugaaguaggugcuguaguccucaucaagcggggagauuaugggacagugaauguucauaauagcugcugugggaaauggaacggaagccaaccgagggcauuuagggagauugcuuuugccaggccguaaggaagauguagcagaggcugccugucguggcucuuguccacagaguugagugauuucucucacgugccuauggaggagagaacacacauaguuggauugauccauacauaauugggcguuugcaggcaaguaugaggacaagaagacaaaaaagaugaaaguauuuguaggcaugauucaagauuagagucacaguguucaagcugcucgcugaugaaaaggaagccaagaaagagcugugagagugaggagaggauggaagccuuuagguucuccauucaauccaagaacggagcgggagagcugggaaggauaacggguuugcuuagaggguaagauaugacauuuaauacauucuucagaagugagauguuuaaaggagugaccagguugacugugugaccaugaguaugaguaaaugaaguagaauggaaauggucaauguaguugagaaagucaaauaauggugaguauuuuaggauauaguugugauuuacaauuucaggugugggucagucggaguuugcuguugcugacaugguugacauguuuguuuuacuacugccaccagcaggaggagaugagcugcagguaauuauuuuuauuuuuucccccaaaaauauaaaauguauaucucugaaaauaaaaauuuccaauguuguguuuuuguaaacuaaguugauaaugguuuagaaaaugaaauaucauucauguuggcuaaaauaccugaaucaaaggcagauucucuauauuuuuuccuaacuuacaggaauagaauauguguccuugagaauguaaaauuaugcaacauuaauuuuuccaucuguaacaugacugaaauacauggaucgcuccagccaguagagaccauuguugcauagauguuguuaguacguugauucaaaaguucuggggagagugggaucccacuaucauaguuuauauguuguacaaugagauucuuacucuccucugcaccgcaguucuggcacaacuaccuaaaguuagugcagacuuuauagggugagggcagaguccuccacaagccuccucucacugcagacacuacuagcugcaagcuccaggguucccaggccacccauaccucugaccaacgggcuauaaauuugaggguucccauuaucccuuagguuuaguaauucacuagaacagugguccccaaccuuuuuggcaucaggaacugguuucauggaagacaguuuuccacagacuggggguaaggggggaugguuucaggaugaaacuguuccaccucagaucaucaggcaucaauuagauuaucauaaggagugcacaaccuagaugccuagcaugcauaguugacaauagaguuugugcuccuaugagaaucaaauguuguugcugaucuaacgggacagagcuuaggcaguaaugcucgccccccugcugccccccugcugugaggcccaguuccuccguggccuggggguuggggacccuugcacuagagugacucagagaacucaggaaagcacuauauuacaauugcagcgugcuuauaaaggagacaaaucaggaccauccaaaugaagacacacauaagaagccugggagggccgaaaugcaaagcuucuguguccucaagacacauuucucuccuggcauauugauguguaucaccaaccagaaggcuccccugagcuuuagugucccaaguuuuucuugggguuucauuauguaggcaugauugacugaauaauugaaguugaucucuagccccuguccccucccuggaaguuggguugauaucacauggcauaaaaccccaacccucuaaucacaugauaagucuuucugccauggucagucucccauccugagugaucucauugcauaaacucagguauaggccgggcgcaguggcucacgcauguaaucccagcacuuugggaggccgaggugggcggaucacgaggucaggagauugagaccauccuggcuaacauggugaaaccccgucucuacuaaaaauacaaaaaaaauuagccgggcaugguggcaggcgccuguagucccagcuacuugggaggcugaggcaggagaauggcuugaacccgggaggcagaguuugcagugagccaagaucgcaccacugcacuccagccuaggugacagagugagacucugucucaaaacaacaacaacaacaaaaaaacccagguauagccccaggcaccucccaugaauaacagacacuccuguuacucaggaaauucugggaauuuagaacuuaaaagauuaccucccagaaacccaaaaaccagacaaauuuuuuccuuuuuuuuuucagagacagggucucacucuguuucccaggcuggagugcaguggcaugaucauagcucacuguaaccuugaacuccugggcucaagcuacccuccugccucagccucccagguagcugggacuacagccaugugcaaccacucucggcuaauuuuuuaauuuuuuuuucuacagaugaagucuugcuuuguugcccgaguuggucuugaacucuugaccucaggcaauccuucugccuuagccuccuuaagugcugggauuacuggugugagccaccacaccuagcccagacaaauuauuuguuauacaaugcuucuguuucaauuuuauaauucuaaaacauagugauugcagacuaucgcugcuuauuuagaaacauuaacuauuaguauuucauaauugaauguuuuguuuaaaaauauuugaaaagaaauuuuaaucuuauguagaaaaaucuguauuuacuaaauaagguuuggcuuuuggauuucauccuuuauuucuaauauuuuuaugugacauaauuugaauuaagagauugagguuuguccacgcaaagcugaaauaagaaaaauacaaaguauaaaaauaaauaauaauaaaaaaagagauugacauauuuuuaggcaucagguucuuuuuccucaaaugcaaauugaaaauaaaaugcuauauacauuuaaggaaaauuucaaagacuuuuuucuggaaaugcagauguuaaggauagguguuuucuuuuuaagcaccuuaaugaugaaugguuuugcauccugcaguguuagcucaggagaagcacauuccaucacgagauaaugugaacuguccugccacucaaucauguugugacuugauguauuuacccuaauucugaauguauuucaacauguuagucucuaaauuuggaagagauauuacagaugacuucuauaauuccaauagccaaugcuuuugaguaauuucugucaaguaauggugauucuuggcauccagggcuuaggaggauauggaugaaaaguuaaugaaauguaugacuuucaaaaucugagcauugacuaguuuucccauuuuuauguugguugucauuaaauguuucugaucucuuuaggguaucaaaagggguauaaucgagauggcagaucugguagcuguaacuaaaucugauggagacuugauugugccagcucgaaggauacaagcggaauaugugagugcacugaaauuacuccgcaaacguucacaagucuggaaaccaaagguaagcuugcuugcauucuguaucuuucacucugaauggauuguguacauuagaagacaggauauaagucccaaacuagacauauaaucaaucuugcuucuaugugaagaugauaguuuuaaaaaucaugacaaagacggaguguguagucaugauuuuaaauauaauccuuuaaccacuagaugucaaaaacuagaucagagaugauagaugugauuguaauacuugauuugagccauuuggaagugauagcaaauccauucugaaaggaaccauccuuauuaagauuauggagcaguuaaugauuugauuaucuauauuggaauuugauucccauuauguuuguugggugccauuuucaguaaggaaaaaauuuuaauccuguaauaagugaugcaguaauauugauguggucaucuuuaucuguagacagacacuauguuauuaaagaauaagcuguaaucauuauaaugaggacaaugaugacuuaucuuacugucauaucccaguuuuucccaaucauguugucugcauugagucuggauucaccucauauauacaugcagaugucagauacccagcucuuccacuugcuaaaucaggcaaauuuggcagagagaauuaggcuauuucucaaccuagcuucauuuucuggcacucaguccucaggggaaccuaccuggcauugcccuugucacaaguccucuaugaugccccugaccaucugagcaauuaaaauaaaauaaauuaaauuaaaauaaaucucugggcuuaaaauuugaccuugaaucaguguuuuauuucugcuaugcacuuaguaauccuagguauauuaccucagaauauauauugguauauuuacuuugacacagcaauaaaaucucacucuugucaauugccuauuuuuguagaccguaagaauuaacuggcagguaucagcgucccuguaaaaauuuuuucuaucauuuuaaguaaaauggucugguucuucccuuuucgauagguaauucguauuucugcccgaaguggagaggggaucucugaaaugugggauaaaaugaaagauuuccaggaccuaaugcuugccaguggggagcugacugccaaacgacggaagcaacagaaaguuuggauguggaaucucauucaggaaaguguguuagagcauuucaggacccaccccacaguccgggaacagauuccacuucuggaacaaaagguucucauuggggcccuguccccaggacuagcagcagacuucuuguuaaaagcuuuuaaaagcagagacuaauaaaauucauccuguauaauaauuuuacauaucauuucauaaaguauuuuaauagaaaaaucacuuguaugcuuauauuuucaguaauuauuguauggugcucuugucuucuuuguuugugacccaugcuugaaaacuugaaggaaguuagauaugaauggcaaaaguuaggcaguauuuauaagguaccuguuuuauguuacugauaucuguuuccuucucuucuuauacccuggcaugguggccuguaggguaguuucuucuuaauagucaagaacagagaaagcugaggagagcagaaaauaucuugcacuuuaaaaugcuuauuuugauuccauauuaucugaauuuccagagaggauguaaacaagagugaccauauuuuuggaguccuucuugaagccagaacaacacacaguggguugcuaagagccgacaaucauaauugacauuuaguguaccagauuauucuaagaauuucugaaauuaccauguacaugaguaaugaaacaacuggaauaaugugaugaugugaacacaauuuuaaagucugcuugucuggauuugcagguacccuuccgccaccccccaacaugauagguaagagagcaaaagggaacugggaaaaaucagcuacaaauaaaaugggugacuaauccccaguucuuggacccauuauauuuguagccaauuggaguaaaccccuaaaagacaaagugaggucagaaugauucaaggauuauucaguuugaagacuaccaaaggcuuuugcuucucuucuuccuuggccauuucacuucauuuuaguauuuuaaaaaucuuuuuucuugauggugaacaaguuuuguccuaugcuauggaggaggcauagcacagugauuaagagcuugggcucuguaguuggacuauguggguuuaaacuuuaaacccagaucaauuguauauuagcuacaugagcuaaucucuuuaagcuuccauuuccucccugguaaaaugaaauuggcaaauaacuuucuaagguuagugaagauaggaaauacucgaaggcugcuuacuauccuuauuacauuaaaguuauggguaucuugaaacuacaaaccugauguauaauuucaguuuucucucauggucuuguuacuaccaucauacucuugauauuuuaggauacuuuaggauuaccuuugaagaacccuuucuaguuaauucuuugaauauguuuuauacuuauuugaugguaguuguaacuguguacauuugaauaaaauuucuaaccauaaaauuucgccauugcacaaaaagccuuuauagaaguuucuaacauauucuauucugaacccuguagaauauuuuauguaguauagcagcuugcauuguuacuuacuguacuggaaucaaaccucuugagcauuauuuuaacaaacaucccuuuacauuuuuuggaaagauuuuuaguacuccauuggcauagcuauuucauacaaggauuaggagaaacuuugaaagguuauccacuugacuuuucugauuuuagaaaggacuaccauuaaaccacccuaucagacaaaaaaaacugguuuuuagaaaccugagagaaggaauuuuauaauuucccugaguaagcuguuacagggaauaacaaaucuccugccacauguggcacaguguaaguaaugcuggagcacacauacugcauuguaaagaagguaggaaagguggggggacuuuuguuagcuuuaauuuuaaggcuaaaagcauuucuucucaguuugaacuacuuuuaaauguuauaaaugucaucauaaaaaucauuagaaaacucauuucuccuuauguugucguuguaccauuggguauuguauagagaccaauuucuaagagauuuuuucaccucuguuucuguuauuugcuauacuggagguaauauaauaauaaugaaauauagcuuuuuuuuucaacucagaaauccuauucccucuccccaucugugauuauauuguacuggacuucugacuuggucaaaagcauagguuuugacuuagauacaugugggggcagaucucagcucuaucacuaacuagcuauaugauauuuggcaaguuuuuucucuaugugcaguaguuucuuuaucuguaaaauuaagauaauagcuacuuuacaggguuggaagaauuaauuuagaaauuguacagugcuuagccucaauaauugguagguggugguguaaauauuuuacauagauacuugugacaguucuuuguucuacaaaacagacuaauauuaauuucagauuggccaagcuacuuaauuucucugugccucaguuuccucacuauuaaauggggaugacaauaguguccaccuagagcaggacuauuuuaguauuacauauaauccuuggauauaaaugcugaugaaguuuggauauuuguccccacccaagucucauguugaaauguaauccccaaucuuggagguggagccuggugggagguguauggauuagaucagaucucucaugaaugacuugggccauccuuugggugguaagugagcucuugcuccgaguucacacgaggucuagaucuggucauuuaaaaguguguggcaucuccccaucccucacucuaucacuugcuccuacuuucgucauaugacaugccugcuccccuuucaccuucugccaugauuguaagcuuccugaggccucccuagaagcugagcagaugccagcaccaugcuuccuguagucuguagaaccauaagccaaauaaacaucuuuucuuuauaaauuuauaaauuacccagucgcagauauuuauagaaagaacagccuaauacaggugcuaaauacauaucugacaauaaaugguaguuaucucuuagaacuguuaugaggauuaaacgaguuacaguguccaucuuaaaaagauaauucugaaaaaaaucucauagguucacuuugccuugucaagaauaugauuaccauuaacuucuguagauaggaaaaaaaugugcugagcuccaaaacugacagacauuuugcuaaaacaauaucaaaucucauuaaaaugaugacaguuauuucaauaguugacaguagcuaucccaauacaaccuaacaaggcauuuucucuucagaaucacucgaucauauggccauuucccuaagcuuuuauagcuauugcccaguguacacugaagacaacagcuaacgaacaacauacgugugauaauuuauguaguugaaccucuaaggcaaaaaaaaaaaaaaaaaggaaaaauuagugaaaaucauucaaacauuaugcucaccagguagacugccaucauagaaguccuaaugcuacugcuaaaaacuaguaaacuaccaguaaacugugaagacagaaguaacuccugugaucuauauguuugugcagaugguggagcuuuucugcuccuaaagccugagaaaugcaaauguggcuucguuaaugcaaaugcuuccuacgccagacuuuaugaaacuccuccuaaaguugaauucuuauccaaguggacauauguuagggugccauuguaauucagguagagugucagagugguggcuggcaccaacgguagauguucucaacauuagcguuauucagguaagacuacaacaaugaugaacaugucaaaacuuuccuuuaaaaggaacaaucagaaaaacucuuuaacaaauguuuuucuuuccguaguauuuuaauuaaaauuuuuaaaauuuuaaaauuuacuaaauuuaugaacguuuuuaucccacuugagaugaauacuuauuuauagucccugucccaugaagcuucuguggauuugcuuuguuugucauuugugguauguuugauaacaaaaauauuaguggcacaaaagcaguuauauugaaugcuuuuguuuuagagaaaauuucacucuguacuagaaaauguagaugaugugagucaaaguucauuaauauuuaccugaaaauuuguguauaaagguaaccuuggggcaguuuauuuugcuuagaccccucagcuucuugauagagugaggugagggcauauguaagucaguaaacuauucuguuaguaaagucaaaggcguaaucuaaauuaauuaugcuuuuaacuaacacagaagaaaucaugugaccucauucucaaa

SEQ ID NO: 15662 - RNA, 28458 nt, Homo sapiens
caggguccccguggacguggccgcgcaguuccggcguguggcggagagcgagugagcgugaaggucucccggccugcagcaggcugcggaagcucugcgccgggaaguucucuggcgggggaggggagggcgguuuacggccuuugggguagguuuugcccuuuuuaagauccacaugaaaucuuucgccuccgaaguucgaggguaacuuucguucccuccuggccuucgcgacacccucgagucggacggaggccgagucguguccucacccccagcagccugcggcggccgggacccccggaggcccuucuuccgcuccuuggaaacuuaaaauguggggugagggagagacgcguuacguuugacagaccggugaaauuaaagacacucaagcuucucagagugauuugaagaaaugcucagcguucugccgaaauauaguuuuaaguuuuuaaaccacggcaugguuuuuaaaggcugaaggacccacaguuuuuuucucuuaaagggcacgcauucauuuugauuaauauuucuuaacaugcagccaaagccaggacucgggcucacugcugcagggguguccucgggaagucccgaggggggaaaggcgcgcaagccugaaauggagaugaaaauaaacaggcauaauauuugcuaccucacugcguugggcguaguaguaacuaauucuuaaaaaacgucuuagaugacauauaaguaguaaagccguuguaugcuaaucuagaauuuuugagaaaaacuuaaucacccaaauguuugcuauaaugugaugaagauagcauccaucggcaguagccaggaucaaaugacgaguagauaugguuauaaauggggcccaugcaguauaauuaguauaugaaaccaagaugucaguccucacacagaauuuguguaaugauaugcauuugggaggcuucaggccuuuucagcuauuugauacagguugauucuuacugaauacagaauaauaaaaaaugaauuacuggucucaccauuuucauuauuacuauuuggaccaaaagacuaccacuuuuacuccaaagauugauuguagacucaauagccaaugacagaaaauuaagcacaagucuaaaugaagccgaggaucuaguagaaagaacacagaaucaaaccuuucaaaucucagccuaucgaacacaaacagauugacaguucuugagacgguuuacuuccuuucuuuaaacuuggcguugcucaucugaacaauuguuucgguaaggguuacguuugaugaaagcucaguuugugcuaccuuagaagugaagaaguuuguuaauuuuaaaauugaguuuauccuuaccugcuuuucguucuacaaacucaaacacuuucaugcaugucacuuuuuuauucagaaguuuucuaaacaguacagcuuagggaacacauuuccauggaacauuaguguuuugcaaaauguuaauagauucuucaugggaaaaaaauugcuagcaucaccaauacuggcgaaaauaugaaccugucauuaugaggcuaugggaaauacacuuuuguagagcucuugccaaaaauguuuaaccugaaucugauugugaggaaacacugagauaaauucugaaugugauuuguucggacuuuucaauaagguuaauaaggaagacaauaaaaaaaggcaggaggacugaucuacauuaaagacagcugucaacuagauagccuuaaggauuuaaaaaauuugaaccugggcugggcgcagugguucacgccuguaaucccagcacuuugggaggccgaggcggguggaucaccaggucaagagaucgaaaccauccuggccaacauggugaaacccuaugucuacuaaaaauacaaaaaugagcugggugugguggcacgugccuguaguccuagcuacuccggaggcugaggcaggagaaucgcuugaacccgggaggcagagguugcagugagccgagauugcgcgacugcacuccagccuggcgacagagacuccagucucaaaaaaacaaaacaacaacaacaacaaaaaaguugguaguuucaggugaauaguauaugaauguucuuuuaacucaucuauagauuugaaaauuuucaaaauaaauaguugaggacaaauuguagcuagcaaugcuggaaacccauuucugccucccagcagguggcagcaaauuaauacuccauaacguacaagaaaaucauugcaauuuccucgucuugguaaauguuuuggauguugcagacuggcuuuuuuuagggauaggagccaaaagaauauuguugccagauuauggauguuuauguuaauuuaucaacuaguugggaaaguacuuacuguucuucauugcucaucucacacagaaccaaaagucuguuuguaagcucuuuuguuggaauaacagucaagcucauguuaccuucauaaacacucaccauaaccauuaauuggcuaauaaccaucaauacaacauuucaaaguuuaugaaauacaacuaaaguauucucagagggaaauuuguaguuuuuucauaccuuuauuagagaagaagaaaaaaaaucagugaucuaagucaggaucagcaaacuguggucuacaggccaaguccagugcauagucuucuuuuguacagccugcaaaacucuagaaaaacucauuuuaaaaauagagaaauuaccaguaucuggaaugaaagaacacuaaagauucuacagacauuaaaacaugggucucaaccagaggguuuuuugcccccagggaacauuuggcaauguccagagacauuuuugguugucacaguuggagagucugcuaucagaaggcagaggucagggaaacagcugaauauucugcaaugcacaggacagucccccacagcuauuuugcuggccuccaaugucaguagugcugagauugaaaaauucuaauuaaaaucacaaaagaauaauauuauaaacaaauuuauaccaauaaaaucugauaacuuagaauaaaaaguuuugggggccgggcaugguggcucacgccuguaaucccagcacuuugggaggccgaggcggguggaucacuugaggucaggaguuugaggccagccaugucaacuuggagaaaccccgucucuccaaaaauacaaaaauuagcugggcaugauggcacgcaccuguaaucccagcuacuugguaggcagaggcaggagaaucacuugaaccuaggaggcagaaguuguagugaguugagauugcaccacugcacuccagccuggaugacagcgagacucugucucaagaaaaaaaguuuuuugaaaaaaaaaaaaaaaacuuaucaaaacacugaagaauaaauagaaaaucugaguauuuguacaucugguacagaauuugaauucgcaauuuaaaaauacaaagaaaaccauccacguuagugaauucuauccagcauuuaaagaacacacaaugucaauuuuauguaaacucagagaauagaggaggaaggaauaacagcagaaccuucggaaaaaucuaacagacauuagagggaaaaaaaacacaaauuaauauuacucacuaauacagaugcaaaauuccuauagaaaauacuggcaaauugaacccagaaaaaaauaaaauaaaaucgccaauugcaguuuauccagaaugcaagauuugcccaacauuaaucaacaauaauuuacaacauuaauaaaggagaaaaucuuaauaauggcggaaaaagcauuugacauauuuuauugcuaacucaugaugacaacaaucacaaaacuagaaauaaaagagaacuuuauaaaggacaucuaugaaagaucaauagcuauuaugcuuaauggugaaauauccaauccuaagauugggaacaagguaaagcugucggcucucaucacuucuauucagcuuuguaucagaaauucuagacaguacaauaaauaauuaaaauaauaaaagauaaauauuacaaaagugcaaaacugucuauucacaguggucuauguagaaaaucuguuuuucaaagcuacuaaauaaauuguuuuuguagacuguacauguggaaaaucuucaacgucuacuggauguugaagucaugggguaaaagcucaguauauauuaaaaaaauacuuuauauacuaguaagcagcaauuggaaaaugacauguuaaaauaugccauuuauaauaguacagaugaucccugacuuaugaggguuucacuuacgauuuuuuuuuacuuuauaaugaugugaaagugauagacauucagaaugcuccucagguuacaaugggguuacauucagauaaacccaucauaaguugaaaauauuaaguugaaaaccccccuacaauuuacaguauuuuccauuuaggauggguuuauucagacauaaccucaucauaaguugaggagcaucuguauuauaaauaccuaggaauacguuuaaugaaagacaugcaagagcuguacccuaaagugacaaaacauugcuuaaaugaaagagcuaaauaaauggagagaugugccauauuuaugcauacugaacaugugccaagaaagaccauauucuggguuauaagucucaauuuauaaggaugaaaaucauacaaaguauuguucuccaaccacaauggaauuagcagucaauaauaguucuuuggaaaucuccaaaucucaauaaucaaaggcacagauuuuccagacugcuggccucaaaaguucagauugacacugaagacauucuucucugcacagccaagccaauugauucacaugggaaauaauuauggacauauugccacauucuaaccaacugcacuaaccuggcacugcccugagauugggguaugcuggaagcaacugcagacggcgguuauauauuuuauuguacuaaaacagaguuacagcauauuuaaaauucaugaaauuguucccauuucuugcuuuccuucccucacagucugaaaauacugaugaaaaaucugggaacaagauuauggguguaguugacaaaacagaaaaucuguuccuggacagcuuuugaugaauuuaauaaguacagagauaaugaacauagacuacauuugcauaauggcauaacaaaaauucauugaacaaugcuaacuaucugggggaaacuacaguuuggaaacugaauguaagauugugguucuggcaagauuacucauucuauuuaaugauuauacaugguguugaagggguugggggaaauaguccauuuugugcugcuguaacagaauaccugagacggcguaauuuauaaagauuaaaauaaacauuuacuucuuagaguucugggggcugagaagugcaagguugaggggcucacuucuggugagggacuuaaugcugugucauuccauggcagaaaacggaagggcaagagaggggaagagggguggguggggaggggacuggcuucauccuuuuaugcggaacucacuccugugacaaccaacucauuccugugaaguggcauuaaucaguuuaugugggcagaggccucauuaccuaaucaccucucaacacuguugcauuggggaucaagccucuaacgugaauuucagaggacacauucaaaccacagcauuccaccccuagucuucaaacuuuaugacuucucaccaugcaaaauacauucauucuaucccaauugucccaaaagucuuguucuacaucaguccaaaaguccaaagaccgaagucucauguaaaucauguaugggugagauucaaggcacaauucacccugaggcaaauuccuuuccaguugugaaccugugaaauuuaacaaguuaucuacuuccaaauauauauauauguugugacagcauaggauagacauucccauuccaaaagggaaaaauaggcaagaagaaaguaacaggacccaagcaagucuaaaauccaauaagaaaaaugaguuuuaaagcuggagaauaaucucuuuugacuccauaucccacauccugggcacaccaggauggggcagggucccuaaggccucgggcagcuccauuccuaccgcuuugguggacugucuacccagcagugcucagauagaaauuucaugccuccagcuuucccagguuggaguugcaugcugguagcccuacaguuuuguggucuugggagcugccccacucucaagaccacuaggcauugaccuacugggcuguccacauucuuugaaaucuagguggaagucaccauguccccacagcucuuggauucuacacaucugcagaaucagcaccacaugaugccaccaaggcuuaccgcuuguguccucuggaauggcaaccugagccacagccaggccugcuugaaccacugcuggggugacaggauuacagcacuggcauacagggagcagagucuggaagucgcccugggcagcaagcccacggagggcacuguggguuguccccccaaaccauucuguucuagagcucugggccugugauggaagggagccucaaagaugucugaaauuccuuucaggucauucuccauggucuugaugaauaucaccugguuuccugcuagccauacuaaccucuuuagcaaauaguggcuuggccauauccucgguuugcuguccuaaagacacuauuuuacuugugaccugagaaaccaaaagagaugccccuuuaucaacuaagacagaccccaaguuuaaagaaacagauacuuuucuuugaggguucagugcucagcugacaugauaacuucuaaauuccuauggcuauaagaauaaacacacucuuauuaaacucccuaacaauaggagcuuucauguaaauuaucaagagcccucauaaacucugauuuacaacucagaccacuucaacucugauuggacagaagaccuaccuuauaaacacacuuuccuaaugaguaaguauagaccuuaagcaaguuucagcaagcuuauagagacugugcacagucuucguauccuacaguucaccuuuuaacauggagccaaauuucaccccauuuuaaugccaaaaccccaccccaaagugaacauggguuauacauuauauaugccugccuauugcacaugcacucaacucuccacauaaauauguauagcuuuuccccaaaccugccgaauauguaugacugcacaagcccuuugaggcauaagggccaaccugcccuuuucaucuucaaaaaagagcaccuucagcacaugccauugauucuucucaguuugcaaacugauauugccaauaaagcucuccuuucuaccauuuaggcauucuggugguguuuuggacaacacacucuccaugcccaggcugcaaauuuuccuaaucuuucugcucugcuucccuuucgguauaaauucuaaaucaccucucucucucucccucucucucucucucucucucucucuguguguguguguguguguguagcuuucauaucuuacauuuuaucuuauuuugcuguauacaguuaaacauauccaugcaacuccuucaauaauuugcugcuuagaaacuucuuccaccagauauuuuaguucaucucuuuuaaguucugccuuccacaaaguccuaggaaauggacacaguuccaucacaauuuucugcaaaacacggauagcuuuuaauccaguuuccaaugcauuguuucuuauuuccaucugagacuucaucagaauggccucuacuguccauauuucuaccagccuucuggucaugaccacuuaaguaauccuuaagaagauuaggcucuccucacaguucuugucuucucaccagaauugcccagugcuccauucacagcagucgaggcuuuucuauuugcuccuccaaauucuuccagccucuauuuguuacccaguuccaaagccacaucuacauuuucagguauuuguuguagcaacagccccacuccucaacaccaauuuuaugucuuagucuguuuugugcuucuauaacagaaugccacagacuagguaauuuauaaagaagagaaauuauuccuuacaguucuggaggcugggaaguccagaaucaagggucccacaccuggugaggccuucuugcuccaucauuccaugguggaaggcuuggagggcaagagagggaaagaguaggcaagggaaaagaguagggaagggggcugaacuuauccuuuuaucaggaacuccacucccaugacaauuaugcacuccugcaauaauggcuccauucaucccuuaaugagaguagagcccucaggacccagucaccucucaaaaguuucacuucucaacaccauugcauuggaaaugaagccuccaacacauuaacuuuggggaacacauucaaaucacagcaacccugcaugcuuucuucuacucucacuauuaucgugauaaaauaauuuauuuuuuaauagaaagauuuccaacauacagaucugucccacauguaucucuuucaaggauuuauaaaauuaaacauuucucuuucaauagaucauugagaggauuggggacuauaaaucacuuuuaauuuuaaaaaguauuuuugacccuuaaaaagguuuuaaguuacucaucuucacaauuguuuauuuugacugucgauuaugcuuaauauaaugagauuaauuuucaaauuucacuugguaaauagaguucauagaccuuucuuuccagaaguugccuuuuuaaaaaaaugacuuuuauuuaaauguuuuuucaaccuuuaucuuuuacaguuuuuaacuucauguuacuucuaauaauucugaaaacaauuauuccauuuugguauaauuuucuaaacucacaggggaagucugauuuucuuuucuugguaugaacauaaagggaaaaucaaaugugauggcaugguaacaacuaaucgcagcugauauuauuaaacuauuuuauggcuauugucaacaucccugugagauagaugcuacuguuaucccauuuuacauacagggaaacugagacucagggagauuaaccaaugugcccaaauguuacaugauaguauaaaagucuggcuuugagcucauguaauugacuucaguguccacauacuuaaucauuggugcuuacuuuucugugaauuuacuaaaguaacaggauuauuucagauucccuaacuuauuaugauaguuccaauuucaguguuaucuauacauaagaugugaugaaauggcaccauguuggcaaauguuucgauguagcgcacaauuucaccacaugauggugccagugaagugagaagucaucugcugcuaguauuugacauuaggcucagaccuaaauaugucaacagaauguaguaaaagauguuuaaaaauuuuuuuaaagagcaaucauaaauaauuauagacuagagugucuuuugaaaacauaaggaaugaaaacaucacaaauacaaaaaggguaagaguaauugacucauaaaacuuaaaaauaaaaaagaugagcuuuuguauucauaaggaaguauguaggacagaugucagagacuuuccacaggaaggaaaacaccaaaggaaaugaauuaaaugagggcaggugacuuaaaaaaaaugagaccagcuguauagugauguagcuccagggucaaaugguuccaguaagauuccacaaucagugcaaacgaguuagcaaaagccaaugacuaaaagauuuuuaaaaaccuuuaauagacauuacuacuuccuuuucuaaucuaaaauaaguauuauuuuucccugcauuaucaaagauggaaacaacaauagaaggaagaagcauugcuuuucagaaauuauugaaacaaauccuuacaugucauuauuacagugauucuccaaguuuggucccuggaccagcagcauugacaucaccugaaauguuagaaauacaaauuauuuggccacgcucagacuuuuacugaaccugaaacuuggggaaugaggccuuucagggcuuuuggaugcacccaaaaguuagggauccacuguguuacuuauggcccacgccuguaaucccagcacuuugggaggcugaggcaggcagaucacgugaagucaggaguucgagaccaaccuggccaacauggugaaacacugucucuaccaaaaauacaaaaauuagcgaggcaugcuggugggcaccuguaaucgcagcuacuuggaaggcugaggcagaagaaucacauuaaccugggaggcggagguugcagugagcugagaucgcgccacugcacuccagccugagcaagacucuaucucaaaacaaaacaaaaaaaaggauagaaagaaaacaaauucaccaaagcauaauuaauaauacaaagauauuggaaaugccaguuuaauauuaaagaaauauuaaguaaauaauaguauauugucaaggcauuuaaacaugauucuguuaaauaauuuuuaauaauggaaaaugccuauuauauaauagcagaagagucucaauuauguaaaacaauucuagaagaaauauuagaaggaaagaagcaaaacuaguuauuaaugguugccuuggagugaugugauuaaauauaccauuuuccuccugccugauuauauugcagaugcuguuuucaaauuuuauaugagaaacuauuuuacuccuauaaauaagucuuauaaugauuaaggauguuggggggggggguacuuuccaaaguccuacucagagguuacacucuugcccauuuuguucuaacuguaugguugguaagaacaaaauaugacacagaugccaguccacaacauaacccaccuuccccuuccacauacaccaaaaaaccccacggucaucauguugcuuacuggagaaagaagacauagaaagaccauucuggcguaguuuauauguauucaauguugaaagggaaguaggggauuaaaaucugacagugagaaaaaacaaucuuguuauagacacuaaucacaugcuuugccaaguauuguuaguuaaugaaaauauuaaauauucugaaguaauauaagggaaaauaucuuuauguguagauaacaacuugcuuagacauguuaccccuaagaaagauucucauuuuauaacugugucauuugaauuaaugaccugacaaaucaaguagucaaaaaaauuccaagauuauaauuuaaaagauuaauaucuaucuaccuauuuauguucauguauaucuugaauguuagacccuaaauaugauuauuucuuuuugacaaagaucuguagaauauaugcuaaaauugauaacauuaggccauuaaaaacucaguauuuagaaaauaaucuaaaacuuagaucacauucucuaaaaguaauaaaauacaauaaaaaugaauaacaaaugauuaaacaaggggaaaaaagcaaucauuuagaaauuugggaaggagauuaucccaaauaaguuauaugacaaaaaggaaauaaaaacaauaauuauugcuccuuuagaaaagaaguauauaaaauuacaaaacaaaugggaugcaugugaagaugaacucaaacaaaauauauuauuuaaggaaaaggaaauuagaaaaauaaagacaaaaauuaaagaauuauuaaauaaaagccauuacaguuauaaguauaccaaaaguugugucuuugaaggaaaaaauaauacaaaaaugcccugaagacagagggcggugacucaugccuguaaucccagcacuuugggaagcugaagugggaaguugcuugagccgaggaguuagagaucagccuaggcaaaauagugagacccugucucuacaaaaagaauaaaaauaaauuagccagguaugauggcaugcaccuguggucccccagcuacuugggaggcugaggugggaggauugcuugggccugggaggaugaggcugcagugagccaugauugugccacugcacuccagccuggaugacagagugagacccugucucaaaaaaagauaaaugcccuggagauuucuaauuaagaaacacacacacgcagagacacagacccacaaacacacacacaccacaaauacacacacacacacacacacaccacaaauaccuaauacauuaggaaugaaaagggggauagaaacacuuggauaugcuuuuauaauuacaaaagaagauuuccacuuccagcuguauggcaggcuggguuauucagaccaacauucccggcugaaggaaagaauaacuuaaaaugcuguauagcacaugaaaagugaauccuuuuaagcaauaaagauaugauaagguaguaagacauuuccagggcaaaaccuaaaaagaggaaagacccaagguaggagcacagcauugaaacugcuuuugcccuaaaagcauuugcuaaaccaagcgaauuugguuucaguggccuuguagagcacggaaaacagaacucaaagccuaguguguacuugagaugaacaaugugaagaucuaaaaggaggcccuucugccauaaagccaagauaccaaaacgauauucccucaggaaaaaagauaaaccagaaaugaaccugcuccaccucugccaggaagguuaacuuggcucuaagcagagcagggcuggaaaauaaccaccccugaaaaguugugagcauaugaaugcaucaggcuuuuucacacaguauuuacaacaccaagguaguccaaaaaacuuuaaaccauaauuuuaaguuguuuccaaacugaugguguuucuaugcacuagucagaggcaaaggcaucuugacuuuaggccucuaagacaacucaaaaauaauuuuccaaggaaaaacaaaaagcaacucacagacaaacguaaccaagaaccacaaggaaauaagucacuaugcacaagacccagcaaaaaacaacaaagagcagaaacaaauauacaauuaauuuagauauuguaauauuccaguuacaggaaauaaaaugacuaugcuuugaaaaugaaaaaccaaguauuuucagggaauaggaaacuauuuuuuuaaaaaccuagcauauuuaaaagagaacuaagcaaacuucuagaaauaaaaaauauaacaauugaaauauaaaacucaauggauagaauuaacaacacacaagaagaaguugaaaagagaauuagugaauuugaagauugguaagaacuauucagaauacagagacaaaaagaaguaggaaguauaaaccagaguuuauguaacacagagcuuagagcuucuucauuuaagaguuucuuagguuaagaagaucuauuauacaucugauaagaguuccaguugaagagaaagaaagauauggaacagagauaauagcugagaauuuuccaggacuaaugaaagaaaccaaaaauaaauauacaucuugacacauacugaauugcagaaaagcaaggacuuaacacuuaaaaagaagccguaggaaaagagaagacugauuauuuucaaaggaaccucacuuagaccaacaauaaacacuggaagccaggagcuggugaaauaucuuuaauauguugaaagaaaauaacugccauuuaaaaucuuauauucaauaaaaucguuuuuuaagaaugaggguagagacauuuucagaccaaaaacaaacaaacaaacaaacaaaaaaacaacaaaaaaagagaguuuaccagcagugcaaaacucaaagaagaaaugauaaaagauguaauuugaacugaagaaaagugauuugaaagggagggucugauauguaauaggaaauaaaggguaaaggcugaggcaggcaggaucacuugaggucaggaguucaagaccagccuggccaggauagugaaaccuugucucuacuaauaauacaaaacuuagggccaggcgcaguggcucacaccuguaaucccagaacuuugggaggccgagguggacggaucacgaggucaggagaucgagaccacagugaaaccccguuucuacuaaaaauacaaaaaauuagccgggcacgguggcaggcgucuguagucccagcuacucaggaggcugaggcaggagaauggcgugaaccugggagguggcacuugcagugagcugagauugcaccacugcacuccagccugggcaacagagccagauuccaucucaaaaacaaaaacaaaaacaaaaaaauaacaaacuuagccaggcgugguggcacaugccuguaaucccagcuacuugggagacugaggcaggagaaucgcuugaaccugggaggcggagguugcagugagccaagauugcgccauugcacuccagccugagugacaagagcgaaacuccaucucaaaaaaaaaaaaaaaaaaagaaugcuugauucagaauaccaaccacaaaaaauuaugagaaagaugguguccuaaauaaauggagaaaggaagcauuauuucauuaauagucuagggaaaauugguugauuaggugaggaaaugacagcaaaggcaugacaugaagcugggauugugacagaggcaucucuuuucaggugccuugguagaaaauaggaaagacagaagauuugaggguuuucugcuugcauuaucaaaucuaguaaugugugauuccuagaucuacaucuaucuuuauuuauuuagaugcuggaggaaaugcacaacauguuagcagugucugucucccacuuucauauuuuaguuaaauaugcaaagaggacuuuuaauuguuaugaaaaaaacuaacauuuaaaaaugccccaugaucuuaaugugcaaaguuuagaaaagcuaaucauuguuuucaguugcuuaaguaugcuccauuuuacacaaagcuccauaaacugaauacuauaaauuuccaaaauaauuaccaaaaucuaaguuaaugucucuaaacacaugaucuuaacaauaguauaugcaauauagcuaacgugaccacaucauuuuacagucugccuauuuuucuucuuuuugcugcguuuuuucuacaaauguucaagcuuucuuuccucucauucaggagaaaaauaacuaaagguagugguguaaaagcaagcaacagcucuucccuaggaugagacaaaaagaaauacaauguauuuuuaaaaugauauuugguaauggacuuuaauuucaaaguagaaggaaagaauuuuuuuaaaaaaagauuauauuaaaagcaugagcaguugcccugaagcguaauucaauauuuaucaaauucuuuguguauuuuugcugaacuggaaaugaguagauuuggucucagaugaguaauauucaacugucuaugauaaauagucuucuuuacaccaaauucaaaugugcuuauuuuguuucuuuucaguuucauaagaaagggagacaagacugaaugcugaauguuucuuuuugaucuuaugcacuauuucagcugacagaauaaaagaaaugucuguuuacuuaauuuauuaauuuauuugaaaaaaaaaaaacccuguuggcugcguuagccugucuucuuccuuagagaacagcaacugcauuuauaaaaggauaaaaaauuguggguucaauugcuccaacauuuucuagccuauuuugauagcacuugggaauaucagccaaucuuuuaaagaugguuuuuuuaugaagccuugaaauaaccauuccugucugacauuuuaaaucauuauugucuuucuagggauaguugaugaaauaucucaaaaauaucuccugauaauugauuaauucaaauugcugauuggaaaaaaaaaaaaacuaacccuaaagccaguagucucaaggggaaagcugccuggccagcccaauacaggcccugggggcacuacuuggggaugauggccccgcacucaauccagagccagucccuggccuagcaggcucaaagcuuaauuuauagucuccucagguaaagauucauggagauacuuucccaaacacuaauacaugugaccaaaaugccaacagcauauccaguucuuauuaauaauucucuccacaggcaaauuucuauuugaggccaaauuucaaucagaagaggaguaaggugauaguaauggcuagugucaacaaucuguaauaccuacuacaccagcuccaugugagcauuuauauucuacauugcuaaucacuacuucugauugauauaugcccuuuuaaaaaacagauuauuaaauauucagucuggcuacagucaaggguuguugggcacgaguguauuucuuauccccauggugaacuucauaaacuuuuuaaguaguuuacuccagaguuuaguuauauuuuucucuuuccauauucugaagaggaacaucucaccucuagaacaaaaacuacauaagcacagaaaacuugucugucuuacucacccugugcccuaucugcaccgcccugcccccaagucuagaaaaaugucuuaauauuguaagcacuaaaaaaaaguaaaugaaugauagaaaaagcaucuuuuauuugcaggcauuccuauacuacacaaauguuauuagaaaaauggcauauacuaaguaccuguauuuaguacuuguggauuauuccuccgacggaggagcucaaaggaaagagcucacacagugcuugccuuugacccaacaauuuaaauuagacacccuucuucacuuuauuauucucucuuaacuuucuuuuccuucagcacuuacuacaguugguaguuugcaguuuauucaugcuuauuuauuuaagaucugaaucaugcucugggaaggcagggacuaugucuauuuuauaugcagcucaugucuauaggcugccuuuaaugguauaggcuccaugauauucauaaaaauugccuugaguauuuuuuuuaagacagaguuuugcuaugucacucagucuggagggcaguggcuauucauagucacaaucacagcucgcugcagccuugaacuccugggcucaacugauccuccugcuucaaucuccggaguaguggggacauguuaugcaauugguucacacaguacuuacaugccuugaguuuuaugagccagaucuaucuugcagucacaggaagaaaaaaauaacuugauggcuuuaaauaaugagcuauuuuggaggacaggcagccaucccaauaccccaaaaucauaccauauggggaaaugcugaucccagguagacuaugggucauugguguuucccaggcuagcuauaggaggaaacagcaaggaaacgauuuaguucauguuuauucuguaaacuugagaguuaagauuaacuuauuauguuuuauagaaagcuagucacaugcuuaauaaucacugugcuucuuccuaaaaguugcucauuucagcuaauaguuaauggugcacuuugccuugacuauuggauuuugcacauuuaaaugucauuuacaucugucagcuuuagacuuuuuauugugucaugauagccaauucacagaaauaaaucaguuauuuaaaaguaaaguauaaaaguagugacgaaaauuguaauauaaauagaacaacacuguaaauguaaacagggaacaggaauucaaugcaaauaucaaauaugaagcuguauuugcuaaaacaagugaaucuugaugaauaugugaaaauuggauuuuaucagaccagcaaucaauuugccucuaguuucuauugcauugucuguuacaaaacuuuguuaaagaauggcaagaagccacaggagcuuuugcauugcuuucauaguuccgugaccuuucugauaaaccaauugaauuuuuccugaacaagcacaaaauaaugcuuucuaauaugaaauugauaaauuuugucauuuaaagauggagaagagacuaaaacuaaauaaacauuauucaaaguuacacaucaaaaaaagaaauauagaagucacauuaucacuaagaaauuucugaaaccagcucuaagguuaaugaucauuaccaugcucaggaagaaacuuuaauuagcuacuggcaauuucauaauccaagugaacuacuguacaucauauaauauuaauggcauacagcacagaagaacaaugucuuaucaggaguacaugcuagcagauacuuggcuuacauuuggaaagaaucaggugugcagaguaucaaucagcgcuugacagaaauaugcagaaauauaugaaagaaaagugcucaaugacuuauuggcuaguuuauggcuccaaccccaugcuaggggagguuuuccaugugguuaacaauuauucugugaacuaugauuuaggcuagaaagacaugaacagcaguaugugcucaacaagaaaauauuuacauggauaaagaugaauguccuuuaugcauugcuuuguccccagaaaauaguuggugaaguaguuaauacauucaaacuguggccccaaguguuuaucuuuuaagcaugcuuugugaagaaauuggcagcaagcauaagucuccuuuucuacacagaaguaaacuauuuauugaggugaaaauuuuuacacaaauuuuugaaaccaggguugagauaaaagcauuucuuuucuucaugacaccaguaaugccauuuuuuuaaaaguaguuuuuucaaguggcauaucucaaugguauauucuaccuuuuaguagccuuaugucaaaguguaaauuuagucauuuuaaauaucgugucugucagaguuucuuaagaaaacuaaacuaugguauaaauauccuaaucaacaaguuccauuuuaacacuugauugucucacucaucauauagaucaaugacauuacaggacauauuuauacaucauaguaaaaagacaauauaaauaaaaacaaacaaauucaaaugcuguucacaaaucuucagaaacaccuuccagagccagauggaaucaaaguggagcaggacugcauucaucaucaacucugaggcuauaacagaggacauuccaguuauuaagugugauguuuuccccucuaguaccugacuuacugcugagaaagaaauacuaugcuuucuggguacauguuuaaaugauauauuuagaaugaucagacagagguccugaacaauucuaccaaucccgaugaccaauaauuaugauuagggcuauuucagcagaaauagagucaggaaagaaauggacugcauugggcucuuuaucuuggaaaaaaguuacagaaaacaucaucccuuucacugauaugaaacagucauuauuaagugaaaaauauuauguuuuggaugaaccuugaggauaauuauguuaagugaaaagagccagacauaaagugacaaauauuguaugauucaacuuauaucagauaccuagaauagccaaauucacacagacagaaacuaauauaaaggcuacuaagggcuagggggagaucagaauggagaguuaauguuuaaugugugcauaauuucuauauggaguaaugaaaaaguuauggaaauggaugguggugauggcugcauaauaugaauguauauagugccacugaauuguauacuuuaaaauggucaaaauggcaaauuuuguuacaguuugccacauuaaaguaauuguuuuauuacgauuuuuaaauugugauuaaaauguacuuaaagccaggcgugguugugugcaccuguauucccagcuacuccggagucugaggugagaaggucgcuugagcccaggaguuaaaguccagccugggcaacauagugagacccuaucucuuaaaaaaaaguaccccaaauuguuagccuuguggguaccaaacacccaguuacugaucuguuaaugcuggaauccagcucuggaaauucucauuaggacuuuugaagcaucauuucuaccaacuggaggaagugagaguggauuggaaaagaccaggaagagggcuaacccugagaaauuagggcuaggaggugaaaauugaaacuccuuguaguuuguugugggguguccacuuuccucuuaccugcagagacagaagccaaaaagaaauguaauguaggguuuucuucuuaccaaggaaaauucugugguaggcagcagaagcacauuuguugcuguuugauaguucuguacuuauuuugcacuuuuacucauucgguauguuaaaaagaaagcauuuggcuguagaaucccuucuuuaggcaaagucaucaaaauaagaagccuuuggaacuucaaugaaagacagaaauucuucucagacugaagacggcacuaugguuuaagugugucccccaaaguucaugugcuguaaacuaaauccccaaugugacaguguuggaagguggggcuuaauaagaggugguuaggucacaagggcuccgccuucaugaauggauuguuguugcuaaugugggagugggucaguuaccaugagacugggcuuguuauaaaagugaguucaggccucucuugaucuugcuuucucuggagcauccuuucuugaccuuccaccuuccuuuuccaccuuccacuaugaaaugaugcaacaggaaggcucuccuuagaugcuagcacuuugauauuggacuuuuaaaccuccaagacuguaagaaggaauuauuuuucuuuauaaauuacauaguguguggugaucuguuauaacaacacaaaaugaacgaagauggcauuuccuaaaguggggaccaugaaauauuaauggguguuccaugaaaaaaauagaucuguggucaaauaaguacaguugacccuugaacaaccuaaaagucaggggcaccaacuccauacaggcaaaaaucuucaugcaacuuuugacucccccaaaacuucacaaagaauacccauauuguuggagggucaacaacugaaauugcuguagagguuucucuacugcagaacauuccauagugccuuuugaauuuacaaaagauuuagaguccuuuuuaaaauguugccaacauggcuauaggucuuaaaaaucaacccuguuuaugcuuuucacagagaauuuugugaauguguguuuucaggaacacacuuugagaaagguuggccucaaggaauuuauuguuauuuauuugcuucucaugcaugcuucugugaucacugcaaauaucaguggcucaguugcugacaagugaucauaacacuuuuuguuauacaguauguuuaauauuuauuuuucuuauuaaaaagacaaugcaaccuuguugaagaaaaacuaggaaaaaggucagcaagaagaguaacauaagauacccaugaccccacugucuagggguaaucacuguuaacagcuucugcguaucaacucagcucucuucuuuuuaauaaauauauauacacuuauccacuacaguggcaccauucacuacaaauugguuuuucaccugauuuuuaaauuaucagucuacuacaaaguucuucccaugucaguaaauauuuguccucaauaugguuuucaaugauaaaaauauuuuauauguguaacuauauauguagaauguuaaaaugcaggucugaacuaucagcacaaauguuguagguuuaggaaauucauacaugcuuucauucauuuuuuuuucuucuguguuacauuuuaaugcaauuuuuaagaaaggauuuagcccuuccuuaaucccuucacagcugcauuuugacuaacauagccacagcugaucaaggcuguguguauuguuaacacauuugccuauaagguaauguugacaugaacacuugaaaaugacuguccuuuucuaagacacuuauuagcaguucacaaguauuuauuuaugcauugacugccaucucauugcacauucuggacuguaaauggugguuagcaacuagaacacaaaguucaauacagaaaacgggaaagacacaaaacuccuuuugaaaggaauuuggccuuugaauugaaauuuauaggagagguuccaagauggccgaacaggaacagcuccagucugcagcucccagcgugagugaugcagaagaugggugauuucugcauuuccaacugagguaccggguucaucucacaggggcuugucagacagugggugcagcccacugagcagggugggguaucgccucacccaggaagugcgagggguuggaaaauucccucuccuagcaaagggaagcugugacagaugguaccuggagaaucaggacccucccacccuaauucugcgcuuuuccaauggccuuagcaaacagcacaccaggagauuauauccugcgcauggcuuggugagucccacgcccacggagccuugcucacugcuagcacagcagucugagaucaaacugcaaggcagcagcaaggcuacgggaggggaauccaccauugcugaggcuugaguagguuaacacaguggccgggaagcucaaacuggguggagcccacugcagcucaaccaggccugccugccucuguagacuccaccucugagggcagggcauagcugaacaaaaggcagcagaaacuucugcagacuuaaacgucccugucugacagcuuugaagagaguagugguucucccaguguggaguuugagaucugagaauggacagacugcuuccucaagugggucccugaccccugaguagccuaacugggagacaccuccaguaggggccgacugacaccucauacagcuggugccccucugagaugaagcuuccagaggaaggaucaggcagcaacaucugccauucugcaauauuugauguucugcagccuccacuggcugcaggcaaacagggucuggaguggaccuccagcaaacuccaacagaccugcagcugaggguccugacuguuagaaggaaaacuaacaaagagaaaggacauccacaccaaaaucccaucuguacgucacaaucaucaaagaccaaagguagauaaaaccacaaauauagggagaaaccagaggagaaaaguugaaaauucuaaaaaucagagugccucuucuucuccaaaggaaugcagcuccucgccagcaacagaacaaagcuggacggagaaugacuuugacgaguugagagaagaaggcuucagacgaucaguaauaacaaacuucuccgagcuaaaggaggauguucgaacccauugcaaagaagcuaaaaaccuugaaaaaagaauagaugaauggcuaccuagaauaaacaguguggagaaguccuuacauaacaugauggagcugaaaaccauggcacgagaacuacgugaugcaugcacaagcuucaguagaagaaaggguaucagugauugaagaucaaaugaaugauaugaagugagaagagaaguuuagagaaaaaagaguaaaaagaaaugaacaaagccuccaagaaauacgugacuaucugaaaagaccaaaucuacaucugauugguguaccugaaagugacagguagaauggaaccaaguuggaaaacacucuucaggauauuauccaggagaacuuccccaaccuagcaaggcaggccaacauucaaauucaggaaauacagagaacaucacaaagauacuccucaaugagagcaacuccaagauacauaauugucagauucacgaaaccugaaaugagggaaaaaguguuaagggcagccagagagaaagacuggguuacccacaaagggaagcccaucagacuaacaacggaucucucggcagaaacucuacaagccagaagagagugggggccaauauucaacauucuuaaagaaaagaauuuucaacccagaauuucauauccagccaaacuaagcuucauaagugaaggagaaauaaaauccuuuacagaaaaacaaaugcggagagauuuugucaccaccagcccugccuuacaagagcuccugaaggaagcaagcacuaaacauggaaaggaacaaccaguaccagccgcugcaaaaacaugccaaauuguaaagaccaucaaugcuaggaagaaacugcaucaacuaacgagcaaaauaaccagcuaacaucauaaugacaggaucaaauucacacauaacaauauuaaccuuaaauguaaaugggcuaaaugcuccaauuaaaagacacagacuggcaaauugaauagagucaagacucaucagugugcuguauucaggagacccaucucacgugcagagacacacauaagcucaaaauaaagggauugaagaucuaccaagaaaauggaaaacaaaaaaaagcagggguuguaauccuagucucugauaaaacagacuuuaaaccaacaaagaucaacagagacaaagaaggccauuacauaaugguaaagggaucaauucaacaagaaaagcuaacuauccuaaauauauaugcacccaauacagaagcaccuagauucauaaagcaaguccuuagagaccuacaaagagacuuagaaucacucacaauaauaaugggagacuuuaacaucccacugucaacauuagauagaucaaugagacagaaaguuaauaaggauauccaggaauugaacucagcucugcaccaagcagaccuaauagacaucuacagaacucuccacaccaaaucaacagaauauacauucuucucagcaccacauugcacuuauuccaaaacugaccacauucuuggaaguaaagcacuccucagcaaauguaaaagaacagaaauuauagcaaacugucucucacaccacagugcaaucaaacuagaacucaggauuaagaaacucacuuaaaacugcucaacuacauggaaacugaacaaccugcuccugaaugacuacuggguacauaacgaaaugaaggcagaaauaaagauguucuuugaaaucaaugagcacaaagacacaacauaccagaaucucugggacacacuuaaagcaguguguagagggaaacucauagcacuaaauggccacaagagaaagcagcaaagaucuaaaauugauacccuaacaucacaauuaaaagaacuagagaagcaaaagcaaacacauccaaaagcuagcagaaggcaagaaauaacuaagaucagagcagaacugaaggagauagagacacacaaaaacucuuuaaaaaaaucaaugaauccaggagcugauucuuugaaaagaucaacaaaauugagagaccgcuagcaagacuaauaaagaagaaaagagagaagaaucaaauagacgcaauaaaaaugauaaaggugauaucaccaccaaucccacagaaauacaaacuaccaucacagaauacuauaaacaccucuaugcaaauaaacuauaaaaucuagaagaaauggauaaauuccuggacauauacacccucccaagacuaaaccaggaagacgcugaauccuugaauagaccaauaacaaguucugaaauugaggcaauaauuaauagccuaccaaccaaauaaaguccaagaccagacggauucacagcugaauucuaccagagguacaaacaggagcugguaccauuccuucugaaacuauuccaauaaacagaaaaagagggaauccucccuaacucauuuuaugaggacaacaucauccugauaccaaagccugacagagacacaacaaaaaagggaauuuuagaccaauuucccuaaugaacaucagugcaaaaacccucaauaaaauacuggcaaacugaaucuggcagcaccucaaaaagcuuauccaccaugaucaaguaggcuucaucccugggaggcaaggcugguucaacauacacaaaucaauaaacguaauccaucauauaaacagaaccaaagacaaaaaccacaugauuaucucaauagaugcagagaaggccuucgacaaaauucaacagcccuucaugcuaaaaauucucaauaaacuagauauugauggaauguaucucaaaauaauaagagcuauuuauaacaaacccacagccaguaucauacugaaugggcaaaaacuggaagcauucccuuugaaaacuggcacaagacaaggaugcccucucucaccacuccuauucaacauaguguuggaaguucuggccagggcaaucaggcaagagaaagaaauaaaggauauucaguuaggaaaagaggaagucaaauugucccuguuugcagaugacaugauuguauauuuagaaaacccuaucaucucagcccaaaaucucuuuaagcugauaagcgacuucaacaaagucugaggauacaaaaucaaugugcaaaaaucacaagcuuuccuauacaccaauaacagacaaacagagagccaagucaugagugaacuccuauucacaauugcuucaaagagaauaaaauacuuaggaauccaacuuacaagggaugugaaggaccucuucaaggagaacaaaccacuguucaauaaaauaaaagaggacacaaacaaauagaagaacauuccaugcucauggauaggaagaaucaauauuuugaaaauugccauacugcccaagguaauuuauagauucaaugccaucccuaucaagcuaccaaugacuuucuucacagaacuggaaaaaacuacuuuaaaguucauauggaaccaaaaaggagcccgcauugccaagacaauccuaagcaaaaaaaacaaagcuggaagcauuaggcuaccugacuucaaacuauacuauaagguaacaguaacaaaaacaguaugguacuggcaccaaaacagagauauagaccaguggaaccgaauagagcccucauaaauaacaccacacaucuacagccaucugaucuaugaaaaaccugacaaaaacaagaaauggggaaaggauucccuauuuaauaaauggugcugggaaaacuggcuagccauguggagaaagcugaaacuggaucccuuccuuacaccuuauacaaaaauuaauacaagauggauuaaagacuuaaacgauagaccuaaaaccauaaaaacacuagaauaaaaccuaggcaauaccauucaggacauaggcaugggcaaggacuucaugacuaaaacaccaaaagcaauggcaaccaaagacagaauagacaaaugggaucuaauuaaacuaaagaguuucugcacagcaaaagaaacuaccaucagagugaacaggcaaccuacagaaugggagaaaauuuuuacaaucuacccaucugacaaagggcuaauauucagaaucuacaaagaacuuaaacaaauuuacaagaaaaaaaucaaacaaccccaucaaaaagugggcaaaggauaugaacagacacuucucaaaagaagacauuuaugcagccaaaaaacacaugaaaaaaugcucaucaucacuggccaucagagaaaugcaaaucaaaaccacaaugagauaccaucucacaccaguuagaauggcaaucauuaaaaagucaggaaacaacaggugcuggagaggauguggagaacuaggaacacuuuuacacuguuggugggacuguaaacuaguucaaccauuguggaagacaguguggcgauuccucaaggaucuggaacuagaaauaccauuugacccagccaucccauuacugggcauacacccaaaggauuauaaaucaugcuguuauaaagacacaugcacauauauguuuauugcggcacuauucacaauagcaaagacuuggaaccaacccaaaaguccaucaauaauagacuggauuaagaaaauguggcacauauacaccauggaauacuaugcagccauaaaaaaggaugaguucauguccuuugcagggacauggaugaagcuagaaaccaucauucugagcaaacuauugcaaggacagaaaacgaaacagcauguucucacucauagugggaauugaacaaugagaacacuuggacacgggguggggaacaucacacacuggggccuguagugguguggggcaaggggggagggauagcauuaggggauauaccuaauguaaaugacgaguuaacgagugcagcacaccaacauggcacauguauacauauguaggaaaccugcauguugugcacauguacccuagaacuugaaguacauauauaaaaaaagaaauaaagcugcaaugaacauuaaaaaaaaaaucuguagagagcaccaccacuuucccaaagaugaugcuaaguauuuccuugugccacccaaaacucuauuuguaauuauguucauauuucaaaagcucuuggagaucaauagagauggacaauuacacucugcugguggaaacacuguuucucagggaggaaagaauauuggugaaagacagacauuucuucuuuagccuuuuucagugauccagaugagauuucucucucaacuguuagucauaucuuaccuuuauuuucugccucaauaccacccaaagaaaucauaguggagucagguuuucugugaauuuagcuaaaccacaccugaguaccaacucuuuguccaggggagagggacggccccucugaugaaauaaugaacucaccuagacuugaggaccaaguggaucaaugacuugaagcuccugaagguagagaguuuacuccaaauuaggaauuaaaacuaugag

SEQ ID NO: 15663 - RNA, 1653 nt, Homo sapiens
uuuuaagucuaaaguagggggaaccaagccugcugguggugauuuuggagaagucuugaauucggcugcaaaugcuagugccaccaccacggagccucuuccagaaaagacacaggagagccugugagauuccuaccuuuguucugcuacccacugccagaugcugcaagcgagguccaagcacaucuugucaacaugcauugccaugaauuucuaccagaugugcuuuuauuuagcuuuacauauuccuuugaccaaauaguuuguggguuaaacaaaaugaaaauaucuucaccucuauucuugggaaacacccuuuaguguacauuuauguuccuuuauuuaggaaacaccauuauaaaaacacuuauaguaaauggggacauucacuauaaugaucuaagaagcuacagauugucauaguuguuuuccugcuuuacaaaauugcuccagaucuggaaugccaguuugaccuuugucuucuauaauauuuccuuuuuuuccccucuuugaaucucuguauauuugauucuuaacuaaaauuguucucuuaaauauucugaauccugguaauuaaaaguuuggguguauuuucuuuaccuccaaggaaagaacuacuagcuacaaaaaauauuuuggaauaagcauuguuuugguauaagguacauauuuugguugaagacaccagacugaaguaaacagcugugcauccaauuuauuauaguuuuguaaguaacaauauguaaucaaacuucuaggugacuugagaguggaaccuccuauaucauuauuuagcaccguuugugacaguaaccauuucaguguauuguuuauuauaccacuuauaucaacuuauuuuucaccagguuaaaauuuuaauuucuacaaaauaacauucugaaucaagcacacuguauguucaguagguugaacuaugaacacugucaucaauguucaguucaaaagccugaaaguuuagaucuagaagcugguaaaaaugacaauaucaaucacauuaggggaaccauuguugucuucacuuaauccauuuagcacuauuuaaaauaagcacaccaaguuauaugacuaauauaacuugaaaauuuuuuauacugagggguuggugauaacucuugaggauguaaugcauuaauaaaaaucaacucaucauuuucuacuuguuuucaauguguuggaaacuguaaaaugauacuguagaaccugucuccuacuuugaaaacugaaugucagggcugagugaaucaaagugucuagacauauuugcauagaggccaagguauucuauucuaauaacugcuuacucaacacuaccaccuuuuccuuauacuguauaugauuauggccuacaauguuguauuuguuauuuauuaaauugugauuguuuuauuauuguuuaugccaaauguuaacugccaagcuuggagugaccuaaagcauuuuuuaaaagcauggcuagauuuacuucaguauaaauuaucuuaugaaaaccaaauuuuaaaagccacagguguugauuguuauaaaauaacaugcugccauucuugauugcuagaguuuuuguuaguacuuuggaugcaauuaaaacuaugugcuaucacaugugaaaagcuuaauaaauuccaucuaucagua

SEQ ID NO: 15664 - RNA, 31072 nt, Homo sapiens
aagauacauauuuuaaagauuucauuuacaugaaaauacguuuaauacauauucugucauuagcaguaaguagaacugugcucuuauaucacaaguacuuucuuuaagacaauccaggaucaguaaauaacaauagcuuuugcuuauuuuauucaauauauuugaaaugaucauucacaaauuuaaccuauccuuaaaaauaggcauuacuuauuuuaguauaaucccauuuguauacaaaacaaacccuuuacauauucacacuuagguaagugcacagaaaaaagcaugaaagaauauacauuauuaaauucaaacgcugguaaccuuugggaggguaauaaagggagaucauuuuuuuauuccauucuguauauuugaauuuuuuacaacauguauuuauggguuacugaaauuauuuuuaaaaggcauaauaggguccaguuaaaccauacuuucuagccauuauuugcauauuaaucaagacuucuguuauuucaaguagcucuuaaaguuugucaaacaguuucuaauuuccuccucaauuuugcuugccccagucauuuauuuaguaaacacucuuccucacucauaauuccaguuuagucagaaguacaacuuaaaguggcuccaggcuccagguaauccuguucaaaauucaggaacucaagaaauuuagauggguuuuuggaacuacaaaaugguuuagauaaugugcucuauauccaaacucacaaaugaauauaugugguaccaggggauacuuuguauugccaucuggggacuuuugcauuaauguugccuuuagggaagugguuuauaauccuuggcugcccaacagaaaaaucuguggaacuuaaaaaaaauacauagaugcuuaggcaccaucuuuaaagauuucgagucuguaguucuaagggaagcaaauauucuuuagaaaugcuuuuuccuaaaucucaaucagugauuauauaaauauauguguacaaaaaugacauuaccuagagaaugacugaauacagaaccucauggaaugcaaaaacaaaaaaaguucagaguaaaguuagggguuuuuugcggggaauggaacugaauugguuuuugcuaaacauguuuaaaagcaccaaaaaagauuaaaaacaauuuaaaaauaccuauuuuuccaacagugguguuuugcaguagauaaucuuccucggaaaccauauacugguaauauagugcaaagacugaaaacaaacaauaaacauaauccugauguuuauuuaucaaaugucaaucaguggaaucuuugacuggcuuuuaaaauaagggcaguuucauuacacuggcauacuuggcaaaccagguaaguacagaaacccuuuucaagauuuaaaaaauggagcaacacuggucagcauuugguaccgugaauauaauacaccuacugaaaaucuucccauacaucaugaaaacuuggaaguaauuuguauagcuugaaaugucuucauuuuagaauauuaugcacaaaagagccucuucaggaacagaaaaguggcauuuucuguguuucaacuacaauuuagaacccaacuggcuuuuuauguuauauuaaguauauuauacuucaaguuccagaguauguggggcauaaaauccugauucaaguuuuauaugacaaaaaauucuaguaaauacuccuuuuaauaaauggcuuaucaauauucucagagucagucuaaucauccaagaaaaaguaguuuccacucuucuuuuguucuacauccuaaaaaagaaaacagaagccacaaaaaucagcaacacgauucuacuauagguaaaaguagacuuucacucaugguauuacuuagcugugcuuaaaacagugccuguacaaccuguucugcacauaccaucuguuucuggauauuccuggguccacugcucaaaggaaagauaacuaccucugccccaucccuaaugcuagaaugacucacuugcaccaacucaaguaaagucccuuuauauaagaugccucacauauauaaaauuuugcuauguguuauuauuucuaggaaaacuauuaaauuccauuuucaucaaugcaacuuuuaucuccagauucaaaaugcagcauacugucaguuugagaucugccuacuacacaaaauauauauauauaaaguuuuuuccaauacuggccaguaacaaucucaccuaccuacuuguugagcuguucucuuauuaggauuaagguaugacaaucuuaagaugaguaggcauacagaaaugauaacucauggugacugaaccauaagucugucuaagaaaaugacaauacaaaguguccuuaaugcuuccaaagaaauucuucuuuucuacccaauaugcuuuucaaaacugagaaaacucuucaauuuuaugugagaacuuaaccauuucucuauccuggccaagaaguaauaucaaucagaaaaaaggcauccagacauacuguuaggugcuuaagaauacaaugacgugcaagauaacuuugccucuggcauuccaagagcucaugguuuagcagcaaagcuaggacuacaaauaugaaaauaaaugcuacagcagaaguauguauaacauacuucuaaagcuuuuaagcauuaaggaugauggauacagagugauaaaauguaaacacuuugaggcacugcagauauuaaaaacagaaaugauggccagcaugguggcucacgccuguaaucccagcacuuugggaggccaaggcagguggaacacuaggucaggaguucaagacuagcacgggcaagauggugaaaccccaucucuaucaaaaaaauacagaaaauuagucgggugugguggugggcaccuguaaucccagcuacucgggaggcugaggcagagaauugcuugaacucgggaggcagagguuguagugagccgagaucacgccacugcacuccagccuaggugagagagugagacucugccucaaaaaaacaaacaacuaaaaccaaaaccaaaaaaacaacccagaaaugcuuuuagaguucauuuacuuucuguuucugagugacuaagauuuuugccuuuuaagaaacaaauacuguauuucacagaggaaaucaacuguagggugcacaacugugaacuacaaagacaaaaaacauugucaauuaaguagacacaauguuuuccucaucacaggagcuuguuuagacuuucaaaauauacuuuuuuugcggggguugcgggggcgggggcagggacagagacucgcucuguugcccaggcuggaguacaguggaacgaucucagcucacugcaaccuccaccuccuggguugaagugauucuccugccucagccucccgaguagcugggauuacaggcgcaugccaccacgccuggcuaauuuuuuguauuuuuaguagagauggguuuucaccguuagacaggauggucucgaucuccuuggcuucccaaaguucugggauuacaggcauaaaccacugcgcuuggccuaaaauacaccuuuuaaucauguauugaaaaauauaacagaaauugguuaagguauucuuaaaaaauucuuuguuacaauggugaauuaguguaaucuuuccccagacauuuuaagugguaaucaauauagguaguacaacugugauacaacuuaaagagaaaacaggaagagcucuugaguucacacagcaaugacagcuacauuacaauugcugccuaccgcacacuaaaguaugccaucaggucuuaaaauguaaaaaacauaggaauuuuaaaauaaaauaugguuguuuuuuaauuuauuuuuauuuuuuuagacagagucucacucuuuugcccaggcuggaguacagugggaugaucucagcucacuacaaccuccaccuuccagguucaagugauucuccugccucagacuccuaaguagcugggauuacagauaccugccaccagacucggcuaauuuuugcauuuuuaguagagaugggguugcaccauguuggccaggcuggucucaaacucgugaccucaagugaucugccugccuuggccucccaaaagugcuugaaucacaggugugagccacugugcccagccauauguuauugauuuuuaaauagccuuucaaguguuuauacugagaucaguaauccaugauuuaagacaacuuuucuacauaccuuaauugaauuaaguuuguuuauucguggccuauaguuguuuggaucucuucugaauguaauuucaagcugagacaaaaauuuauucaugccagccaaaaggguuugaggacuaagagaaaaaaaaaaaucaauuuugauuaaauuuuacuucagaaauguaacuaccuuuugagaggaaggguauuaagaauuacuauuaccucaaauuccccaaucauaaaucaucuggauaacaguauaauaacagcauauuacaaauccuguguucagaaauagcuuugcuuggacuauauaguuuucuuggcuguaauauuuuugugcaaaacaaaaaaaaaauuuaaccuggauuucuaaucuggugaaagaaacauuuaagauagaaguacuacuuuagaaaaacagaagauaauuaauaaguagauuacagaaucuccaauugcacauuuuuaggggggaugagaaucuuaaaaaguuauauuuauaugaaaaauuuguuacuggagggaauauguccuccuaauagugguuuucagugacaauuccuuucuaaauuucuaugcuuaaucguuuuuacccaagugaguucuuaaaucaugccaaaucacaacauacaugugaaacauuuuaaaauuuuguaaauagaaaggugggauaucacuagaugaacaaauaaacaucacauaugcuaagaaauuucccuagcucuuuaagaaauauguaauucucaauuuauaaaaaaaaaaaaggaauucagggaagaagcccagcaaaauacuuuuauuucuuagaugaauuauuaaaauggcaacuccauuccuugcucuccaauaccagaaaacaugcugaaaccacaugaaacugcugguuuuauaggugaaaacugaacaccaguaauuucauuuaguucaaucuaauaauauaggcuuuagcacuaaagguaaaaugaauuucucauaacuugaucugaauguuaggcuucucuauauugcaagugcucuuaaucaggcuaacaaggaaaaaugagaagaaaaaacgaaaaaaguaaaaccauuuauuuuaacucugcuauagauuaauaccagauauuugggauccacugugagcucaaucacugucagcauaaguuggacaaaucauguaaccucuuuaaucuuguuuucuuuuucuaucauguaugaaagcaauaguuuucaaucuuuuuugggaaauucaaauaauaaagcaaacaaaaguuaagcugagaaaaggugaggggcccacagcuuuuuaugcuguggccuacagcuuuuuaucuuccuggugagggauuccacacugaagccuaaacacuacucuuccacauggucccauccaguccccaauaccaaugaucucaggagucacagaaucaagucuagaauuucuagcuuucauuuuuuaaaaauuaaagugagugacuuuacuauuuacuggaaaauuuaaaaugaauuacuuugaacauauuaaaaaguaauuuuaccuguuugcaacuguguucuuagauggaacaccaucaaaaacgaugacgcgauccgcuagauagguggccaugaugaagucauguuccacaacaaaggcugucuuuuuugcauggaguaugaaacuaaaacacaaugauuuugaaaucuuauagcuuucuaucauaaaacauucgacuguuauauuaagcacacuuguaggacaguauacauaaucaaaauauggcuaggagcaagauauuuaccguuugacaacucgagcugccaucagucuuugcucagaauccaaauaugcagaugguucaucaauuaaauagacaucagcagguuugcccaagcaaagggcuaaagcuacucgcuguaguucaccaccagauaaugucugcaccuaauuggaggaguuuagcaaaccauguaaaggcauccaaaauucaaaauaauaaaaaaauaaaaaaaauuauguuaaaguaccucuugaucaaugauguuuucaauuugcagaggcuucauuacaucggucacaaauugugggugaguauaagcaucucuuaucuuuucauguaguaacuggcgaacacuucccuguuuuuaauauaaaaaaguauuuaaaugauaaacuuucacuauagaacucuucuauuuaugaaucuugacaaaguuaagcuucagaauaaaaguauaucaauuugccaccaacagauaucaauguguauccaccaucuaugacauguuuugagauuuucuauucaaaacccaucauguccaacaaguaaaaaggaauuuuuuuuuuucuuuugagacagggucuugcuccauugcccaggugugcaauggcaugaucagggcucacugcagcaucaaccucccaagcucaagcgauccucccacuucagccucuagaggagcuggaacuacaggcaugcaccaccaugcugaaccaauuuuuaaguuuuuguggaggcggaaucuguuggucaggcuggucuuaaacucuuggguucaagugacccuccugccucagccucccaaagugcugggauuacaugcgugagcuaccaugcccagccugcaacaaucuuuuuuuuuuuuccacuccacagccccugcaauaauuuuaaaauuagaaaguaauaagcaaauaaugaauguuucagaggaaaaaucauuuaagaguagaaauuccaaaggucaaaguggguaucaagcaaccuuaggcaaucaguaagagaacacaaaaugcaugauaaugugcuagggaugaauccuaagauggcuuuuccuugcuguuucaggauaaggcugaauuuuagaauuuaaagcuaagcuuauagagagcaucaaugacaaaacuuuuaugguaagcuaagccaaguagacaaaacauaaauugaauguugagguacugaggaguucauuacaacacccgcagaaaucaaaggagguuaacuuuaacagaaugguuucaaggacuguggcauuuguuaauauuucauuucuuuuuauggcugaauaacuaaaagacauuugcucauuuuuaauuauaagaguucuuuauacaugcuggauacaaguccuuuauuggauauaugaugugcaaauguuucucccaucuuguggguaaagccuuuucaccuucuugcuguugucaauuugcagcacaaaauacauuagguuuuuaauuauuuauuuagcaaaaagaugacaaacaucuuuauuuuuuuauuuuuuuuugagacagacucucgcuuugucgcccaggcuagaguguagugaugcaaucuccacucacugcaagcucugccucccagguucacgccauucuccugccucagccuccugaguagcugggacuacaggcgcugccaccacgcucggcuaguuuuuuguaguuuuaguagagacaggguuucaccauguuagccaggauggucucgaucuccugaccucgugaucugcuggccuaggccucccgaaguguuggcauuacaggcgugagcuacugcacccggccaaagaugacaaauaucuuuaaagcacuuucuuagcaguggauaugaaucaaggauuggacucuuaauacauuuguuugcaacuaucaauaaaacuguauagaaucuaauuuggagaaaaauuuuaauauaguaaaagaugaaagcuauaggcauauauacaaaauuuucuuuaguaaccauauaaaaaauaauaacucacaguugauuugggacuaauuuucuguggcuuauaacugacauuuagaacugguacuucuccugcaaaauaaugaaauacauaagacacuaaaaacugcccagaucuuuaaaguuuacuguguaaaacagaguaaaaagacucaacaguuacaaauguaccuccuucaucagguuuaagucuuccagcaagcauucugauaaaugucguuuuacccguuccuggcaacacaacauaugacaguuugaucugaaagaugcuugacguuuaaaguaaaucacuauguccuauuugguuuuaacugagaaauuuguuuuaaagauauacacugacauuauugaauucugaaguuuauauagaaaaauacuuaagucuuucauggcucaccucugaagugucauucuaagguaauuaagaggaauaaagacuagucaaagcuuaugacaauuuuaauaaaugguaugucuauaaaguuuaaauccugcaauaguuugaaaagaucuacuuagcuaaauuaucagggcacacaauuuauuaagacaguauagacuguuuuaugaaagauaacuguaauuuuaaaguuuacuuauauaaaauauuuaaauuaauugcaacccaauucaaaauucccauuaucuaaagacugauacauuguaacaaucuuuauauaaaauuuaucuucuauaguuuuguaagcuguaagauuacaauucaaauaguucuuaaaucaugaaggcaauaucacauauuuaguagucaaauucaucuuauaucuacacuuaugacaauuuauuaugaaauauaugcugguaauacaauuauuuacaaagguagauugcucugaauuuaaaauaagaaaaguuccacauugaaguguaugaggaaaaaauuuuuaaagcuggauuauuucugaaucaccauuuauccuuuccaucuuagucaauuuauaagauuaauaacugccuuaucaauuuacauguaaaaaaccagcugacaaagaacaccuuauuuucacuagagguuauaaaacaaaauaagaacuauuaaccugauugaauuacagugaaauugaauuacacaaugccaaaaaaaugugaaaguacacuaagaaauuuguggguuuaaauaaaacucugcuucuagcccuauaacauaugauucaaauuuuuccacaaaacaguuaaaacuaauuuacuagauaaacaggaagauuuuuacuuaucacaaaacagaaaacuuaccauuuucccccagcaucaccauaauuucagaaucuguaaacucuccagcuacaauugcuagcucaaauucucccauuuuuuucuucauuccuggauauuuauacauacacaucuuuuuaacuucuucuucauuugcugucucagccacuuuaaaaacaagugaugcaucucugaaucucaaguuuucuguuggaacauagccauccaaaaaaauguuuaugccuguugggaagaaaauugucaaccgggagaaaucauuagagccaaaauccuaagcucucuugggagcaaucuauagacuauauacuuuaaauuucuguggauuuuugcuaacauguuggucugcauauaaagaaguaacuuaaaaaacuauauauauuuaauguaaguuuaaauaauucaugaauauauaugcaugucccccccaaccacaugaaguacaucuucucauuauccuguaauuacuuuuuccaucagguuuuaugcaaaagagagcacaugauguccuuuuugcuuuaucuuuaaagcgaaaaugacaaauauguaagaguauuuucagauugauguaauauugauauaaaaguuugggggauaaauuuuuuaauauacaauguuaucaauauuuaauuucauaugagacauaagcacauauuuugagguuauaauuuauugcuuuaaaaaaauuaauccugcagguucauaugaaauugaauaugagcuaauuccaguuaacauuuuuuuaauggcuucacuguacaaagauaacaaccauuaucuaaacagauuuuaauaacuuaaauccacauuguauacaagaacccucuguaauaaaauuuuaagaucuacaauggcagacacacugaaaugaaaagcguauuugagaaacaaugaauaauccauauuucaguguuuccuauauuuaagugaagagaaagcugaaguuucuuggaaggucuugacguuauucauuuuauuuggaacugagagacacaucaugcagccuguauccucauccuagaacacagguguucaauacaucuuugcugacagaacaaaugaacagauuacauuuauuuugccaaaaucagcauguuuuuugaucuuaaacuaucuaaaaccuauaaaugugaaguuaaaaaauuaaauaaaaacaauuacauaaaaacauaaacucaaaggaaccuuagcagccacuugguucaaauaccuaacuuauuuuggaaaauaaaggcucaaagaacuaagugacuucguuuaaaaaaaacacagcaagucagucuuuacaguccuacuucaauguuugucuugucaauuuaaaaaugaguucaaaccauaaucaccuuuacaguuuauagaaagcuuuuaaguaugcugcacugauuucaauauauuaaaggaacagagaaaaacuaaaguuucuuaagcuguuuuaauagaucgagcacauuaaaaaccuuacuggguaccauuuacugaauggcacagccuuuagacaugacauuuauaacuggaguugugaagaaugacugccgaguacccauauuauuaucaacuugauucaaagacuaccauaugguauagaguaagguacucaauacauauuuguuaauugacaagaauaaaacauuaauaaauuuguucugaugucaucccuuaagacuacuggcaagaaaacuagguaacugcaaauuuuucuuuaaaguaugcaucuaucucaaauguauaaguagguaaguuacaaccauuucuuccccacaucuuaauauuuauguacuuuuuauaaauuauaaaaacucccaauaucuuuuuaugaaaaggauuauaaugcaauauaaauuuauuuuuccaaaagagcuuuuagguauaaaaaagauuccuccaagauuaaaaaaaaaaaaaagaaagaaagaaaccaaaaaaccugucaccucuuagggaacuacaggcuacaugaauuuuucuacuucuaggagaugguauuuuuuuccugaguaaacagcccuuuuaguguucugaauugucaguuuaagacagguggagagaaaaauaaaaauaagacacaaguaaggaagcagugaaaggaaaaugggaagaaaaaaaggaaaaagguauugaaggcagagaguacauugguacuuuuuuuuaaggagccacuuagugguacgcuaguuucuauuuuugcuuaaauuacacagguaaggaggagacauggaagggagaggccagggaaucucauuuucuuggaaguacaaagacuaaaugaaaauuuuaauacacuuacuaaacuaucuuauuagguuuuuagauagccuuaguuccaaaaacauaguauacauauuacagauaaauuuaaaacaugaaaacaagaugaacacugaaagcauuuuaagaguuucauuacugguauuggccugucaaaguuaauuugaaaaugacaaauacuacaguaauacugcagaagccaaaaugcagaggacuuuuacuguagccucccaacccccaacaaaaguaacauugcauuucuacccauccccaggagaaaauucuccaaaaugaaaaaaauauauuuuguauaacaacugauauauauaaccuuauaugcucagugauuaaauuccaaggaacuagaguuuuggaugauaucagaccaauguaaaacuacuuaauaucaauaauguaguuuauaagcauuagaguagaagagaauacagcauaugugaaaaaaguuuuucaaguuaccuucucuuacacuaaaaggcauagugacaacuccauaggcgcuugguacaccauauaaacagcagaugaagucggagagauagucuaauacacuuagaucauguuccaccacaaugauauaucugaaaaucaaaccagauuuuaguuaaaacucuuacauaacuauuuuuaauaguuggaaauuucagaaaaagagauacaucuaauaaaauuuaagcauaaagacauaagaagcaaaagccauaaaacauuuuuaguaaggcucauuaucaaugcucauauuuaaaaauguuuuccugaacuaaaaggaaaaaaucagccaauuuaaaaguuuauugauauaugaauuaaaugcauucugcuaauaagaaacauauuucgaaauaaguguuacaaaguaauuauaauagauuuaauucagauguagccuaaacuguuuauuaugcuacucaauuuauguauuaagcccuguaccuguccugucccaugcuagcuguaguaggggauggacgcauacacaaagauaggacagaauccuuaaccugagacguuuccauuuagcuggggaagacaaggaauagguaugaaaugguaacaaaaaaagauuacauggcaaaauaugcuccacagauaauaaaaucagugaacaucagaaagaaaauagguuaguggguacuggagcacuuuaugaaugagaaugggauaugaugugaagcuuaaguggcuauauuugaaugaagugauacaguauuggcuggaauagaaguuuuagacgcaaguaauagucaugaagguuuuauguagcacuuuauucccauuuccauaucgaacaccauucaacauguuaaaaaaauguccugcaaacaucucauaugucaaauuaauguaucagcuuccuacacaaauaaaaauucuccauauuuguauuaacgaaauuaucauucccucaaaaaugacauuuuauucccacugauauuuuguuuaaacuguuaaagucugugaauuccuucucaacaaugucuuguguuucaaucucacccuuuuucuucuuugccuaaauucuaguucaggcccucguauuucuuucauaucucauuuucuuuagguccccugaugugggucucaauuccaaaugaaauuaaucacuuaaauuaauuagacuuagacuuucaacacuuucuaaaacuuuaguuacuaucuuucuauuagcucauacacaggaaacacugaagaaugcaucuuuuuucuuaaauaaaccacuucucuacuucucuggugucuaggaagcuauucuuuuucuaaguagucuccugccuagaucuuuaccugcugaaaucccaccuaacccuuuaagguccaucucaaauccaacuugcuaugggaauacuuuuccuaauaugcaaaugagcuuucccccucacucuugaauacugguaacaaguauuuggacugauacuuggacuuuuauuauuuuugauuaccccauaacuugcucauaaacaucuuaagggagacucuuaauacauuuuagcaccucugugaucuuuagucuuacacuguguacuaacagacaccuaaaaaaguuguugaaugacaaaaugaagaguaugaacuaauuggaaaugaggaagauaguaguagguucugaaauagcacuguccagaacuuucuacaauuaugaaaauguucuaucucuauguugucccauauagugacuacuagccauaaguugaauguugcuaguuugaugaaauaaaauuuuaauuucaauuaaaauuuaaauaaggauguuugucuagaggcuacagcacaauucuagaguaagggaaugaaaugagaaaacauuucaggaguaaucuggcaagaaaaaaaaaguaacaauggaaaauuggaaaauaagagcaggucuaagaugaaaagggaaaauuaaaaggaaauguuuucuaccacaauggugguaauuaucaauaaaaauggcaaaucacccaggugagcuggugauacucaucuugcaucggugucuuuguuggcacuaauccauuacauggaauacuucucuacucuuaaaauccuauguuuccuuaaacagccagugugagggagcauuguauuacguaguagcuuuuacuuugcuuugaaaagaagaaaaaaauaggucaaacuuccugcccccaaccccaaccuucaaauggagguuauggagacagaaguccaaaauauaaacaugauuuaggucagccauucuguuuucugagaaguugggaagaaauaaaaaucuggagcauaguaaggaaucuagguuguaaaaaauguauacccuacaguuaauuuggggcuaucucuuagucuucaauguuacugauaauguucugaggucaaacucuauaaaacuucuuaaaucucuauucuuuuguccaaugcauccucuauuuuucauuauccaaggauaugaucuccaaaaucuuuuuauggcauuaaagacugaauguaugccuugacccaucaaauuucagaauggagauauacuuuuuaugacucuuuaucaucaaucuaucacuacauagagaucuuaacuuuauaccuguaaauaagaccagcccacuugugaaaugucuuaaaaauuuucucuacguugucaugccaaucugucuuaccauguuaucccuauuacaauuaaaguuacuguccucucucuuauaauauaggaaagucuuggguaguauuacuuuuccuuaacuaguuuuuuuuuccccgagguccaucuacacuuauuuauuucacuuuccuauugcaacuauacaaaauaguuacugaucuuuuaauuuuaaauuuauucguuauaagucaauauaaguaccugaugccuuguuuucuagugaugugucuaaacaguuacacauugaaauacuggcuguaaacuaguauuuucuuuuaguuuuccucuuauuguuaggacaugauuugauaucuuuaaaguuuuauaugaacguagauauuaucuaugacuuucauuuuaguauaaaaagggacuauaaaaauacuuuuuauaaaaagugacuugaguugagaacuagugaccugacuuuguguauuccuuucaagacucugguacauguguaugcuuuucuuuaccacaguguguauuuuucuuuaccacauugugaaguccuugaauacugggacuguauuuuuacacuugccuuccccaaagagccuaucauaaugcccaggcucuuaaugccuguguauggaguaaaaauuauggcuucuauuuggcucacaugagauugucucuuuaucacugauauucuaaguuucacuucaaaguaucuacaugaauuaguuaguaucuguagaacuugugcuccuugaaucuaaggagcugaauuuuucaucaauucugaacaguucucagucauaauccuuucaucacuuuauuuuucagacuauuaagauauauguaaauaguuuccucauuacauucuccagguuucugaaccuucuuuccacauuuuaauuuuauucucucucugcuguauucuaguaacuuccuaagaucugguuucuaaugcacuuuucugcugucccuaacccaucuaacauguccagugaaucuguaaugucaccaugcuuuuaauuucuagauuugucuggguuucugaacaucuaccuauugcuuuuuuaguagcauuauauccuuaggguuuugaauccuuuuauuuaaagauuuuauuuugaagauuauuuaauagccgcccuuagaaugucaccuaaaguucuugaauccugcugccauauaauaugugcuggcuaauuugcggaccguuuccuccucuaauuuauaaauuuuauaauuuacaauuugagcucguccucaugagccauuaccuauaggaauccugugcaaccaggguugaaagcauauugguucguugcuucugcuauguaccauaaaaguuccagaccccuuaaacauauuacuuucucacuuugaaggguucacagauuccacugguuauauaaauuucaauuccauagccaggcgagcugcuggcccaugaauagagauuugaaacagagcaaucccuucacuuccagggagcucagugaaugauagauauuugcuuucuugacauuuccgugcaaugauagacaaguuguuucuaauucgcccuuucagugagaaagcaguccuuugagaguccuggcacuuuaugugugaaaauccaauacuagaccuugcuucuugcccaugaguggauguuaaaacccaagaccuauuacagaaaccaucaacaucugguccuauuacuccucuauaguucuaaugcuuuaguuuuugaccauuugggauuucucuugcuuucuugcaagaugagccauguauuuaaaaggauguucauuaaauuguuaagucagaagaggcaguauaacacagaaaauacuauacagaaaaaaaccccuggggucuggucacagcuuugucauacaguaaauuuguaaccuagaacaaacaacuagauuuuugaccuugugcuucaucugcaaaauaggaauaccaucuaaagauuccuacaagauaaccaugaggaucaaaugacauaaugaaucugaaaacucuacaaaccacaaaagcacccuauaaacacagcguauuuugaauacuaacagaaguuaugauaauuuucuuuucuuuuguccagcaagauucugaaaaaccagaauuacucuagugauucuuacaaauucuaagcgugugcgugcguguguugugugugugaaaaugagagacagagagagagaaaaagauagcugguaaaagcuaagggucugcuuccuauaaagcuacggaauuugcauauaauuucagaauauuccuaagcucccuggaagcggggguguuaauaaaugaaucuugcauugagaaccucuguucuagguaaagaaagguaaauuuagguggcagcuauaaacaaccaagauaaaaaauauguacaucacauugacagucccaguguuuaauccuuagaaaucuguaaaaaucuccaaacaaaacaacacaguaauaugccagaucucuacuuaccuaucuggauuuauuagagaucguauaguaauagcagccuuuaaacgcugcuugacaucuagguaacuagaaggcucaucaaacaugaaacuaugaaaaaaaaaaaaaaaaagcaaauauaaguuugaaagacaagacauucuaccuuacauacuauuuuaaagcacuguaguaucaagagcuuuugaguuaaccacaacacaaaucuccaauaguaaugaagagucuacuuguaaugguaaaaauuucuguauucuguucagaaguagaaggaaaaaauuacagaaagcaagauuacacaccaggucuggugagggucuaccagguuaggcuaauuuacaaauuggucacuccucauaaaaaguauucugauauagucucaaguaguuuggagagcuuuucucuuaagucagcugcauuuaagcauaguuuuuuggaggguauuucaagaauuuauagaauacuuuguggagaagaguuagccuucaccggacaacagggcagaaauguggaaaaagcagcaauaaaugucugggaggagagacacuaaauaaaggaaggaaacuuuccucuccucucuuucacauggcaugccacagugaucuacagugauuuaaaagaccucgcgucuugcuucagauauuaaaaagcuugcuagccuggcuggagagcuuaagucuuuucacauaaaaacagggcuuaggccaggcgugguggcucacgccuguaaucccagcacuuugggaggccgagguggguggaucauugaggucaggagaucaagaccaaccuggcuaacauggugaaaccccgucucuacuaaaaauacaaaaaaaaauuagcugggugugguggcgggcgucuguagucccagcuacucaggaggcugaggcaggagaauggcgugaacccgggagguggagcuuguagugagccaagauugcgccacugcacuccagccugggcaacacagcgagacuccgucucaaaaaaagagagcuuagauaaugaauaacugacuuuauauaaaaaguuccggcaccuaucaguuauaaacuaucuaaauaaauaaauauuuuccccugugaauauaacagggaaaaugaguaguggauacacaacugcuucaacaucuuaccucgaaauuaggaacuuagauacuauuucuauuaauuucucucaaaaccauuccucuauuagcagcaucacaacugaaaacucuacaauacggaugaagauaaacaaaaauuguaaaguaaccuacauaucagcuuucuguaugcaaacgacagcacaagcaaaucucugcaacucuccuccugaaagaucuucaacauuucguucuuuuagguggguuaaaucuacaaagaacauagaggcauugugcucaauguauuucaccucuuccagguaaaaaguauacugcaugucaucauuugaaguuugaaugcuauuucaguugaaaauuguuuaaauauaacaauuacuggagauuuucaguaauccacauaaagauguguacuuucaucacuuaaguucagggccuauugaaauauauacacaaaauggccgggcgcaguggcucacgccuguaauccuagcacuuugggaggcugaggcaggugggaguucgagaccagccugacugacauggagaaacccggucucuacuaaaaauacaaaaaauuagcugggcgugguggcacaugccuguaaucccagcuacuugggaggcugaggcaggaguaucgcuugaacccgggaggcagagguugugguaagcagagguugcaucauugcaccccagccugggcaacaagagcgaaacuccgucucaaaaaauaaauaaauauauauucacacaaacaaaaaauaaacacuuaccaagcugcugacauacaauugccugugucuuuguuucaucuuuucgguccaaaauagaucccacuguccccugccacaauauaccaaaaacaguuacuauuuucuuucaauauuaaaaagaaucacaaaguaaaacaaguuuauuuugauauaucuuuuauacuucuacuaauauccguuaaguucccucuaucaaaaaccgaccuuugcagccuuaggaaucuggucuacauauugagguuugaugauggcuuuuaggucaucuucuagaaucuuuguaaaguaauuuuguaauucagauccacggaaauaagucaaaaucuccugccagucaggaggauccuaaaaaaaaaaaaaaaauacagaaucaugugaauuuaauaauacaaugacaaagaggaugaaugcuacaggaaauagauuauauaugcaaauagaacacuuguggcuuuuaacuuaagguuggaggcgaacauaauuaauaaaagucucauuucccuauagcagcaaagaaagaaaacagaacagauauuauguuauucaaaagcagauuccuagcaccuaggacauagaagggcaucuaauaagagguuaagcuggaaggaauguuuccugcucauauuuucaaaacaagugaaaauguuuucagguauccaagauaucuuucuggauacuuaaucaaggauucagaaaugaaaagcaaaauacacuuaugauuuauuugaacaauuaauagggcggcauucacacucuggugaagcuccauuuuauaauaucuacaaauaaaaauaucuaacuuaagaacauuacacaguggcuccuaaauuucuuuauguacuaaaguuggaaauuuaccauucaugagucaaaagccuaaucaaacuauugacugcaacaaaaacuaauugagcuauuuuuacauuauugggacaaauuaaauagaaacguguguaauacagcagaaucaagcagaauucugcuucagaucaaggcuuaacaacucagaauuuucaguuaaguaacauuaacagauuuuuaguucaaaaguacaaaagagcuuuguuuauaaauuucucagcauuaauuccauaaauaauuuugaaaauaagaauauuuuaaaaauauacauaucauccccccaaaaucucauaaaacugacucaugauauuaauuuuuacaaggugauaauacauacaucguacuuuccaagguuuggcuuuuguuuuccugcuaaaauuuuuaaagcaguugacuuuccaauaccauuaguuccaacuaaucccaaaacuucaccuggacgagggauaggcaaccuguuacaaguauacaaaaauaauaaaacaacucagauuuacacagaaaaagccacauaacaucagaaugauauauuuuaaugcaccugcacuucacaaccauccauuaauaagcuaagaaacauaugccagauauuacuggcuauuaggaaaaaaacagccaagauuaauggcuauuagaaaaaagaacagccaagauuaacuuacacuguuaauuguuagaaaugcauccuuaaacaacauuacuacaaguuuuauuuauucaguuuucaaaguccauccuaaaguaaauuucuucuuuacauauaaggcccaguuuuaauguauaacaaaaugcuuugguacaaaauuacacagcaggugcaaccucacaaugucuuucuuuucuggccugccauuuacuuacaaggagagaagugccacaucaaccagaaauauuccacuuccuucucccugcugcaguaggccccuuaaagcuggcagguugagaaauacuuuuuuauuaguaaaaaucuagacuccuagauucaaaguguuaguguucagcagauaaaaaucccaaacuaaggauuuauuugugccuuaauaauacauguccaaauucaaagugauauucucuguagaucauaagauuaauggauaaacaaaaucaaaggcaaguucccuuaaaaguuauuuuggggauaaggguacuaggaacaacagugacucucagucccaguuguauauuagagucaccugggacuuuuucaauauacuaagguccagacccuaugauguaauuaaacugggcugaaaccugggcauuaguagcuuuaaaaagucccauagguaacuguaauguuagccagaaugaaccacagacauaugcaguaugauucugcaugauguuauaauauuguauuuuccuuuagugacugguuaauagcauuuccccccaauuucugcacuucucuuaaaaucccaaauguauuuuacucuuaacuugacagaagaggaauccugaugugaaaauauaccugugaaguuugaaggcauuggcacaauaucgaugugugguuucuuuuuccaaguugcuugguagauugacaauugauaaggcgccaaaggggcauuucuguuauuuaaaguaaagaauuaauuuuuguauuaauuuguagacauauacacauaacuaaaauggauuaaaaauauuuuuauaagcaaucuucuaaacaugauuucauaaagaugugaaauguuguuucauuuccuucuacuauuuacuuaaaauaaaagguuccuugaacauuagaauuauaucaauugucucucaguauauguggggaaaauuguuccaggacugccgaguacaccaaaaaauuggcacauacucaaguccugcagucagcccuggagcaccugaguaaaagaaaaagucagcccuuucuaaaaugguuuugcauccugcaaauacucuauuuccaauuggcauuugguugggggaaaaaauacacguguauguagaucugcacaguuugaaccugugauuucaugggucaacuguaacuugauauucccuuuaguguuggguauaauccuauacauuuaaagagugcuuaauacuuauugaaaaaccuuguagaacuugagguuuuuuguuugguuuuguuaaaacauauuagaugaggggaggcuaagaggcaagucaacaaaaaagucacugaauauauggcuuuauauucuuuccaaaacagauguucucccucuguuuccuucaauuauuccugcccuuguauacuuccuguucuaccuuguaaagucguuugaggucauggaucuuauccuuuuuugggcuauuuccaucccaccaauagcuagcauauuugcacagacuggggauuaaugucuuuccauuaugacuuuuaucuaucuuauaugaauaagauacuugaauucucggagucaauucacauuaaaaaacaaaauaaaacacauaggcuuauucaaauaacauucaacuauaagaugacuguccaaggaacaagaacagcaaaaacaggaaggucauuuaagaaugguaauauggcuagaaaaauuuuucguaaguacagacaacuacagagguacaugcaaaaauuauaaccucauguuauuagagaucuguucagcagacauguucaaugagcuuaggggaccaauucuaaguuuccguguuuagagauuccagggaauuuccauuuuauacauuauaaaaacagauaauuacucuuguuuucuaauaaaguaauuuccacccucuaaccaaaacuauuaaguuuuuacaaauuauauuuuucuauauuacaguggaggauaguggaguuaccuccauuauccucuucucuuaaauguacauacaaugcuuauaugcugcaagugauuuaaacucaauucuacaaggaaaaaaauauccacuguucauauaugagguacauuauaauaucuuaguguucaggaauuauacauuacuucuccacccucaaagaggaccaccucauuaguauguuuuuagccacucaaguguauauccaaaauuuaaaauuuaaauuaauauaauuuucuuacagcacaaagagagaaaacagaauagauacuauauugcucaaaaccagauucccagcacccaggauaaaggcagguaucuaguaagagauuaguaaauauuugcuggaaggaaugcuuccuguuuauauuuucaaagcaagugaaaauguuucagguauccaugaaaucuuuccggauacuuaaacaaggauucagaaaccaaugugaaauauacacacgauuuauuugaacaauagugugguaucugaauucuggugaagcgccuuuuuauaauaucuacaaacagaaagaucuaaauuaaguauguuacacauuagcuccuaaauuucuuuuaugaacuaaaguuggaaauucaccauucaugagucaaaagccuaaucaaacuauucaaggcaacaaaaacuauuaauaauugagcuauuuuaaguauuauacuauugggaaaaauucaauagaagcauguguaauacaguagaagaauuauguuaaauuuuaaaauuuuuggcugugugcauuucuauuuaaaaggugugaauuuaaaauucaauacagacuugaaagaaacauguaaugugaugguaauguccuuauaaaaaggugaaaaaagagaaauuuugguuggaaauggcuuuauaaaguugaguacagcaagaguaacuuuuaaaaagggugguuuaauuuauuuaaaaaagcaacaaugucacugauauuagaauaccacuuuccuaaauuuacauucucuauucauuugcuuuauacuuugccucacuuaaaguaguuauagcauaguauccagaauuuucagauuucaguuuuagguuacacguuugauccaguaaauaaaauauuacuuaccuuaauacagauaccacaaccaauacaaagaguuucggaaauccaugcuauuuugcucugggguguaaccucuaugcauaauuuuccugguaaaggaaaagauauaauuaagccauuuccuuugaucuucuaauuuuccgaacacuguuauuuaggcaaugcugguucuaaauuuccauacagaagcagauuuucaaaaacaaaggccacacaaagaaauacauuugagauaaugucuuaaaucagugcuuuguggggacagauuucuaaucacuuauaugaauauccuuguuuggcagcagggagaugauuaauuaauauauauuuauuuuacuuaauuuacuacuggggaagaaaauaugcuaguaaaaguaugacauauccugaaauauuuuuaagcugauuaaccuaaauuuuaaauucauaaaacaaaauaugccuugaaaaugguaaggcagagcauuaaacgaaugaacuauuguagcuagaucaguaaaacuccaaaaagguaugcagucaucuaacauacagcuaaaauuaaacaugguaguagggauaauggaauuucugaauagcaaaggagacaauaacagaugacaacuaaaguuucuaaguuucaguaauucuaagagucaguaauucuaugccucauucguauauucacaauuacuuaacauagcccuuaacgacuaccaauaauuuuucaacugaauuguuggaaauuuaucuaaucuucaaaauauaguuaaaccuuaugaauagucauucuuauuaagcucuuuguucauuuuuuaaauaugaaaauacugucaaaguuuacuguaacccuucccccauugauuauaguaauuaauuacuauauauauaauauuaaaguaauuauaagauuuuguagauuucaagaucaguaagcugaacucugcuuugaguucacauccaauacacuuuuaaauauugauguauuauucuaaaauuuggucuuucuuuaaaaaauaugauccuucagucacaaagcaauaaaagaaauuuagaacaaacuacuuuucuugucuucacaguuuuaugaaacuaauggugaacacaaaguuuauguuaauguccguaaagaauuaucaaaccaguugauuucuuucaugguuuucuuuuauacuuaaaugauccacagaacagcuuacccauucgaacuacaggacaacucuuuuugcauuccugucgacauuucuuagguuuacauuugucaugguugacaauagcaauucucguuaacuugucugccauaacugggcgaaagaauauccagcucuucuaugaaagaaaaaucaacaaauuuaaugccauuaguuaagggaacuaauuugcauacaugaaagacaggaaaacauaaaugaucauuauauggagaugaaaugauuaucugcaaaaaaaaaauauaaauuuugacaaauguaaaaauuguaaaauaaucuauaaucuaguaagguugggaaaaucaaauuuuacauauauacuuuaaucagaagauuuauauaaggaaagaaaaaaaugucauuuacaauagcgacaaaaagaaaauaucuaggaauauacucaacaagauauauacacaagaaaacuuuaaaacaacaccaaaugauauaaaugaccugaacaaaugacaugcuaucucaguuuuuauaauaaagaauaguuaauaucacagauuuaaacccuuccugaauuuauauauuuaauucaaucucaugagaaaaaacaaacaaaagaaccccagacaugugguggugugcgccugcggucccagcuauuccggaggcugaggugggaggauuaccugagccuaggagguggagguuacagugagcugagaucacacuacugcacuccagccuggaugagagucagacccagucucaaaaaaaaaaaaaaaccccaaccaacccagacaaagcaaaucuaaagcucuaauggaaaaagaauuauuaauagccaggaaaacugaaaaaggggaagcaggaugggggaaaucccacaagcucuucccccaaacuaagcauuacuucacgucguguacaucugacuauaaugacacugacagaaauggcaaauaaucauaauagcaaugaaauuaaaaggagaccaaauaacuauauguauauacuaugcucacuuuuaaagcuuuuauaagucuugauauuccaauuuaaucaacuacacagcauuaagaucaaaguuaacuuaaaaaucuuucacaauauugggcuuagugguucagaaauuaauuuccuuagaauggugauuaaaguaaaaaauuccaaaaggugccuuaauacucaaguuuauuccaauauguaaugaaugaaucugaaaccaagauuauccauuuagaaagagaucauguugucuuuuucuuacugugauaaucaaucuugauuuuauuuuauuuuuuuuaauagacugcuucccuuuguagacaucucaagucuuuuucacacccaucaauaucauuaggcuuggauggggauaagagaucuugcuccucgacgcuguccuagacuauuaucucucccuccucccuaaaaaguuuugcaucucaacuaucuaacugcuuuaguuaguagugaccaccagaucacucccuuucauucuuugaagauuucagccccuguuaacuuucacacacucuuuuacaacuccugacauaguucucgauuucaauaugcucacagaugacccuccuguccucucauuuaaccccucuccucaaacagcuugucuucuaccuuaccacagccauucauuuuuucugguuacauccuagaccuuaucauuaccaguaauugcaauccuucuauaaccucaacuucaaauacuccauucuccaaccaccauucuuaucuuuuuaguucacccccuacuacacaacaauccaacaacucugauuccuccauucuucaaaccuuucauuaucucuugauucuaucauauuuccacugucccucagcucuugguguuuuuauuuuccuucucacccagcuaaaauacccuaaaucacaaucuugguuaaauucgacucuucaccugcacacauagagcugaaaaugguaggugaaaaaaaaacacaaaaccugcugacuagucucccuuuaaauucaucaucucaaauggacccuuaugccaaccagcaaugacacuguauguauuucccuggcuaagaccauuuguacacuagaagacauuccauaagaaugucccaacaauucucccuucugucuuuaacuucaucaauuauucucuccacuggcucauucuuaucagcauucaggcauucuauuaucugaccccaucgucucccauuguuuuauuuuuccuucuucaagacuacuucaaagaguugcuuauacucaaugucucaaauuucuugcuacaugcucucuggaauccauucuaggcucuagagcccaucauuuaaucaaaacuuuucgagccaucauuguucuucacauggcuaaaacaaaugguuaucagaccuuaauucaccugaccaaucaauugcaucugacacaaauaaacacuuuuccuacuagauaaaaacccuuucuuaacuugguuuuaggauacaacacuaaucugguuuuucuacuguuuuccuggucacucaucuucaucucccaggcuucuaaaugcagagugcucuaagacuuggucauuuuuuuccacauauacucauuccccaaguuguucuauucuggucucacagguuuaaauuccauuuauauacugcaaauuuccaaauuucuaucuuuagucagcauaccucucuugaacccuuccugcccaccuaacaucucuggaaggcuuaagaggaaucucccaacuaagcuccugauauccucaccaaaauuucagcagucuugcccauuuuguuagauggcaacuccagucuuccauuugcucaggcccaaauccuugaagucauuuucuuuuccaccuaauaacagcaaaucccacugaagcuauaaaacauccagaaucugaucucaugaguuugguguaagcuaucacuaucaucucuuaccagcaucacucaaauagcuuccuaacagaucucuuugcuuuuacccucaccucuuucuacucuaacccucaacaguucauucucaacacaggaaccauaggaagccuuuuaaagaguaagcuagaucaugucacuccucuauuuaaaauccugcaauggcuucauucucaaucugaguaaaugccaaaguccugaaaauaaucaaugaggcauugaucagccucuguuaacuuucugaucucaucuccaacuacucuagcucuuguauggcuccagcuacauuggcucuuuguuguuccuagcacaugccaggcauguucuugcuucaagaucuuggcacuuucugccuguaaugcuauucccccuagagaguuacauggcuuacuccuuucaaucuuuacuauuucucagugagccuuuuguaacuacacuaccacaauauacacuaccgaaaaauacacccaacugccucuucauccuucuuucuugcuuuauuuuucucccuagcucaacuauaugacauacuauauauuccauauauauauuuuuuuuauauauaucugguguauaugcacacaucuaucguggguguguguauguauauugucucucuacaaacacauacacauuuuuccccuccccaaguagaauguacuccauccaucaugaggguaggaauuuuuguucauuccaguggcugaaccugugccuagcacacaggagaucaagcauuucugcuaaaugaaugagaauaugaauuuaaauauaguaaauaauuuuccuguagguuauaacaacuuuagaaaucuugcaaguuaccaauauuuuauagugacaguuguccacuaaacuacauacugaaaaaaaaaaucauucaaaaggagacuaaauguucauguaauaaguacaggguuauuccaauaaacagguugacucuauuccucuaaaaacugguccaggucuuguaaagauuagaagaggaagaaauuagauggcuugaauugucacaaaaaagcuauuauucgggaaaugacaacuuccuaggaaaugaagauucuucagcaagcuauuaaaacuggacaccaugcauucuaauuuaaauacugaaugccuuucuacaauuacucagugaaagagcauaaugaauuccccuccaggggauaaaucaccacgaaauugcuuaaacuuuauuucuguuaaacuacuaaaauauuuaauuuuucaaacuauuuuaaaaaccaaaagacuguaaaagacaauuuuuuaaaaagacacagggaucuugcuaugguguccuggcugagggcagugaucacaggacacuacagacugggacuccugggcucaagggauccucuugcuuuagccucccgaauagcugggacuauaggugcaugucacuacccuggcuugauuuuuacaguagaauaaaaacauaccagaagugguuaauaaacugauuuauauaaaaauagugauaaauuguaaugcauuuaagaaaaaugaacauggauucuuuguagaacuguuaauuaacugugugaacacuuuuaauucaauuucuguaucaguuucaauaauuggggcaaggggauucccuacuuguuuuucaauagaaaaccuaggcacaguaaagcuuggagaggaagauuauaguuaacaggcuccugcaaacaaagaaggauuugcggauauuucagauucgaagacaaaaguguucaaaauugacacuagaacaaugacccucagugucauucuuacagcugagaggaaaaaaggaagugaggaauacuuagaagcauuuacagucuaaagccaaaauaauuguaacgcuguguaaaagcauuucaaagacugcuguuaacuaaugauguuuaguaucacaugaaauagucuaacccaugcuuauuguaguuuauuagucuuacaaaacacguagaaguuaggagugguacacggcucugauuucaaagaguuuuaaguuuaagacauuuagaagaacucuaacuuaauauuguuuucucccccucucucccaauuguuagaugcucuuccaacaaacaaacaaacaaaaaaacucccuuuuuuaaaauaggggagaacuaaguucucaaaaagcucacaaaccccaaacagcuuuugguucaaauacagguucugagccuuugguuacacuaacaaaguauuagugucagguggcugguauacaaugaauauucucagaauaugggacaaacuacugcaacauaaaugccacuaucauaaaugacuaguuagcaguccuguugggaaagaguaaaaaaauaaaacauguuauuuggacaguucuuccucuuauagauuuuuaccaucaaaaaagagaaaauaagcuuauguaguuaaugggaggugggaauucggcuuuggcugucauucauucacaauacguauuaaaugccuacaauguacgaagcccugaagagauaauaaagguauucugaguaaagacaucaaccuugaucucaaugaguauuagauacaauaaaaggaaaaacggguaaggggagaaagugccuagugcuacaaaagcguaccaaaaaaacuauaggauuucuacugggaaacuacuugggacaaccccagucauagcugcguacacgcuguucugagaaaagcagagugacaugugggcaucauuucuauaaagccugggaguggacagcgaguauucgacuucauggcggcaagaugccaugacucauuccacucaacaaaacguggaagccacgacuucccacaaccaaauaugcacaugugacaauauauccauuuugggugcuggaggaguguggggguacuagagagugcuguaaguucuaaaggugccuuccucuccagcagguuuagcuucagggcgggagugggguaaagggggaguggagacuacggcaucuagguccauucucgaagucccucgcggguguggcaggcaacagcggcgacagccgggucggcuggaggggaagaccgaggcgcccccaagcucucggcgucgcccgcgcuccaucaguuccagcugucccgcaggaaccgcugccacgcgcugcugcugucuccgccaccuaaggccuaaccaaaggcucucggagaacgucccuacauucuuuccaaccuggcagauggcagcuaacggccaaaccucuccgggcuauucacguaccuggagaaaacgauccccuugcggaggggagcacagaggccaaaucagcucuugccuucacuuuucagccacacagcguguucucacggccaccggccaaaauggcggugcccagccgccgcacgcgcaagccauaggacguagugcgcgcgcgcgacauagagcgugaggcggaacccuggagguagguagggagau

SEQ ID NO: 15665 - RNA, 31072 nt, Homo sapiens
aucucccuaccuaccuccaggguuccgccucacgcucuaugucgcgcgcgcgcacuacguccuauggcuugcgcgugcggcggcugggcaccgccauuuuggccgguggccgugagaacacgcuguguggcugaaaagugaaggcaagagcugauuuggccucugugcuccccuccgcaaggggaucguuuucuccagguacgugaauagcccggagagguuuggccguuagcugccaucugccagguuggaaagaauguagggacguucuccgagagccuuugguuaggccuuagguggcggagacagcagcagcgcguggcagcgguuccugcgggacagcuggaacugauggagcgcgggcgacgccgagagcuugggggcgccucggucuuccccuccagccgacccggcugucgccgcuguugccugccacacccgcgagggacuucgagaauggaccuagaugccguagucuccacucccccuuuaccccacucccgcccugaagcuaaaccugcuggagaggaaggcaccuuuagaacuuacagcacucucuaguacccccacacuccuccagcacccaaaauggauauauugucacaugugcauauuugguugugggaagucguggcuuccacguuuuguugaguggaaugagucauggcaucuugccgccaugaagucgaauacucgcuguccacucccaggcuuuauagaaaugaugcccacaugucacucugcuuuucucagaacagcguguacgcagcuaugacugggguugucccaaguaguuucccaguagaaauccuauaguuuuuuugguacgcuuuuguagcacuaggcacuuucuccccuuacccguuuuuccuuuuauuguaucuaauacucauugagaucaagguugaugucuuuacucagaauaccuuuauuaucucuucagggcuucguacauuguaggcauuuaauacguauugugaaugaaugacagccaaagccgaauucccaccucccauuaacuacauaagcuuauuuucucuuuuuugaugguaaaaaucuauaagaggaagaacuguccaaauaacauguuuuauuuuuuuacucuuucccaacaggacugcuaacuagucauuuaugauaguggcauuuauguugcaguaguuugucccauauucugagaauauucauuguauaccagccaccugacacuaauacuuuguuaguguaaccaaaggcucagaaccuguauuugaaccaaaagcuguuugggguuugugagcuuuuugagaacuuaguucuccccuauuuuaaaaaagggaguuuuuuuguuuguuuguuuguuggaagagcaucuaacaauugggagagagggggagaaaacaauauuaaguuagaguucuucuaaaugucuuaaacuuaaaacucuuugaaaucagagccguguaccacuccuaacuucuacguguuuuguaagacuaauaaacuacaauaagcauggguuagacuauuucaugugauacuaaacaucauuaguuaacagcagucuuugaaaugcuuuuacacagcguuacaauuauuuuggcuuuagacuguaaaugcuucuaaguauuccucacuuccuuuuuuccucucagcuguaagaaugacacugagggucauuguucuagugucaauuuugaacacuuuugucuucgaaucugaaauauccgcaaauccuucuuuguuugcaggagccuguuaacuauaaucuuccucuccaagcuuuacugugccuagguuuucuauugaaaaacaaguagggaauccccuugccccaauuauugaaacugauacagaaauugaauuaaaaguguucacacaguuaauuaacaguucuacaaagaauccauguucauuuuucuuaaaugcauuacaauuuaucacuauuuuuauauaaaucaguuuauuaaccacuucugguauguuuuuauucuacuguaaaaaucaagccaggguagugacaugcaccuauagucccagcuauucgggaggcuaaagcaagaggaucccuugagcccaggagucccagucuguaguguccugugaucacugcccucagccaggacaccauagcaagaucccugugucuuuuuaaaaaauugucuuuuacagucuuuugguuuuuaaaauaguuugaaaaauuaaauauuuuaguaguuuaacagaaauaaaguuuaagcaauuucguggugauuuauccccuggaggggaauucauuaugcucuuucacugaguaauuguagaaaggcauucaguauuuaaauuagaaugcaugguguccaguuuuaauagcuugcugaagaaucuucauuuccuaggaaguugucauuucccgaauaauagcuuuuuugugacaauucaagccaucuaauuucuuccucuucuaaucuuuacaagaccuggaccaguuuuuagaggaauagagucaaccuguuuauuggaauaacccuguacuuauuacaugaacauuuagucuccuuuugaaugauuuuuuuuuucaguauguaguuuaguggacaacugucacuauaaaauauugguaacuugcaagauuucuaaaguuguuauaaccuacaggaaaauuauuuacuauauuuaaauucauauucucauucauuuagcagaaaugcuugaucuccugugugcuaggcacagguucagccacuggaaugaacaaaaauuccuacccucaugauggauggaguacauucuacuuggggaggggaaaaauguguauguguuuguagagagacaauauacauacacacacccacgauagaugugugcauauacaccagauauauauaaaaaaaauauauauauggaauauauaguaugucauauaguugagcuagggagaaaaauaaagcaagaaagaaggaugaagaggcaguuggguguauuuuucgguaguguauauugugguaguguaguuacaaaaggcucacugagaaauaguaaagauugaaaggaguaagccauguaacucucuagggggaauagcauuacaggcagaaagugccaagaucuugaagcaagaacaugccuggcaugugcuaggaacaacaaagagccaauguagcuggagccauacaagagcuagaguaguuggagaugagaucagaaaguuaacagaggcugaucaaugccucauugauuauuuucaggacuuuggcauuuacucagauugagaaugaagccauugcaggauuuuaaauagaggagugacaugaucuagcuuacucuuuaaaaggcuuccuaugguuccuguguugagaaugaacuguugaggguuagaguagaaagaggugaggguaaaagcaaagagaucuguuaggaagcuauuugagugaugcugguaagagaugauagugauagcuuacaccaaacucaugagaucagauucuggauguuuuauagcuucagugggauuugcuguuauuagguggaaaagaaaaugacuucaaggauuugggccugagcaaauggaagacuggaguugccaucuaacaaaaugggcaagacugcugaaauuuuggugaggauaucaggagcuuaguugggagauuccucuuaagccuuccagagauguuaggugggcaggaaggguucaagagagguaugcugacuaaagauagaaauuuggaaauuugcaguauauaaauggaauuuaaaccugugagaccagaauagaacaacuuggggaaugaguauauguggaaaaaaaugaccaagucuuagagcacucugcauuuagaagccugggagaugaagaugagugaccaggaaaacaguagaaaaaccagauuaguguuguauccuaaaaccaaguuaagaaaggguuuuuaucuaguaggaaaaguguuuauuugugucagaugcaauugauuggucaggugaauuaaggucugauaaccauuuguuuuagccaugugaagaacaaugauggcucgaaaaguuuugauuaaaugaugggcucuagagccuagaauggauuccagagagcauguagcaagaaauuugagacauugaguauaagcaacucuuugaaguagucuugaagaaggaaaaauaaaacaaugggagacgauggggucagauaauagaaugccugaaugcugauaagaaugagccaguggagagaauaauugaugaaguuaaagacagaagggagaauuguugggacauucuuauggaaugucuucuaguguacaaauggucuuagccagggaaauacauacagugucauugcugguuggcauaaggguccauuugagaugaugaauuuaaagggagacuagucagcagguuuuguguuuuuuuuucaccuaccauuuucagcucuaugugugcaggugaagagucgaauuuaaccaagauugugauuuaggguauuuuagcugggugagaaggaaaauaaaaacaccaagagcugagggacaguggaaauaugauagaaucaagagauaaugaaagguuugaagaauggaggaaucagaguuguuggauuguuguguaguagggggugaacuaaaaagauaagaauggugguuggagaauggaguauuugaaguugagguuauagaaggauugcaauuacugguaaugauaaggucuaggauguaaccagaaaaaaugaauggcugugguaagguagaagacaagcuguuugaggagagggguuaaaugagaggacaggagggucaucugugagcauauugaaaucgagaacuaugucaggaguuguaaaagagugugugaaaguuaacaggggcugaaaucuucaaagaaugaaagggagugaucugguggucacuacuaacuaaagcaguuagauaguugagaugcaaaacuuuuuagggaggagggagagauaauagucuaggacagcgucgaggagcaagaucucuuauccccauccaagccuaaugauauugaugggugugaaaaagacuugagaugucuacaaagggaagcagucuauuaaaaaaaauaaaauaaaaucaagauugauuaucacaguaagaaaaagacaacaugaucucuuucuaaauggauaaucuugguuucagauucauucauuacauauuggaauaaacuugaguauuaaggcaccuuuuggaauuuuuuacuuuaaucaccauucuaaggaaauuaauuucugaaccacuaagcccaauauugugaaagauuuuuaaguuaacuuugaucuuaaugcuguguaguugauuaaauuggaauaucaagacuuauaaaagcuuuaaaagugagcauaguauauacauauaguuauuuggucuccuuuuaauuucauugcuauuaugauuauuugccauuucugucagugucauuauagucagauguacacgacgugaaguaaugcuuaguuugggggaagagcuugugggauuucccccauccugcuuccccuuuuucaguuuuccuggcuauuaauaauucuuuuuccauuagagcuuuagauuugcuuugucuggguugguugggguuuuuuuuuuuuuuugagacugggucugacucucauccaggcuggagugcaguagugugaucucagcucacuguaaccuccaccuccuaggcucagguaauccucccaccucagccuccggaauagcugggaccgcaggcgcacaccaccacaugucugggguucuuuuguuuguuuuuucucaugagauugaauuaaauauauaaauucaggaaggguuuaaaucugugauauuaacuauucuuuauuauaaaaacugagauagcaugucauuuguucaggucauuuauaucauuugguguuguuuuaaaguuuucuuguguauauaucuuguugaguauauuccuagauauuuucuuuuugucgcuauuguaaaugacauuuuuuucuuuccuuauauaaaucuucugauuaaaguauauauguaaaauuugauuuucccaaccuuacuagauuauagauuauuuuacaauuuuuacauuugucaaaauuuauauuuuuuuuuugcagauaaucauuucaucuccauauaaugaucauuuauguuuuccugucuuucauguaugcaaauuaguucccuuaacuaauggcauuaaauuuguugauuuuucuuucauagaagagcuggauauucuuucgcccaguuauggcagacaaguuaacgagaauugcuauugucaaccaugacaaauguaaaccuaagaaaugucgacaggaaugcaaaaagaguuguccuguaguucgaauggguaagcuguucuguggaucauuuaaguauaaaagaaaaccaugaaagaaaucaacugguuugauaauucuuuacggacauuaacauaaacuuuguguucaccauuaguuucauaaaacugugaagacaagaaaaguaguuuguucuaaauuucuuuuauugcuuugugacugaaggaucauauuuuuuaaagaaagaccaaauuuuagaauaauacaucaauauuuaaaaguguauuggaugugaacucaaagcagaguucagcuuacugaucuugaaaucuacaaaaucuuauaauuacuuuaauauuauauauauaguaauuaauuacuauaaucaaugggggaaggguuacaguaaacuuugacaguauuuucauauuuaaaaaaugaacaaagagcuuaauaagaaugacuauucauaagguuuaacuauauuuugaagauuagauaaauuuccaacaauucaguugaaaaauuauugguagucguuaagggcuauguuaaguaauugugaauauacgaaugaggcauagaauuacugacucuuagaauuacugaaacuuagaaacuuuaguugucaucuguuauugucuccuuugcuauucagaaauuccauuaucccuacuaccauguuuaauuuuagcuguauguuagaugacugcauaccuuuuuggaguuuuacugaucuagcuacaauaguucauucguuuaaugcucugccuuaccauuuucaaggcauauuuuguuuuaugaauuuaaaauuuagguuaaucagcuuaaaaauauuucaggauaugucauacuuuuacuagcauauuuucuuccccaguaguaaauuaaguaaaauaaauauauauuaauuaaucaucucccugcugccaaacaaggauauucauauaagugauuagaaaucuguccccacaaagcacugauuuaagacauuaucucaaauguauuucuuuguguggccuuuguuuuugaaaaucugcuucuguauggaaauuuagaaccagcauugccuaaauaacaguguucggaaaauuagaagaucaaaggaaauggcuuaauuauaucuuuuccuuuaccaggaaaauuaugcauagagguuacaccccagagcaaaauagcauggauuuccgaaacucuuuguauugguugugguaucuguauuaagguaaguaauauuuuauuuacuggaucaaacguguaaccuaaaacugaaaucugaaaauucuggauacuaugcuauaacuacuuuaagugaggcaaaguauaaagcaaaugaauagagaauguaaauuuaggaaagugguauucuaauaucagugacauuguugcuuuuuuaaauaaauuaaaccacccuuuuuaaaaguuacucuugcuguacucaacuuuauaaagccauuuccaaccaaaauuucucuuuuuucaccuuuuuauaaggacauuaccaucacauuacauguuucuuucaagucuguauugaauuuuaaauucacaccuuuuaaauagaaaugcacacagccaaaaauuuuaaaauuuaacauaauucuucuacuguauuacacaugcuucuauugaauuuuucccaauaguauaauacuuaaaauagcucaauuauuaauaguuuuuguugccuugaauaguuugauuaggcuuuugacucaugaauggugaauuuccaacuuuaguucauaaaagaaauuuaggagcuaauguguaacauacuuaauuuagaucuuucuguuuguagauauuauaaaaaggcgcuucaccagaauucagauaccacacuauuguucaaauaaaucguguguauauuucacauugguuucugaauccuuguuuaaguauccggaaagauuucauggauaccugaaacauuuucacuugcuuugaaaauauaaacaggaagcauuccuuccagcaaauauuuacuaaucucuuacuagauaccugccuuuauccugggugcugggaaucugguuuugagcaauauaguaucuauucuguuuucucucuuugugcuguaagaaaauuauauuaauuuaaauuuuaaauuuuggauauacacuugaguggcuaaaaacauacuaaugaggugguccucuuugaggguggagaaguaauguauaauuccugaacacuaagauauuauaauguaccucauauaugaacaguggauauuuuuuuccuuguagaauugaguuuaaaucacuugcagcauauaagcauuguauguacauuuaagagaagaggauaauggagguaacuccacuauccuccacuguaauauagaaaaauauaauuuguaaaaacuuaauaguuuugguuagaggguggaaauuacuuuauuagaaaacaagaguaauuaucuguuuuuauaauguauaaaauggaaauucccuggaaucucuaaacacggaaacuuagaauugguccccuaagcucauugaacaugucugcugaacagaucucuaauaacaugagguuauaauuuuugcauguaccucuguaguugucuguacuuacgaaaaauuuuucuagccauauuaccauucuuaaaugaccuuccuguuuuugcuguucuuguuccuuggacagucaucuuauaguugaauguuauuugaauaagccuauguguuuuauuuuguuuuuuaaugugaauugacuccgagaauucaaguaucuuauucauauaagauagauaaaagucauaauggaaagacauuaauccccagucugugcaaauaugcuagcuauuggugggauggaaauagcccaaaaaaggauaagauccaugaccucaaacgacuuuacaagguagaacaggaaguauacaagggcaggaauaauugaaggaaacagagggagaacaucuguuuuggaaagaauauaaagccauauauucagugacuuuuuuguugacuugccucuuagccuccccucaucuaauauguuuuaacaaaaccaaacaaaaaaccucaaguucuacaagguuuuucaauaaguauuaagcacucuuuaaauguauaggauuauacccaacacuaaagggaauaucaaguuacaguugacccaugaaaucacagguucaaacugugcagaucuacauacacguguauuuuuucccccaaccaaaugccaauuggaaauagaguauuugcaggaugcaaaaccauuuuagaaagggcugacuuuuucuuuuacucaggugcuccagggcugacugcaggacuugaguaugugccaauuuuuugguguacucggcaguccuggaacaauuuuccccacauauacugagagacaauugauauaauucuaauguucaaggaaccuuuuauuuuaaguaaauaguagaaggaaaugaaacaacauuucacaucuuuaugaaaucauguuuagaagauugcuuauaaaaauauuuuuaauccauuuuaguuauguguauaugucuacaaauuaauacaaaaauuaauucuuuacuuuaaauaacagaaaugccccuuuggcgccuuaucaauugucaaucuaccaagcaacuuggaaaaagaaaccacacaucgauauugugccaaugccuucaaacuucacagguauauuuucacaucaggauuccucuucugucaaguuaagaguaaaauacauuugggauuuuaagagaagugcagaaauuggggggaaaugcuauuaaccagucacuaaaggaaaauacaauauuauaacaucaugcagaaucauacugcauaugucugugguucauucuggcuaacauuacaguuaccuaugggacuuuuuaaagcuacuaaugcccagguuucagcccaguuuaauuacaucauagggucuggaccuuaguauauugaaaaagucccaggugacucuaauauacaacugggacugagagucacuguuguuccuaguacccuuauccccaaaauaacuuuuaagggaacuugccuuugauuuuguuuauccauuaaucuuaugaucuacagagaauaucacuuugaauuuggacauguauuauuaaggcacaaauaaauccuuaguuugggauuuuuaucugcugaacacuaacacuuugaaucuaggagucuagauuuuuacuaauaaaaaaguauuucucaaccugccagcuuuaaggggccuacugcagcagggagaaggaaguggaauauuucugguugauguggcacuucucuccuuguaaguaaauggcaggccagaaaagaaagacauugugagguugcaccugcuguguaauuuuguaccaaagcauuuuguuauacauuaaaacugggccuuauauguaaagaagaaauuuacuuuaggauggacuuugaaaacugaauaaauaaaacuuguaguaauguuguuuaaggaugcauuucuaacaauuaacaguguaaguuaaucuuggcuguucuuuuuucuaauagccauuaaucuuggcuguuuuuuuccuaauagccaguaauaucuggcauauguuucuuagcuuauuaauggaugguugugaagugcaggugcauuaaaauauaucauucugauguuauguggcuuuuucuguguaaaucugaguuguuuuauuauuuuuguauacuuguaacagguugccuaucccucguccaggugaaguuuugggauuaguuggaacuaaugguauuggaaagucaacugcuuuaaaaauuuuagcaggaaaacaaaagccaaaccuuggaaaguacgauguauguauuaucaccuuguaaaaauuaauaucaugagucaguuuuaugagauuuuggggggaugauauguauauuuuuaaaauauucuuauuuucaaaauuauuuauggaauuaaugcugagaaauuuauaaacaaagcucuuuuguacuuuugaacuaaaaaucuguuaauguuacuuaacugaaaauucugaguuguuaagccuugaucugaagcagaauucugcuugauucugcuguauuacacacguuucuauuuaauuugucccaauaauguaaaaauagcucaauuaguuuuuguugcagucaauaguuugauuaggcuuuugacucaugaaugguaaauuuccaacuuuaguacauaaagaaauuuaggagccacuguguaauguucuuaaguuagauauuuuuauuuguagauauuauaaaauggagcuucaccagagugugaaugccgcccuauuaauuguucaaauaaaucauaaguguauuuugcuuuucauuucugaauccuugauuaaguauccagaaagauaucuuggauaccugaaaacauuuucacuuguuuugaaaauaugagcaggaaacauuccuuccagcuuaaccucuuauuagaugcccuucuauguccuaggugcuaggaaucugcuuuugaauaacauaauaucuguucuguuuucuuucuuugcugcuauagggaaaugagacuuuuauuaauuauguucgccuccaaccuuaaguuaaaagccacaaguguucuauuugcauauauaaucuauuuccuguagcauucauccucuuugucauuguauuauuaaauucacaugauucuguauuuuuuuuuuuuuuuuaggauccuccugacuggcaggagauuuugacuuauuuccguggaucugaauuacaaaauuacuuuacaaagauucuagaagaugaccuaaaagccaucaucaaaccucaauauguagaccagauuccuaaggcugcaaaggucgguuuuugauagagggaacuuaacggauauuaguagaaguauaaaagauauaucaaaauaaacuuguuuuacuuugugauucuuuuuaauauugaaagaaaauaguaacuguuuuugguauauuguggcaggggacagugggaucuauuuuggaccgaaaagaugaaacaaagacacaggcaauuguaugucagcagcuugguaaguguuuauuuuuuguuugugugaauauauauuuauuuauuuuuugagacggaguuucgcucuuguugcccaggcuggggugcaaugaugcaaccucugcuuaccacaaccucugccucccggguucaagcgauacuccugccucagccucccaaguagcugggauuacaggcaugugccaccacgcccagcuaauuuuuuguauuuuuaguagagaccggguuucuccaugucagucaggcuggucucgaacucccaccugccucagccucccaaagugcuaggauuacaggcgugagccacugcgcccggccauuuuguguauauauuucaauaggcccugaacuuaagugaugaaaguacacaucuuuauguggauuacugaaaaucuccaguaauuguuauauuuaaacaauuuucaacugaaauagcauucaaacuucaaaugaugacaugcaguauacuuuuuaccuggaagaggugaaauacauugagcacaaugccucuauguucuuuguagauuuaacccaccuaaaagaacgaaauguugaagaucuuucaggaggagaguugcagagauuugcuugugcugucguuugcauacagaaagcugauauguagguuacuuuacaauuuuuguuuaucuucauccguauuguagaguuuucaguugugaugcugcuaauagaggaaugguuuugagagaaauuaauagaaauaguaucuaaguuccuaauuucgagguaagauguugaagcaguuguguauccacuacucauuuucccuguuauauucacaggggaaaauauuuauuuauuuagauaguuuauaacugauaggugccggaacuuuuuauauaaagucaguuauucauuaucuaagcucucuuuuuuugagacggagucucgcuguguugcccaggcuggagugcaguggcgcaaucuuggcucacuacaagcuccaccucccggguucacgccauucuccugccucagccuccugaguagcugggacuacagacgcccgccaccacacccagcuaauuuuuuuuuguauuuuuaguagagacgggguuucaccauguuagccagguuggucuugaucuccugaccucaaugauccacccaccucggccucccaaagugcugggauuacaggcgugagccaccacgccuggccuaagcccuguuuuuaugugaaaagacuuaagcucuccagccaggcuagcaagcuuuuuaauaucugaagcaagacgcgaggucuuuuaaaucacuguagaucacuguggcaugccaugugaaagagaggagaggaaaguuuccuuccuuuauuuagugucucuccucccagacauuuauugcugcuuuuuccacauuucugcccuguuguccggugaaggcuaacucuucuccacaaaguauucuauaaauucuugaaauacccuccaaaaaacuaugcuuaaaugcagcugacuuaagagaaaagcucuccaaacuacuugagacuauaucagaauacuuuuuaugaggagugaccaauuuguaaauuagccuaaccugguagacccucaccagaccugguguguaaucuugcuuucuguaauuuuuuccuucuacuucugaacagaauacagaaauuuuuaccauuacaaguagacucuucauuacuauuggagauuuguguugugguuaacucaaaagcucuugauacuacagugcuuuaaaauaguauguaagguagaaugucuugucuuucaaacuuauauuugcuuuuuuuuuuuuuuuuucauaguuucauguuugaugagccuucuaguuaccuagaugucaagcagcguuuaaaggcugcuauuacuauacgaucucuaauaaauccagauagguaaguagagaucuggcauauuacuguguuguuuuguuuggagauuuuuacagauuucuaaggauuaaacacugggacugucaaugugauguacauauuuuuuaucuugguuguuuauagcugccaccuaaauuuaccuuucuuuaccuagaacagagguucucaaugcaagauucauuuauuaacacccccgcuuccagggagcuuaggaauauucugaaauuauaugcaaauuccguagcuuuauaggaagcagacccuuagcuuuuaccagcuaucuuuuucucucucucugucucucauuuucacacacacaacacacgcacgcacacgcuuagaauuuguaagaaucacuagaguaauucugguuuuucagaaucuugcuggacaaaagaaaagaaaauuaucauaacuucuguuaguauucaaaauacgcuguguuuauagggugcuuuugugguuuguagaguuuucagauucauuaugucauuugauccucaugguuaucuuguaggaaucuuuagaugguauuccuauuuugcagaugaagcacaaggucaaaaaucuaguuguuuguucuagguuacaaauuuacuguaugacaaagcugugaccagaccccagggguuuuuuucuguauaguauuuucuguguuauacugccucuucugacuuaacaauuuaaugaacauccuuuuaaauacauggcucaucuugcaagaaagcaagagaaaucccaaauggucaaaaacuaaagcauuagaacuauagaggaguaauaggaccagauguugaugguuucuguaauaggucuuggguuuuaacauccacucaugggcaagaagcaaggucuaguauuggauuuucacacauaaagugccaggacucucaaaggacugcuuucucacugaaagggcgaauuagaaacaacuugucuaucauugcacggaaaugucaagaaagcaaauaucuaucauucacugagcucccuggaagugaagggauugcucuguuucaaaucucuauucaugggccagcagcucgccuggcuauggaauugaaauuuauauaaccaguggaaucugugaacccuucaaagugagaaaguaauauguuuaaggggucuggaacuuuuaugguacauagcagaagcaacgaaccaauaugcuuucaacccugguugcacaggauuccuauagguaauggcucaugaggacgagcucaaauuguaaauuauaaaauuuauaaauuagaggaggaaacgguccgcaaauuagccagcacauauuauauggcagcaggauucaagaacuuuaggugacauucuaagggcggcuauuaaauaaucuucaaaauaaaaucuuuaaauaaaaggauucaaaacccuaaggauauaaugcuacuaaaaaagcaauagguagauguucagaaacccagacaaaucuagaaauuaaaagcauggugacauuacagauucacuggacauguuagauggguuagggacagcagaaaagugcauuagaaaccagaucuuaggaaguuacuagaauacagcagagagagaauaaaauuaaaauguggaaagaagguucagaaaccuggagaauguaaugaggaaacuauuuacauauaucuuaauagucugaaaaauaaagugaugaaaggauuaugacugagaacuguucagaauugaugaaaaauucagcuccuuagauucaaggagcacaaguucuacagauacuaacuaauucauguagauacuuugaagugaaacuuagaauaucagugauaaagagacaaucucaugugagccaaauagaagccauaauuuuuacuccauacacaggcauuaagagccugggcauuaugauaggcucuuuggggaaggcaaguguaaaaauacagucccaguauucaaggacuucacaaugugguaaagaaaaauacacacugugguaaagaaaagcauacacauguaccagagucuugaaaggaauacacaaagucaggucacuaguucucaacucaagucacuuuuuauaaaaaguauuuuuauagucccuuuuuauacuaaaaugaaagucauagauaauaucuacguucauauaaaacuuuaaagauaucaaaucauguccuaacaauaagaggaaaacuaaaagaaaauacuaguuuacagccaguauuucaauguguaacuguuuagacacaucacuagaaaacaaggcaucagguacuuauauugacuuauaacgaauaaauuuaaaauuaaaagaucaguaacuauuuuguauaguugcaauaggaaagugaaauaaauaaguguagauggaccucggggaaaaaaaaacuaguuaaggaaaaguaauacuacccaagacuuuccuauauuauaagagagaggacaguaacuuuaauuguaauagggauaacaugguaagacagauuggcaugacaacguagagaaaauuuuuaagacauuucacaagugggcuggucuuauuuacagguauaaaguuaagaucucuauguagugauagauugaugauaaagagucauaaaaaguauaucuccauucugaaauuugaugggucaaggcauacauucagucuuuaaugccauaaaaagauuuuggagaucauauccuuggauaaugaaaaauagaggaugcauuggacaaaagaauagagauuuaagaaguuuuauagaguuugaccucagaacauuaucaguaacauugaagacuaagagauagccccaaauuaacuguaggguauacauuuuuuacaaccuagauuccuuacuaugcuccagauuuuuauuucuucccaacuucucagaaaacagaauggcugaccuaaaucauguuuauauuuuggacuucugucuccauaaccuccauuugaagguugggguugggggcaggaaguuugaccuauuuuuuucuucuuuucaaagcaaaguaaaagcuacuacguaauacaaugcucccucacacuggcuguuuaaggaaacauaggauuuuaagaguagagaaguauuccauguaauggauuagugccaacaaagacaccgaugcaagaugaguaucaccagcucaccugggugauuugccauuuuuauugauaauuaccaccauugugguagaaaacauuuccuuuuaauuuucccuuuucaucuuagaccugcucuuauuuuccaauuuuccauuguuacuuuuuuuuucuugccagauuacuccugaaauguuuucucauuucauucccuuacucuagaauugugcuguagccucuagacaaacauccuuauuuaaauuuuaauugaaauuaaaauuuuauuucaucaaacuagcaacauucaacuuauggcuaguagucacuauaugggacaacauagagauagaacauuuucauaauuguagaaaguucuggacagugcuauuucagaaccuacuacuaucuuccucauuuccaauuaguucauacucuucauuuugucauucaacaacuuuuuuaggugucuguuaguacacaguguaagacuaaagaucacagaggugcuaaaauguauuaagagucucccuuaagauguuuaugagcaaguuaugggguaaucaaaaauaauaaaaguccaaguaucaguccaaauacuuguuaccaguauucaagagugagggggaaagcucauuugcauauuaggaaaaguauucccauagcaaguuggauuugagauggaccuuaaaggguuaggugggauuucagcagguaaagaucuaggcaggagacuacuuagaaaaagaauagcuuccuagacaccagagaaguagagaagugguuuauuuaagaaaaaagaugcauucuucaguguuuccuguguaugagcuaauagaaagauaguaacuaaaguuuuagaaaguguugaaagucuaagucuaauuaauuuaagugauuaauuucauuuggaauugagacccacaucaggggaccuaaagaaaaugagauaugaaagaaauacgagggccugaacuagaauuuaggcaaagaagaaaaagggugagauugaaacacaagacauuguugagaaggaauucacagacuuuaacaguuuaaacaaaauaucagugggaauaaaaugucauuuuugagggaaugauaauuucguuaauacaaauauggagaauuuuuauuuguguaggaagcugauacauuaauuugacauaugagauguuugcaggacauuuuuuuaacauguugaaugguguucgauauggaaaugggaauaaagugcuacauaaaaccuucaugacuauuacuugcgucuaaaacuucuauuccagccaauacuguaucacuucauucaaauauagccacuuaagcuucacaucauaucccauucucauucauaaagugcuccaguacccacuaaccuauuuucuuucugauguucacugauuuuauuaucuguggagcauauuuugccauguaaucuuuuuuuguuaccauuucauaccuauuccuugucuuccccagcuaaauggaaacgucucagguuaaggauucuguccuaucuuuguguaugcguccauccccuacuacagcuagcaugggacaggacagguacagggcuuaauacauaaauugaguagcauaauaaacaguuuaggcuacaucugaauuaaaucuauuauaauuacuuuguaacacuuauuucgaaauauguuucuuauuagcagaaugcauuuaauucauauaucaauaaacuuuuaaauuggcugauuuuuuccuuuuaguucaggaaaacauuuuuaaauaugagcauugauaaugagccuuacuaaaaauguuuuauggcuuuugcuucuuaugucuuuaugcuuaaauuuuauuagauguaucucuuuuucugaaauuuccaacuauuaaaaauaguuauguaagaguuuuaacuaaaaucugguuugauuuucagauauaucauugugguggaacaugaucuaaguguauuagacuaucucuccgacuucaucugcuguuuauaugguguaccaagcgccuauggaguugucacuaugccuuuuaguguaagagaagguaacuugaaaaacuuuuuucacauaugcuguauucucuucuacucuaaugcuuauaaacuacauuauugauauuaaguaguuuuacauuggucugauaucauccaaaacucuaguuccuuggaauuuaaucacugagcauauaagguuauauauaucaguuguuauacaaaauauauuuuuuucauuuuggagaauuuucuccuggggauggguagaaaugcaauguuacuuuuguuggggguugggaggcuacaguaaaaguccucugcauuuuggcuucugcaguauuacuguaguauuugucauuuucaaauuaacuuugacaggccaauaccaguaaugaaacucuuaaaaugcuuucaguguucaucuuguuuucauguuuuaaauuuaucuguaauauguauacuauguuuuuggaacuaaggcuaucuaaaaaccuaauaagauaguuuaguaaguguauuaaaauuuucauuuagucuuuguacuuccaagaaaaugagauucccuggccucucccuuccaugucuccuccuuaccuguguaauuuaagcaaaaauagaaacuagcguaccacuaaguggcuccuuaaaaaaaaguaccaauguacucucugccuucaauaccuuuuuccuuuuuuucuucccauuuuccuuucacugcuuccuuacuugugucuuauuuuuauuuuucucuccaccugucuuaaacugacaauucagaacacuaaaagggcuguuuacucaggaaaaaaauaccaucuccuagaaguagaaaaauucauguagccuguaguucccuaagaggugacagguuuuuugguuucuuucuuucuuuuuuuuuuuuuuaaucuuggaggaaucuuuuuuauaccuaaaagcucuuuuggaaaaauaaauuuauauugcauuauaauccuuuucauaaaaagauauugggaguuuuuauaauuuauaaaaaguacauaaauauuaagauguggggaagaaaugguuguaacuuaccuacuuauacauuugagauagaugcauacuuuaaagaaaaauuugcaguuaccuaguuuucuugccaguagucuuaagggaugacaucagaacaaauuuauuaauguuuuauucuugucaauuaacaaauauguauugaguaccuuacucuauaccauaugguagucuuugaaucaaguugauaauaauauggguacucggcagucauucuucacaacuccaguuauaaaugucaugucuaaaggcugugccauucaguaaaugguacccaguaagguuuuuaaugugcucgaucuauuaaaacagcuuaagaaacuuuaguuuuucucuguuccuuuaauauauugaaaucagugcagcauacuuaaaagcuuucuauaaacuguaaaggugauuaugguuugaacucauuuuuaaauugacaagacaaacauugaaguaggacuguaaagacugacuugcuguguuuuuuuuaaacgaagucacuuaguucuuugagccuuuauuuuccaaaauaaguuagguauuugaaccaaguggcugcuaagguuccuuugaguuuauguuuuuauguaauuguuuuuauuuaauuuuuuaacuucacauuuauagguuuuagauaguuuaagaucaaaaaacaugcugauuuuggcaaaauaaauguaaucuguucauuuguucugucagcaaagauguauugaacaccuguguucuaggaugaggauacaggcugcaugaugugucucucaguuccaaauaaaaugaauaacgucaagaccuuccaagaaacuucagcuuucucuucacuuaaauauaggaaacacugaaauauggauuauucauuguuucucaaauacgcuuuucauuucagugugucugccauuguagaucuuaaaauuuuauuacagaggguucuuguauacaauguggauuuaaguuauuaaaaucuguuuagauaaugguuguuaucuuuguacagugaagccauuaaaaaaauguuaacuggaauuagcucauauucaauuucauaugaaccugcaggauuaauuuuuuuaaagcaauaaauuauaaccucaaaauaugugcuuaugucucauaugaaauuaaauauugauaacauuguauauuaaaaaauuuaucccccaaacuuuuauaucaauauuacaucaaucugaaaauacucuuacauauuugucauuuucgcuuuaaagauaaagcaaaaaggacaucaugugcucucuuuugcauaaaaccugauggaaaaaguaauuacaggauaaugagaagauguacuucaugugguugggggggacaugcauauauauucaugaauuauuuaaacuuacauuaaauauauauaguuuuuuaaguuacuucuuuauaugcagaccaacauguuagcaaaaauccacagaaauuuaaaguauauagucuauagauugcucccaagagagcuuaggauuuuggcucuaaugauuucucccgguugacaauuuucuucccaacaggcauaaacauuuuuuuggauggcuauguuccaacagaaaacuugagauucagagaugcaucacuuguuuuuaaaguggcugagacagcaaaugaagaagaaguuaaaaagauguguauguauaaauauccaggaaugaagaaaaaaaugggagaauuugagcuagcaauuguagcuggagaguuuacagauucugaaauuauggugaugcugggggaaaaugguaaguuuucuguuuugugauaaguaaaaaucuuccuguuuaucuaguaaauuaguuuuaacuguuuuguggaaaaauuugaaucauauguuauagggcuagaagcagaguuuuauuuaaacccacaaauuucuuaguguacuuucacauuuuuuuggcauuguguaauucaauuucacuguaauucaaucagguuaauaguucuuauuuuguuuuauaaccucuagugaaaauaagguguucuuugucagcugguuuuuuacauguaaauugauaaggcaguuauuaaucuuauaaauugacuaagauggaaaggauaaauggugauucagaaauaauccagcuuuaaaaauuuuuuccucauacacuucaauguggaacuuuucuuauuuuaaauucagagcaaucuaccuuuguaaauaauuguauuaccagcauauauuucauaauaaauugucauaaguguagauauaagaugaauuugacuacuaaauaugugauauugccuucaugauuuaagaacuauuugaauuguaaucuuacagcuuacaaaacuauagaagauaaauuuuauauaaagauuguuacaauguaucagucuuuagauaaugggaauuuugaauuggguugcaauuaauuuaaauauuuuauauaaguaaacuuuaaaauuacaguuaucuuucauaaaacagucuauacugucuuaauaaauugugugcccugauaauuuagcuaaguagaucuuuucaaacuauugcaggauuuaaacuuuauagacauaccauuuauuaaaauugucauaagcuuugacuagucuuuauuccucuuaauuaccuuagaaugacacuucagaggugagccaugaaagacuuaaguauuuuucuauauaaacuucagaauucaauaaugucaguguauaucuuuaaaacaaauuucucaguuaaaaccaaauaggacauagugauuuacuuuaaacgucaagcaucuuucagaucaaacugucauauguuguguugccaggaacggguaaaacgacauuuaucagaaugcuugcuggaagacuuaaaccugaugaaggagguacauuuguaacuguugagucuuuuuacucuguuuuacacaguaaacuuuaaagaucugggcaguuuuuagugucuuauguauuucauuauuuugcaggagaaguaccaguucuaaaugucaguuauaagccacagaaaauuagucccaaaucaacugugaguuauuauuuuuuauaugguuacuaaagaaaauuuuguauauaugccuauagcuuucaucuuuuacuauauuaaaauuuuucuccaaauuagauucuauacaguuuuauugauaguugcaaacaaauguauuaagaguccaauccuugauucauauccacugcuaagaaagugcuuuaaagauauuugucaucuuuggccgggugcaguagcucacgccuguaaugccaacacuucgggaggccuaggccagcagaucacgaggucaggagaucgagaccauccuggcuaacauggugaaacccugucucuacuaaaacuacaaaaaacuagccgagcgugguggcagcgccuguagucccagcuacucaggaggcugaggcaggagaauggcgugaaccugggaggcagagcuugcagugaguggagauugcaucacuacacucuagccugggcgacaaagcgagagucugucucaaaaaaaaauaaaaaaauaaagauguuugucaucuuuuugcuaaauaaauaauuaaaaaccuaauguauuuugugcugcaaauugacaacagcaagaaggugaaaaggcuuuacccacaagaugggagaaacauuugcacaucauauauccaauaaaggacuuguauccagcauguauaaagaacucuuauaauuaaaaaugagcaaaugucuuuuaguuauucagccauaaaaagaaaugaaauauuaacaaaugccacaguccuugaaaccauucuguuaaaguuaaccuccuuugauuucugcggguguuguaaugaacuccucaguaccucaacauucaauuuauguuuugucuacuuggcuuagcuuaccauaaaaguuuugucauugaugcucucuauaagcuuagcuuuaaauucuaaaauucagccuuauccugaaacagcaaggaaaagccaucuuaggauucaucccuagcacauuaucaugcauuuuguguucucuuacugauugccuaagguugcuugauacccacuuugaccuuuggaauuucuacucuuaaaugauuuuuccucugaaacauucauuauuugcuuauuacuuucuaauuuuaaaauuauugcaggggcuguggaguggaaaaaaaaaaaagauuguugcaggcugggcaugguagcucacgcauguaaucccagcacuuugggaggcugaggcaggagggucacuugaacccaagaguuuaagaccagccugaccaacagauuccgccuccacaaaaacuuaaaaauugguucagcaugguggugcaugccuguaguuccagcuccucuagaggcugaagugggaggaucgcuugagcuugggagguugaugcugcagugagcccugaucaugccauugcacaccugggcaauggagcaagacccugucucaaaagaaaaaaaaaaauuccuuuuuacuuguuggacaugauggguuuugaauagaaaaucucaaaacaugucauagaugguggauacacauugauaucuguugguggcaaauugauauacuuuuauucugaagcuuaacuuugucaagauucauaaauagaagaguucuauagugaaaguuuaucauuuaaauacuuuuuuauauuaaaaacagggaaguguucgccaguuacuacaugaaaagauaagagaugcuuauacucacccacaauuugugaccgauguaaugaagccucugcaaauugaaaacaucauugaucaagagguacuuuaacauaauuuuuuuuauuuuuuuauuauuuugaauuuuggaugccuuuacaugguuugcuaaacuccuccaauuaggugcagacauuaucugguggugaacuacagcgaguagcuuuagcccuuugcuugggcaaaccugcugaugucuauuuaauugaugaaccaucugcauauuuggauucugagcaaagacugauggcagcucgaguugucaaacgguaaauaucuugcuccuagccauauuuugauuauguauacuguccuacaagugugcuuaauauaacagucgaauguuuuaugauagaaagcuauaagauuucaaaaucauuguguuuuaguuucauacuccaugcaaaaaagacagccuuuguuguggaacaugacuucaucauggccaccuaucuagcggaucgcgucaucguuuuugaugguguuccaucuaagaacacaguugcaaacagguaaaauuacuuuuuaauauguucaaaguaauucauuuuaaauuuuccaguaaauaguaaagucacucacuuuaauuuuuaaaaaaugaaagcuagaaauucuagacuugauucugugacuccugagaucauugguauuggggacuggaugggaccauguggaagaguaguguuuaggcuucaguguggaaucccucaccaggaagauaaaaagcuguaggccacagcauaaaaagcugugggccccucaccuuuucucagcuuaacuuuuguuugcuuuauuauuugaauuucccaaaaaagauugaaaacuauugcuuucauacaugauagaaaaagaaaacaagauuaaagagguuacaugauuuguccaacuuaugcugacagugauugagcucacaguggaucccaaauaucugguauuaaucuauagcagaguuaaaauaaaugguuuuacuuuuuucguuuuuucuucucauuuuuccuuguuagccugauuaagagcacuugcaauauagagaagccuaacauucagaucaaguuaugagaaauucauuuuaccuuuagugcuaaagccuauauuauuagauugaacuaaaugaaauuacugguguucaguuuucaccuauaaaaccagcaguuucaugugguuucagcauguuuucugguauuggagagcaaggaauggaguugccauuuuaauaauucaucuaagaaauaaaaguauuuugcugggcuucuucccugaauuccuuuuuuuuuuuuauaaauugagaauuacauauuucuuaaagagcuagggaaauuucuuagcauaugugauguuuauuuguucaucuagugauaucccaccuuucuauuuacaaaauuuuaaaauguuucacauguauguugugauuuggcaugauuuaagaacucacuuggguaaaaacgauuaagcauagaaauuuagaaaggaauugucacugaaaaccacuauuaggaggacauauucccuccaguaacaaauuuuucauauaaauauaacuuuuuaagauucucauccccccuaaaaaugugcaauuggagauucuguaaucuacuuauuaauuaucuucuguuuuucuaaaguaguacuucuaucuuaaauguuucuuucaccagauuagaaauccagguuaaauuuuuuuuuuguuuugcacaaaaauauuacagccaagaaaacuauauaguccaagcaaagcuauuucugaacacaggauuuguaauaugcuguuauuauacuguuauccagaugauuuaugauuggggaauuugagguaauaguaauucuuaauacccuuccucucaaaagguaguuacauuucugaaguaaaauuuaaucaaaauugauuuuuuuuuuucucuuaguccucaaacccuuuuggcuggcaugaauaaauuuuugucucagcuugaaauuacauucagaagagauccaaacaacuauaggccacgaauaaacaaacuuaauucaauuaagguauguagaaaaguugucuuaaaucauggauuacugaucucaguauaaacacuugaaaggcuauuuaaaaaucaauaacauauggcugggcacaguggcucacaccugugauucaagcacuuuugggaggccaaggcaggcagaucacuugaggucacgaguuugagaccagccuggccaacauggugcaaccccaucucuacuaaaaaugcaaaaauuagccgagucugguggcagguaucuguaaucccagcuacuuaggagucugaggcaggagaaucacuugaaccuggaagguggagguuguagugagcugagaucaucccacuguacuccagccugggcaaaagagugagacucugucuaaaaaaauaaaaauaaauuaaaaaacaaccauauuuuauuuuaaaauuccuauguuuuuuacauuuuaagaccugauggcauacuuuagugugcgguaggcagcaauuguaauguagcugucauugcugugugaacucaagagcucuuccuguuuucucuuuaaguuguaucacaguuguacuaccuauauugauuaccacuuaaaaugucuggggaaagauuacacuaauucaccauuguaacaaagaauuuuuuaagaauaccuuaaccaauuucuguuauauuuuucaauacaugauuaaaagguguauuuuaggccaagcgcagugguuuaugccuguaaucccagaacuuugggaagccaaggagaucgagaccauccugucuaacggugaaaacccaucucuacuaaaaauacaaaaaauuagccaggcgugguggcaugcgccuguaaucccagcuacucgggaggcugaggcaggagaaucacuucaacccaggagguggagguugcagugagcugagaucguuccacuguacuccagccugggcaacagagcgagucucugucccugcccccgcccccgcaacccccgcaaaaaaaguauauuuugaaagucuaaacaagcuccugugaugaggaaaacauugugucuacuuaauugacaauguuuuuugucuuuguaguucacaguugugcacccuacaguugauuuccucugugaaauacaguauuuguuucuuaaaaggcaaaaaucuuagucacucagaaacagaaaguaaaugaacucuaaaagcauuucuggguuguuuuuuugguuuugguuuuaguuguuuguuuuuuugaggcagagucucacucucucaccuaggcuggagugcaguggcgugaucucggcucacuacaaccucugccucccgaguucaagcaauucucugccucagccucccgaguagcugggauuacaggugcccaccaccacacccgacuaauuuucuguauuuuuuugauagagaugggguuucaccaucuugcccgugcuagucuugaacuccugaccuaguguuccaccugccuuggccucccaaagugcugggauuacaggcgugagccaccaugcuggccaucauuucuguuuuuaauaucugcagugccucaaaguguuuacauuuuaucacucuguauccaucauccuuaaugcuuaaaagcuuuagaaguauguuauacauacuucugcuguagcauuuauuuucauauuuguaguccuagcuuugcugcuaaaccaugagcucuuggaaugccagaggcaaaguuaucuugcacgucauuguauucuuaagcaccuaacaguaugucuggaugccuuuuuucugauugauauuacuucuuggccaggauagagaaaugguuaaguucucacauaaaauugaagaguuuucucaguuuugaaaagcauauuggguagaaaagaagaauuucuuuggaagcauuaaggacacuuuguauugucauuuucuuagacagacuuaugguucagucaccaugaguuaucauuucuguaugccuacucaucuuaagauugucauaccuuaauccuaauaagagaacagcucaacaaguagguaggugagauuguuacuggccaguauuggaaaaaacuuuauauauauauauuuuguguaguaggcagaucucaaacugacaguaugcugcauuuugaaucuggagauaaaaguugcauugaugaaaauggaauuuaauaguuuuccuagaaauaauaacacauagcaaaauuuuauauaugugaggcaucuuauauaaagggacuuuacuugaguuggugcaagugagucauucuagcauuagggauggggcagagguaguuaucuuuccuuugagcaguggacccaggaauauccagaaacagaugguaugugcagaacagguuguacaggcacuguuuuaagcacagcuaaguaauaccaugagugaaagucuacuuuuaccuauaguagaaucguguugcugauuuuuguggcuucuguuuucuuuuuuaggauguagaacaaaagaagaguggaaacuacuuuuucuuggaugauuagacugacucugagaauauugauaagccauuuauuaaaaggaguauuuacuagaauuuuuugucauauaaaacuugaaucaggauuuuaugccccacauacucuggaacuugaaguauaauauacuuaauauaacauaaaaagccaguuggguucuaaauuguaguugaaacacagaaaaugccacuuuucuguuccugaagaggcucuuuugugcauaauauucuaaaaugaagacauuucaagcuauacaaauuacuuccaaguuuucaugauguaugggaagauuuucaguagguguauuauauucacgguaccaaaugcugaccaguguugcuccauuuuuuaaaucuugaaaaggguuucuguacuuaccugguuugccaaguaugccaguguaaugaaacugcccuuauuuuaaaagccagucaaagauuccacugauugacauuugauaaauaaacaucaggauuauguuuauuguuuguuuucagucuuugcacuauauuaccaguauaugguuuccgaggaagauuaucuacugcaaaacaccacuguuggaaaaauagguauuuuuaaauuguuuuuaaucuuuuuuggugcuuuuaaacauguuuagcaaaaaccaauucaguuccauuccccgcaaaaaaccccuaacuuuacucugaacuuuuuuuguuuuugcauuccaugagguucuguauucagucauucucuagguaaugucauuuuuguacacauauauuuauauaaucacugauugagauuuaggaaaaagcauuucuaaagaauauuugcuucccuuagaacuacagacucgaaaucuuuaaagauggugccuaagcaucuauguauuuuuuuuaaguuccacagauuuuucuguugggcagccaaggauuauaaaccacuucccuaaaggcaacauuaaugcaaaaguccccagauggcaauacaaaguauccccugguaccacauauauucauuugugaguuuggauauagagcacauuaucuaaaccauuuuguaguuccaaaaacccaucuaaauuucuugaguuccugaauuuugaacaggauuaccuggagccuggagccacuuuaaguuguacuucugacuaaacuggaauuaugagugaggaagaguguuuacuaaauaaaugacuggggcaagcaaaauugaggaggaaauuagaaacuguuugacaaacuuuaagagcuacuugaaauaacagaagucuugauuaauaugcaaauaauggcuagaaaguaugguuuaacuggacccuauuaugccuuuuaaaaauaauuucaguaacccauaaauacauguuguaaaaaauucaaauauacagaauggaauaaaaaaaugaucucccuuuauuacccucccaaagguuaccagcguuugaauuuaauaauguauauucuuucaugcuuuuuucugugcacuuaccuaagugugaauauguaaaggguuuguuuuguauacaaaugggauuauacuaaaauaaguaaugccuauuuuuaaggauagguuaaauuugugaaugaucauuucaaauauauugaauaaaauaagcaaaagcuauuguuauuuacugauccuggauugucuuaaagaaaguacuugugauauaagagcacaguucuacuuacugcuaaugacagaauauguauuaaacguauuuucauguaaaugaaaucuuuaaaauauguaucuu
